United States Patent 9,220,755 (MODIFIED POLYNUCLEOTIDES FOR THE PRODUCTION OF PROTEINS ASSOCIATED WITH BLOOD AND LYMPHATIC DISORDERS) - sequence listing, part 63

SEQ ID NO: 120771 - DNA, 3486 bp, Artificial Sequence
  Description of Artificial Sequence: Synthetic coding sequence
atgactttcggtactgtgctcctgctgagcgtcctagctagctaccacggctttaatctggatgttgaggaaccgacaatttttcaggaggacgcaggaggtttcggccagagcgtggtccagtttggggggtccaggcttgtggtaggtgcccccttagaagtcgtggctgccaaccagactggaagactctatgactgcgcggccgctaccggcatgtgccagccgataccactgcacatcagacctgaggcagtcaacatgtctctgggtctcacacttgctgcctcaacaaacggatctcgacttcttgcctgtggtcctactctccaccgagtatgcggagagaatagttattctaagggcagttgccttctgttaggaagtcgctgggagattattcagaccgtcccagacgccactcctgagtgtccacaccaggagatggatatcgttttcctcatcgacggctctggcagtatcgatcagaacgactttaaccaaatgaagggatttgttcaggcagtgatgggtcagtttgagggaactgatactctgtttgcgctgatgcagtactcaaacctgctcaagattcactttactttcacgcagttccggacctccccaagtcagcagagtcttgtcgacccaattgtccagctgaagggcctgacctttaccgcaaccgggattttgaccgtggtcacccaactctttcaccacaaaaatggggcacgcaagagtgctaagaagattctgatcgtgattacggacggccagaaatataaagaccccctcgagtactctgatgtgatcccccaagccgaaaaggccggcattataaggtatgctatcggggtgggtcacgcatttcagggacccactgcccgccaagagcttaatacgatctcaagtgcacccccgcaggatcacgtttttaaagtggacaactttgccgccctcggatccatacagaaacagctccaggagaagatttacgctgtggaaggtacacagagtagggcatcatccagcttccagcacgagatgtcgcaggagggattcagcacagccctgaccatggacggcctctttctgggggcagtcgggtcatttagctggtctggcggggcgtttctgtatcccccaaatatgagccccacctttatcaatatgagtcaggagaatgtcgatatgagagacagctatcttgggtacagcactgagttggctctctggaaaggcgtccagaacctggtgctgggggccccacgttaccagcacactggtaaagccgtgatctttacacaggtatccagacaatggagaaaaaaagcagaagtcactgggacccaaattggcagttattttggcgcatccttatgctcggtggacgtagacagtgatggttccacagaccttatactgattggcgctcctcattactacgagcaaacccgtggtggtcaggtgtcagtgtgtcctttgccgaggggacgcgtgcagtggcagtgcgacgccgtgctgaggggcgaacagggccatccatggggtagatttggggccgcccttactgtcctgggggatgttaacgaagataagctgatagacgtggccatcggcgccccgggagagcaagaaaacaggggagccgtttatctcttccacggcgccagtgagagtggaattagcccttcccatagccagaggatcgcctcgtcgcagctatccccccgactacaatattttggccaggctctgtccggaggacaggacctgacacaggatggtctcatggacctggctgtgggagccaggggccaggtgttactactgcgatcactgcccgtgctcaaggtcggcgtggccatgcgcttctccccggtcgaggtcgccaaggccgtctaccggtgttgggaagagaagccatcagccttagaagctggggatgctactgtctgcttaacgatccagaaatcctcactagaccagctgggagatatccagagttccgtgaggtttgatttggcccttgatcccgggcgacttacttcccgcgccattttcaatgaaacaaaaaaccctaccctcactcgcagaaagaccctgggattaggcatccactgcgaaactctgaaacttctcctcccagactgcgtcgaggacgttgtcagtcctatcatacttcatcttaacttcagtcttgtcagggagcccattcccagcccccaaaatctgaggcctgttttggctgttgggagtcaggaccttttcactgcttcgctgccttttgagaaaaattgcggccaggatgggctttgcgagggcgacctcggcgtgaccctgtctttctctggtctgcagaccctgacggtaggaagctctctggaactgaacgtgatcgtgacagtttggaacgccggcgaagatagctacggcaccgtggtgtctctgtactatcctgccgggctgtcccatcggagagtcagtggggcacagaaacagccccaccaatcggcgctccgactcgcatgcgagactgttccaaccgaggacgagggtctgcggtcttcacggtgcagcgtcaatcatccaatttttcacgaaggatccaatgggacctttatagtgaccttcgacgtatcctataaagctacactcggcgaccgaatgcttatgcgcgccagcgcctccagcgaaaacaataaggcttcttcgtccaaggccaccttccagctggaactgccagtgaagtatgctgtctacacgatgatcagccgccaggaggaatccactaaatacttcaacttcgccacatccgatgagaaaaagatgaaggaggcagagcacagataccgggtgaataatctgagtcagagggacttggctatttctatcaatttctgggtacctgtgctactcaacggcgtggcagtttgggacgtggttatggaggcacccagccagtcactcccttgcgtgtcagagaggaaaccccctcagcactccgacttcctgacacaaattagccgcagccccatgcttgactgctctatcgctgattgtctccagttccgttgtgatgtcccttcattctctgtgcaggaagaactggatttcacgcttaaaggtaatctgtcttttggttgggtgagagaaaccctgcagaaaaaggtcctggtagtgtccgtggccgagattacattcgacaccagtgtctacagccagctgcccggacaggaggcattcatgcgggcccaaatggagatggttttggaagaggacgaggtatataatgcgatcccgattattatgggatcctcagtcggcgctctcctgcttctggccttgatcacggccactctctataaactgggcttcttcaagcggcactacaaagagatgctggaggacaaacccgaggataccgctacattctcaggtgatgacttcagctgtgttgctcctaatgttcccctcagttag

SEQ ID NO: 120772 - DNA, 3534 bp, Artificial Sequence
  Description of Artificial Sequence: Synthetic coding sequence
tgcgcactgagccctacttttcactttccatccacaaggtgttcaggcatgacgttcggcacagttttgctcttatcagtcctcgcctcatatcacggattcaatttggacgttgaagagccaacaatttttcaagaggacgccgggggcttcggacagtctgtggtgcagtttggcgggtcccgtcttgtcgtgggagcaccactcgaggtggtggcagcaaaccagactgggagactttatgactgtgcagctgccactgggatgtgccagcccattccattgcacatccgccctgaggccgtgaatatgagtcttggcttaacactggccgcaagcaccaacggtagtcgactgcttgcctgcgggcccaccttgcatcgagtttgtggcgagaattcatattcgaaaggatcgtgcttgttgctgggatcacgctgggagattatacagactgtcccggatgctacacctgagtgtccccaccaagaaatggacatagtcttccttattgacggtagcggaagtattgaccagaatgattttaaccagatgaaaggcttcgtgcaggccgtaatggggcagttcgaaggcaccgatactctgtttgcactgatgcagtatagtaatctgttaaagattcattttacttttacacagtttaggacttctccttctcagcagtcactggtcgatccgatcgttcagctaaaaggtctgacattcacagctacgggcatcctcactgtggtgacccagctgttccatcataagaacggcgctaggaagagtgctaagaagatcctcattgtaattacggacggacagaaatataaggatccgttggagtactccgacgtcattccacaagcagaaaaggccgggattatacggtacgcaatcggtgtcggccacgccttccagggacctaccgcacggcaagaactgaacactatctctagtgctcctccccaggaccacgtattcaaagtcgataacttcgccgcacttggaagcattcagaaacagctccaggaaaaaatttacgctgttgagggcactcagtccagagcctcaagcagctttcaacatgagatgtcgcaagaaggcttctctaccgctctgactatggatggcctgtttctgggggccgttggatcattctcctggagcgggggcgcatttttatatccaccgaatatgtcaccgacttttattaatatgtcacaggaaaatgtggacatgagggattcctaccttggctacagcacggaactcgccctgtggaagggagtgcagaatctcgtcctcggggccccccgttaccagcatacagggaaggcggtcatcttcactcaggtttcccggcaatggagaaagaaagcagaggtcaccggcacccagattgggtcttatttcggcgccagtctttgtagtgtcgatgtggattcagacgggagcactgacctgattctcatcggggccccgcattactacgagcagactcggggtggacaggtcagtgtgtgtccgctccctagggggagggtgcagtggcagtgcgatgcagtcctaaggggtgagcagggccatccctggggcaggttcggagccgcactgacagttctaggcgatgttaacgaggataagctgatcgatgtggccattggtgcaccgggtgagcaggagaacaggggcgccgtctaccttttccacggtgcttcagaatctggaatcagcccatctcatagccagcgaatcgcttcatctcagctatctcctagactccaatacttcggtcaggctctttcaggtggccaagatctaactcaggacggcctaatggaccttgccgtgggcgcgcgtggccaggtcttgctgttgcgcagtctcccagtgttgaaagtcggcgtagcaatgcgattttcacccgtggaagtggccaaagccgtctaccgatgttgggaagaaaagccaagcgctctggaggcaggagacgctaccgtctgtctcactatccaaaagtctagcttggatcagctcggggacatacaatcgagtgtgcggtttgatttggcgctggatcctggacgtttaacctctcgcgccatatttaatgagacgaaaaaccccacactgacccggcggaagactttagggctggggattcattgtgaaactctgaaactgctgctgccagactgtgtggaggacgttgtctccccaataattctgcatttaaatttttccctggtaagggagcctatccccagcccccagaacttacgcccagtcctggcagtggggtcacaggacctgtttaccgcatcccttcctttcgaaaagaactgcggccaagacggcttatgtgaaggcgatctcggcgtgacactatcctttagcggactgcaaactttaacagtagggagctctttagaactcaatgttatcgtcaccgtttggaacgctggagaagacagttacgggaccgtggtatccctttattaccccgcgggccttagtcatcgccgggtgagcggggcccagaaacaacctcaccagtctgccctgcgattagcctgtgagacagtaccaacagaggatgaagggcttcgaagttccaggtgctcggtcaatcaccctattttccatgaagggagtaatggtaccttcattgttacattcgacgttagttataaagctaccctgggcgatcgtatgctgatgagggcttcagcttcctctgaaaacaataaggcaagcagcagtaaagccacattccagttggagctcccagttaaatacgcggtgtacacaatgatttcacgacaggaggagagtacaaagtacttcaacttcgcaactagcgacgagaaaaagatgaaggaggctgaacaccgataccgagtgaataacctgagccagcgtgatctcgcaatctctataaatttctgggtgcctgtgctgctaaatggcgtcgccgtgtgggacgtcgtgatggaagccccaagccagtccctgccatgcgttagtgaacggaaacccccgcagcattccgactttcttacccaaatttccaggtcgccgatgctcgactgctccatcgccgactgtctgcagttcaggtgcgatgtgccaagtttttcagtgcaggaggaactggattttacactcaaggggaatctgtcatttgggtgggtaagggaaaccctgcaaaaaaaggtcctggtagtgtcagtggctgagatcacgttcgatacatctgtgtattcccaattgcccggccaagaagcattcatgcgcgctcagatggagatggttctggaggaggacgaagtgtacaacgcaatccctatcatcatgggatcctcagttggggcgttgctcctactggctctaataacagcaaccttgtataagttggggttttttaagaggcattacaaagagatgctcgaggataaaccagaggacacggccaccttttccggggatgacttctcttgcgtcgcgcccaacgtgcctttgagctag

SEQ ID NO: 120773 - DNA, 3513 bp, Artificial Sequence
  Description of Artificial Sequence: Synthetic coding sequence
atgaaagattcttgtataaccgttatggccatggccctactgtcagggtttttcttcttcgctccagccagctcctataatctggacgtaagaggtgccaggtcttttagtcctcctcgggccggcagacattttgggtatagagtgctccaagtgggcaacggcgtaattgttggcgcccccggcgagggaaattccaccggcagcctgtaccaatgtcagtctggaacaggacattgtctgcccgtcacactgcggggttctaactacacttcaaagtacctcgggatgacattggcaacagatcctactgatgggtccatattagcctgcgatccaggactgtcaaggacatgcgaccagaatacctatctcagtgggttgtgctatctgtttcgccagaatctgcagggtccgatgttacagggtaggcccggctttcaggaatgtattaaaggcaacgtcgacctagtgtttctgtttgacggcagtatgagtctgcagccagacgagtttcagaagatactcgatttcatgaaggacgtgatgaaaaaactttccaacaccagctatcaatttgctgctgtgcagtttagcacgagctacaaaacagaatttgacttctccgattatgtcaagcgcaaggaccccgatgccctgctgaaacacgttaaacacatgctcctgcttaccaacactttcggtgccatcaattatgtagccaccgaggtttttcgggaggagttaggcgccaggcccgatgctacaaaggtgctgatcattatcaccgatggcgaggcgaccgactccggaaacatcgatgcagccaaagacataatcaggtatatcatcgggattgggaagcactttcagacaaaagaatctcaggaaactctgcataagtttgccagcaaaccagcctctgagtttgtaaagatcctagatacatttgaaaaactgaaagacctctttaccgagctccagaagaagatctacgtgatcgaggggaccagtaaacaggatttaacctcttttaacatggaactgagctcctctggcatatctgccgacctctctaggggtcatgctgtggtgggggctgtaggtgctaaggactgggcaggcggctttctggatcttaaggccgatctgcaagacgatacgttcatagggaatgagccattgaccccagaggtgcgggcagggtaccttggttatactgtgacatggctgccgagtcgtcaaaagacttccttgctggcctcaggcgcccctagataccagcacatgggaagagtgttactgtttcaggaaccacaggggggcgggcattggtctcaagttcagactatccacggcacccaaattgggagttacttcgggggagaactatgtggggtggacgtggatcaagatggcgaaacagaactcctccttatcggagcccctctcttctatggcgaacagagaggagggagagtgttcatctatcaaagacgtcagctggggtttgaggaggttagtgaactacaaggcgatcctggctaccccttggggcgtttcggagaagcaatcacagcactgactgacataaatggcgatgggttggtggatgtggccgtgggcgcccctctggaggaacagggcgccgtgtacattttcaatggcaggcatggaggtctgtctcctcaaccatctcaacgtatcgagggcacgcaggtgttatcgggtatccagtggttcggtagatccatccacggcgtcaaggacctggagggagatggcctcgcagatgtcgctgttggcgcagaaagccaaatgattgtcctcagcagcaggcctgtggttgatatggtcacgctcatgtccttctcccccgctgagatccctgtgcatgaagtggaatgctcctactccacttccaataaaatgaaggaaggagtgaatatcacaatctgcttccagatcaagtccctgataccccaatttcagggtcgcctcgttgctaacctgacttatactcttcagctggatggccacagaacacgccgacgcggtctgtttcccggaggcaggcacgaacttcggaggaatatagctgtaaccacttcaatgtcatgtaccgacttttctttccacttcccagtctgtgttcaggatttaatttcgcccatcaacgtctcccttaacttttcgctctgggaagaagaaggaaccccaagggaccagagggcccagggtaaggatatcccacctattttgaggccgtccctccattccgagacttgggaaattccattcgaaaagaattgcggagaagacaagaagtgcgaagctaacctgagggtttctttctcaccagcaaggtctcgggcacttcggctgaccgccttcgcgtccctgagcgttgaactcagcttgtcgaacctggaagaagatgcatactgggtacagctagacctgcactttccaccaggcctgagtttcagaaaggtggaaatgctcaagccgcactcccaaattcctgtatcatgtgaggagctcccagaagagtcaaggttgctgagcagagcgctctcatgcaacgtgagcagccctatcttcaaggccggacactcggtggccttgcagatgatgttcaacacattggtgaactctagttggggcgactcagtggaactgcatgcgaacgtaacttgtaacaacgaggacagcgatttgcttgaagataattcggccactaccattattcctattctatacccgattaacatactcatccaagaccaggaagattccacactctacgtgtccttcacaccaaaggggccgaagatccaccaagtcaagcatatgtaccaagtaaggatacagccgagcatccacgatcataacattcctactttagaagcagtggtgggggtgccccagccgccttcagaaggtcccatcacacatcagtggagtgtgcaaatggagccccctgtgccatgccactacgaagatctggagagactaccggacgccgccgaaccctgtctgcctggcgctctgtttaggtgtccagtggtatttaggcaagagatcctggtccaagtgatcgggactctggaattggtgggtgaaatagaagcgagttcaatgtttagcctctgtagtagcctgtctataagcttcaatagctctaaacacttccatctttatgggagtaacgcaagcctggcgcaggtggtcatgaaggtggacgtggtatacgagaagcaaatgttgtatctgtacgttttgtcagggataggtggcctcctcctgcttctgttgatctttattgtcctgtataaagtaggattctttaaacgtaacctgaaagagaagatggaggctggcagaggtgtgcccaatggaatccctgctgaggatagtgagcaattggccagtggccaagaggccggtgatcctggctgcctgaaacctctgcacgaaaaagactcggagagtggcggcggtaaggactag

SEQ ID NO: 120774 - DNA, 3261 bp, Artificial Sequence
  Description of Artificial Sequence: Synthetic coding sequence
atgaaagactcatgcataaccgtgatggcaatggccctcctatcaggattctttttttttgctcccgcgagttcttacaatcttgatgttaggggggctagatccttcagcccccccagagcagggaggcattttggttacagggttctgcaggtgggcaatggggttatcgtaggagcccccggagagggaaactccacagggtccctgtatcaatgtcagtctgggacaggacattgcctgcctgtgactctgcgagggagtaactatactagcaagtacctggggatgacattagcgaccgacccgaccgatggctctatcctgtttgccgcagtccagttctctacatcttacaagacggagtttgactttagcgactatgttaagcgaaaagaccccgatgccctgctgaagcacgttaaacacatgctgctgctgaccaacacatttggagcaattaactatgttgcaaccgaggtattccgggaagaactgggcgccaggcccgatgcaacgaaagtcctcatcattatcacagacggtgaggccactgattccggtaatattgacgctgctaaggatatcatacggtatattatcggtatcggaaagcattttcagacaaaggagtcccaggaaacgctgcacaaatttgcgtccaagcccgcaagcgaatttgtgaaaatactcgacactttcgaaaagctgaaggatctgtttacagagctgcagaagaagatatatgtgattgaggggaccagcaagcaggatctgacttcattcaatatggagctgtcgagctccggtatctctgctgatctgtctcgaggacatgccgtggtcggcgcggtcggcgcaaaggattgggctgggggattccttgaccttaaggcagacctccaggacgatacctttatcgggaacgaacctttgacgcctgaggtgcgcgcagggtacttggggtacaccgtcacctggctgccctctaggcagaagacgtctcttcttgcttctggcgccccccgctatcagcacatgggcagagtactgctcttccaggagccccagggcggcggccattggagtcaggtccagacaatccacgggacccagattggctcatacttcgggggcgaactgtgtggggtcgacgtggaccaggatggcgaaaccgagctgttactgatcggcgcgccactattctatggtgaacagcggggcggccgggtattcatctatcagagacgtcagctcggctttgaggaagtgtccgagctccagggagatcctggctaccccctcgggagattcggggaggccattaccgctctgacagacatcaacggtgatggattagtcgacgtggctgtgggagcacctctcgaggaacagggggccgtttacatatttaatgggcgacatggtggtttgtcaccacagcctagccagcgtattgagggcactcaggtcctgtctggtatccagtggttcggcagatccatacacggggtgaaggaccttgaaggcgatggactcgccgacgttgccgtcggcgctgagtcccaaatgattgtgctgtcctctcgacctgtcgtagacatggtcacactgatgagcttttccccggccgagatcccagtgcatgaggtcgagtgttcttacagcacaagcaacaagatgaaggagggtgtaaacataactatatgtttccaaatcaagtctctgatacctcagttccaaggccgccttgtggcaaacctgacatatacgctccagctcgatggccacaggactaggcgccgaggcctgttccctggaggccgccatgagctgagaagaaacatcgccgttacaacctctatgtcgtgtacagacttctcttttcactttcctgtgtgtgttcaagacctcattagccccatcaacgtgagccttaacttctcactatgggaagaagaagggactccccgggatcaaagagccgggaaggatatcccacctattctccggccttccctgcacagcgaaacctgggaaattccctttgaaaaaaactgtggcgaggataagaaatgtgaagccaacttgcgcgtctcattcagccccgcccggagtagagcattgcggctgacggctttcgcctccctgtccgtggaactctccctctctaatctcgaggaagacgcctactgggttcagctggatctgcactttcctcccgggctgtcttttcgcaaagtggagatgctcaagcctcatagtcagattccggtctcctgtgaagagcttcctgaggagtcccggcttctcagccgcgctttgagctgcaacgtgtccagtcctatcttcaaggcagggcatagcgtggctctgcaaatgatgtttaataccttggtgaattcaagctggggtgacagtgtggaactccacgccaatgtcacatgcaataatgaggattcagacctgctggaggataattctgccaccaccatcatccccattttgtaccccattaacattctgattcaggaccaggaggattccacgctatacgtgtctttcacccccaagggtcctaaaattcaccaggttaagcatatgtaccaggtgcgaatccagcctagcatccatgatcacaatatccctactcttgaagcagtagtgggcgtgccccagcctccaagcgagggccctataacacaccagtggtcagtgcaaatggaaccacctgttccatgtcactacgaggatttggaacggctgccggacgctgccgagccctgcctgcctggagcactctttaggtgtccagttgtttttagacaggagattctggtacaggtgattggcacactggaactggtgggcgaaatcgaggcttctagcatgttcagtttgtgctcatccctgagcattagttttaactcctcaaaacacttccacctctatggtagcaatgcctcactcgctcaggtcgtgatgaaggtagacgtggtgtacgagaagcagatgctgtacttatatgtgttgtcagggatcggggggctgcttttgctcctgttgattttcattgttctgtataaagtgggcttcttcaaaagaaacctgaaggagaaaatggaggctggtcgtggcgtgccgaatgggattcccgctgaagatagcgagcagctggctagcggacaagaggcgggtgatcccggctgcctcaagcccctgcacgagaaagattctgaatcaggaggaggaaaagactag

SEQ ID NO: 120775 - DNA, 1215 bp, Artificial Sequence
  Description of Artificial Sequence: Synthetic coding sequence
atgaaggactcatgtattacagtgatggccatggccctgttgtcaggtttcttttttttcgctcccgccagcagctacaatctggatgtgaggggcgcccggtctttctccccaccaagggcgggaaggcacttcggatatcgtgtcctccagataaaatccctgattccacagtttcagggtcgcctcgtagcaaatctcacgtacacactccaacttgacgggcaccgtacaagacgtagaggcctgttcccaggcggaagacacgaattgcggcgcaatattgccgtcacaacctcaatgtcatgtacagacttctcatttcacttccctatgatgtttaacactctcgtgaattctagttggggcgattccgtagaactccacgccaacgtgacgtgtaataacgaagactccgaccttttagaggacaatagcgcaacaacaattatccctatcttgtaccccatcaatatcctgatacaggaccaagaggatagcacgctgtacgtgagctttacccccaagggcccgaaaatccaccaggtcaaacatatgtaccaggttagaattcaaccttccatccacgatcacaacatccccacactggaagcagttgtgggcgttcctcaacccccaagcgaaggccccatcacccaccagtggagtgtacagatggagcctcccgtcccatgtcactatgaggacctggaaaggctgcccgacgccgcagaaccctgtctgcccggcgcactgtttcgttgtccggtcgtgttcagacaggaaatacttgtgcaggtgatcgggactctggagctggtcggggaaatagaggctagtagcatgttcagcctttgctcaagtctatccataagttttaatagtagcaagcatttccacctgtacggttcgaacgcgtctctggcacaggtagtgatgaaggtagacgtggtgtatgagaagcagatgttgtatctgtatgtcctgtctggtatcgggggcctgcttctgctgcttctaatcttcattgtgttgtataaggtcggatttttcaaacggaacctgaaggaaaagatggaggctggaaggggagtgcccaatggcattcctgccgaagattcagaacagttggcctccggccaagaggcgggagaccccggctgtctgaagcccttgcacgagaaggacagcgaaagtggaggtggcaaagactag

SEQ ID NO: 120776 - DNA, 489 bp, Artificial Sequence
  Description of Artificial Sequence: Synthetic coding sequence
atgaaagactcatgcattaccgtaatggcgatggcactgctcagtggtttcttcttcttcgcgcctgccagtagttacaacctcgacgtccggggcgcacgcagtttcagcccgccacgagccgggagacattttggttacagggttctgcaggtggggaacggcgttatcgtgggggccccaggcgaaggcaattccaccgggtcactctatcagtgccagagtggaaccgggcattgtctgccagtgactttgaggggtagtaactatacctccaagtacctgggaatgactctggccacagatcccaccgatggctctatactcgcctgtgatcctgggctttcacgcacgtgcgatcagaatacttacctgagcggactctgttatcttttcaggcagaacttacagggccccatgctgcaggggaggcctggatttcaggtgtgctgttgcagcgtgtttcacaagcttcaaaaccgcatctag

SEQ ID NO: 120777 - DNA, 3459 bp, Artificial Sequence
  Description of Artificial Sequence: Synthetic coding sequence
atggcattgcgagttcttcttctaaccgccctaacactgtgccatgggtttaaccttgacactgagaatgccatgacatttcaggagaatgcccgcggcttcggtcagagcgttgtccagctgcagggcagcagagtggtggtgggtgcgccacaggagatagtggctgccaaccagagaggtagcctataccagtgcgattatagtacaggttcatgcgagccgatccgcctgcaggtgccagtcgaggccgtgaatatgtcacttggcctcagcctggccgctactacatctcctcctcagctgctggcctgtggccctacggtacaccaaacatgctccgagaatacctatgtgaagggtctgtgcttcctgttcggtagcaatctacgacagcaacctcagaagttcccagaagctctgcgcggatgtcctcaggaagatagcgatattgctttccttatagatggcagcggaagcatcattccccacgactttcgtcgcatgaaagagtttgtgtctaccgtgatggagcagctcaagaaatccaagaccttgttctctctgatgcagtatagcgaggagtttaggattcatttcacctttaaagaatttcaaaataaccccaacccccgctcattggtcaaacccataacacagctgttgggccgcactcacacagctactggtatccgcaaggtggtgagagaactgtttaacattaccaatggggctaggaagaacgcatttaagatcctggtagtcatcaccgatggcgaaaaattcggcgaccctttggggtatgaggatgtgattcccgaagccgacagggagggcgtcatccgctacgtgatcggtgtaggagacgcattccgctcagaaaaatccagacaggagttgaacaccatcgccagcaagccaccaagggaccatgtgttccaggtgaacaattttgaagccttgaaaacaattcagaatcagttgagagagaagatcttcgccatagaaggaacccaaactggaagcagctcttcctttgagcatgaaatgagtcaggagggcttcagcgcagcaatcactagtaacgggccactgttatctacagtgggatcatacgattgggccggcggagtctttctctacacttccaaggaaaaatctacttttatcaatatgactagagtggacagcgatatgaacgacgcttatctgggctacgccgcagccattatcttgcggaacagggtacagagcctcgttcttggagccccccggtatcagcatattgggcttgtggctatgtttagacaaaatactggtatgtgggaaagcaatgccaacgtcaaaggaacccaaatcggcgcctacttcggggcgtccttatgcagcgtcgatgtagattcaaacggatctacagacctggtgctgattggggctccccactactacgaacagacccgaggcgggcaagtgagcgtttgtcctttgccacggggcagagccagatggcagtgcgatgcagttctgtacggtgaacagggccagccttgggggcgtttcggcgctgccttaaccgtactaggggatgtgaatggggacaaactcacagatgtggcaatcggggcaccgggggaagaggacaacaggggtgcagtttacctgtttcatggaaccagcgggtcaggaatcagccccagccactctcagcgcatagcaggcagcaagctctctcctagattgcaatattttggccagtctctttccggaggccaagatctcacaatggatggcctcgtggacctgacagtgggggcacagggtcacgtattgctgctgagatcccagccagtattgagggttaaagcgataatggaatttaacccacgcgaagtggcaaggaacgtcttcgagtgtaacgaccaagtcgtcaagggaaaagaggcaggggaggtacgggtgtgtctccatgttcagaagtccactagagacagattgcgcgagggccaaatacaaagcgttgtgacctacgacctagcgctggatagcgggcgtccccactcgagagcggtattcaatgaaactaagaactccaccagacggcagacccaggttctcggccttactcagacgtgcgagacacttaaattgcagttgccgaattgtatcgaagaccccgtctcccctattgtgctcaggctgaacttctcactcgttgggaccccgttatccgcctttgggaacctgcggccagtgcttgccgaagacgcccaacgattgttcaccgccctgttcccatttgaaaaaaattgtgggaacgacaacatctgccaagatgatttaagcattacattttcatttatgtctctggattgcttagtcgtcggcggaccaagagagtttaatgtaactgtaaccgtccggaatgacggggaagatagttaccgaacccaagtgacattttttttccctctagacctcagctacaggaaggtgtctactctgcagaatcagcgcagtcaaaggtcctggagactggcatgcgagtcggctagcagcacagaggtatctggcgctctgaaatcaacgtcctgctccataaaccacccaattttccctgagaactcggaagtgacttttaacattactttcgatgtggattctaaagcgtccttagggaacaagttgctgctgaaggcgaatgtgacatctgagaataacatgccccggaccaacaagactgagttccagcttgagctgccagtgaagtatgccgtctatatggtagtaaccagtcatggggtgagtactaaatacctgaattttacggccagcgagaacacttccagggttatgcagcaccagtaccaggtctccaaccttgggcagaggtccttgccaattagcttagtttttcttgtgccggtgagattgaaccagacggtaatctgggacagacctcaggtaactttttccgaaaatctcagctcaacatgtcataccaaggagagactgccatcccactccgacttcctggctgagttacggaaagcaccggtggtgaattgtagtattgctgtatgccagcgaattcagtgtgacatacccttctttgggatacaggaagagttcaacgccacactgaaagggaaccttagttttgattggtatattaaaacctcccacaatcacctgctgatcgtgtccaccgccgagattctttttaacgactcagtattcaccctgttgcctggacagggtgccttcgtgagatcccaaacagaaactaaggtggagccatttgaggtgcccaacccattgcccctcattgtcgggtcctctgtcggcgggctgctactgctagcactaataactgccgcattgtataagttaggattctttaagcggcagtacaaggacatgatgtcagagggaggaccgccaggggccgagccacaatag

SEQ ID NO: 120778 - DNA, 3462 bp, Artificial Sequence
  Description of Artificial Sequence: Synthetic coding sequence
atggctttacgcgtgctattgctgactgccttaaccttgtgtcacgggtttaatctcgacaccgaaaatgccatgacatttcaggaaaacgcacgaggtttcggccagagcgttgtgcaacttcagggatccagagtggtcgtaggcgcccctcaggagatcgtggcagctaaccagcggggaagcctgtaccagtgcgactactctaccggaagttgcgaacctattcggctgcaagtgccggtggaagcggtgaatatgagccttggcctgtccctggccgccaccacaagccccccccagctgttggcatgcgggcctaccgtgcaccagacatgcagtgagaatacctatgtgaaaggactgtgtttcctgtttggaagcaacctcagacagcaaccacaaaaattccccgaagccctgcgcggttgccctcaagaagatagcgatatcgcgtttttaatcgacgggtccggctctatcattccgcatgatttcagaaggatgaaggagttcgtgtccactgtaatggagcagcttaaaaaatccaagactttgttcagtctgatgcaatactccgaggaattcaggatccacttcaccttcaaagaattccaaaataaccccaacccaagatccctggtgaaaccgatcacacagctgctcggccgaacgcatacagcaacaggaatccggaaggtcgtgcgcgagctgtttaacatcacgaacggtgcaagaaagaatgcttttaagatcttagtcgtgattacagacggagaaaagtttggcgaccccttaggttacgaggatgtgatcccagaagccgaccgggaaggggtgatccgatatgtcataggggtgggcgacgcatttcggtctgagaagtcccggcaggagctgaacacgatcgcttccaagcctcctcgagatcatgtcttccaggtgaataattttgaagctttaaagactatccagaatcagctgagagagaaaattttcgcaattgagggcacccagaccgggtccagttcgagtttcgaacacgagatgtcacaagaggggttcagtgccgccataaccagcaacgggccactgctaagcacagttgggagctatgattgggcagggggagtgtttctttacacatccaaggagaaatctactttcatcaacatgacacgagttgactctgatatgaacgatgcctacctcgggtatgcggcggctataatcctcaggaaccgggtgcagtccttagtgttaggcgctccgaggtaccagcacattggactggtggccatgttccgacaaaatacgggcatgtgggaaagtaatgccaatgtgaaaggcacacagatcggggcctacttcggggccagcttgtgtagcgtagacgtggactccaacggctcaactgatctcgttctcataggagcgccccactactatgagcagacccgtggggggcaggtgtccgtgtgtccattgccgcgagggcagcgcgcaagatggcaatgtgacgccgttctgtacggggaacagggtcagccctggggcagattcggagccgctcttactgtactgggagacgttaacggcgacaaactgactgacgtcgccatcggcgcccccggtgaggaggataatcgcggtgctgtgtacttgttccatggaactagtggtagcggcatatcacccagccactcccagcgaatagcgggaagcaagctttctcctcgcctccagtattttgggcaatcactctcaggtggacaggacctgaccatggatggtctcgtggacctcactgtgggagcccaggggcacgtgttactcctgagaagccaaccagttctgcgtgtgaaggctatcatggaatttaatccccgcgaggtcgcgcggaacgtgttcgaatgcaacgaccaagtggtgaaaggcaaagaagctggagaagtgcgtgtctgcttacacgtgcagaaaagcactcgagatcgtttgagagagggccagattcaatccgttgtaacatatgaccttgctctagacagtggaagaccacactctcgagcggtattcaacgagaccaagaacagtacccgacgccagacacaggtgcttggactgacccagacatgcgagactctgaagttacagcttcctaattgtatcgaagatccagtgtcacccatcgtgctgcggttgaatttttctctggtgggaactcctcttagtgcattcggcaaccttcggcctgtactggctgaggatgcccagcgtctctttacagccctattcccctttgagaagaattgcggtaatgacaacatttgtcaagacgacctcagcatcacgtttagcttcatgtctttggattgtctggtcgtcggaggacctcgcgagtttaatgtcacagtcacagtgagaaacgacggtgaggattcgtaccgtacccaagttacatttttcttccctctggacctttcgtataggaaagtgtccactctgcagaatcagaggtcccagagaagttggagactggcatgtgaatccgccagtagtacggaggtgtccggggcgctaaagtccacttcctgcagcattaaccatcctatattcccagagaattctgaagtcactttcaacataaccttcgatgtcgactctaaggcatcactgggcaataaactactactcaaagcgaacgttacgtccgagaacaacatgccacgtaccaataaaaccgagttccagctggagcttcccgtgaaatacgctgtgtacatggtcgttacttcacacggggtgtccacaaagtacctgaacttcactgctagcgagaacacgtcccgggtgatgcagcatcaataccaggtgtccaacctgggacaacgtagtctacctataagtctggtctttttagtgccagtccgactaaaccagactgtgatctgggaccggccccaggttacattctctgagaatctttcctctacatgtcacacaaaagagaggctcccctctcattccgactttttagctgaactgcggaaagctccagtggtaaattgttctatcgccgtgtgccagagaatacagtgtgatatacccttctttggcatccaagaggagttcaatgcgacgctgaaaggtaatctctctttcgattggtatataaagacctctcacaaccatctcttgatcgtgtcaaccgccgagatactgtttaatgatagcgtgttcaccttactacccggccagggggccttcgtccgatctcagactgaaacaaaagtggagccgtttgaagtccctaaccccctcccactcattgttggtagctctgtcggtggattactgttgctagccttaattactgcagctctctacaaactgggcttcttcaagagacagtacaaggatatgatgagcgaagggggacctccgggagctgaacctcagtag

SEQ ID NO: 120779 - DNA, 3492 bp, Artificial Sequence
  Description of Artificial Sequence: Synthetic coding sequence
atgaccaggacacgcgccgcactcctactgtttacggctcttgctacctccctcggttttaaccttgacacggaagagctcacagcttttcgggtcgactctgcgggctttggtgactcggtcgtccagtacgcgaactcatgggtcgtcgtcggggcaccccagaagatcactgccgccaaccagacaggaggtctgtaccaatgcggatatagtacaggggcgtgtgaacccatcggactccaagtccccccagaggctgttaacatgtcccttggattgtccctggcctctaccacctcccccagccaacttctcgcctgcggcccaaccgtgcaccatgaatgtggaagaaacatgtatctgacagggctttgctttctgttaggacctacacagctcacacagaggctgcctgtcagcagacaagagtgtccacgtcaggaacaggacatcgtttttttaatcgacgggtccggttccatttcaagtaggaatttcgctaccatgatgaattttgttagggcagttattagccaatttcagaggccatccacacagtttagcctgatgcaattttctaataaatttcagacccacttcacctttgaggagttcaggcgttcgtcgaacccactgtccctcctggcgagcgtccaccagcttcagggcttcacctatacagccaccgctattcaaaatgttgtacatcgcttattccacgcaagttacggagctaggagagacgctgcgaaaatcctcatcgtgattactgacggaaagaaagaaggggactccctggattacaaagacgtgattcccatggcggatgcagcagggatcattcggtatgcaattggcgtgggactcgcctttcagaaccgtaacagctggaaggaactgaacgacatcgcctccaagcctagtcaggagcacatttttaaggtggaggacttcgatgccttgaaggatatccaaaatcagttgaaggagaagatcttcgccatagaagggacggaaaccaccagctcatcatccttcgagcttgagatggcccaggaagggttttccgccgtgttcacacctgatggaccggtcctaggcgccgtgggatcttttacgtggtccgggggagcttttctgtatccaccaaatatgagtcccactttcatcaatatgtcccaggaaaacgtcgatatgagagactcatacctcggctattcaacagaacttgccctttggaagggagttcagtccctggtcctgggggcccctcggtaccaacacaccggcaaagccgtcatattcacacaagtctcgagacagtggagaatgaaggcagaagtcaccgggacccagatcggctcatactttggggcctcgctctgcagtgtggatgtggactctgacggctcaacagatctggttctgataggcgcccctcactattatgagcagacacgaggcgggcaggtatccgtgtgcccgttgccacggggctggcgcaggtggtggtgcgatgctgtgctgtatggagaacagggacacccctggggaagatttggcgctgcccttactgtactgggtgatgtgaacggcgacaaacttacagatgtcgtcatcggcgcacccggcgaagaggagaacaggggagctgtgtatctattccacggcgttttgggtccttctatcagcccttcccatagtcagaggatcgcgggtagtcagttatctagcaggctgcagtattttggccaggcccttagtggcggtcaggacctcacccaagacgggctggtggatctggctgtgggggcaaggggacaggtgctattgctgcgtactagacctgtgctatgggtaggggtgtctatgcagtttatcccggcggaaataccccggtcggcatttgaatgtcgagagcaggtcgtgagcgagcagacactcgtgcagagcaatatttgcttatacatcgataagagatctaagaacctgctaggctccagagacttgcaaagttccgtaacgcttgacctggcattggaccctggccgtctgtcgcctagagctactttccaagaaacgaaaaatcgctcactgagtagggtgcgcgtcttgggcctgaaggctcactgtgaaaacttcaacctcctcctaccgtcttgtgtcgaagatagcgtcacccctatcactttgagattaaacttcactttagtgggaaagcccctcctcgcctttaggaacctccgtccaatgctcgcggcagatgcccagagatactttaccgcgtccctgccatttgagaaaaattgcggcgctgatcatatctgccaggacaacttggggataagtttttccttccccgggttgaaaagcctgctggttggctccaatttagaactcaatgccgaggtaatggtgtggaatgacggggaagactcttacggaacaactataacattttcccatcccgcgggtcttagctacaggtacgtagccgaaggccaaaagcagggacaactcaggtcgcttcacctcacctgcgatagtgctcccgtagggagccagggaacatggagcacctcatgtcgaatcaatcacttaatcttccgaggcggtgcacaaatcacattcctggcaacctttgatgtgtcccccaaggctgtgcttggtgataggcttctgttgactgccaacgtaagcagcgaaaacaacactccccgcacctctaagacaacgttccagctggagttgcctgtcaagtatgcggtgtacaccgtggtgtcctcccacgaacagtttacgaagtatctgaatttttccgagtccgaagagaaagagtcacacgtggctatgcacaggtaccaagtgaacaacctgggccagcgcgatcttcccgtgtctatcaatttttgggtccccgtagagttgaatcaggaagccgtctggatggacgtggaggtcagccatccacagaatccctctttgagatgcagcagcgaaaagatagccccgcctgcatctgattttttggctcacattcagaagaacccagtgctcgactgcagcatagccggctgtttgcggttcagatgcgatgtgccctctttctcggtgcaggaagaactggactttacgctgaagggtaacctctcattcggatgggtgcgccagatcctgcagaaaaaagtctcagttgtgagcgtcgccgaaattacatttgatactagcgtatactctcagttaccaggtcaggaggctttcatgcgagcacagactactactgtgcttgaaaagtacaaggttcacaacccaacaccactgatcgtggggtcaagcattggaggcctgctgctcctggccttgattactgccgttctgtacaaagtcgggttctttaagcggcagtataaggaaatgatggaagaagctaatggtcagatcgcccctgagaacggcacccagacaccttcccctccatctgagaagtag

SEQ ID NO: 120780 - DNA, 5469 bp, Artificial Sequence
  Description of Artificial Sequence: Synthetic coding sequence
atggccggaccacggccaagcccatgggcacgcttattgttggccgcccttattagtgtttctctctcagggactttagccaatagatgtaaaaaggctcccgtgaagtcgtgcaccgaatgcgtaagggttgacaaggactgtgcctactgcactgacgagatgttccgcgacaggagatgtaatacacaggccgagctgctggccgccggatgccagagggaaagcatcgtagtcatggagtcatcttttcagatcaccgaagagacacagattgatactaccctgagacgaagtcaaatgtctccacagggtctacgagtgcgattaagacccggggaggaaaggcattttgaacttgaggtctttgagccactcgagagcccggtggacctgtatatcctcatggattttagcaacagcatgagtgacgacctggataatctgaagaaaatgggtcagaacttggcgagagtcctaagtcagcttactagtgactataccataggattcggtaaatttgtggacaaggtcagcgttccccagaccgacatgaggcctgagaaattaaaggagccttggccaaactcagacccccccttttcattcaagaatgttatatcacttacagaggacgtggacgagttccggaacaagctccaaggtgaacggatatcaggcaacctggatgcccctgagggcggattcgacgcgatcctgcagacagcagtgtgtacccgagatattggctggagacctgattccacacatttgctagttttctcaacggaatccgcgtttcactatgaagctgacggggccaatgtgttggccggtatcatgtctcgcaacgacgagaggtgccatctggacacaacagggacctacacgcaataccgtacccaggattatccctctgtgcccactctggtacgcctcctggcaaaacataacataatacccattttcgctgtgaccaactactcatactcttattacgaaaaattacacacttatttccctgtctcctcgttaggcgtgctgcaagaagattcttcaaacatcgtggaattactggaagaggcattcaatagaatccggtctaacctagacattagggccttagactcgccgcggggactgagaactgaagtcaccagcaagatgttccaaaaaacccgaaccggctccttccatatccgcagaggagaggtcggcatttaccaggtccaactcagggccctggagcatgtcgatggcactcacgtatgccaactgcccgaagatcagaagggcaatatccaccttaaaccctcattctccgatggcctgaagatggatgccggcattatttgcgacgtatgtacctgtgagctccagaaggaagtgaggtccgctaggtgtagtttcaacggtgattttgtttgtggccagtgtgtatgctccgagggctggagtgggcagacctgtaattgctcgacaggttcgctgtccgacattcagccttgcctgagagagggcgaggataaaccctgctctggccgtggggaatgccagtgcggccattgtgtttgctatggggagggacgctacgagggacagttttgtgagtatgacaattttcagtgcccccgcacctccggcttcctctgcaatgatcgcggccggtgtagtatggggcagtgcgtttgtgaacctggttggaccggcccttcttgtgactgccccctcagtaacgctacttgcattgactcgaacggcgggatctgcaacgggcgaggacactgcgagtgcgggaggtgccactgtcaccaacagtcactatacacagatacaatctgcgagatcaattactcggctatccatccaggcctctgtgaggatcttcggagctgcgtccaatgccaggcgtgggggactggtgagaagaaagggcgcacctgtgaggagtgtaactttaaagtgaaaatggtcgatgaactcaagcgggctgaggaggtagtggtcaggtgtagtttccgcgacgaagacgacgattgtacgtacagctacactatggaaggcgacggcgctccaggtccgaattctaccgtgcttgtccataaaaaaaaggactgtccacctgggtctttttggtggctgatccctctgcttctgctcctgctgccattgcttgcccttctgctccttctgtgttggaaatattgtgcgtgctgcaaagcttgcctagccctgcttccttgctgtaatcgcggacatatggtgggcttcaaagaggatcattatatgctacgagagaacctgatggcttcggaccatttggatactcctatgctccggagtggcaacctgaagggtcgagatgtcgtcaggtggaaagtgaccaacaacatgcaacgccctggatttgcaacccatgccgcatccataaatcctacagagctggtcccatatggcctcagcctcagactggccaggttatgtacggaaaatttgctgaaacctgacacaagggagtgcgcgcagctccgtcaggaggtggaggagaatctaaacgaggtgtaccgccagatatccggcgtgcacaagcttcagcagactaaatttcggcagcagccaaacgccgggaagaagcaggaccacaccatagtggacactgtgcttatggcaccgcgcagcgctaagcctgctctgctgaaactcacagaaaagcaagtggagcaaagggccttccatgacctcaaggtggcccccggctattatacactcacggctgatcaggacgcaagaggcatggtcgagtttcaggaaggcgtggagctggtcgacgtgagagtaccgttgttcattcggcccgaagatgacgatgaaaagcagctcctggttgaggctattgacgttccagccggaaccgctacccttggtcggcggctggtaaatataaccataatcaaggaacaggcccgagacgtggtatccttcgagcaaccagaattttccgtgagccgtggcgaccaagttgcgaggatccccgtgatcaggagggttctggatgggggcaaatcccaagtgagctatagaacgcaggacggaacagctcagggaaatcgcgactacatccccgtggagggcgagctcctcttccagcccggggaggcttggaaagaactccaggtgaaactgctcgagctgcaggaggtcgacagtctcctgagggggaggcaggttagacgatttcatgtccagctttctaatccaaagttcggtgcacaccttgggcagccccactctacaaccattataatacgagaccctgacgaattagatagaagcttcacttcacagatgttgtcatcccagcctccccctcacggggatctgggagcacctcaaaatcctaatgcaaaggcggctgggtccagaaagatacacttcaactggttgccaccttcaggcaaacccatgggctaccgggttaagtattggatccaaggcgacagcgagagcgaggcacatctactcgactctaaggtcccaagcgtggagctcactaatttgtacccctattgcgactatgagatgaaggtatgcgcctacggcgcccagggggaaggaccttatagctctctggtctcctgcaggactcatcaggaagtcccgtctgagcctggacgcctagcattcaacgtagtttctagcactgtcacccagctaagttgggccgagcctgccgaaaccaatggcgagatcactgcctacgaggtatgttatggactagtgaatgacgataataggcccattggtcccatgaagaaggttctggtcgataacccaaagaatcgcatgctcctgattgaaaatctccgtgagagccagccttatagatacaccgtaaaagcacgaaacggggctggttggggcccagaaagggaggccattataaaccttgctactcagccaaaacgaccgatgtccatccctattattcctgatattcctatcgtcgacgcccagagtggcgaagattacgattcctttcttatgtacagcgacgatgtcttacgctcgccttcgggctcacaaagaccatctgtaagtgatgatactggctgtggatggaagtttgaacccctgctgggagaggagctggatctgaggcgtgttacctggagactgcccccagagctgatcccccggctgtccgcctcctcaggtcgttcttccgatgccgaggctccccacggccctccagatgatggcggcgccgggggcaaaggcggtagcctgcctagaagcgcaacccccgggccaccaggagagcacctggtgaacggccgaatggactttgccttccccggcagcaccaattccctgcaccgcatgacaactaccagtgccgccgcttacggcactcatctgagcccccatgtaccccacagggttctgagtactagttctaccctgactcgtgattacaacagccttacaaggtcagagcactcacattccacaacgcttcctcgtgactatagcacccttacgagcgtgagttctcacgactctagactgacagccggagtaccagacacccctacccgtctcgtgtttagcgctttaggaccaacaagcctacgggtgagttggcaggagccccgttgcgaacgcccgctacagggttactcagtggagtatcagctacttaatggcggcgagttacatcgacttaacatccccaatcctgctcagacatcggtggttgtcgaggacttactgcctaaccactcctatgtgttccgagtcagggcccagtcccaggagggttggggccgcgagcgcgaaggagttattacaatagagagccaggtgcatccacagtcacccttgtgtcccctccctggatcagcctttaccctaagtaccccttcagctcccggacctctggtgtttactgccctcagtccggactctttgcagctgtcatgggagcgacctcgcagacccaatggcgacatagtgggctacctcgtgacctgtgagatggcccaggggggaggaccagctaccgcctttcgggtggacggtgatagcccagaaagccgcctgacggttcctggcctcagtgaaaacgtcccatataagttcaaagtgcaggcccgtacgacagaaggctttgggcctgagcgtgagggaatcattacaatcgagagccaggatgggggaccatttccccagttggggtcccgagccggcctgttccagcaccccttgcagagtgagtattcctccattaccactacacacactagtgccacagaacccttcctggttgatggtctaacgctgggcgctcagcacctagaggctggaggaagtttgacacgacacgtgacccaggaattcgtaagccggacacttaccactagcggaaccctttccactcacatggaccagcagttctttcagacctag

SEQ ID NO: 120781 - DNA, 5418 bp, Artificial Sequence
  Description of Artificial Sequence: Synthetic coding sequence
atggccgggcccagaccctcgccatgggctcggctgctcctggccgctttgatcagcgtctccctcagtggcactctggctaatcgctgtaaaaaagcccccgttaaatcatgtaccgagtgcgtccgggtggataaggactgcgcgtattgtaccgacgaaatgtttcgagatcgcaggtgtaatacgcaagctgaactgctagctgccggctgccaaagagagtccatcgtggtcatggaaagttcttttcagattaccgaggaaacgcagatcgacacaactctcagaagaagtcagatgtccccccagggattacgggttagactccggcctggagaagagcggcatttcgagctggaggtattcgaaccattagagtcaccggtcgacctgtatatcctcatggacttttccaattccatgtcagacgatcttgataatctcaagaagatgggacagaaccttgctagagtgttatcccaactgacatccgattataccatcgggttcggaaagttcgtcgataaagttagtgtgccccaaaccgatatgcggcctgaaaaacttaaagaaccttggccaaactcagatccaccttttagctttaagaacgttataagtctcacagaggacgtggacgaattccgtaacaagctgcagggcgaaagaatctcgggaaacctggacgcccccgagggcgggttcgacgccatcctgcagaccgcagtctgcacccgcgacatcggatggagacctgatagcacccacctgttggtattttctacggagagcgctttccattatgaagctgacggtgctaatgtgttggctggaattatgtctcgtaatgatgaaaggtgtcacttggacaccactgggacttacactcaatataggacccaggactatccatcagtccctactctggtgcgtctcctcgccaagcataacatcatacccatttttgcagtgaccaactatagctattcgtattatgagaagcttcatacctacttcccggtgtccagtctgggggtacttcaagaggactcctctaatattgtggaactgctggaggaagcattcaacaggataaggtctaatcttgacattcgcgccttggattcgccgcgaggcttaaggacggaggtgacctctaaaatgttccaaaagacaaggactggatctttccacattcgtaggggggaagtcgggatatatcaggttcaactgcgcgcactggagcatgttgacggaacacatgtatgccagctccccgaggaccaaaaaggaaacattcatctcaagccttcctttagtgacgggctcaaaatggatgctggcattatttgtgatgtgtgtacctgtgaattgcagaaagaggttcgatccgctcgctgttcatttaacggagactttgtgtgtggacagtgtgtgtgctccgagggctggtctggccaaacctgtaactgctcaactggatcactctccgacattcagccgtgtcttagagagggtgaggacaaaccatgctctggaagaggcgagtgtcagtgcgggcattgcgtgtgctacggcgaaggaaggtacgaaggacagttctgcgagtatgacaatttccagtgccccagaacctctgggttcctgtgtaacgaccgcggtcgctgtagtatggggcagtgtgtgtgcgagccgggctggaccggcccctcctgcgactgcccccttagtaatgctacgtgtatagactctaacggcggtatctgtaacggacgaggacactgcgagtgtgggcggtgtcactgccatcagcaatctctgtatacagacactatctgtgagatcaactactcagccatccatcctggtctgtgcgaagacctacggagctgtgtccagtgccaggcatggggtaccggggagaagaaaggaagaacttgcgaagagtgcaactttaaggtaaagatggtagacgagctcaagcgcgctgaggaggtcgtggttcggtgtagtttccgagatgaagacgatgattgtacttactcatacaccatggagggtgacggcgctcccggtcctaatagcactgtactagtgcacaagaaaaaagactgcccccctgggtcattctggtggctaatccctcttctgctcctgttgttgcctctgcttgctctactcctccttctgtgttggaaatactgcgcatgttgtaaagcctgcttagcccttctcccatgctgcaatcggggccacatggtcggctttaaagaagatcactatatgctgcgtgagaaccttatggcctctgaccatctcgacacgcccatgctgcgtagtggaaatttaaaaggcagggacgtcgtgcggtggaaagtcaccaacaacatgcagcggcctggattcgccactcacgccgcaagcatcaatccaacagagctggtgccttatggcttgagtttgcggttggcgaggctgtgcactgaaaatctcctgaagccggacactcgggagtgtgcacagctccgacaggaagtcgaggaaaatttaaatgaggtataccggcagatatctggtgtccataaacttcaacagaccaaattccgacagcagccaaacgcgggcaagaaacaggaccacaccatagttgacacagtcctgatggctccaaggtccgcaaagcctgctttgcttaagctaacggaaaagcaggttgaacagcgagcctttcatgatcttaaggtcgcccccggctattacactctgaccgctgaccaggacgcacgcgggatggtcgagttccaagagggagtcgagctggtggatgtgcgtgtgcctctgtttatcagacctgaggatgacgacgaaaagcagctcctggtagaggccattgatgttccagccggcaccgccactctgggcagacgcctggttaacataacgataatcaaggagcaggcccgcgacgttgtgagcttcgagcagcccgagttctccgtcagtagaggcgaccaggttgcccgcattccagtgatcaggagggttctcgatggaggtaaatcccaggtctcatacagaactcaagacgggacggctcaagggaatcgggactatatcccagtagagggggaattgttgttccagccgggcgaagcctggaaggagctgcaggtaaaactgctggagctccaagaagtggacagcctgctacgcggacgccaggtgagacgttttcacgtccagctgagcaaccccaagtttggcgcccacctgggacaaccacactcgaccacgataattatcagggatccagacgagctggacaggtctttcaccagtcagatgctatcttcacagccccctccccacggcgatctgggcgcccctcagaatcccaatgcaaaggccgctgggagccgaaaaattcattttaactggctcccaccttccgggaaacctatgggctacagagtgaagtactggatccaaggagacagcgaatcagaagctcacctgttggactccaaagtaccttctgtggaattgactaacctttatccctattgtgattatgagatgaaagtgtgtgcatacggcgcccagggagagggaccctactcgtcactggtgtcatgtaggacgcatcaagaggtgccctccgagcccgggcgactggcctttaatgtggtctctagcactgtgacccaacttagttgggcagagcctgctgagacaaacggcgagatcactgcctatgaggtgtgctacgggttagtaaatgacgataaccgaccgattggcccaatgaagaaggtactcgttgacaatcctaaaaaccgcatgctgctcatcgagaaccttagggagtcccagccttatagatatactgtcaaagcccggaacggcgcgggatggggccctgagcgcgaagctatcataaacctcgccacacagccaaagcggcctatgagcatacctattatccccgacatccccatcgtggacgcccagagtggcgaagattacgatagttttcttatgtactctgacgacgtacttcggagcccctcgggaagccagaggccatctgtgtcagacgatacggaacatctggtgaatgggcggatggacttcgcctttccagggagcaccaattccctccacaggatgacaaccacttctgccgcggcttacgggactcacttgtccccacacgtgcctcaccgggtcttgtccacgtcgtctactcttaccagagactacaattccctcacccgaagcgaacacagccatagcacaaccctcccaagagactattcgactcttacctccgtttcctcccatgggttgccacccatctgggagcacggcaggtctcggctgcctctctcttgggccctcggttctaggtcccgagcgcagatgaaaggcttcccaccatctcggggccctcgcgattccatcattctagccggaaggccagccgcccccagttggggcccggatagccgacttacggcgggagtgcccgacacacctacgcgcctggtgttttcagctctgggcccaacctctcttagggtgagttggcaggagcctcgctgcgaacggcctctgcaggggtatagcgtggagtatcagcttctgaatggaggtgagttacacagactaaacatcccaaatccagctcagacaagcgtggttgtggaggatctgttaccgaatcactcctacgtcttcagggttagagcacaatcacaagaaggttggggccgggagagggagggagttatcacaatagaatctcaggtccacccgcagagccctctgtgtcccctgcctggaagcgcttttacgcttagcaccccatccgcacccggccccctggtgttcacagctctatcccctgactcgcttcaactgtcgtgggagcggccgcgtcgtccaaacggcgacatcgtaggctacctggtcacatgcgagatggctcagggcggaggtccagccactgcctttcgcgttgacggcgacagcccagagtctcggctgaccgtaccaggcctgagcgagaatgttccatataaatttaaggtgcaggccaggactaccgaggggttcggaccagaacgggagggtataattacaatcgaatctcaagacggcggaccatttccccagctgggatcacgtgctggactattccagcatcctctacagtccgagtattcatctatcacaactacccacacatcggccaccgaaccttttttggtcgatggactgacactgggtgcccagcacctggaagcaggtgggtcgctgacccggcatgtcacccaagagtttgtgtcccgaactttgaccacgagcggcactttaagcacgcacatggatcaacagtttttccagacatag

SEQ ID NO: 120782 - DNA, 5418 bp, Artificial Sequence
  Description of Artificial Sequence: Synthetic coding sequence
atggcaggtccgaggccttccccttgggccaggcttctcctggctgccctcatatctgtcagcctgtccggcaccttagcaaacaggtgtaaaaaggctcccgttaagagctgtaccgagtgcgtacgcgtggacaaagactgcgcttattgtactgacgagatgtttcgggaccggcgctgtaatactcaggcagagcttctagcagcagggtgtcaacgggagtctattgtggtgatggaaagcagcttccagatcaccgaagagactcagattgacacaacacttcgacgaagccagatgtctccacaaggacttcgggtgcgtcttaggcctggcgaagaacgacatttcgagctggaagttttcgaaccactggaaagtccagtagatttgtacatcctgatggattttagtaatagtatgtcagacgacttagataacttgaagaaaatggggcagaacctagcgagggttttgtcccaactgacatcagactacacgattggtttcggaaagttcgttgataaggttagtgttcctcaaaccgatatgaggcctgaaaagctgaaagagccgtggccgaattctgatccacccttcagcttcaagaacgtgataagcctgacagaggatgtggacgaattccgaaacaaactgcagggagaacgcatttctggcaaccttgatgcacctgaaggtggctttgacgctatcttacagacagcagtatgtacaagggatatcggatggaggccagatagtactcatctgctggtcttcagcaccgagtcagctttccactacgaggcagacggggccaacgtgctggctggcatcatgagtagaaatgatgagcgctgccacctggacaccaccgggacctacacccaataccggactcaggactaccccagcgtgcccacactggtgagactgctggctaaacataatataattcccatctttgcagtgaccaactattcttattcatattacgagaagctgcacacctattttcctgtttcttctctcggggtgctacaggaagatagcagcaacatcgtcgagttgctcgaggaggcgttcaatagaatccggtccaacctggacatcagggcgcttgactcaccaagagggctgagaactgaggtgacaagcaagatgtttcagaagacccggaccgggtccttccacattcggcggggcgaggtgggaatctaccaggtgcaattacgagccctggaacatgtcgacggaacacatgtgtgccaattaccggaggaccagaagggcaacatccaccttaaaccctcctttagcgatggtctgaaaatggacgccggaattatttgcgacgtgtgcacctgcgagctccaaaaagaggttcgcagtgcccgatgctcatttaatggcgattttgtatgcggacagtgcgtatgctccgaaggctggagcgggcagacatgtaactgctcaaccgggtctctgtcagacatccagccatgcctgagagaaggtgaagataaaccctgctcaggccggggagagtgccaatgtggacactgtgtttgctacggagagggccgatatgaaggacaattctgcgaatatgataattttcagtgcccccgcacaagtggctttctgtgcaacgaccgcggccgttgcagcatgggccagtgcgtgtgcgagcccggatggaccggcccttcctgtgactgtcccctgtccaatgcaacttgtatcgattctaatgggggtatctgcaatggcaggggtcattgcgagtgtgggagatgtcactgccatcaacagtcattgtacacagacacaatttgcgagatcaattatagcgccattcacccaggcctgtgcgaagatctgaggtcctgtgttcagtgtcaggcttgggggaccggcgagaagaaaggaaggacctgcgaggaatgcaacttcaaggtcaagatggtggacgaactgaagagggcagaggaagtggttgttcgttgtagctttagggatgaggacgacgactgcacgtatagttataccatggagggggacggagcccccggacctaacagcactgtcttagtgcacaaaaagaaggattgtccccccggctcattctggtggttaatccccctcctgctactactcctgccccttctggctctgctccttttgttatgctggaagtactgtgcttgctgcaaagcctgtctagcactactgccctgctgtaaccgaggacacatggtgggatttaaagaggatcattatatgttgcgagaaaacctgatggctagtgaccatctcgacacgccgatgcttcgctcagggaatctgaaaggtagggatgtggtgcggtggaaggtcacaaataatatgcagcgacccggctttgccactcacgctgccagcattaaccctacagagcttgtaccttacggactcagtcttcgccttgcacgcctgtgtactgagaatctcctcaagccagacacacgcgagtgcgctcagcttagacaggaagtggaagagaatttgaatgaagtgtaccgccagatctcaggggtccataagcttcagcagacaaagttcaggcaacaacctaatgcgggaaaaaaacaggaccataccatcgttgacactgttctgatggcacctcggtcagctaaaccggccctgctgaaactcaccgagaagcaggttgaacagcgcgcctttcatgatttgaaggttgcaccaggatactacaccctcaccgctgaccaagatgctcggggaatggtggagtttcaagagggcgtggaactggtggacgtacgcgtccctctgtttattaggcctgaggacgatgatgagaaacagctcctcgtcgaagccatcgatgttccagccggtaccgccactttaggtaggcggctggtgaacattacgataatcaaggagcaagctcgggacgttgtgagttttgaacagcctgagttttccgtgtccaggggtgaccaagtggcccgcatcccagttatcagacgagtgctcgacggcggcaagagccaggtttcttataggacgcaggatggtacagcccaggggaaccgggactatataccagttgagggagaacttcttttccaaccaggcgaagcttggaaggagcttcaggtgaaactgctggagttgcaggaggtggattctctcctgcgcggacggcaggtgcggaggttccatgtccaattaagcaatcccaaattcggggctcatctgggacagccacattcaactacaattattatcagagaccccgacgagctcgaccgctcatttactagccagatgctgtctagtcagcctcctccccacggcgatctgggggctccccaaaaccctaacgccaaggcggccggttcccggaaaattcattttaattggttgccaccatcggggaaacctatgggttaccgagtgaagtactggatccagggtgatagcgagagcgaagcgcacctgctggacagtaaggtccctagtgtggaattaaccaacctgtacccctattgcgattacgagatgaaagtatgcgcctatggggcccagggagaggggccatacagctcgctcgtaagctgtcgtacccaccaggaagtcccctccgaacccggacgactggcgtttaatgtcgtttcgtctactgtgacccagctgtcctgggccgaacccgctgaaaccaatggtgaaatcaccgcttatgaagtctgctatggcctggtcaatgatgacaatcgcccgatcggccccatgaaaaaagtgctcgttgacaaccctaagaatcggatgctcctcatcgaaaatttacgtgaaagccagccctaccggtacacagtgaaagcccgtaatggagcagggtgggggccggagagagaggctataataaatttggccactcagcccaaacggccaatgtctatccccatcatcccagatattccaatagtagacgcgcaatctggagaagactacgattcatttctcatgtactcagacgatgttttgaggtcgccttccggttctcagcgccctagcgtgtccgatgacaccgaacaccttgtcaatgggcgcatggattttgcctttcccggctccacgaattcccttcatcgtatgaccactaccagcgccgccgcctatgggacacatctctcacctcatgtaccacaccgggtcctttccacctcctctaccctgacccgtgattacaattcattgacaaggtccgaacattctcactcaaccactttacccagagattatagcacactcactagtgtgagttcccatggattgccacccatctgggaacacgggaggtccagactgcccctgtcttgggcactagggagcagatctagagctcagatgaaggggttccctccgagccggggcccaagggatagtatcatccttgcagggcgaccagctgctcctagctggggcccagatagtcgtcttaccgcaggggtaccagatacacccacaagattagtgttcagcgccctaggtccaacatcactcagggtttcctggcaggaacccaggtgcgaacgtccactgcaagggtacagtgtggaatatcagttactgaatggtggcgaactacataggctaaacataccgaatcccgcacagacctcggtagtcgtcgaagatttactgcccaaccactcctatgtgtttcgcgtgcgtgcccaatctcaggagggctggggccgggaacgggaaggcgtaatcaccattgagagccaagtgcatccccagtccccactgtgtcctctgccagggtccgcctttacactgagtaccccgagcgccccaggcccgctcgtctttaccgcactatccccagatagtttacagttgtcctgggagagaccgagacgcccaaatggtgacatagtcggatatttggtgacctgtgaaatggcacagggaggaggaccagccacagcattccgggtcgacggagattctcccgaaagtcggctgaccgtgcctgggttgagtgaaaatgtgccgtacaaatttaaggtccaagcgagaacaactgaaggttttggacctgaacgagaggggataatcacaatcgagagccaggatggtggtccttttccacaactaggctcccgcgcagggctatttcaacatcctctgcagtccgagtactccagcatcacaactacacacacatcagccaccgagcctttcctggtggatggactgacactgggcgcacaacatttagaggctggcgggtctcttaccagacatgtcacgcaggaatttgtaagtcgcacactgaccacttcaggcaccctttctacccatatggatcagcagtttttccagacatag

SEQ ID NO: 120783 - DNA, 1932 bp, Artificial Sequence
  Description of Artificial Sequence: Synthetic coding sequence
ggaggaattgaggagacccagatagacacaacgctgcgacgcagccagatgtcaccccagggccttagagtgcggctgcgcccaggtgaggagcggcacttcgagctggaggtgttcgagccccttgagagccccgtggacctgtacatcctcatggatttttccaactcaatgagcgatgacctggataatttaaaaaagatgggccagaaccttgctcgagtgctctctcagctgacgtcggactatacgattgggtttggaaaattcgttgacaaggtgtcagtgccccagacggacatgcgtcccgaaaaattgaaggagccttggcctaactccgatccgcccttttcctttaagaatgtgatctcgctgaccgaagatgtagacgaattccggaacaaactacagggcgaaaggatctcagggaatctagacgctcccgagggcggtttcgacgccattctgcagacggcagtgtgtacccgtgacataggatggcgccccgattctacccacctcctggtgttcagcaccgagagtgcattccactacgaggctgacggcgccaacgtcttagctggcatcatgagtcgcaatgacgaaagatgccacctagacacaactgggacctatacccagtatcgaactcaagactacccctccgtgcccactttggtgcgtctgctggcaaaacacaacattataccaattttcgccgtgactaactatagctactcctattacgaaaagctgcatacatattttcctgtgtccagtcttggtgtcctacaggaggatagttctaacattgtcgagctcctggaggaagcattcaacagaatccggtctaatttggacattagggccctggatagtccacgtggcctgaggactgaggtgacctccaaaatgttccagaagaccagaacagggtcattccacatccggagaggagaagtgggcatctatcaggtccagttgagagcactggagcatgtggatggaacccacgtttgccagcttcctgaagaccaaaaaggcaatatacatttgaaaccgagtttctctgatggcctgaaaatggatgccgggattatatgtgacgtctgtacttgcgagctccagaaggaagttcggagcgctcgctgtagtttcaatggtgattttgtgtgtgggcaatgtgtgtgtagtgagggatggtccggccagacatgtaactgctccacgggctccttgagtgacatccagccttgccttcgggaaggagaagataagccttgctccggaaggggagagtgtcagtgtggccactgtgtgtgctatggagaggggcggtacgaaggtcaattttgtgagtacgacaacttccagtgtcccaggacgagcggatttctttgtaacgatcgtgggagatgctccatgggtcagtgcgtgtgtgaaccagggtggacaggtccaagctgcgactgtcccctctctaacgcaacctgcatcgattccaacgggggaatctgcaacggccgtggtcactgcgaatgcgggaggtgccactgtcaccagcagtcattgtacactgacacgatctgcgagatcaactactcggctatccacccaggactgtgcgaagatcttaggtcatgtgtgcagtgccaggcctggggcacaggcgaaaaaaaggggcggacctgtgaggagtgcaactttaaagtaaagatggtggacgaactgaagcgggccgaggaggtggtggttagatgtagcttcagagatgaagacgatgattgcacatactcgtacacgatggagggggacggagctccaggaccaaactccactgttttggtgcataagaagaaagattgcccccctggatcattttggtggttaataccattgctgctgttactgctccccctgctggcgctctag

SEQ ID NO: 120784 - DNA, 2367 bp, Artificial Sequence
  Description of Artificial Sequence: Synthetic coding sequence
atggggattgaactgctgtgcctgttctttctgtttcttggcagaaatgatcacgtccagggcggctgtgcactggggggagccgaaacctgcgaggattgtctcttgattgggccccagtgtgcctggtgtgcccaggaaaactttacgcatccttccggggtgggggagcgatgtgacactccagcaaacctacttgccaaggggtgccaattgaacttcatcgaaaatcccgtgtcccaggtggagatcctaaagaacaagccgctgtcagtggggcggcagaagaattcctccgatattgtgcagattgccccccaatccctgattctgaaacttcgacccggaggagctcaaaccttgcaagtgcatgtcagacagaccgaggattatccggtggacctgtactaccttatggacctatccgcctccatggatgacgatctgaacactattaaggagctgggctcgcgcctatctaaagaaatgagtaaacttacaagtaattttagactgggctttggatctttcgtggaaaagcctgtgtcgccgttcgttaaaacaacaccagaggaaatcgccaatccatgtagctcgataccttacttttgtttgcccacatttgggttcaaacacattttaccactgacaaatgacgccgagcgcttcaatgagatagtgaagaatcagaagattagtgcgaatatagacactcccgagggaggattcgacgccattatgcaggcagccgtgtgcaaggagaaaatcggctggagaaatgattcactccacttactcgtcttcgtatcggatgcagactcacacttcggcatggattctaagctcgctggaatcgtgattcctaatgatggcctatgccacttagattcaaaaaacgaatactcgatgagcaccgttctcgagtaccccacaattggacagctgattgacaaattggtccagaacaatgttctgctcatctttgcggtcactcaggagcaagtgcatttgtacgaaaactacgcaaagctcatcccaggagcaacggtaggtctcctccagaaggacagcggtaacatcctccagctgatcatcagcgcatatgaagaactgcgatctgaagtggagctggaggtgctgggggacacggagggtctaaatctgtctttcactgcaatctgcaataacgggacactattccagcaccagaaaaaatgctcccatatgaaggtgggcgatactgcttcattttcagtgaccgtcaacattccccattgcgagcgtagaagccgccacattattatcaaacccgtgggcttaggagacgcacttgagcttctcgtgtcacccgaatgcaattgtgactgtcagaaggaagtggaagtcaacagctctaaatgccatcacggcaatggctcctttcagtgcggcgtgtgcgcttgtcatccggggcacatgggtccaagatgtgagtgcggcgaggacatgctgtccacagattcatgcaaggaagctccagatcacccctcttgctctggaaggggggactgttattgtggccagtgtatatgtcatctgtctccctacgggaatatttacggcccatactgtcagtgtgataacttcagctgcgtacgacataaagggctgctgtgtggcgggaatggcgattgcgattgtggcgaatgtgtatgcagatccggttggacaggtgagtactgtaactgcaccacgagtactgattcatgcgtctcggaggacggcgtactgtgttccggccggggcgactgcgtgtgcggtaagtgcgtctgtaccaatcccggtgcaagcggccctacctgcgaacgatgtcctacctgcggtgacccatgcaactctaaacgatcgtgtatcgagtgccacctttccgctgccggacaggcccgggaagaatgcgtggacaaatgcaagttggccggtgcgacaatttctgaagaagaggatttttctaaggatggatcagtctcctgctctttgcagggtgagaatgaatgtctgatcacgttcttaatcaccaccgataacgaggggaaaaccatcatacacagcatcaatgaaaaggactgccccaagcctcccaatatccctatgataatgctgggcgtaagcttggcgatcctgttgattggggtggtcctgctgtgcatctggaaattgctggtgtctttccacgatcgtaaggaggtggctaaatttgaagccgaaagaagcaaggccaaatggcagaccggtaccaaccccctctaccgcggcagcacttccacttttaagaatgtaacgtacaagcaccgagagaagcaaaaggttgatttgagtactgattgttag

SEQ ID NO: 120785 - DNA, 2367 bp, Artificial Sequence
  Description of Artificial Sequence: Synthetic coding sequence
atgggcatcgaactgttatgtttgtttttcctcttcctaggccgtaatgaccatgtacaaggaggctgcgccttggggggtgctgaaacttgtgaagactgcctcctaatcgggccccagtgcgcatggtgtgcacaggagaacttcactcatcccagtggcgtgggagaacgatgtgacactccggccaaccttctagccaagggatgtcagctgaatttcattgagaatcccgtctcgcaagtcgagatactcaaaaacaaacctctgtccgtgggccgacagaaaaactccagtgacattgtccagatcgctccccagagtcttatcctgaagctcagacccgggggcgcccagacactgcaggtgcatgttcgccagacggaggattaccctgtcgacctttactacctaatggacctatctgcctcaatggatgatgacctcaacaccattaaggagctgggaagtcgcttgtcaaaagaaatgtcaaagctaacttcaaactttcgcctgggattcgggtccttcgttgagaagcctgtgtccccattcgtcaagaccaccccagaagagattgccaatccatgttccagcatcccttatttctgcttacctactttcggcttcaagcacatcctgccccttaccaatgacgccgaacgatttaacgagatagtaaaaaatcagaaaatttcagcaaacatcgacacacctgagggcgggttcgacgccatcatgcaagccgccgtatgtaaggagaaaatcggatggagaaatgatagtctgcaccttctagtgttcgtcagcgatgctgattcccattttggtatggacagcaaactggccggaattgtcatacctaacgacgggctgtgtcatctggatagtaagaatgagtactctatgtctacagtgttagagtaccctacaatcggacagctgatcgacaaattagtgcaaaacaacgttctgctgatctttgccgtcacacaggaacaagtccatctctacgagaattatgcgaagttgataccaggggccactgtaggtctgttacagaaagatagtggaaatatcttgcagctgatcatctccgcctatgaggaattgcgtagcgaggtggaactagaagttttgggcgatacagagggactgaacctctctttcacagcgatctgcaataatggcactctatttcagcatcagaagaagtgctcacatatgaaggtgggcgatacagcttcattttctgtgacagtcaatattccccattgtgagagacgatcgcgccacattattattaagcccgtgggcctgggagatgctttggaattactggtttctcctgagtgcaattgcgattgccagaaggaggttgaggtcaattcatctaaatgccaccatggaaacgggtcattccagtgcggggtgtgtgcttgccatcctggccacatgggtccccggtgcgagtgtggggaagacatgttatctacagactcttgcaaggaggctccagatcatcctagttgtagcgggcggggtgattgttattgcggtcagtgtatttgtcacctgtctccttacggcaatatctacggaccttattgtcaatgcgataacttttcttgcgtgagacacaagggattgctatgcgggggaaacggtgactgcgattgcggcgagtgcgtctgtcgttcgggctggactggcgaatactgcaattgcacgacatccacagactcctgtgtaagcgaggatggagtgctatgcagtgggcgtggcgactgcgtgtgtggcaagtgcgtatgcaccaaccccggagcgagcggacccacctgtgaacgatgtccaacatgcggcgatccctgtaatagcaagcggtcttgtattgagtgccatttatcagccgccggacaagcgcgggaggaatgcgttgacaaatgcaagttggcaggagcgacaatcagcgaggaagaggacttctccaaagacggtagtgtctcatgctccctacagggtgagaacgaatgtctgatcacgtttctcattacgacagacaacgaagggaaaactataatacattcaatcaacgagaaggactgtcccaaacctccaaatattccaatgatcatgttaggcgtgagcctcgctatactgctgattggagtggtgctgctctgcatttggaagctcttagtttcttttcatgaccggaaggaagtagcaaagttcgaggccgaacgctcaaaagcaaagtggcagaccgggacaaatccgctctatcgtggttcaacaagtacctttaaaaatgtcacgtataaacatcgggagaaacagaaggtggatctgagtactgattgttag

SEQ ID NO: 120786 - DNA, 2397 bp, Artificial Sequence
  Description of Artificial Sequence: Synthetic coding sequence
atggtcgctttaccgatggtactggtcctgctcctggtgctgtccaggggcgaatccgaactcgacgctaagatcccatcaacaggagatgctactgaatggaggaatccccacctgagcatgttgggcagttgtcagccagccccgagctgtcagaagtgtatcctgtcacacccaagttgtgcctggtgtaaacagttgaacttcacagcctcaggcgaggccgaagctcgtcgatgcgccaggcgcgaagaactcctcgctcgtggctgcccactggaggaactggaggaaccgcgagggcaacaagaggtgctgcaagatcaaccactatcccaaggcgctagaggagagggggctacacagctagctcctcagcgggtaagagtgacattgcgccctggcgaaccgcagcagctccaggttcgcttccttcgagctgaaggctaccctgtggacttatactacctcatggacctctcatatagtatgaaggatgacttggagcgcgtgcggcagcttgggcacgctctgcttgttcgcctgcaggaggtgacacacagtgtcagaatcgggttcggctctttcgtggacaaaacagtgctgccattcgtcagtactgtaccctcaaagttacggcacccgtgtcctacacggctggagcggtgccagtcaccgtttagcttccatcacgtcctaagtttgacaggcgatgcccaagccttcgagcgagaggtgggacgtcaatccgtgagcggaaatcttgactcgcctgaagggggttttgatgccattctgcaggctgccttgtgccaggagcagataggctggaggaacgtttctcggctgttggtatttacttccgacgacactttccacaccgccggagatgggaagctcggcggcatattcatgccatctgacggacattgccacctggattcaaacggcttatattcccgatctacagagttcgattaccccagcgtgggccaggtggcccaggcactgagtgcggccaatatccagccaatttttgcagttacaagtgctgcgctacccgtgtatcaggagctgagtaagctgatcccaaagtcagcagttggggagctgtctgaggatagcagcaacgtggttcagctcattatggacgcatataactcgctatcctcaacagttacgttagagcatagtagcctgccccccggcgtgcacatctcctacgagtcacaatgcgagggccccgaaaagagagaagggaaggccgaagatcggggacagtgcaaccatgtgagaattaatcaaacggtcactttttgggtttctctccaagccacacattgtttgcccgaacctcacttactgaggctcagggcccttggcttttcagaggagctgatagtcgaactgcatacactttgcgattgtaactgctctgatactcagccccaggcaccgcattgtagcgacgggcaggggcatctgcagtgtggcgtatgcagctgtgctccaggccgactcgggagactctgtgagtgcagcgtggcggagctctcgtctccagacttagagagcggatgtcgggcacccaacggcacaggacctctatgcagcgggaaaggtcactgccaatgcggccgttgttcctgctccggccagtcttccggccacctctgcgaatgcgacgacgcgagttgcgagaggcatgagggcatcctctgcggaggtttcggtcggtgtcaatgtggggtgtgccattgccacgcaaaccgcactgggcgtgcatgtgagtgttctggggatatggactcatgcatttcccctgaggggggtctctgctccgggcatggccgctgtaagtgcaaccgatgccagtgtctggatggatattacggcgcactgtgcgaccagtgcccggggtgcaagacaccatgtgaacgacacagagattgtgcggagtgtggggccttccgcaccgggccgctggcaaccaattgctcaacagcatgcgcacacacaaatgtaactctcgcgttagctccaatactggacgatggctggtgtaaggaaagaactctggataaccagctgttcttcttcctggtggaggacgatgctagagggacagtggttctccgcgtgcggccacaagagaaaggggccgatcacactcaggccatcgtgctgggatgcgtgggagggatcgtggccgtcggactgggactggtgcttgcctacagattaagtgtggagatctacgatcggcgcgagtactcgcggtttgagaaagaacagcaacagttgaactggaaacaggatagtaaccccctgtataagtccgcaataactaccaccattaacccaagatttcaagaggccgattcccccactctctag

SEQ ID NO: 120787 - DNA, 1953 bp, Artificial Sequence
  Description of Artificial Sequence: Synthetic coding sequence
atggtggcgctgccaatggtgctagtactgttattagtcttgagccggggagaatccgagctggatgccaagatcccctcaacaggtgacgcaacggaatggcgaaaccctcacctctccatgctggggtcatgccagcctgctccttcatgtcaaaaatgtattctgtctcatccatcgtgcgcttggtgcaagcaactgaattttaccgccagtggcgaagccgaagcccgaagatgtgctaggagggaggagctgttggcccgcggatgccctctggaagagttggaagaacccagggggcagcaggaggtgctgcaggaccagccgctttcccagggagcacgtggggaaggggccacacagctggcacctcaaagggttagggtgacactgcgccccggcgaacctcagcaactgcaagtgcggttcttgcgagctgagggctaccccgtggatctctactacctaatggacctttcttactcaatgaaggatgacctcgagagagtacgccaattgggacatgcacttctggtgcgattgcaagaggtgacccacagcgttcgcatcggattcggttcttttgtcgacaagaccgtcttaccttttgtcagcacagtgccatctaaactcagacacccgtgccctaccagactcgagaggtgccaaagccccttctcatttcaccacgtcctatctttgacgggtgatgcccaagccttcgaacgcgaggtcgggagacaatccgttagcggcaacttggactcccccgagggcggcttcgatgctatcctccaggccgccctgtgtcaggaacaaatcggatggcggaacgtctctaggcttcttgtgtttacatcagatgacacatttcacactgccggggacggtaagcttggtggtatattcatgcctagcgacgggcactgccacttagactccaacggcctctactcacgttcaacagagttcgattatccttcagtgggacaggtggcacaggctctgagcgccgccaatatccagcccattttcgccgttacaagcgctgcactccctgtataccaagaactcagcaaattaattcccaaatctgccgtgggggagctgtccgaggactctagtaatgttgtccaactaattatggacgcttacaacagcctttcaagcaccgtaactctggagcattccagcctgcccccaggcgtgcatatttcttatgagtcccagtgcgaaggaccagagaaacgcgaagggaaggctgaggatcgcgggcagtgtaatcatgtgcggatcaaccagacagtcacgttttgggtgtcgctgcaggccacgcactgccttccagaaccccacctgctgcgattaagagcccttggcttttcagaagaactgattgtggaactccacaccctgtgcgactgtaattgttccgacacacaaccacaggctccccattgttccgatgggcagggccacctacagtgcggtgtgtgtagagattgcgcagaatgtggcgctttcaggacaggccctttagcaactaactgcagcaccgcctgcgctcatactaacgtgacgctagcccttgcacctatactcgatgatgggtggtgtaaagagcgtacactcgacaatcagctctttttctttctggtagaagacgacgccaggggcactgtggtgctgagagtgcggccccaggaaaagggagctgatcacacacaggcaatcgttttaggttgtgtagggggcatcgttgcagtgggccttgggctggtgctcgcctaccggctgtctgtggaaatctacgatagacgggagtacagtagatttgaaaaggaacagcagcaactgaattggaagcaggattcaaaccccctgtacaagtcggccatcacaaccacgattaacccacggttccaggaagccgacagcccaactctgtag

SEQ ID NO: 120788 - DNA, 2397 bp, Artificial Sequence
  Description of Artificial Sequence: Synthetic coding sequence
atggtagcgctgcccatggttttagtgctcctactagtgcttagccgcggcgagagcgagctggacgcgaagatcccctcaacaggtgatgccactgaatggcgaaacccccacctgtccatgctcgggtcttgtcagcccgccccatcatgccaaaaatgtattctcagccacccttcctgcgcctggtgcaagcagcttaacttcacggcttcaggcgaggccgaagctagacggtgtgcccggagggaagaactactcgcccgcggatgcccactcgaagaactggaagagccacgcggccaacaggaagtgctacaggaccagcccttaagccagggagcacgtggcgaaggagcaacacagttggctcctcagagagttagagttaccttgagacctggcgaacctcagcagctgcaagtgagattcctcagagccgagggctatcccgtggatctgtattaccttatggatctgtcttatagcatgaaggacgacctcgagagggtccgacagctgggacacgctctcttagtgagactccaggaggtaactcacagcgtgcgcattgggtttgggtccttcgtagacaagacggtgctgccctttgtcagcacagtcccctccaaactgaggcacccatgtcccacccgactggagagatgccaaagcccattctctttccaccacgtactgagcttgacgggcgacgctcaagccttcgaacgcgaggtgggccgccaaagcgtctctgggaacctggatagtcccgagggcggatttgatgcaatcctgcaggcagccctctgccaagaacagattggatggaggaatgtgagccgactactggtattcacctccgatgacacattccacaccgctggagacgggaaacttggggggatttttatgccttctgatggacactgtcatcttgactccaacggcctctacagcaggagtaccgaattcgactatccaagcgtggggcaggtagcccaagctttgagcgcagcgaacattcagccaatctttgctgtcacctctgccgctttgccagtgtatcaagaactgagtaagctgattcccaaatccgccgtgggagagttgagcgaggattcttctaacgtcgtgcagttgatcatggacgcctacaactccttatctagcacggttactctggaacattcaagcctgcctccaggtgtccacatctcctatgagagccagtgtgagggccctgaaaagcgggagggaaaggctgaggacagggggcaatgtaaccacgtaagaattaatcaaactgtgacattttgggtgtctcttcaggcgacccattgcctccccgaacctcatcttctgaggctgcgtgccttaggcttcagcgaggagctcatagtggaactgcatacactttgtgactgcaactgctcagatacccaaccccaagcgccacattgctctgacggccagggacacttacaatgtggagtatgcagttgtgcccccggaaggctagggcgcctttgtgaatgttccgtggctgaactcagttctcccgatttagagtccggctgcagggctcccaacggcacaggtcctctgtgctcgggcaaagggcattgccaatgtgggcgatgctcatgttcagggcagtcttcaggtcacctctgcgaatgcgatgacgccagctgtgaaagacacgagggaatcctctgcggtggattcgggcggtgccaatgcggggtctgccactgtcatgccaacaggactggccgcgcctgcgagtgttcaggtgacatggattcttgcatctctcctgaaggcggtctttgctccggtcatggccggtgcaaatgtaataggtgccaatgcttagacgggtactacggggccctgtgtgaccagtgtcccggctgcaagacaccatgtgagcgccatagggactgtgcagagtgtggggccttccgtacaggaccgctggcaacaaactgcagcacggcatgcgcccacacgaatgtgactctagctcttgccccgatcctggatgatggatggtgcaaagaacgcactctagataatcagctctttttttttctagtcgaggacgacgccaggggcactgtagtgctcagagtaagacctcaggagaagggggccgaccatactcaagcgattgtgctggggtgtgttggcggtatcgtcgcggtaggcctggggcttgtcctggcctataggctttctgtcgagatatatgaccgacgcgagtatagtagattcgagaaagagcagcagcagctgaattggaagcaggatagtaaccctctctataagagtgccattactacaacaatcaatccaagattccaggaagccgatagccccaccttgtag

SEQ ID NO: 120789 - DNA, 1206 bp, Artificial Sequence
  Description of Artificial Sequence: Synthetic coding sequence
atgaacctcgtcgccgttatgggagcttttaacaaaggtcacggtaagtgtgattgtggcaagtgcaaatgcgaccagggctggtacggagatgcttgccaataccccacaaattgcgatttgacaaagaaaaagtcgaatcagatgtgcaagaactcccaggacataatttgctcaaatgctggtacttgccactgcggacggtgcaaatgcgacaacagcgacggtagtggcctggtgtatgggaaattttgtgagtgcgatgatcgcgagtgcatagacgacgaaactgaggaaatttgtggaggacatggcaaatgttattgcggtaattgctactgcaaagccgggtggcacggggacaaatgtgagtttcagtgtgacatcaccccttgggaatcaaaaaggcgatgcaccagtcctgatggcaagatttgtagtaataggggcacgtgcgtgtgcggcgagtgcacttgccatgacgtggatcccactggcgattggggtgacatccacggcgatacttgtgaatgcgatgagcgggattgcagagctgtttacgaccggtatagcgacgacttctgctcaggacatggtcagtgtaattgcggccgctgtgattgcaaggctggttggtacgggaagaagtgtgaacacccacagtcgtgcaccctatcagctgaggagagtattaggaaatgccaaggtagctccgacctcccctgctctgggcgcggaaagtgcgaatgcggaaagtgtacctgctatcctcctggcgaccggagagtctacggtaaaacgtgtgagtgtgatgatcggcggtgtgaagatcttgatggtgtggtctgcggtggtcacggcacatgcagctgtggcaggtgcgtttgcgaacgcggatggttcggcaaattatgccagcatcctaggaagtgtaatatgacggaagaacagtcgaagaatctgtgcgagagtgccgatggcattctgtgttcgggcaaggggagctgccattgcgggaaatgtatctgctccgcagaggagtggtacatctcaggcgagttctgcgattgtgatgacagggactgtgacaagcacgacggcttgatttgcaccgggaatggtatttgctcctgcgggaattgtgagtgctgggatggctggaacggcaacgcttgcgagatttggctggggagcgagtacccgtag

SEQ ID NO: 120790 - DNA, 1485 bp, Artificial Sequence
  Description of Artificial Sequence: Synthetic coding sequence
atgcggccgccaggttttaggaacttcctcctgctggccagcagtctcctgtttgccggcctgtccgccgtgccccagtctttcagcccctcgctccgctcttggcccggggctgcttgtaggctgtcaagggccgaatccgaacgaaggtgccgcgcccccggacagccaccgggagccgctctctgtcacggaagaggacgatgtgactgcggggtttgcatttgtcacgtgactgagcctgggatgttcttcgggcccctgtgcgagtgtcacgagtgggtctgtgagacgtacgacgggagtacctgtgcgggtcacggtaaatgcgactgtgggaagtgtaaatgtgaccagggctggtacggtgatgcctgccagtatccaactaattgtgaccttacaaagaaaaagtccaatcaaatgtgtaaaaatagccaggatatcatttgcagcaatgctggaacctgccactgtgggcgatgtaaatgcgataactccgatgggtccggcctggtctatggcaaattttgtgaatgtgacgatagagaatgcatcgacgacgagacagaagagatctgcggagggcatggcaaatgctactgcggaaactgctattgtaaagctggatggcacggagataaatgcgagttccagtgtgacattactccctgggagagcaaacggcgctgcacctccccagacgggaagatttgtagcaacaggggcacctgcgtgtgtggagaatgtacatgccacgacgtggaccctacaggcgactggggggacattcacggggacacttgcgagtgcgatgaacgtgattgtagagcggtttatgataggtactccgatgacttttgctctgggcatgggcaatgcaactgcggacgctgcgattgcaaggctgggtggtacggcaaaaagtgcgagcatcctcagtcttgcaccctgtcagccgaagagtctatcagaaagtgccagggcagcagtgacctcccttgtagtggccggggtaagtgcgagtgtgggaaatgcacgtgctacccacctggagatcgccgcgtttatgggaaaacctgcgagtgtgatgatagacgttgcgaggacttggatggggttgtgtgcgggggacatggcacttgcagttgtgggaggtgcgtgtgcgagcgaggctggtttgggaagctttgtcaacaccccaggaaatgtaacatgacagaagagcagagtaagaatttatgtgagtctgctgacgggatcctttgctccgggaaagggtcttgccactgtggtaaatgtatttgttcagccgaagagtggtacatcagcggcgagttctgtgactgcgacgatagggactgtgataagcatgacgggttgatttgcacaggtaacggcatatgttcttgcggcaactgtgaatgctgggatggctggaacggcaacgcctgcgagatctggctgggaagtgagtatccgtag

SEQ ID NO: 120791 - DNA, 1209 bp, Artificial Sequence
  Description of Artificial Sequence: Synthetic coding sequence
atgtcgggctgtgcccgcccaactaccggtgcacccgtccaagctatggtgtccgtcaccggcaaatgtaaatgcgatcagggctggtatggagacgcatgtcagtaccctacaaattgtgatttaactaagaagaaaagcaaccagatgtgtaagaattcacaggacattatctgctccaacgctggaacatgccattgcggtcgctgtaaatgtgacaactccgacggtagcggcctggtctatggtaagttttgcgaatgtgacgatcgggagtgcatagacgatgagaccgaagaaatttgcggcgggcatggcaagtgttactgtggaaactgttattgtaaagccgggtggcatggtgataaatgcgagttccagtgcgatattaccccatgggagtcaaaacgtcgatgcacatcgccagatggcaaaatttgtagcaatcgcggtacttgcgtttgtggagagtgcacctgtcacgatgtcgaccccaccggggactggggcgacattcatggagatacttgcgaatgtgacgagcgcgattgcagagctgtttatgacaggtatagcgatgacttctgttccggtcacgggcagtgtaattgcggccggtgcgactgtaaggctgggtggtacggcaagaaatgcgagcaccctcagtcttgtaccctgagcgcagaggaatcgatccgcaagtgccagggcagctcagaccttccttgctcggggagggggaagtgcgaatgtggcaaatgtacatgttatcctcctggagatcggagggtgtatgggaaaacttgcgaatgcgacgaccggaggtgtgaggacctcgatggagttgtctgcggcggccacggtacatgttcttgcggccgttgcgtgtgtgagaggggctggttcggtaaactctgtcagcatccgcgaaagtgcaatatgaccgaggagcagtctaagaacttgtgtgaaagtgcagatgggatcctgtgcagcggaaaggggagctgccactgtggaaaatgcatatgcagcgccgaggaatggtacatcagcggcgaattttgtgactgtgatgaccgagactgtgacaagcacgatggtctcatttgtaccggcaatggcatctgttcttgtggcaactgcgagtgctgggacggttggaacggcaatgcatgtgagatttggctgggctctgagtatccttag

SEQ ID NO: 120792 - DNA, 1062 bp, Artificial Sequence
  Description of Artificial Sequence: Synthetic coding sequence
atgtgtaaaaacagccaggacatcatttgttccaacgccggaacctgtcactgcggccgctgcaaatgcgacaattccgatgggagtggccttgtttacggcaaattttgtgagtgcgatgatcgggaatgcattgacgacgaaacagaggaaatatgtggcggccatggcaagtgttactgtggcaactgctattgtaaggccggatggcacggggacaagtgcgaattccagtgcgatatcaccccgtgggaaagtaaaaggaggtgcacgtcacccgatggcaaaatttgtagcaataggggtacttgcgtatgcggggagtgcacgtgccatgacgtggacccaaccggagattggggggatattcacggtgacacgtgcgagtgcgacgaacgggactgccgcgcagtttacgacagatacagcgatgacttctgttcagggcatggacaatgcaactgcggcaggtgtgattgtaaggccggatggtacggcaaaaagtgcgaacacccccagtcctgcacattatcggcggaggaatccatccgtaaatgccagggttctagcgacctaccatgcagcggaagggggaaatgcgaatgcggcaaatgtacctgttaccctccgggggatagacgcgtgtacggaaaaacatgtgagtgtgatgatcggcgatgcgaggacctggacggtgtggtgtgcggcggacacggcacctgctcttgcggccgctgtgtatgtgagcgtggctggtttggcaagctttgccaacatcctagaaaatgcaatatgactgaggagcaatccaagaatctgtgtgagtctgccgatggaatcctgtgcagtgggaagggatcttgccattgtggtaaatgtatctgctctgcagaagagtggtatatttccggggagttttgcgattgcgatgaccgagattgcgacaaacacgacgggcttatctgtacgggcaatgggatatgctcatgcggcaattgcgagtgctgggatggttggaatgggaacgcatgtgagatctggcttggcagcgaatacccatag

SEQ ID NO: 120793 - DNA, 1062 bp, Artificial Sequence
  Description of Artificial Sequence: Synthetic coding sequence
atgtgcaaaaactcacaagacatcatttgttctaacgcaggcacctgtcactgtggcagatgcaaatgcgacaactctgatgggtctggactggtatatggtaaattttgcgaatgtgacgatcgagaatgcatagacgatgagaccgaggagatctgcggcgggcacgggaaatgttactgcggaaactgttactgcaaggctggctggcacggggacaaatgtgaattccagtgcgacatcacaccctgggagtcaaagaggaggtgtacttcaccggatggcaaaatttgttccaatagaggtacctgtgtatgcggagagtgtacatgccatgacgttgacccaaccggggattggggagacatccatggtgatacctgtgaatgcgacgaaagagactgcagggcagtgtacgatcggtactcagatgacttctgttctggccacggccagtgtaactgtgggcgatgcgactgtaaggccgggtggtacggcaagaagtgcgagcacccacagtcctgcactctcagtgccgaggaatccattcgtaagtgccagggttcttcagacttgccgtgttcaggcagggggaagtgtgagtgcggaaagtgcacgtgttatcccccaggtgatcggagagtctatggtaaaacctgcgagtgcgacgaccggaggtgtgaggatctggacggagtcgtatgtggaggccatggaacatgttcatgtggaagatgcgtgtgtgagagagggtggtttggaaagctgtgtcagcacccccggaaatgcaatatgacggaagaacaaagtaagaatctttgtgaatcagccgacggtatcctgtgtagcggaaagggctcctgtcactgcggtaaatgcatctgtagcgccgaggagtggtacatcagcggcgagttttgtgactgcgatgacagagactgcgataaacacgatggtcttatttgtactggaaatggcatttgttcgtgcggcaattgcgagtgttgggatgggtggaatggaaacgcatgtgaaatatggttgggcagcgaatacccatag

SEQ ID NO: 120794 - DNA, 903 bp, Artificial Sequence
  Description of Artificial Sequence: Synthetic coding sequence
atggcgaattgtgaattctcacctgtatcgggcgataagccatgctgtcggctgtctcggcgggcgcagctgtgtctgggcgtgtccattcttgtcttaatactggtcgtggtgctcgctgtggttgtgcccagatggaggcagcagtggtccgggcctggcacaacaaagagattcccagagaccgtattggcccggtgtgttaagtacacagagatccaccccgagatgcggcatgtggactgccagtccgtgtgggacgccttcaagggcgccttcatttccaagcatccgtgtaacataacagaagaagactatcagccgctaatgaagctcggaacccagacagtgccctgcaacaaaattctgctgtggtccaggataaaggacctggctcaccaattcacacaggtacagagggacatgttcaccctggaagatacactgctgggttacctggcggacgacttgacatggtgcggagaatttaacacctcaaagatcaattatcagagttgtccagactggcgtaaagactgtagtaataatccggttagtgttttttggaaaacagtttctagaaggtttgccgaggctgcatgcgatgtcgtgcatgtgatgctcaacggctctcgatccaaaatcttcgataagaactctaccttcggcagcgtggaggtgcacaacctgcagccggaaaaggtgcagaccctcgaagcatgggtgattcatggggggagagaagattcccgcgatctctgtcaggaccccaccattaaggagctggagagcatcatttctaaaagaaacattcagttcagctgcaagaatatttacagacctgacaagttcctgcagtgtgtgaaaaatcccgaagatagcagctgtaccagcgagatctag

SEQ ID NO: 120795 - DNA, 942 bp, Artificial Sequence
  Description of Artificial Sequence: Synthetic coding sequence
atgaatcagctttcgtttctgctgttccttatcgccaccactagagggtggagtactgacgaggcaaatacgtacttcaaagaatggacctgctccagctcaccctctctccccaggtcatgcaaggagattaaggacgagtgtcctagcgctttcgacgggctatattttctgcgaacagaaaacggggttatctaccagaccttctgcgatatgacaagtggtggaggagggtggacccttgtggcttctgtccacgagaatgatatgcgcggaaaatgtaccgtgggagaccggtggtcatcccagcagggcagtaaggccgtctatccagagggcgatggcaattgggctaattataacacttttggatccgccgaagccgctacatccgacgactacaagaacccgggctattacgacattcaggccaaggatctgggtatttggcatgtgcctaacaagtccccgatgcagcattggcggaactccagtctcctccggtaccggactgatacaggtttcctgcaaaccctggggcacaacttgtttggcatctaccaaaagtaccctgtgaagtatggcgagggaaagtgctggaccgacaatgggcccgtgatcccggtcgtttatgattttggtgatgcacaaaaaactgcatcctactactccccttatggccagagggagttcacagctgggttcgttcagtttagggtgttcaacaatgagcgcgctgccaacgccctctgcgcgggaatgcgggtcaccggatgtaatactgagcatcactgcatcggtggtgggggatactttcctgaggcttctcctcagcagtgcggtgacttctccggtttcgattggtcagggtatggcacccacgtgggttatagcagcagccgggaaatcacggaggctgctgtgttactcttttatcggtag

SEQ ID NO: 120796 - DNA, 978 bp, Artificial Sequence
  Description of Artificial Sequence: Synthetic coding sequence
atgctctcaatgctgcgcaccatgaccagattgtgttttctgctgttctttagcgtggcaacttctggatgtagtgccgcagctgcctctagtctcgaaatgcttagcagggaattcgagacttgcgcattttcattcagttccttgccgcgtagctgcaaagaaatcaaggagcgatgccattctgcaggcgacgggctgtatttcctgcgaactaagaatggggtagtgtaccaaaccttctgtgacatgacctccggtgggggtggctggactttagtcgcttcagtccacgagaacgacatgcgcgggaagtgtaccgtaggggaccgctggtcttcgcagcaaggcaataaggccgattaccctgagggcgacgggaactgggccaattacaataccttcgggtccgcggaggctgcaacctcagatgattacaaaaatcccggatactacgatatccaggccaaggacctgggcatttggcacgtccctaataaatcgcccatgcagcactggcggaatagcgctttgttgaggtacagaaccaacacgggtttcctccagagactcggacacaatctctttggcatttatcagaagtaccccgttaaatataggtcggggaagtgttggaacgataatggtcctgcaataccagtcgtgtatgatttcggcgacgcaaagaaaactgcctcctattactccccttacggccaacgggagtttgtggcgggtttcgtgcaattccgagtcttcaataatgaacgagccgctaatgcattgtgtgcgggtatcaaagtgacaggttgtaacactgaacaccactgcatcggaggcgggggcttttttccccagggaaaaccaaggcagtgtggcgacttctctgccttcgactgggatggatacggcacccacgtgaaaagttcgtgcagtcgtgagatcacagaggctgctgtcctgcttttctatcggtag

SEQ ID NO: 120797 - DNA, 2736 bp, Artificial Sequence
  Description of Artificial Sequence: Synthetic coding sequence
atggatggggcaatgggccctaggggactcctgctctgcatgtacctggtgtctctgttaatccttcaagcaatgccagcactgggtagcgcgaccggccgctcaaagtcttctgagaagcgtcaggccgtggacactgctgtggatggcgtgttcattcgaagcctcaaggtgaattgtaaggtaacatctaggttcgcccattacgtggtgacatcgcaggtcgtgaatactgccaatgaggctcgcgaggttgcgttcgatctggagatcccgaaaactgcttttatttccgattttgctgtaaccgccgatggaaacgcctttatcggtgatatcaaggacaaggttacagcctggaagcagtacaggaaagccgcaatctccggagaaaatgctggactggttcgagcgagcgggcgcaccatggagcagtttaccatccatctcacagtgaatcctcaatccaaagtgacctttcaactcacttacgaagaggtcttaaagcggaaccacatgcaatacgagattgtgataaaagttaaaccaaagcaactggtacaccacttcgagattgatgtggatatattcgagccgcagggtatttcaaagctggatgctcaggccagtttcttacctaaagagctagcagcccagacaatcaaaaagagcttctccgggaagaaaggccatgttctgttcaggcccaccgtgtcacagcaacaatcttgtcccacatgctccacttctctgctaaatggacattttaaggttacatacgacgtaagtagggataagatctgcgacctccttgtggccaacaaccattttgcgcatttctttgccccgcagaacttaactaatatgaacaagaatgtagtcttcgtgattgatatctctgggagcatgcgaggccagaaggtcaagcagacgaaagaagcacttcttaaaatactgggagatatgcagcctggggactactttgaccttgtgctctttggaactagggtgcaaagctggaaagggtcgctggtgcaggcctctgaagcgaatctgcaagccgcgcaggatttcgtccggggattctccttagacgaggcaaccaatctaaatgggggtctactgagggggatagagatcctgaaccaggtgcaggagagtctgcccgagctcagcaaccatgcttcgatcctcattatgctgacagacggcgaccccaccgagggcgtgacagacagaagccagatactcaagaacgtcaggaacgccattaggggccgcttcccattatacaatttaggatttggacataacgtcgatttcaatttcctcgaagtgatgtcgatggagaataatggtcgggctcaacgaatctacgaagaccacgacgcaacacagcagttacaaggtttttattcgcaggttgccaagccactgttagtggacgtggacttacagtacccgcaagacgccgttctggcacttacccagaatcatcacaagcagtactatgagggctctgagatagtcgttgccggccgaatcgccgacaataagcagtcctcattcaaagccgatgtgcaggcccacggagagggtcaggaattcagcatcacgtgcctcgtggacgaggaagaaatgaaaaagctcttacgggagcgcggccacatgttggaaaaccacgtggaaagattgtgggcttacttaaccatccaggaactgctggcaaagcgcatgaaagtagaccgggaggagcgcgccaatttgagctcccaagccctgcagatgtccctcgactatggcttcgtgactccattaaccagcatgtcaataaggggtatggcagatcaggatggcctcaaacctacgattgataagccgtctgaagactcaccaccgctcgagatgctgggtccccgccgcacctttgtgttgagcgcgttgcaaccttcccccactcactcttcatctaatacccagaggctgcctgaccgggtcaccggcgtcgacactgaccctcatttcattattcatgtgcctcagaaggaggacaccctgtgctttaatattaacgaggagcctggcgttatcttaagcctcgtccaggacccaaatacgggctttagcgttaatggccagttgattggcaacaaagcaagaagccctggtcagcatgatggcacttattttggccgactggggatcgccaaccctgccacagactttcagctggaggtgacccctcagaacatcacgctcaacccgggattcggaggccctgtgtttagttggcgggatcaggcagtactgcggcaggacggggtagttgtgactataaataaaaaaagaaacttggtagtgtcagtggacgacggaggcacttttgaggtggtgctgcatcgcgtttggaaggggtcatccgtccaccaggacttcctgggattctatgttttggattctcatcggatgagtgcccgcacccatggcttgctgggtcagttttttcatccaatagggtttgaggtgagtgacatacacccagggtcggatcccaccaagccagatgccacaatggttgttcgcaatcgtagactcaccgtaaccaggggtctccagaaggattactccaaggacccatggcatggcgcggaggttagctgctggttcatccacaacaacggtgccggattaattgacggagcctatactgactacattgtgcccgatatcttctag

SEQ ID NO: 120798 - DNA, 1872 bp, Artificial Sequence
  Description of Artificial Sequence: Synthetic coding sequence
atgaacaaaaacgtggtctttgttatagacatcagtggctccatgcggggccagaaggtgaagcagacaaaagaggcactgttgaagattttgggcgatatgcagccaggcgactatttcgatcttgtcctgttcggtactagagtccagagctggaagggctctctggttcaggcaagcgaagcgaatttgcaggcagcccaggattttgtgcgggggttttctctggacgaagcaacgaatctgaatggcgggctgctcagaggaatagaaattcttaatcaagtgcaggaatcactgccggaattgtccaatcacgcaagtatcctgatcatgttaacagacggtgaccccacagagggagtaacggatagaagccagatcctcaagaatgtcaggaatgcaataagaggacggttcccactctataacctgggatttggacataatgtggactttaactttctggaggtcatgtcaatggagaataatgggcgggctcagagaatatatgaggaccacgatgctactcagcaactgcagggcttctatagtcaggtggctaagccgctgctggtcgatgttgacttacagtatccgcaggacgcagtgttggccctcactcaaaatcaccacaaacagtactatgaggggtctgaaattgtagtcgccggcaggatcgctgacaataagcaatcttctttcaaggccgacgttcaggcccatggcgagggccaggagttcagtatcacatgcctggtggacgaagaggagatgaaaaaactgttgagagagaggggacacatgctagagaaccacgtggaaaggctttgggcttacttaacaatccaggaattactcgcgaaacgtatgaaggttgacagagaggagagggccaatctgagcagtcaagccctgcagatgagcttggattatgggtttgttaccccattaacctctatgtccatccgcgggatggccgaccaggatggtctgaaaccaacaattgataagccgtccgaggatagcccaccattggagatgctgggcccgcggcgtacatttgtcctgagtgcactgcaaccctctccgacgcactcatcaagcaatacacaacgcctccctgatcgcgttacaggcgtcgatactgacccccactttattatccacgtgccacagaaagaggatacgctgtgctttaacatcaacgaggaacctggggttatcttgagcctcgtgcaggatcccaatacagggtttagtgtcaatgggcagctcatagggaacaaggcgcgctcccctggccaacacgatgggacttattttgggaggttagggattgccaacccggccacagactttcagctagaggtaacaccccaaaatatcactctgaaccctggcttcggagggccagttttttcctggagggatcaggccgtgctacgacaagacggtgtcgtggttacaatcaacaagaaaagaaatctagttgtgtccgtcgatgatggtgggacgttcgaagttgtgctgcacagagtgtggaaaggatcctcggtgcaccaggacttcctgggattttatgtgctggacagccatcgtatgtccgccagaactcatggcttattgggtcagtttttccatcctataggtttcgaagtatctgacatccatccaggatccgacccaactaagccagatgctacaatggtggtgaggaatcgccgtttaacagttacccgcggactccagaaagattatagtaaggatccttggcacggggccgaggtctcctgttggttcattcacaataacggggcaggacttatcgacggggcatatacagattacatcgtcccggatatcttctag

SEQ ID NO: 120799 - DNA, 2310 bp, Artificial Sequence
  Description of Artificial Sequence: Synthetic coding sequence
atggaacagttcaccattcacctaacagtcaatcctcagagcaaggtcacctttcagttgacgtacgaagaagtgctcaaaagaaaccatatgcagtacgagattgtcatcaaagtaaagccgaagcagctggtgcaccatttcgagattgacgttgatatttttgagcctcaagggatatctaagctggacgcacaggcctcattcttacccaaagagttggcagcgcaaaccatcaaaaagtctttttcaggtaaaaaggggcacgtcctattccgccctaccgtgtcacagcagcaatcatgtcctacatgctccaccagccttctgaacggccattttaaagtcacctatgacgtgtccagggacaagatttgtgacctgctagtcgccaacaatcactttgcacacttcttcgcccctcagaatctgacgaatatgaacaagaatgtggtattcgtgattgacatttctggatccatgcggggacaaaaggttaagcagacaaaagaggcactcctgaagatcctcggggacatgcagcctggagactacttcgacctcgttctctttggtactagagtgcagtcatggaagggctcattagtgcaggcctctgaggcaaatttgcaggcagctcaggactttgtccgtggattctccttggacgaggccaccaacttaaatggaggactgctcagggggattgagatcctgaaccaagtgcaggagtccctgcccgagctcagcaaccatgcctcaattctcatcatgctaacggacggcgaccctaccgagggggtcacagaccgctcccagattctgaagaacgtcaggaatgcaattcgagggcggttccccttgtacaatctggggttcggccacaacgtggatttcaactttctcgaagttatgagcatggaaaacaacgggagagctcagcgcatttacgaagaccatgacgctactcaacagctccaggggttctattcgcaagtggccaagcctttgctagtggatgttgaccttcagtatccgcaggacgctgttttagcactgacacagaaccaccataaacagtattatgaaggaagcgaaattgtggtggctggccggatcgccgacaacaagcagagctcgtttaaggccgatgttcaggcccatggtgagggccaagagtttagcataacttgtctagtagacgaggaagagatgaaaaaactgctgcgggagaggggtcatatgctagaaaatcacgtcgagaggctctgggcttacctgacgatccaggagctcctggccaaaaggatgaaggtcgacagagaagagcgagccaacctgtcctcccaggcgttgcagatgtctctggactacgggtttgtgacaccgctcaccagcatgtctattagaggaatggcagaccaggacggactcaagccgactatagataagccatctgaggacagtcctcctcttgaaatgctcgggcctcggaggacatttgtgctatctgcgctgcagccctccccaacacatagctccagtaacactcagagactgcctgatcgcgtgaccggagtggacacagatccccatttcataattcacgtgccccagaaagaagacactctgtgcttcaatatcaatgaggagccaggcgttatcctctccctcgtacaagatcccaacaccggattttccgtaaacggccagttgattgggaacaaagctcgatctcctggtcagcatgacggcacatactttggtcgcttggggatagccaatcccgccacagattttcagctcgaggttacacctcagaacatcaccctcaatcccggatttggcgggcctgtgttctcctggagggatcaggccgtgctgcggcaggacggtgtggtggtaacaattaacaagaaaaggaaccttgtggtcagtgtggatgatggagggactttcgaagttgtcctccacagagtgtggaaggggtcctcagtgcatcaagactttctgggcttttatgttctcgacagtcacaggatgtccgcaagaacgcatggcctcctcggtcagtttttccaccctatcggatttgaagtaagcgatatacaccctggctcagatcccaccaagcccgacgcaaccatggtggtccgcaatagacggctaactgtcacacggggcctccagaaggattattccaaagacccttggcacggagccgaggtgtcctgctggtttattcacaacaatggggcagggctgatcgacggagcctacaccgactacattgttccagacatcttctag

SEQ ID NO: 120800 - DNA, 1938 bp, Artificial Sequence
  Description of Artificial Sequence: Synthetic coding sequence
atggacggcgccatgggccccaggggcctgctcctgtgcatgtaccttgtcagtctcctgatcctccaagctatgcctgccctgggaagtgcaaccggccggtcaaagagctctgagaagaggcaagccgtggacaccgcggtagacggggttttcataaggagtttgaaagtaaattgcaaggttacgtctcgttttgcccactacgtggtcaccagtcaggtggtcaatactgccaacgaggccagggaggttgccttcgacctggagattcctaagactgcttttattagtgatttcgctgtgacggcagacggcaatgccttcatcggcgatatcaaagataaggtcactgcatggaaacagtaccgaaaagctgctatcagcggcgagaatgcaggcctagtgagggccagtgggcgcacgatggaacagtttaccatccatctaactgtgaacccacaatctaaggtaacttttcagctaacgtacgaggaagtactgaagcgtaatcatatgcagtacgagatcgtgatcaaggtcaaacccaagcagctggtgcaccatttcgaaattgatgtcgacatctttgagccacagggcatctccaagctggatgctcaagcttctttcctgcccaaggaactggcagctcagactattaagaagagcttcagtggaaaaaaggggcacgttctgttccggccgacggtatcacaacaacagagctgtcctacctgctccaccagcttgttgaatggacattttaaggtaacttatgacgtatctcgggataagatctgcgatctgcttgtggcgaacaaccactttgctcacttttttgctccacagaacctcactaacatgaataagaatgtggtcttcgtgattgacatctcaggtagcatgagaggacaaaaggtcaaacaaacaaaagaggccctgctgaaaatacttggcgacatgcaaccaggagactatttcgacttggtcctgttcgggacaagagttcagtcctggaaaggtagcctggtgcaagcgagtgaggccaacctccaggccgcccaggatttcgtgcgcggcttctcccttgatgaagccacaaaccttaatggcggcctgctacggggtattgagatactgaaccaggtgcaggagtctctccccgagctgagcaaccacgcctccatactgatcatgctgacagatggagaccctaccgagggtgtcacagacagatcacagatactgaagaacgtcagaaatgcaatccgtggaaggtttccactctacaacctagggttcggacataacgtcgattttaacttcctcgaggtgatgagcatggaaaacaatgggagggcacagaggatttatgaagaccatgacgcaactcagcagctacagggattttactcccaggtagccaagccactgctggtggacgtggatctgcagtacccccaggacgcagtgctagcgctgacacaaaaccatcataagcagtactatgaggggagcgagattgtggtagctggaagaattgctgataacaaacagtcgtccttcaaggcagatgttcaggcccatggggaaggacaagagttctcaattacttgccttgtggacgaagaggaaatgaaaaaactgctccgcgagcggggacatatgctggaaaatcacgttgaacgactctgggcctacttaacaatccaggagctcctagccaagcggatgaaggtagaccgcgaggagcgcgcaaacctgtctagccaggccctgcaaatgtccctagattatgggtttgtgacaccactcacaagcatgagcatccgggggatggcagatcaagacgggctaaagcccactatagataagccatcactccaccacccacgcgcacccgagcggggtcatccagtgctgcaacaccaatag

SEQ ID NO: 120801 - DNA, 2841 bp, Artificial Sequence
  Description of Artificial Sequence: Synthetic coding sequence
atgaagcgcctgacctgttttttcatttgttttttcctgagcgaagtcagcggctttgagatccccataaatggtctatctgagttcgttgactacgaagacctggtcgaattggcgccagggaagtttcaactagttgctgagaaccggcgctaccagagatccttgcctggggagtccgaggaaatgatggaagaggtggaccaggttacattgtatagctacaaagtacaaagtactatcacaagtagaatggccactaccatgatacagtcaaaagtggtgaataactccccccagccacagaatgtggtgtttgatgtgcagataccgaaaggggctttcatatccaacttctcaatgaccgtggatggtaaaaccttccgatcgagcatcaaggagaaaacagtcgggcgtgcactctatgcgcaggcccgcgctaaggggaaaacagctggcctggttcgatccagcgcactggacatggaaaatttccgcaccgaggtgaacgttctgccgggcgccaaggtccaatttgaattgcactatcaggaggtgaagtggcgcaagctgggttcttacgagcaccgtatctacctccagcccgggcggctcgcaaaacatcttgaggtggatgtgtgggtaatagaaccccagggattgaggttccttcatgttccggatactttcgagggccacttcgatggggtgcccgtcatctctaaggggcaacagaaagctcacgtgtcgtttaagcccaccgtcgcccaacagcggatctgccctaattgtagggaaaccgcagtggacggcgagctcgtcgtactttacgacgtgaagcgagaagagaaagcaggcgaactcgaagtctttaacggttatttcgtgcatttttttgccccggataatctcgaccccatcccaaagaatatcttgttcgtgatcgatgtatcaggatccatgtggggcgtgaaaatgaaacagactgtcgaagcaatgaagactattttggacgatctgagggccgaagaccattttagtgtgattgatttcaaccaaaacatccgaacatggcggaacgaccttatttctgcaaccaagacacaagtggctgatgcaaagcggtacattgagaaaatacaaccatccggtggcaccaatattaatgaggccctcctgcgggccatatttatcttaaacgaggcaaataatttgggcctattagacccaaacagcgtgtccttaatcattctcgtaagcgacggcgatccaactgtcggggagttgaagctgtctaaaattcagaagaatgtaaaagagaatattcaggataatatctcgttgtttagccttggaatggggtttgatgtagactacgacttcttaaaacggctaagtaatgaaaaccatggtattgctcagcgtatatatggtaatcaggacacttcaagccagctcaagaaattctataaccaggtgtctacaccgctcctgaggaacgtgcagttcaactatccgcacactagcgtgactgatgtgacccaaaataatttccataactattttggaggctccgaaattgttgtggccggaaaatttgatcccgccaagctcgatcagatagagtccgtcatcactgcaacaagcgctaacacgcaacttgtcctggaaaccttggcacagatggacgatttgcaggacttcctctctaaagataagcatgctgacccagatttcacccgcaaactgtgggcgtatcttacaatcaaccagctgctcgcggaaagatccctagctcctacagccgctgccaaacggcggatcacccgatcaatccttcagatgtcccttgatcaccacatcgtaacgcccctgacaagcctagtcatcgagaatgaggcaggggacgagaggatgctggcagatgcccctccgcaagatccttcatgctgtagcggagctctttattatggtagtaaggttgtgcctgatagcacacccagctgggccaacccaagcccaactcctgtgatttcaatgctcgcccagggtagccaggttcttgagtccacccctcctccgcacgtgatgcgagttgaaaacgatccccatttcatcatttatcttcccaagtcccagaaaaatatttgctttaatatcgacagcgaaccaggaaaaattctgaatctggtgtccgacccagagtcaggaatcgtagtgaacggacagttggtaggggcaaagaagccaaacaacggcaagctgtcaacatactttggaaagcttgggttttacttccaaagcgaagatattaaaatcgagatctccacagaaacgatcaccttaagtcatggctccagcactttttcactctcctggtccgacacagcccaggttactaatcagcgagtgcaaatttcggtcaaaaaagagaaggtcgtgacgatcaccctggataaagaaatgtccttctccgtgctgctgcacagagtgtggaaaaagcacccggtgaatgtcgactttctgggaatctatattccacctaccaataagttctctcccaaggcacacggtttgattggacagtttatgcaggagcccaaaattcacatctttaacgagcgtccgggtaaggaccccgaaaaacctgaagccagcatggaagttaagggtcagaaactgatcatcactcgaggcctgcagaaggattacagaactgacctggtgtttggaactgatgtgacttgttggtttgtccataactctgggaaggggtttatcgacggccactataaggattatttcgttccacagctctactctttcttaaagagaccctag

SEQ ID NO: 120802 - DNA, 2658 bp, Artificial Sequence
  Description of Artificial Sequence: Synthetic coding sequence
atggtcgcactgtctcatctgggatcagccttgcagttgggcagcttatttccacggtccccctttcgattgctcggtaaaagatctctgcccgagggcgtggccaatgggatcgaagtatactccaccaagattaactctaaggtgacttccaggttcgctcacaacgtggtgacaatgcgcgcagttaatcgggccgacactgctaaggaagtgtcttttgacgtggagcttccaaagaccgcatttatcacgaattttacattgaccatcgatggcgtgacgtacccggggaatgtgaaagagaaagaagtggccaagaagcagtatgagaaggctgtttcccaggggaagactgctggcctcgtgaaggcctctgggcgcaagttagagaagttcacggtcagcgttaacgtggctgccgggagcaaggtgactttcgagctcacctatgaagagctgctgaaacgacataaaggcaagtacgagatgtatcttaaggttcaacctaaacaactggttaagcacttcgaaatcgaggtggacattttcgagccacaaggcatttccatgttagacgcggaggcatcatttatcacaaacgacctgctgggaagtgcgctaaccaaatctttctcaggcaaaaaaggccacgtgtcattcaaaccctctctggatcagcagcgctcctgccccacttgtactgattcattacttaatggcgactttacaatcacctatgatgtcaacagggagagtccaggaaatgtccagatcgtgaacgggtactttgtgcacttcttcgccccgcagggactccccgttgtgccaaaaaacgtcgcattcgtcatcgatattagtggatctatggccgggcgcaagctcgagcagactaaagaggcactcctgcggatcctcgaagatatgcaggaggaggactatctgaattttattctgttttcaggggacgtttctacatggaaggagcacttagtgcaggcaacaccagaaaatcttcaggaagcccgcacatttgtgaagagcatggaagacaagggcatgactaacatcaatgatggactgttgaggggtatttccatgttgaacaaggcgcgcgaggagcaccgaattccagaaagaagtacatctatcgtcatcatgctgaccgatggagacgcgaatgtaggagaatcccgtcctgaaaagattcaggagaatgtgaggaatgcgattggagggaaattccccctttataacctcggttttggaaataacctgaattacaactttctggaaaatatggccctggaaaaccatgggtttgccaggaggatttacgaggatagcgatgcagatttgcagcttcagggcttttacgaagaggtggccaatcctctccttacaggtgtcgagatggaatatccagagaacgccattttagatctgacccagaatacctaccagcacttttatgacggctcagagattgtcgtcgcaggcagactggtggacgaggatatgaacagctttaaggccgacgttaagggccatggggcaactaacgacctaacatttaccgaggaggtggatatgaaggaaatggaaaaagccctgcaggagcgcgattacatctttggaaactacatcgaacgtctctgggcatatctaactatagagcagctgcttgaaaagcgcaagaatgcacatggagaggagaaagagaacctaacggcacgtgccttggacctttctctgaagtatcactttgtgactcctctgacatccatggtcgtcacaaagccggaagacaacgaggacgagcgagctattgcggataagcctggcgaaggattcagcgctacacccgttagccctgcaatgagctaccttacttcctatcagcccccacaaaatccatattactacgtggatggcgacccacacttcatcatacagatcccggagaaggacgatgccttgtgcttcaacattgatgaggcccctggtactgtcctgagactgatccaggacgccgtcaccggactgaccgttaatggtcagattaccggggacaagaggggatcccctgattcaaaaaccagaaagacctatttcggaaaactgggcattgcgaatgcacagatggacttccaggtggaggttacgaccgagaaaattaccttgtggaatagggctgtgccatccaccttctcttggctcgacactgtcacggtcactcaggacgggctttccatgatgatcaaccggaaaaacatggtagtgtccttcggcgacggcgttactttcgtcgtcgtgctgcatcaggtatggaagaagcatcctgtgcacagggactttcttggcttctatgttgtggatagccatcgtatgtccgctcagacccatggtctgctgggccaattttttcagccattcgacttcaaagtttcagacattagaccgggtagcgacccaaccaagccagatgctactttggtcgttaagaatcaccagttaatcgtaactagagggagtcagaaggattatagaaaagacgcttctatcggcacaaaagtcgtgtgttggtttgtccacaataacggagaagggctgatagacggcgtacacacagattatattgtccctaatctgttctag

SEQ ID NO: 120803 - DNA, 2013 bp, Artificial Sequence
  Description of Artificial Sequence: Synthetic coding sequence
atggccttcgcatggtggccctgcctcatccttgcactgttatcctctctcgcagcctctgggtttcccaggagcccatttaggctgctcggaaaacggtcccttcctgaaggcgtggccaacggcattgaggtctactctactaaaatcaattccaaggtgaccagcagattcgcccataacgttgtcactatgcgggcagtaaatcgcgccgatacagccaaggaagtatcttttgacgtggaacttccaaaaactgcgttcattactaatttcacactgacaattgacggggttacctatccaggcaatgtgaaggagaaagaagtggcaaagaagcagtatgagaaggctgtttctcagggcaagacagcaggactagtgaaagcttcaggtcgtaaactggagaagttcacagtgtctgttaatgttgccgccggaagtaaggtcaccttcgagttgacttatgaggaactgctgaagagacacaaaggcaagtacgagatgtaccttaaagtgcaaccgaaacagctcgtgaaacatttcgaaatcgaggtggatatcttcgaaccacagggaatatccatgctggacgctgaagcctcgtttatcacaaatgacctcctgggatccgctctgaccaaatctttttccggaaagaagggccatgtgtcctttaaaccatccctcgaccagcagagatcctgcccaacttgtactgacagcttgcttaatggggactttaccatcacatatgacgtcaatagggagagtccagggaacgtccagattgtcaatggctatttcgtccatttctttgctcctcagggacttccagtggtgcccaagaacgtagcatttgtaatcgacatctctgggtccatggccggccgcaagctggaacaaaccaaggaggccctcctaaggattctggaggacatgcaagaggaggattacttgaactttatactgtttagcggagacgtgagcacatggaaggaacacctggtgcaggccactcctgaaaatctccaggaggctcggacttttgtgaaatcgatggaggacaagggcatgactaatattaacgacggactgctgcggggcataagcatgttgaacaaagccagggaagaacatcggatcccagaaaggtctacctccatagtcatcatgctgacagatggagacgcaaacgtgggagagtcaagaccggagaagattcaggaaaatgtgaggaacgcgatcggtggcaaatttcccttatataacctcgggtttggcaacaacttgaattacaacttcctggaaaatatggccctcgagaaccatgggttcgcgaggcgcatctacgaagactcagatgctgacctgcagctgcagggattttacgaggaagtcgcaaacccacttttgactggagttgagatggaatatcccgagaacgcaatccttgatcttacccagaatacatatcaacacttctacgacggtagcgagatcgtggttgccggccggctcgtggacgaagatatgaactcctttaaagccgatgtgaaggggcacggagctaccaatgatcttaccttcaccgaagaagtggacatgaaggaaatggagaaggcactgcaggaacgggactacatttttggaaactacatcgaacgactgtgggcctacctcacaatagagcaactactggaaaaacgcaaaaatgcacacggggaagagaaagagaacctgactgctcgggcgctggacttaagcctcaagtaccatttcgtgacccctttgacatccatggtggtcacaaaaccggaggacaatgaggatgagagggcaatcgccgacaagccaggggaaggcggagactcccacacaggcgagccacgtcatgttctgcctgatcaactccctgcctctagtaagccccttttactgtgcggcaggggatcacctttgcaccatcccaacagtggagaaaggaggtgtcctctactacagcacaggtag

SEQ ID NO: 120804 - DNA, 2673 bp, Artificial Sequence
  Description of Artificial Sequence: Synthetic coding sequence
atggcatttgcgtggtggccgtgccttattctggccctcttgtcatcgctggccgccagcgggttccctcgcagcccgtttcgcctgcttggcaagcgcagtttgcctgaaggcgtagcgaacgggatcgaagtttacagtaccaaaatcaatagtaaggtcacctccaggtttgcgcacaatgtggtcaccatgcgtgcggtcaaccgtgccgatacggccaaggaggtgagtttcgacgttgagcttcccaagaccgcattcatcaccaattttacactcaccattgacggcgtgacatatccaggcaatgtgaaagaaaaggaggtcgccaaaaaacagtacgagaaagccgtgtcccaagggaagactgccgggctcgtgaaagcgtctggaagaaaactcgaaaaattcacggtcagcgttaacgtggcggctgggtccaaagtgaccttcgaactgacttatgaggagctcttgaaacgccataagggaaaatacgaaatgtatctgaaggttcaaccaaaacagctggttaagcacttcgaaatcgaggtagacatatttgaacctcagggcatctcaatgctggacgccgaggcgagctttataaccaatgatctgctgggatccgcccttaccaaaagcttttccgggaagaaagggcacgtgagctttaaaccctcgctggaccagcagagatcatgccctacatgtaccgactcactcttgaacggcgattttacgatcacctacgacgtgaatcgtgagagccctggcaacgtccagattgtaaacggttattttgtgcatttctttgctcctcagggcctgcccgtggtaccaaagaatgtggcattcgtcattgacattagcgggagtatggctggcagaaagctcgagcaaacgaaagaggccctgctacgaattcttgaagacatgcaggaggaagactatcttaattttatccttttctccggagacgtgagcacctggaaggaacacctggttcaagctacaccagagaacctacaggaggcgcggacgttcgtgaaatccatggaggataaggggatgactaacatcaatgacgggctgctgcgaggcatttccatgcttaacaaggccagagaagagcatcgtatcccagagagatcaacctctatcgtgattatgctaacagacggggatgccaacgtgggcgagagccgcccggagaagatacaagagaacgtgcgtaatgctattggcggaaagttccccttatataacttaggctttggtaataacctgaattacaacttcctcgagaatatggcactagaaaatcacggattcgcccggcgcatctacgaagactccgatgccgacctgcaattacagggcttttatgaagaagtggcgaatccgctgcttacaggcgtggaaatggagtaccctgagaacgctatcctcgacctgactcagaatacatatcagcatttctatgacggaagtgaaattgtggtggccggtcgactcgtggacgaggatatgaattcattcaaggctgatgtaaagggacatggggctacaaacgacctaaccttcacggaggaagttgacatgaaggagatggaaaaagcccttcaggagagggattacatcttcgggaattacattgaacgattgtgggcgtatctgaccattgaacaactcctggagaagaggaaaaatgcccatggagaggaaaaggagaacctgactgctagagcccttgacctgagtctgaaataccattttgtcacccccctgacttctatggtggtgactaaacccgaggataacgaggatgagcgggctatagcagacaagcctggggaagacgccgaagcaacaccagtttcaccagctatgtcatacctcacctcttaccagcccccacagaatccttactactatgtggacggcgaccctcactttatcatacaaatacctgagaaggacgatgctctctgtttcaacatcgacgaagccccaggaaccgtgttgagactgatacaggacgccgtaaccggcctgacagtaaatggacaaataacaggggacaagcgtgggtcaccggactcaaaaacccggaaaacctatttcggaaaactaggtattgctaatgcacagatggatttccaggtagaggtgactaccgaaaaaattactctgtggaacagagctgtacccagcacgttcagttggctagatacagttacagtgacacaggatggactatccatgatgattaatcgaaaaaacatggtggtatcattcggggatggcgtaaccttcgtggtggtgctgcaccaggtgtggaaaaaacatccagtccatcgggattttctgggtttttatgtcgtcgactctcacaggatgagcgctcaaacccacggactactgggccaattcttccagccttttgatttcaaggtttccgatatcaggcccggatcggatcccaccaagccagatgcgacacttgtcgtcaaaaatcatcaattaatcgtgacccggggaagccaaaaagactacaggaaggatgcaagtatcggcacaaaagtggtttgttggtttgtccataataacggggagggcctgattgatggcgtccataccgactatatcgtgcctaaccttttctag

SEQ ID NO: 120805 - DNA, 1977 bp, Artificial Sequence
  Description of Artificial Sequence: Synthetic coding sequence
atggcctttgcatggtggccctgtctgattctggccttactgagctctttggctgctagcggtttcccccggagccctttccgattgctgggcaaaagatccctgccagaaggtgtagcgaacggcattgaggtttactccactaaaattaatagcaaagtcacctctcgatttgcccataatgtggtgacaatgagagccgtaaatcgcgcagataccgccaaagaggtgagctttgacgtcgaactgcccaagactgcgttcattactaacttcacattgaccattgacggtgtgacctacccaggaaatgtgaaggagaaggaggtagccaaaaaacagtatgaaaaggcagttagtcagggtaagaccgcaggcctggttaaagcctccggtcggaagttggaaaagtttactgtttctgtcaatgtggcggctggcagcaaaagacataaagggaaatacgaaatgtacttaaaggtacagcctaaacagctggtgaagcactttgaaatcgaggtcgacatctttgagccacagggaatcagtatgttagacgccgaggccagcttcatcacaaatgatcttctgggatccgcattgaccaaatcgttcagcggcaaaaaggggcatgtgtcctttaaaccatcgctggaccagcagcgcagttgtccgacgtgcactgatagtctcctcaatggcgatttcacgattacatacgacgtcaaccgggaaagcccagggaatgtccagattgtcaacggatactttgttcatttctttgcgcctcagggtctgcccgtcgtgcccaagaacgtggcatttgtgattgatatcagtggcagcatggctgggcgtaaactggaacaaacaaaagaggcgttgcttcgcatcctggaagacatgcaggaagaagactatctgaactttatcctgttttctggagacgtgtccacttggaaagaacacctcgtacaagccactcccgaaaacttgcaggaagctcgtacctttgtaaagagtatggaagataagggaatgacaaatattaatgacggccttcttagaggcattagtatgttaaacaaggctcgcgaagagcatcgcatccccgaaagatcaacctccattgtgattatgctcacagacggtgatgccaacgtgggggagtctcggccagaaaaaattcaggagaacgtgcgtaacgctatcggcggtaaattcccactttataatctgggctttggaaacaatctgaactacaatttcttagagaacatggctctggagaaccatggtttcgcccgccgtatttacgaggatagtgacgcggaccttcagcttcaaggcttctacgaagaggtggctaaccccctcttaacgggcgtagaaatggaatatcctgagaacgccatcttggatctgacccagaacacataccagcacttttacgacggcagcgaaattgtagtggcaggcaggctggtcgatgaggacatgaattcgttcaaagcagatgtaaaaggccatggagcgacgaatgatctcactttcactgaggaggtagatatgaaggagatggaaaaagccctccaagaacgggactatatattcggcaactacattgagcggttgtgggcctacttaactattgaacagctgctggagaagcggaagaatgctcatggagaggagaaggagaatctgaccgcacgggctctagacctgtcattgaaataccacttcgtcacaccacttaccagtatggtggtgacaaaacccgaggacaatgaggatgagcgggctatcgctgacaagcctggagaaggcggggattcccataccggagagccccgccatgttctgcctgaccagcttcccgcctcaagcaagcccctgctgctctgcgggagaggcagtccgttgcatcatcccaactcgggggaacgccgatgtccactgctccagcatcgctag

SEQ ID NO: 120806 - DNA, 2793 bp, Artificial Sequence
  Description of Artificial Sequence: Synthetic coding sequence
atgaaaccaccacggcctgttcgcacgtgtagtaaagtactggtgctgttgagcctgctcgcgattcatcagaccacaactgccgaaaagaacggcattgacatttatagcttgaccgttgatagtcgcgtttcttcccgtttcgcccacaccgtggttacatcaagagtagtgaatcgcgctaacaccgtgcaggaagcgacatttcagatggagctgccaaaaaaggccttcatcaccaatttcagtatgattatagatggtatgacctaccctggtattataaaggagaaagcggaagctcaggcacaatatagtgctgcagtggccaaggggaagagcgcagggcttgtgaaagctacaggtagaaatatggagcagtttcaggtcagcgtgtcagtggcccccaacgccaaaatcactttcgaattggtgtacgaagagctgctgaaacggaggttgggtgtttacgagctgttactcaaagtgcggccacagcaacttgtgaaacatctccagatggacatccatatcttcgagcctcaggggataagttttctcgagaccgaaagcacattcatgactaaccaactggtggacgcgctcacaacctggcagaataagaccaaggctcatattaggtttaagcccactctgagccagcagcagaaaagtccagagcagcaggaaacagtgctggacgggaacctgatcattagatacgatgtggatcgtgcaatttcaggaggatcaatccagattgagaatggttactttgttcattatttcgcacctgagggtctgactaccatgcctaagaacgtggtctttgtcatcgataagtctggtagtatgtccggccgcaaaatccagcagacccgcgaagccctaatcaagatccttgatgacttatcgccccgtgatcagtttaatttgattgtcttctctactgaagcaacccagtggcggccctccctcgtgcctgccagtgctgaaaatgtcaacaaggcccggtcctttgctgcagggattcaggctcttgggggtaccaacattaacgatgccatgctgatggccgtgcagttactcgatagctctaatcaggaggaaagacttccagaaggttctgtgtctctcatcatactgctcaccgatggggatccaacggtgggagagaccaatcccaggtctatacaaaataatgtgcgcgaagctgtaagcggtcgctatagcctgttttgcttaggatttggcttcgacgtcagctatgcctttttagagaagcttgcgctcgacaacgggggacttgcaagacgtattcacgaggattctgactccgctctgcagcttcaggatttttaccaggaggtggcaaatccgctgctgaccgccgtgacttttgagtacccatcaaacgcagtggaggaggtgacccagaacaacttccgtctactgtttaaggggtcagaaatggttgtggccgggaagctgcaggaccggggcccagatgtgttaacggcgactgtgtcgggcaaattacccacgcagaacataacattccaaacagaatcgagcgtggcggagcaagaagccgaatttcagagcccaaagtatatcttccacaatttcatggagcgcttgtgggcgtaccttacaatccagcagcttctggaacagactgtcagtgccagcgacgctgatcaacaagcgctgagaaaccaagctctgaatcttagcctagcatacagcttcgtcacacctcttacaagcatggtagtgaccaagcccgacgaccaagaacaaagccaggtggccgaaaaacccatggagggcgagagtcgaaacaggaacgttcactcgggatctaccttttttaagtattatctacagggggccaagattccaaaaccggaggcatctttttcgccgaggcgaggctggaacagacaagcaggtgctgccggttctaggatgaactttagacctggggtgctgtccagtagacagcttggcctcccaggaccaccagacgtgcccgatcacgctgcgtaccaccctttccggagactcgccatactgcccgcaagtgctccacccgcaacatctaacccggatcctgccgtatcacgggtgatgaacatgaagatcgaagagactactatgaccacacagaccccagcccccatccaggcgcctagtgcaattctgccattgcccggccagtctgtcgagcgcctctgcgtggacccccgccataggcaggggccggttaatctgctttctgaccctgagcaaggggttgaagtcactgggcaatacgagagggagaaagctgggttcagctggatcgaggtcactttcaagaacccccttgtttgggtccatgcaagtcctgagcacgtggtcgtgacaagaaatcgccggtcttccgcttataagtggaaggaaacactgttctctgtcatgcctgggcttaaaatgacaatggacaagactggcctcctactcctgtcagatcccgataaagtgaccattggcctcctgttctgggatggccggggagagggattacgccttctgcttagagacacggatcgattttcctctcatgttggcggcactctcgggcagttctaccaagaagttctgtggggatcaccagccgccagtgacgacggacgccgaactctgcgagtccagggaaacgaccactcagctacccgcgagcggagactggattatcaggagggtcctcctggcgtagagatcagctgttggagcgtggaactgtag

SEQ ID NO: 120807 - DNA, 2745 bp, Artificial Sequence
  Description of Artificial Sequence: Synthetic coding sequence
atgaagccaccccggccagtgcgtacatgttcaaaggtgctggtcctgctgtcactgctcgcaatccatcagacaactaccgccgaaaagaatgggatcgatatttattccttgacagttgattccagggtgtccagccgatttgcccacaccgtggttactagccgtgtggtcaacagagctaacactgttcaagaggccacattccagatggaactgccaaagaaggccttcatcactaacttctcaatgatcatcgatggaatgacctatccaggtatcatcaaggaaaaagcagaggcacaagcccaatactccgcagctgtcgctaaaggcaagagcgccgggttggtgaaggctaccgggcggaacatggaacagttccaggtctctgtcagcgtggctccaaacgctaaaataactttcgagctcgtctacgaggaactgctcaagagacggctcggagtgtacgagctgctcttgaaggtccgacctcaacagttggttaagcatctgcagatggacatccatatcttcgaaccacaggggatctcttttctcgaaacagagagtacatttatgaccaaccagctggtggatgccttgacgacttggcagaataagaccaaggcccacataaggtttaaacctactctgagtcagcagcagaaatcaccggagcagcaggaaacagtactggacggcaacctgatcatcaggtacgacgtggatcgggccatctcgggtggatccatccagattgaaaacggctactttgtgcattatttcgccccagagggattaaccacaatgcccaagaatgtggtctttgtgatcgacaagagtggatccatgtctggtaggaagatccagcagacccgagaggccctgattaagatcctggacgatctaagcccaagggaccagttcaatctgattgtgttctctacggaagctacccaatggaggccatccctggtacctgcttcggctgaaaacgtgaacaaagccagatcgttcgcagccgggattcaggctctgggcgggactaacatcaacgatgccatgctgatggccgtccaactgctggactcctcgaaccaggaggaaaggttaccagaggggtcagtgtccttgattatcctgctgaccgatggtgatccaacagtcggagaaacaaatcccagatcaattcagaataatgttagggaggctgtaagcggacgttacagcctgttctgtctggggttcgggtttgacgtgagctacgctttcttagaaaagctcgctctggataacgggggcctggcaagaagaatacacgaagactccgattcagccctgcaactccaggatttttatcaggaggtggctaacccacttctgacagcagtgacattcgagtatcccagtaatgctgttgaggaggtcactcagaataatttccgcttactgtttaaaggatctgagatggtagtcgccgggaaactccaagacagagggcccgacgtgctcaccgccactgtcagtggaaagcttcctactcaaaacataacattccaaacagagtcatcagtggctgaacaagaggctgaattccagtctcctaagtatatatttcacaacttcatggagcggctctgggcctacttaactattcagcaactcctggagcaaaccgttagtgccagcgatgccgaccagcaagccctgaggaatcaggccctgaatctctctcttgcctacagtttcgtgacccctctgaccagcatggtcgttactaagcccgatgatcaggaacaatcgcaggtggctgagaaacccatggagggggagagccgcaatcgcaatgtgcatagtgctggagccgccggatctcgcatgaacttcagaccgggtgtattgtcaagtcggcaactcggccttccgggcccacccgacgtcccagaccatgcagcctaccatccttttaggagattggctattttgcctgcctcagctccccccgccacatctaatccagatcctgccgtaagtcgggtaatgaacatgaaaattgaggagaccacaatgaccacccagaccccagcttgcccttcctgcagcagatcgcgtgcaccggccgtgcccgctcctattcaagctcccagtgcaatcttaccactcccaggacaatcagtggagaggctttgcgtggatcctcgacatcgccagggaccagtcaacctgctgtctgacccggagcagggcgtcgaagtgactggccagtacgagagggagaaggccggtttttcttggatcgaagtgacatttaagaacccactggtatgggttcacgcatcccccgaacatgtggtcgttacaaggaatcggagaagctcagcatacaagtggaaggaaacactgttttccgtgatgccaggattgaagatgacgatggataaaacaggtctgctgttgcttagtgatcccgataaggtcacaattggactcctcttttgggatggacgcggcgagggactgcgactattgcttagggacactgaccggttctccagccacgtcggcggaactctgggtcaattttatcaggaggtcctgtggggctcccctgcagccagtgatgacggccgtagaaccctgcgcgtgcaaggtaatgatcattctgcaaccagagaaaggagactggactaccaggagggtccaccaggtgttgagatttcctgctggagcgttgagctgtag

SEQ ID NO: 120808 - DNA, 2703 bp, Artificial Sequence
  Description of Artificial Sequence: Synthetic coding sequence
atgaaaccaccacgccctgttcgaacttgcagtaaagtgctggttctgctgtccctgctcgccattcatcagacgactacggcagagaagaacggaatagatatctattctttaacggtagactcgagagtctccagcaggtttgctcatacagtagttacaagccgcgtagtgaatcgcgctaatacagtgcaggaagctaccttccagatggagcttccgaagaaggccttcattaccaacttttccatgataatagatggcatgacatacccgggaatcatcaaggagaaggcagaggcccaagcccagtatagcgctgcagtggctaagggaaaatctgccggcctggtgaaggctacgggcagaaatatggagcagttccaagtgtcggtgtcggtggctcctaacgctaagatcactttcgaactagtttacgaagagctgctaaaaaggcggttgggggtctatgaactcctgttaaaagttagacctcagcaattggtcaagcatctacagatggatatacatatcttcgagccccagggcatttcttttctcgaaacagaaagcactttcatgaccaatcagctagtcgatgcactgaccacatggcagaacaagacaaaggcgcacatcaggtttaagcctaccttgagccagcaacagaagagccctgaacagcaggagactgtcttggatggtaacctgatcatacggtacgacgtggaccgcgccatctccggaggtagcattcagatcgagaatggctactttgtccactattttgctcctgaagggttgacaacaatgcctaagaacgtcgtgtttgtaatagacaagtctggaagcatgtccggaaggaaaattcagcagacacgggaggccctgataaagatcctagatgatctttccccgcgcgatcaatttaacctgatcgtgtttagcaccgaggccacacagtggcgccctagccttgttcccgctagcgcggagaatgtcaataaggcacggtcgttcgccgccggcattcaggctctgggcggtaccaacatcaatgacgccatgctcatggccgtgcagctgttggattcctctaaccaagaggaacggctgcccgagggctctgtgtccctgatcattctgctgactgacggtgacccaacagtaggcgagactaatccccgctctatccagaataatgttcgggaggctgtctccggtcgctacagcctgttctgtctgggcttcgggtttgacgtctcttacgctttcctggaaaagctggccttggataacggcggcctggcgagacgcatccatgaggattccgactcagctctgcagctacaagatttttaccaggaggtggctaacccgctactgactgccgtcacttttgaatatcctagtaacgccgtcgaagaggttactcagaataactttcggctattgttcaaggggtcagagatggtggtggcaggcaaactgcaagataggggcccagatgtcctgaccgccaccgtgagtggaaaactccctactcagaatatcacattccagactgagagcagcgttgccgagcaggaagctgagttccagtcgccgaagtatatcttccacaactttatggaaagattgtgggcctacctaactattcagcagctactcgaacagactgtgagtgcatctgatgccgaccagcaggccctccgaaaccaggctttgaatttatccctcgcctacagttttgttacgccgttgacatcaatggtcgtcactaaaccagatgaccaggagcagagccaggtcgccgaaaagccgatggagggtgagtcacggaacaggaacgttcattccgcaggagcagctgggtctcgcatgaacttcaggcccggcgtgctctcatcaaggcagctgggactccctggcccgcccgatgtcccagatcacgcggcataccacccatttcgacgtctcgcaatccttccggcttcagcaccacctgctacctccaaccccgaccctgccgtgtcacgcgttatgaatatgaagatcgaggaaaccaccatgactacccagacccccgccccgattcaggccccttctgctatactcccactacccggacagagtgtcgaacggctgtgtgtggacccgaggcaccggcaggggccggtaaatctgttaagcgacccagagcaaggcgttgaagtgacaggccaatatgagagggagaaggccggctttagctggatcgaggtcactttcaagaatcctcttgtctgggtacacgctagtccggagcacgttgtggtgactcgcaatcgacgaagctctgcctataagtggaaggagacactcttctccgtcatgcctgggttgaaaatgacaatggataaaaccggactactcctgctatccgacccagataaggttactatcggcttactgttttgggacgggcggggtgagggactaaggctgctgcttcgggacacggatcggttttcaagccacgtgggaggcactctgggccaattttaccaggaagtgctctggggtagccccgctgcatccgacgacggacgccgtacccttcgcgtgcagggtaatgaccactcagcaactcgcgagcggagactggattaccaagaaggacccccgggcgtggagattagctgctggagcgtcgagctctag

SEQ ID NO: 120809 - DNA, 1683 bp, Artificial Sequence
  Description of Artificial Sequence: Synthetic coding sequence
atgacgtatccaggtatcattaaggagaaggccgaggcccaagctcagtattcagcagccgtagccaagggaaagagcgccggcttagtgaaggcgaccggccggaacatggaacagtttcaggtgtcagtgtctgtagcccctaacgccaagattaccttcgagttagtttacgaggagttgctgaaacgcaggctgggcgtctatgagttgctcttaaaggtgaggccccaacaactagtgaagcacctccagatggatattcatattttcgaaccccaggggattagcttccttgagaccgagtcaacatttatgacaaatcagttagtagacgccttgactacctggcaaaacaagactaaagcccacatccggtttaagcctacactctcacaacaacagaaatcccccgaacagcaagagacggtccttgatggcaacctgataattaggtacgacgtggatagggccattagcggaggaagtatccagatcgagaatggttatttcgtgcattatttcgctcccgagggattaacaacgatgccaaaaaacgttgtctttgtcattgacaaaagcgggagcatgagcggacggaaaatccagcagacgcgggaagcattaatcaaaatcctggatgacttatccccccgggaccagtttaaccttattgttttttccactgaggccacgcagtggcgccccagcctcgtgccagccagcgccgagaacgttaacaaggcacgttcctttgccgcgggcatccaggccctggggggtaccaacatcaatgatgctatgctcatggctgtgcagcttttagacagctccaatcaggaagaacggctgcctgaaggctctgtttccctgatcattctgctcacagacggggaccccacagtaggtgaaacaaacccacgctccattcaaaacaacgtgagagaggcggtttctgggcgttacagcttattttgtctcggtttcggctttgacgtttcatacgcctttctagaaaagctggcgctcgacaacggagggctcgccagacgaattcatgaggactccgactctgctctgcaactccaagacttctatcaggaagtagccaatccactgctgaccgccgtgaccttcgagtaccccagcaatgcggtggaggaggtcacccagaataactttcggctgctgttcaaaggaagcgagatggtcgtcgccgggaagctgcaggaccgggggccagacgtactaacagctactgtgtcaggaaagctgcctacacaaaacatcaccttccagactgagtccagcgtggctgagcaggaagctgagttccagtcaccaaagtatatctttcataatttcatggagaggctgtgggcctatttgaccattcagcagctgcttgagcaaacggtgtcagccagtgatgcagatcagcaagcacttagaaaccaggccctgaacctcagtctcgcttacagctttgtgacaccattgacaagcatggtcgtaacaaagccagatgaccaggaacaatctcaggtggcagagaagcccatggagggggagagcaggaaccgtaacgtacactctggatcaactttcttcaaatattacctccagggggccaagatccccaagccaggggataaagtcggcggtggcggacgcggtgattag

SEQ ID NO: 120810 - DNA, 2667 bp, Artificial Sequence
  Description of Artificial Sequence: Synthetic coding sequence
atgaagcctcctcggccagttaggacttgctccaaagtccttgtgttgctaagcctccttgctatccatcagaccactacggccgaaaaaaacgggatcgatatttactccctcacggtggacagcagagtgagctccagatttgcacacaccgtcgtgactagtcgggtcgtgaaccgggctaatactgtgcaggaggccacttttcagatggagctgccaaaaaaagcattcataaccaacttctcaatgatcatcgacgggatgacgtaccctggaatcattaaggaaaaggcggaggcgcaggctcagtactctgccgccgtggctaaaggtaagtcggcgggattggtgaaggcaacgggccggaatatggagcagttccaagtgtctgtctccgtggccccgaacgctaagagaaggctgggcgtctacgagctcctcctcaaggttaggcctcagcagttggttaagcacctgcagatggacatacacatctttgaacctcagggaatttcgttcctggagactgaatccacattcatgaccaaccagttggtcgatgcgttgaccacttggcagaacaagacaaaagcacatatccgttttaagcccacactgtcccaacagcagaaatctcccgaacagcaggaaaccgttctcgacggcaacttgattattagatacgacgttgacagagctatctcaggcgggtccatccagatagagaatggatactttgtgcactatttcgcaccagagggattgactacaatgcctaaaaacgtcgtattcgtcatagacaagagcggctctatgagcggcaggaagatccagcagactagggaggccttgattaaaatacttgatgatttgtctccaagggatcagttcaacctgatagtgttctccacagaggctactcagtggcggccctcgctcgtgccggcgtctgccgagaatgtgaataaggcccggagctttgctgccggaatacaagcgctcggagggacaaacatcaacgacgcaatgctgatggctgtgcagctgttggactcatccaatcaagaagagcggctgccggagggatctgtcagtttgatcattttgctaaccgatggagatcctacagtgggcgaaacaaatcctcgcagcattcagaacaatgtccgtgaggccgtgtccggtagatattccctgttctgcctgggatttgggttcgatgttagctacgcattcttggaaaagctcgccctcgacaatggcggactcgcccgccggatccacgaggactctgattcagcactccagcttcaggatttttatcaggaagtggctaacccgctcctcaccgccgtgaccttcgagtacccaagcaacgccgtggaagaggtcacacagaacaatttccgcctcctgttcaaaggttcagaaatggtggtcgcgggtaagctgcaggaccgcggcccagatgtccttactgcaacagtgtcggggaagcttcctacccagaacatcacattccaaacagaatcttcagtggctgagcaagaggccgaatttcaatcgccaaagtacattttccacaacttcatggagcgtctctgggcctatctcactatccagcagctcctcgaacagacggtcagtgcctccgatgccgaccaacaggcactccgtaaccaggcccttaacctcagcttggcttactccttcgtgacaccattaacctccatggtcgtcactaagcccgacgaccaggaacaatcccaagtcgctgaaaagcccatggagggcgaaagcagaaataggaacgtgcacagcgctggggctgccggctccaggatgaacttccgcccaggggtcctgagttcacggcagctgggcctgccgggacctcctgacgtgccagaccatgctgcttaccacccctttcgaagactggccatcttaccggccagtgctccccccgcgactagcaacccagatcctgccgttagccgcgtgatgaacatgaagatcgaggaaacaaccatgacgactcagaccccggctcccatccaggccccatccgctattttacccctgcccggccagtccgtggaaagactgtgtgtagaccctagacacaggcaaggcccggttaacctcctgagcgatccagagcagggcgtggaggtaacagggcagtacgagcgggagaaggccggattttcctggatagaggttacgttcaagaaccccttggtttgggttcacgcctcgccggagcatgtagtcgttactagaaaccgccgatcttcagcatacaagtggaaagagactctgttttcagtaatgccgggtctaaaaatgacaatggataagactgggctgctgttgctgtctgatcctgacaaagtcactatcggacttttattctgggacggtaggggagaggggctgcggctcttgttgcgagatactgaccggttcagtagccacgtcgggggcacattgggccaattttatcaggaggtgctatggggctctcccgccgcctcagatgacggcagaaggactctccgagtgcaagggaatgaccattctgcgaccagggagcggcggctggactatcaggaaggtccccccggagtcgagatcagctgctggtccgtggaactctag

SEQ ID NO: 120811 - DNA, 2871 bp, Artificial Sequence
  Description of Artificial Sequence: Synthetic coding sequence
atgctactacttctcgggctctgccttggactctccctgtgtgtgggctcccaggaagaggcccaaagctggggccatagctctgaacaggatggccttcgagttcccaggcaagtgagactgttgcagcggcttaagaccaagcccctgatgaccgaatttagcgtgaagtcaactatcattagccggtatgcattcacgaccgtgtcatgccgcatgctaaacagagcgagcgaggaccaggatatcgagttccagatgcagatccctgcggcggcttttatcactaatttcacaatgttaataggggacaaagtgtatcaaggcgagattacggagcgggagaagaaaagcggcgacagagtgaaggagaaaaggaataagaccacagaggaaaatggggaaaagggtactgagattttccgggccagtgctgtgatccccagcaaagataaagccgctttttttctttcctatgaagagctcctgcaacgccggctaggtaagtatgagcacagtatctccgttcgcccacagcagttaagcggtagactgtcagtggatgtgaacatactcgaaagtgcaggcatagcctctctcgaagtgctgccattacacaattctagacagcgcggatctggtcgcggcgaagatgatagtggcccaccaccatctactgtcattaaccagaacgaaacttttgctaatataatttttaaaccgacggtggtgcagcaggcaaggatagcgcagaatggcatactgggggactttatcattaggtacgatgtaaatagggagcagagtatcggcgacatacaagtccttaacggatacttcgtccactactttgctcccaaggatctgccccctctgccgaaaaatgtggtattcgtgctggattcatccgccagtatggtgggcacgaagttacggcagactaaggatgcgttgttcaccatcttacatgatttacggccgcaggacagattcagcataatcggcttctctaacaggattaaggtctggaaagaccatctgatttcggtgacacctgacagcattagggatggcaaggtttatatccaccacatgagtccaacaggcggaaccgatataaatggtgcactccagagggcaattagactgctaaataaatatgtggcccactctgggataggggatagatccgtctctcttattgtattcctgacggatggtaaaccaactgtcggcgaaacccatacactgaagattttaaacaatactcgcgaggctgcacgcggccaagtctgtatcttcacaataggcattgggaacgatgtcgacttccgtcttctagaaaagctgtctttggaaaactgcggactgaccagaagggtacacgaagaagaggacgctgggtcccagctgattggattctacgacgaaatacggacaccgcttctttcggatattagaatcgattacccccccagctctgtagttcaggcaaccaaaacgttattccccaattattttaatggatcggaaattatcattgcaggcaagttggtcgacagaaagctggatcatttgcacgtggaagtgactgctagcaatagcaaaaaatttataatcctgaagaccgatgtccccgtgcggcctcagaaggcaggcaaagatgtaacaggatccccacgccccgggggcgatggggagggggataccaatcacatcgaacgactctggtcttacttaaccaccaaggaattgttgtcctcctggcttcagtctgatgacgagccagagaaggaacggttgagacagagagcccaggccctcgcagtgtcctatcgtttcttaacgccattcacctccatgaaactgagaggcccggtgccaagaatggatggcctggaggaagcacatggcatgagcgccgcaatggggccagaaccagtcgtgcagtctgtcaggggggctgggacccaacccgggccactgctgaagaagccttatcagccaagaataaagatcagcaagaccagcgtggacggcgatccacactttgttgtggacttcccactctctaggctgacagtttgtttcaatattgatggccagccgggggacatcctgcggctggtgtccgaccatagagattccggagtgaccgtcaacggtgaacttataggtgctccggcccctcctaacggacacaagaagcagcggacctacctccgcacaataactatcctgatcaataagcccgagcgctcttatctggagattacacccagccgagtgatcttagatggcggtgaccgactggtgctcccatgtaatcagagtgtggttgttggttcttggggactggaagtatcagtttctgctaacgcaaatgtgactgtcaccatccagggcagtattgctttcgtgattctgatccatttgtataagaaaccagcaccttttcagaggcatcacttgggcttttacattgcaaactcagaaggcctaagctctaactgccacgggctgctgggccagttccttaatcaggacgccagactcacggaagatccggccggtcccagccagaacctgacacatccactgctccttcaggtcggagaaggccccgaggccgtgctcacagtcaagggccaccaagtccctgtagtttggaaacagaggaaaatttacaatggcgaggagcagatcgactgctggttcgccaggaacaatgccgccaagctgattgacggcgagtataaggattatttggcgttccacccattcgacaccggtatggacacttggcctgggaatgtccagggcgccctgaaattggccgccctgaaaatgcaggtccacgagggacagtag

SEQ ID NO: 120812 - DNA, 2229 bp, Artificial Sequence
  Description of Artificial Sequence: Synthetic coding sequence
atgaggaattatgactccggaccccccccatcgactgtgataaatcaaaatgagacgttcgccaacataatctttaagccaactgtggtacagcaggccagaatcgcacagaatggcattttaggtgacttcatcattagatatgacgtgaaccgagagcagtctatcggcgacatccaggtacttaacggatactttgtgcactactttgcacctaaagacctgcccccgttacccaagaacgtagtgttcgtgctcgacagtagcgcttcaatggtggggacaaagttgcggcaaactaaagatgcattgttcaccattttgcatgatctgaggcctcaggacagattcagcatcatagggttcagtaacaggataaaagtctggaaggatcacctgatctctgtcacacccgacagcattagggacggcaaggtttacatccatcacatgagcccgacaggaggtactgatatcaacggtgctctacagcgtgcaattagactgctcaataagtacgtcgcgcatagcggaatcggcgaccgctccgttagcctgattgtgttccttacagacggaaaacctactgtgggcgagacccacacactgaaaattttaaacaacacaagggaggctgcccgagggcaagtatgtatcttcaccatcggcatcggaaacgatgtggactttcggttgctggaaaagctgtccctcgagaactgtggtctcaccagacgggtccacgaggaagaagacgctggctcgcagctcataggattctatgatgaaatccgcacccctctactgagtgatattcgcatagactaccctccctctagcgtcgtccaagccaccaagacactatttcctaactattttaatggaagtgagatcatcattgctggtaagttagtggacagaaagctcgaccacctgcatgtggaagtgaccgcctcaaactcaaaaaagttcatcatccttaagaccgatgtgcctgtgcgtccgcagaaagcaggcaaagacgttacgggatccccccggcccgggggcgacggggagggtgataccaatcatattgaacggttatggagctacctcaccaccaaggagttactgtcctcctggctgcaatccgatgatgaacccgagaaggaaagactaaggcagagagcccaggccctggcggtctcttaccggtttttgaccccattcacctccatgaaactgagggggccggtcccaaggatggacggacttgaggaagcacatggcatgtcagcagccatgggcccggagccagtggttcaatctgtacgcggcgcagggactcaacctggccctctgctgaagaagccatatcagcccagaatcaagatcagcaagacttcagtggacggtgacccgcatttcgtagtggacttcccattgagccgcctgacagtttgcttcaatattgatggacagccaggcgacatccttcggctggttagtgatcatcgggactccggcgtgacagtcaatggggagctgattggagcgccggctccacctaatggtcataagaaacagcggacgtacctgcggactatcacaatactgataaataaacccgagcgttcttacctcgaaatcacaccgagcagggtaatcctcgatgggggggatcggctcgtactgccctgtaatcagtccgtggttgtgggcagctggggtctggaagtttccgtcagtgcgaacgcaaatgttacagtgacaatccaagggagtattgcatttgttatccttattcatctctataaaaagcccgcacctttccagcgacaccacctggggttctacattgcaaactcagagggtctgagctccaattgtcacggacttctgggacagttcctgaaccaggacgcccgccttacggaggatcctgcaggaccaagccagaaccttacccaccctctcctgctgcaggtgggggaggggcccgaggccgtcctcacggttaaggggcaccaggtgccagtagtgtggaagcagcggaaaatatataacggcgaagagcagattgactgttggttcgcccgcaataacgcggccaagcttatagacggggagtacaaggattatttagcattccatccctttgacactggcatggacacatggcctggtaacgtgcagggagccctgaaactggccgccctgaaaatgcaggtccatgaaggccagtag

SEQ ID NO: 120813 - DNA, 2109 bp, Artificial Sequence
  Description of Artificial Sequence: Synthetic coding sequence
atgctactgctgctgggattatgcctcggcctctccctgtgtgtgggctcccaggaggaagcacaatcctggggtcactcatctgaacaggatggactgcgtgtgcccaggcaggtgcgtttgctgcagcggctgaagaccaagccactcatgaccgagttttctgtgaagtccacgatcatttcaagatatgcttttaccactgtgtcttgccgcatgttgaatagagcctccgaggatcaggacatagagttccaaatgcagatccctgctgccgccttcatcacaaacttcacaatgctgatcggagataaggtgtaccaaggggaaatcacagagagagaaaagaagtccggagatcgggtgaaggagaaacgcaataaaaccacggaagagaatggcgaaaagggtactgagatcttcagggcatctgctgtcatcccatccaaggacaaggctgcctttttcctctcttacgaggagctcctccagaggcgactgggaaaatatgagcactcaatatcagtacgcccgcaacaattgtccggaagactctccgttgatgttaacatcttagaatcagctggcattgctagcctcgaagtgctccctctgcataactcacgccaacgcggctctgggagaggcgaggatgatagcgggccacccccatccaccgtaataaaccagaacgaaacgttcgcgaatatcatctttaaaccaacggtcgttcagcaggcaagaattgctcagaatggaatactgggggattttataatcagatatgacgtaaatcgggagcagagtatcggtgatattcaagtgttgaatggatatttcgtccactactttgccccgaaggatttaccaccgctgcccaagaacgtggtcttcgtgttagactcatctgcctctatggttggaaccaaactgcggcagaccaaggatgcgttgttcacaatcctccacgacctgcgacctcaggatcggttctccatcattgggttttctaaccgaataaaggtttggaaagatcacctgatctctgtcacaccggattctatccgcgacgggaaggtttacatccatcatatgtctcccaccggcgggacggacatcaacggggcgcttcaacgtgccatcagacttcttaataaatatgtcgctcatagtggcatcggggaccgaagcgtgtcccttatcgttttcttgactgacgggaagcccaccgttggcgagacacataccctgaagatactcaacaacactagggaggcagctcgaggccaggtgtgtatctttacaattgggattggaaacgatgtggactttcgcctgctcgagaagctgagcctggagaattgtggtttaactagacgggtccacgaggaggaggatgctggtagtcagctcattgggttttacgatgaaatccggactcctctgttgtcagatataaggatcgattaccccccgtcatctgttgttcaagccaccaagacgctcttccccaattatttcaatggatctgaaatcatcatcgctggcaaactggtggatcgaaagttggaccatcttcatgtcgaggtgaccgcctccaactccaaaaaattcattattctgaaaaccgatgtgcccgtgaggccacagaaagccggaaaggacgtgaccgggtccccgcggcctggcggggatggggaaggagatactaatcacattgagaggctttggtcttatctcacaacaaaagagctcttgagctcatggttacagtcagacgacgaaccagagaaagagcgattgaggcagagggcgcaggcgctggccgtatcctaccgattcctcacccccttcacttctatgaagttaaggggtcccgtgccgcggatggatggcctagaggaggctcatggtatgtctgccgcaatgggtcccgaacccgtcgttcagtcggtccggggcgccggcacgcaaccaggaccactcttgaaaaaaccctaccaacctagaattaaaatatctaaaaccagtgttagaggattccggcgggaagaacagatattctctaatgtcatgaaatttccattcgcttcaatattggagctttag

SEQ ID NO: 120814 - DNA, 2088 bp, Artificial Sequence
  Description of Artificial Sequence: Synthetic coding sequence
atgttgcttctcttgggtctttgtctcggactttctctgtgcgtaggcagccaagaagaagctcagtcatggggacactcgtctgagcaagacggcctgcgggttcctcgacaggtgagactactgcagagactaaaaaccaagcccctcatgacggagttctccgtgaaaagcacgatcatctcacgatatgcttttactacggtctcctgtcggatgttgaatcgagcctccgaggaccaggacattgaattccagatgcagatacctgccgcggcattcatcaccaactttaccatgctcatcggggataaagtgtaccagggcgaaattactgagcgggagaaaaagagcggcgatagagtcaaggagaaacgtaataaaactaccgaagagaatggcgaaaagggaacagaaatcttccgagcgtcagctgtcattccatccaaggataaagctgcattttttctgtcctatgaagagctcctccaacgacggctggggaaatatgagcactctatctcagttcgcccgcagcaactttctgggcgtctgtctgtggatgtgaacattctcgaatctgccggcatcgcttcgttggaggtacttcctctccacaacagtcgacagcggggaagcggacgaggagaggatgactctggacctcctccaagcaccgtcatcaaccaaaatgaaacattcgctaatataatcttcaaacctacagtggtacaacaggcacggatcgcccagaacgggattttgggggactttattattcgctatgacgtgaacagggagcaatccattggtgatatccaggtgctgaatgggtatttcgtccactatttcgcacccaaagatctgccaccactgccaaagaatgtggtatttgtgcttgactcaagcgcctctatggtcggtaccaaacttcgacagaccaaggatgcactcttcaccattctgcacgatttgagaccgcaggaccgtttcagcatcatcggtttcagcaacagaatcaaggtctggaaagatcacctcatctctgtaacccctgattccattagggacggcaaagtgtacatacaccacatgtctccaacgggcggtaccgatattaatggtgccctacagagagccatccgactcctgaataagtatgtggcccactctggcatcggcgacagatctgtgagcttgatcgttttcctgactgatggtaagcccacagtaggagagacacacacgcttaagattctcaataacaccagggaagctgctcgcggacaagtctgtattttcacaattgggatcggtaacgatgttgatttcagactcttagaaaaattgtcgctagaaaactgcggcctcacaaggagggtgcacgaggaagaggacgcggggtcacagctcattggcttttatgacgagatccgcacaccccttctgtctgacattcgtattgactatcctccatctagcgttgttcaggccacaaagacattgtttccaaactactttaacgggtctgaaatcataatagccgggaagttggtcgatcgcaagctggaccacctgcacgtggaagtgactgcttcaaactcaaagaagtttatcatcctcaaaacagacgtgcctgtgcggccacagaaagcagggaaagacgtgacaggctccccacgcccagggggcgacggagaaggtgacaccaatcacattgagagattgtggtcctatttgaccactaaagaactgctgagttcctggctgcagagtgacgatgagcccgaaaaagagagattgcgccagcgcgctcaagccctggctgtctcttatagattcctaacaccttttacgtccatgaaactgcgaggacccgtgccacgaatggatggcctggaagaggcccatgggatgtcagcggcgatgggccccgaacctgtggttcagtcagtccgcggagccgggactcagccaggtcccctgctgaagaaacccccaaactctgttaaaaagaagcagaataagacaaagaaacgacacggcagggatggagtctttcccctccaccatctgggaatccgctag

SEQ ID NO: 120815 - DNA, 2172 bp, Artificial Sequence
  Description of Artificial Sequence: Synthetic coding sequence
gattcaggtcctcctccctccacggtgataaaccagaatgagacttttgcaaacattattttcaaacccaccgttgtgcagcaagcccggatagcgcagaatggtatcctaggggattttatcatccggtacgatgtaaaccgtgagcaatccatcggtgatatacaagtgctgaatggatacttcgtgcactacttcgcacccaaggacctgcccccactgcccaagaacgtggtctttgtcctggactcttcggcttcgatggtgggcacgaagctgcgccaaaccaaagatgccttgtttacaatccttcacgatttgcggccccaggataggttcagcatcatcggtttcagtaacagaataaaagtgtggaaggatcatctaatctctgtgacccctgactccattcgtgacggtaaagtatacatacaccatatgagcccaaccggcgggactgacatcaacggcgccctgcagagggccattcggttgctgaataaatacgtcgcccatagcggaatcggcgataggtccgtttccctgattgtattcctgacagacgggaagccaacggtcggggaaacccatacgttgaaaatcctcaataacactagagaagctgcacgcggtcaagtatgtatttttaccatcgggataggaaacgatgtagactttcggttgcttgagaaacttagtctcgagaactgtggcctgaccaggagggtgcatgaggaggaagatgcaggcagtcagctgattggtttctacgatgagattagaacgcctctccttagcgacatccgaatcgactatccaccctcctcagtcgtgcaggcaaccaagaccctgttcccaaactactttaacggctctgagatcatcatcgcgggtaaactagttgatcgcaagctcgatcaccttcacgttgaggttaccgcctctaattccaaaaagtttattattctaaaaacagacgtacccgtgagacctcagaaagccggcaaggacgtcacaggatctccgaggcccgggggagatggcgagggcgacacaaatcatatcgaaaggctgtggtcttatctgacaaccaaggagttactctcttcctggctgcagagcgacgacgaacctgagaaagagcgcttgagacagcgggctcaggccctggccgtaagctatcgatttcttacaccgttcacatctatgaagcttcgtgggccagttccgaggatggacgggctcgaagaagcccatggtatgtccgcggcgatgggtcctgaacctgttgttcagtctgttcgtggtgctggtactcagcccggtccgctacttaagaaaccttaccagccaaggattaaaatcagtaagactagcgtggatggcgaccctcatttcgtggtggattttccactgtcccgacttaccgtgtgcttcaatatcgacggacagcccggggatattctgagacttgtctctgaccaccgcgatagtggcgtgacagtaaacggcgaactcatcggagctcccgctcctcccaatggacacaaaaaacagcgaacctatctcagaacaattacgatcttgataaataaacctgaaaggtcctacctagagataactccgtcaagagtcatcctcgacggtggtgaccgactcgtgctaccttgcaatcaatcagtggttgttggctcatggggtctcgaggtgtctgtgagtgctaacgcaaacgtgacagtgacaattcaggggagtatcgcatttgttatcctgattcacttgtacaaaaaaccagctccttttcagaggcaccacctgggcttctacatcgccaatagcgagggactgtcaagcaattgccacggcctcctcggccagttcctgaaccaggacgcccgtctgacagaggatccagccgggcccagtcagaacctgacacaccctttactgttacaggtcggcgagggacccgaggccgttcttaccgtgaaaggccatcaggttccagtggtctggaaacagcgcaagatctacaatggagaggagcagatcgactgctggttcgcgagaaacaatgccgcgaaactgatcgacggggaatacaaagactaccttgcattccacccttttgacaccggcatgttgggcagagggatgtcaagagagctttag

SEQ ID NO: 120816 - DNA, 1599 bp, Artificial Sequence
  Description of Artificial Sequence: Synthetic coding sequence
atggcacctagtagcccccggcccgccctgcccgctctgctggtattgctgggggctctattcccaggaccagggaacgcccagacatccgtctctccctcaaaggtaatcctcccccggggtgggtcagtgttggtcacgtgctccacttcctgcgatcagcctaagctgctgggaatagagacccctctccccaagaaggaactgctgctgcctggcaacaataggaaagtgtatgaactgtccaacgttcaagaagatagtcagcccatgtgttacagcaattgccctgatgggcagtccaccgcaaagacattcttaaccgtttattggacccctgagcgcgtggaactagccccactgccgtcatggcagccggtgggtaagaatctgactctgcggtgccaagtggagggtggggcccctcgcgctaatcttaccgttgtgctgctgcggggggaaaaagaactgaagagagaacccgcggtgggcgaaccagctgaggtgaccactactgtgctcgttcgacgggaccaccacggtgcgaacttcagctgcagaaccgagctcgaccttagacctcaggggctggaactctttgaaaatacttcggctccttaccagctgcagacttttgtgctccctgccacccccccgcagctggtgagtcctcgagtccttgaagtggatacacaggggaccgtggtctgcagtctcgacgggctgttccccgtatcagaggcacaagtgcatctggcgcttggcgaccagaggctaaaccctaccgtcacgtacgggaacgacagcttttccgccaaagcaagtgtatctgtgacagccgaggatgagggcactcaacgcctgacctgtgctgtaatacttggaaatcagtcgcaggagacgctccagaccgtcaccatatattcttttcctgctccaaacgtaatcctgaccaagccagaggtttcagaaggcaccgaggtgaccgtgaaatgcgaagcacatcctagggcaaaagtcactctgaatggagtgcctgcccagccgttgggcccaagagcacaactcctcctgaaggccactccagaagacaacgggcgaagcttttcatgctctgcaacactagaagtggctggacagctgatccacaagaaccagacccgggaactgcgggtgttatacggcccacgactggatgagagggattgtcctggtaactggacctggcctgagaactcacagcagacaccgatgtgccaggcatggggtaacccactcccagaacttaaatgcctgaaagacggaacatttccgctgcctataggtgagagcgtgaccgtgactcgtgacctggaggggacttatctgtgcagggcgcgctccactcagggcgaggttactcggaaggtgactgtgaacgtgctctccccacgatacgagatcgtgatcatcacggtggtggccgctgccgtcatcatgggtactgctggactgagcacctatctttacaatcgacaacgaaagatcaaaaagtacagactgcagcaagcccagaaaggtactcctatgaagcctaatacacaagctaccccaccttag

SEQ ID NO: 120817 - DNA, 933 bp, Artificial Sequence
  Description of Artificial Sequence: Synthetic coding sequence
atggccccgagtagccccagacccgccctgccagcactgctggtgcttctcggcgcccttttccccgtgtcggaagctcaggttcacttggctctcggcgaccagcggctaaatcccacggttacatatggcaacgactccttttctgctaaggctagcgttagtgtgaccgccgaggacgaggggacccagaggcttacatgcgctgtgattctggggaatcagtcccaggagactctccagaccgtaaccatttattctttccccgctccaaatgtaatactcacaaaacccgaggttagcgaagggaccgaggtaacagtaaagtgtgaagctcacccaagggccaaggtcacgctgaacggcgtgcccgcccagccgctgggaccacgggcccagctgcttctgaaagctacgcccgaggataacggacgctcgttttcttgtagcgctaccttggaggtggctgggcagctgattcataagaaccaaaccagagaattaagggtgctgtatggacctcgcttggacgagcgggactgtcccggaaactggacttggcccgagaacagccagcagacgcctatgtgccaggcgtggggaaatcccctcccagaactgaaatgcctgaaagatgggaccttcccactgccaattggcgagtctgtgactgttacaagggatcttgagggaacctatttatgcagagcccggtccacccagggcgaggtcacacgcaaggtgactgttaacgttctgtccccccgatatgagatcgtgatcatcacagttgtcgccgctgccgtaatcatggggactgcagggttgtccacctacctttacaaccggcaacgaaaaatcaaaaagtaccgccttcagcaggcacagaagggcactccaatgaagcctaatacacaggcgactcctccttag

SEQ ID NO: 120818 - DNA, 828 bp, Artificial Sequence
  Description of Artificial Sequence: Synthetic coding sequence
atgagttcctttgggtataggaccctaacagtagccctgtttactttgatttgttgtcccggcagtgatgagaaagtctttgaggtacacgtgcgcccaaagaagctggctgtggaacccaaaggctccttagaggtgaattgcagcactacatgcaaccagcccgaggtcggtggactggaaacctccctggacaaaatcctgcttgacgaacaggctcagtggaagcattatttggttagcaacatttcccatgataccgtcctgcagtgtcatttcacatgttccgggaaacaggaatctatgaactcaaatgtgagcgtgtaccagccccctagacaggtgatcttaacattacagcctactctggtcgcagtgggtaaaagcttcactattgagtgcagagtcccgacagtcgagccactcgattctctgaccttgtttttatttagggggaacgaaacactacactacgagacctttgggaaggctgccccagccccgcaggaggccactgcaacctttaacagcacagctgatagagaagatggccacaggaatttcagctgcctcgcagtcctcgacttgatgtcccgggggggcaacatttttcacaagcacagcgcaccaaagatgctggaaatctatgaaccagttagcgactcacagatggtgatcatcgtgaccgtggtgtccgtgctgctgagcctgttcgttacatctgtacttttatgtttcattttcggacagcaccttaggcagcagcggatgggcacatacggagtgagagcagcttggcgtagacttcctcaggcctttcgtccctag

SEQ ID NO: 120819 - DNA, 828 bp, Artificial Sequence
  Description of Artificial Sequence: Synthetic coding sequence
atgtcctcctttggatataggaccctgacagtcgctctgttcacactaatctgctgccctgggtccgatgagaaagtgttcgaagtccatgtccggccaaaaaagttagcagtggaaccaaaaggatccctcgaagttaattgctcaactacatgtaatcaacccgaagtcggcgggctcgagacaagtcttgataaaattcttctggacgaacaggcccagtggaagcattacttagtcagcaatatcagccacgacacagtgcttcagtgccactttacctgttcgggaaagcaggaaagcatgaattccaatgtgagcgtttaccagccgccccgtcaggttatcttaacactacaacctacattggtagctgtgggaaaaagtttcactattgagtgccgagtcccaaccgttgaaccgctcgatagcctaactctttttttattccgcgggaacgagaccctgcattacgaaacattcggtaaggcagcaccagcccctcaagaagcgaccgccacatttaacagcactgccgacagagaggacggacaccgtaacttttcttgcttggccgtgctggacctgatgtcaagagggggtaatatctttcacaagcacagcgccccaaagatgctcgagatctatgaaccggtttctgattcccagatggtgatcatcgtcacagtggtgagcgtgctgctctccttgtttgtgacatcagtcctgttatgttttatattcggacagcaccttcggcagcaaagaatgggcacctacggtgtgcgggccgcttggcgccggctgcctcaggcattcaggccctag

SEQ ID NO: 120820 - DNA, 828 bp, Artificial Sequence
  Description of Artificial Sequence: Synthetic coding sequence
atgtcatcttttggttaccgcaccctgactgtcgctttgttcaccctcatctgttgcccagggagcgacgagaaggtgttcgaggtccacgtcaggccaaagaagctggctgtggagccaaagggaagcctggaggtgaactgctcaactacgtgtaatcagccagaagttggcggcctagaaactagcctggacaaaattctgcttgatgaacaggcccaatggaagcactacctagtctccaatatcagccacgacaccgtactgcagtgccactttacatgttccggaaagcaggaatcaatgaattctaacgtgtcagtgtaccagccccctaggcaggtgatcttgaccctgcaacctaccctggttgctgtcggtaagtcttttacaatcgagtgccgcgttccgaccgtggaaccactggacagcctcacactgttcctttttcggggcaacgagactctgcactacgagacgtttgggaaggcagcaccagccccccaagaagctaccgctacttttaactcaaccgccgacagggaggacgggcacaggaacttttcctgtctggcagttcttgatcttatgtctcgaggaggtaacatatttcacaagcactctgcccctaagatgttggaaatatacgaacccgtgtctgatagccaaatggtcattatcgtgaccgtggtgagtgtactgctctcattgttcgttactagtgtactgctctgctttatcttcggtcagcatctcagacaacagcggatggggacttacggggttcgtgcagcgtggaggcgactcccccaggcattccgcccttag

SEQ ID NO: 120821 - DNA, 828 bp, Artificial Sequence
  Description of Artificial Sequence: Synthetic coding sequence
atgtcaagttttggataccggacactcaccgtggccctatttaccttaatctgctgcccaggtagcgacgagaaagttttcgaagtgcacgtgcgcccaaagaaactagctgtggaacccaagggcagtctggaggtcaattgttccactacatgcaatcagcccgaggtggggggactggagacatcactggacaaaattctcctggacgagcaggcacagtggaagcattatctagtgagcaatatctcccacgataccgtcctccagtgtcattttacttgttcaggcaagcaggagagtatgaacagtaacgtatcagtgtatcaacctccaaggcaagtgatattgacactgcaacccacattggtggcagtggggaagagttttaccattgaatgccgggtccccactgtcgagccactcgatagccttacactgtttctattccgtggaaatgaaactttgcactacgaaacctttggtaaggccgcgccggctcctcaggaagcaacggccacttttaactctactgctgaccgggaagatggacaccggaacttctcctgccttgccgtgttagacttgatgtcacggggaggcaatattttccataagcatagcgctccaaaaatgcttgaaatttatgagcctgtttccgacagccagatggtgatcatcgtgacagtggtcagcgtcctgttgagccttttcgtcacctcagtgttgctctgtttcattttcggccagcacctcaggcaacagagaatgggcacctacggcgttcgcgctgcttggagacgcctgcctcaggcatttcgcccctag

SEQ ID NO: 120822 - DNA, 828 bp, Artificial Sequence
  Description of Artificial Sequence: Synthetic coding sequence
atgagctctttcggctaccggacgctgaccgtggccttgttcacgctgatctgttgccccgggtcagatgagaaagtgtttgaagtgcatgtgaggcctaaaaaactggccgttgaacccaaagggagcctggaagtcaactgctccaccacctgtaatcaaccagaggtggggggcctggaaacttctctggataaaattctgttagatgagcaggcccaatggaaacattacttagttagtaacatctctcacgacactgtgctgcagtgtcacttcacctgctctggtaaacaggagagcatgaatagtaatgtgtccgtctaccaacctccccggcaagtaatcctcaccctacagccgaccttggttgctgtcgggaagtcatttactatcgaatgcagggtccccaccgtggagccactggatagtctgactctttttctattccggggaaacgaaacactgcactatgaaacctttggcaaagcggctcccgcccctcaggaggcaacagcaacctttaacagcactgctgatagggaagacggccatcgtaacttttcatgtcttgcggttctcgatctgatgtctcggggaggaaacatctttcacaaacactctgcacccaaaatgctcgagatttacgaaccggtctccgatagtcagatggtcattatcgtgactgtggtgagcgtgcttctctctctgtttgtgacctccgtcctgttgtgtttcattttcggacaacatcttaggcagcaaaggatgggaacatacggtgtaagggcggcttggcgcagactcccccaggcctttcgcccttag

SEQ ID NO: 120823 - DNA, 1644 bp, Artificial Sequence
  Description of Artificial Sequence: Synthetic coding sequence
atggccacaatggtcccctcagtgctatggcctagagcctgttggactcttcttgtctgttgcctattgactcccggagttcagggtcaagaatttttgctgcgggtcgagccgcagaatcccgtgttatccgccggcggttcactctttgtgaactgctcaacagactgtcccagtagtgagaaaatcgccctcgagacgtccctttcgaaagaactcgtggctagcgggatggggtgggctgcatttaacctgagtaacgtgaccgggaactcaagaattttgtgcagcgtgtattgtaatggttcacagattactggctcctctaacattacagtctataggctgccggagcgggtcgaacttgctccgctgcccccctggcagcctgtgggccaaaactttactctcaggtgtcaggtggaggacggctctccgcgaacctcgctgactgtcgtgctgctaaggtgggaggaagaactgtcccggcagccagcggtggaagaaccagcggaggttactgccacagtattggccagcagggatgaccatggcgctcccttctcctgtagaactgagctcgacatgcaacctcagggattaggactgttcgtgaatacgagcgctccccgccagctgcgaacattcgtgctcccggtgactcctcctcgactggtggcgccgcgcttcctcgaggtggaaacatcctggccagttgactgcacacttgatggcctctttcccgcctcagaagcgcaagtgtatctagccctgggagatcaaatgcttaacgcgaccgtgatgaaccatggagatacgcttactgctaccgcgaccgctacggcacgtgctgaccaggagggggctcgggagattgtgtgcaacgtcaccctggggggggagcgaagagaggcccgtgaaaacctgaccgtgttttccttccttggacctattgtaaatcttagcgaaccaaccgcacacgaggggtccaccgtgaccgtgtcatgcatggctggcgccagggtgcaggttacgctggatggcgtgcccgctgccgcccccggtcagcccgcccaactgcagcttaatgctacagaaagcgatgatggaagatccttcttttgctccgccactctcgaggttgacggcgaattcctccacagaaactcctccgtccaattaagggtgttgtatggcccaaaaatcgatagggccacatgtccccagcatttaaaatggaaggataaaacgcgccatgttctgcagtgccaggccagaggcaacccatatccggaacttcgctgcctgaaggagggctccagtcgtgaggtccctgtaggcattccattttttgtgaatgtcacgcacaacggaacctatcagtgccaagcttcttcttcaagaggcaagtataccctcgtagttgtcatggatatcgaggctgggtctagccacttcgtccctgtgttcgtggctgttctgctgacccttggagttgtgacaattgtcttggctttgatgtacgtgtttcgcgagcaccaacgctccggatcgtaccacgtcagagaagaatcaacatacttgcctctgacgagcatgcagcccacagaagctatgggggaggagcccagtcgagctgagtag

SEQ ID NO: 120824 - DNA, 819 bp, Artificial Sequence
  Description of Artificial Sequence: Synthetic coding sequence
atggggtctctgtttcctctttccttgctcttcttccttgccgcggcctatccgggcgtgggatcagccctgggcagacggacgaaaagggcgcaatcccctaaagggtctccactggccccatccggcacttcagtgcccttttgggtgcgcatgtcacccgagttcgtcgccgtccagcctgggaagagcgtgcaactcaactgtagtaactcatgcccacaaccgcagaattcttcgctgaggaccccattacgacaaggtaagactctacgggggcccgggtgggtcagctaccagctgttggatgtgagagcttggtcctctctcgcccactgcctggtgacctgtgccgggaagactaggtgggccacttcaaggataacagcctattcggtgcccggtggtctacttgggggagaccctgaagcctggaaacctggacacctgttccgaaaacccggggcactgcatagaccaggcagtggccaaagagaccttgacttaagggtctgctgctggactccgcggctgctggctgctcgtgacttacctcgagccccccaatccaggagacccgggggtccccagcaacttggcacccattatactgacgcaagattggaaccaagggcacattccttcggcttgaggttccaccgctgcccctgcagagatcccccacactgcggaagatgtgtacctatgcaggtgccctcatacgaagtaccaggggtaaagggggatgtgctttgcagattatcagagaagaagcggaacatgaagcaatccggagagatggccattcatggtggatag

SEQ ID NO: 120825 - DNA, 816 bp, Artificial Sequence
  Description of Artificial Sequence: Synthetic coding sequence
atggggtccctgtttcctctgtcattactgttttttcttgcagccgcttaccctggcgtgggatcagccctcggaaggcgaactaagcgggcgcaaagtcccaagggctcccctctcgctccatctggcacatctgtgcccttttgggtgcgcatgagcccggagttcgtggccgtacaacccggaaagtccgtacaactgaactgttctaacagttgcccacagccgcagaactccagcctgcgcactcccctccggcagggcaagaccttgcgagggcccggttgggtgtcttatcagctgctggatgttcgcgcctggtctagcttggctcactgcctggtgacctgcgcaggcaagacccggtgggcaaccagtcgcatcaccgcctacaaaccccctcattccgtgatcctcgagcctcctgtgttgaaggggcgaaaatacacactcaggtgccacgtcactcaagtgttccctgttgggtacctggttgtaaccctgcgacacgggtctcgggttatctattccgaaagcctggagagatttacagggctggatcttgctaacgtcaccctgacatacgagttcgcagcaggccctcgcgacttctggcagccagtgatttgccacgccaggctaaacctggatgggctcgtggtccgtaattcctccgcgcccattacactgatgctcgcatggagccctgcgcccacagctttagccagcggttctattgccgcactcgttggcatactgctgactgttggcgccgcctacctatgcaaatgcctcgcaatgaagagccaggcctag

SEQ ID NO: 120826 - DNA, 714 bp, Artificial Sequence
  Description of Artificial Sequence: Synthetic coding sequence
atgggatcactttttccgctgagtctgctctttttcctggcagctgcgtacccaggtgtgggctccgcgttggggagacgaacaaagcgggcccaaagtccaaagggctcccccctggccccttcagggacatccgttccattttgggtgcggatgagcccagaattcgttgccgtccagccaggtaagagcgtacagttaaactgcagcaattcttgtccacaaccacagaatagctcactgagaaccccgctgcgtcaggggaagaccctccgaggccctggatgggtgagttaccagttactagacgttagagcctggtcaagcttggcccactgcctggtgacctgcgctgggaagactagatgggctacctctcgaatcacagcttacaaaccaccgcattctgtgattctcgaacctccagtacttaaagggagaaaatacacactcaggtgccatgttacacaggtgttcccagtgggttacctcgtggtaacccttcgtcacgggtctcgcgtgatttacagcgaaagtttggaacggttcactggcctcgacttagcaaatgtaacgctgacctacgaatttgccgctggaccgagggatttctggcagcctgtcatatgccatgcaagactgaacctggacgggctagtcgtgaggaattcatccgctcctatcacactcatgcttggcgaagcccctctgtag

SEQ ID NO: 120827 - DNA, 498 bp, Artificial Sequence
  Description of Artificial Sequence: Synthetic coding sequence
atggagctctgcaggagcctggctttgttaggcgggtcactcgggctcatgttctgcctgatcgctctttccaccgacttttggtttgaggccgttggccccacccacagcgcccactccggactgtggccgaccggtcacggagatatcatcagtggctacatccatgtgacacagaccttcagcatcatggcagtgctgtgggcgcttgtatccgtctccttcctggtgttaagttgttttcccagcctgtttccaccaggccatgggcccctagtgtccactacggccgcttttgcagctgccatctcaatggtcgtcgctatggcagtctatacctccgaacggtgggaccagcctccccacccccagatccagaccttcttctcttggtcattttatcttggctgggtcagcgccatactgttgctttgcactggagctctgtcccttggagctcattgcgggggtccacggccgggatacgagacactttag

SEQ ID NO: 120828 - DNA, 1674 bp, Artificial Sequence
  Description of Artificial Sequence: Synthetic coding sequence
atgatggtggtgctgctaggggcaacaacattggttctggttgcagtggccccttgggtactgtccgcggctgccggaggcaaaaatttgaagagtccccagaaggtagaggttgacataatagatgataatttcattcttagatggaacagaagtgacgagtcagttgggaatgtgaccttcagcttcgattatcagaaaactgggatggacaattggattaagctgtcaggttgccagaacattacgtcaactaaatgtaacttctcgtcactaaaactgaatgtgtatgaggagattaagctgcgcatccgcgctgagaaggaaaatacatcttcttggtacgaggtggattccttcaccccatttagaaaagcccagatcggccctcctgaagtgcacttggaagcagaggacaaagctatcgtgatccacattagccccggtacaaaagattccgtgatgtgggccctggatggccttagctttacttattctctcgtgatttggaagaacagtagcggcgtggaggaaagaatcgagaatatttatagccgtcataagatttataagctctcgccagagacaacctactgcctcaaagttaaggcagccctgcttaccagctggaagattggggtgtactcccccgtgcattgtataaagactaccgttgaaaatgaactcccccctcccgaaaacatcgaagtctcggttcagaaccaaaattatgttctaaaatgggattacacctacgccaacatgaccttccaggtgcagtggctgcacgcctttcttaaacggaacccgggcaaccatctatataaatggaagcagattccagactgcgagaacgtgaaaaccacacaatgtgtcttcccccagaacgtcttccagaaaggcatttatcttcttcgggtgcaggccagtgatggaaacaatacgtcattttggtccgaagaaattaaattcgacaccgaaattcaggcattcctactcccccctgtgttcaatatccgctccctctcagactcattccacatatacatcggcgcccctaagcagtctggaaatacccccgtcatccaagactacccactgatttatgagattatcttctgggagaacacttcgaatgccgaaaggaagattatcgaaaagaaaaccgatgtgactgttcctaatctgaaaccactgacggtttactgcgttaaggcacgcgcccacaccatggacgaaaaactcaacaaatcatccgtgttctccgatgccgtctgcgaaaaaaccaaacccgggaacacctcgaagatttggctcattgtgggtatatgcatcgcactgttcgccctcccttttgtgatctacgcggccaaggtgtttctgcggtgtatcaattacgtctttttcccctctcttaagcccagctccagcatagacgaatacttcagtgagcagccgctgaagaatctgttactgagcactagcgaggagcagatcgagaaatgctttattatcgagaatatctctacaatagccactgttgaggagactaatcagacggacgaggaccacaaaaaatacagcagccagactagtcaggattccggaaattactctaacgaggacgaatctgagagtaaaactagcgaggagctgcagcaggacttcgtttag

SEQ ID NO: 120829 - DNA, 1467 bp, Artificial Sequence
  Description of Artificial Sequence: Synthetic coding sequence
atggataactggatcaaactaagtggctgtcaaaacatcacgtcaaccaagtgtaattttagttcgcttaaactgaacgtgtacgaggaaatcaagctgcgcattcgcgcggaaaaggaaaacaccagttcttggtatgaagttgatagcttcacacctttccgcaaggcacagatcggacccccagaggttcatcttgaggccgaagataaagctatagtcatacacatctccccaggaaccaaagacagcgtgatgtgggccctggacggtctgagcttcacctacagcctcgtcatttggaagaactcaagtggagttgaggaacgcattgagaacatctacagcagacacaagatttataaactctccccagagaccacttattgtctgaaagtgaaggccgcattgctgacctcttggaagataggagtttatagtccagtgcactgtattaagacaaccgtggagaacgagctgcctcctccagagaatatcgaagtgagtgtgcagaaccagaattacgttctgaagtgggattacacctacgcaaacatgacctttcaggtgcagtggctgcacgcatttcttaagcggaacccggggaatcacctgtacaagtggaagcagattcctgattgcgaaaatgttaaaaccacccagtgcgtgttcccccaaaatgtctttcaaaaaggtatctacctgcttcgggtccaagcatctgatggcaataacactagcttctggtctgaagaaatcaagtttgacaccgaaatccaagcgttcctgttgccccctgtcttcaacatacgctctctcagcgattcattccatatttatatcggggcccccaagcagagcggcaacacaccagtcatccaggactaccccctgatctatgagatcattttttgggaaaatacctccaatgctgagcggaaaattatagaaaagaaaacagatgtaactgtccctaacttgaaacctctgacagtttattgcgtgaaagcccgagcccacaccatggacgaaaagcttaataagtcctctgtctttagcgatgcggtgtgtgagaagaccaaacctggaaatacaagtaagatctggttaattgtggggatctgtattgccctatttgcgctgccatttgtgatctatgccgccaaggtgttcctgaggtgcataaattatgtattttttcctagtttaaaaccgtcatcttctatcgatgaatatttctccgagcaacctttaaaaaacctcctgttgagcacgtcagaggagcaaattgagaagtgctttataattgaaaacatttctaccattgccactgtggaagagaccaaccagactgacgaggatcataagaagtattcgtctcaaacatcacaggactctggaaactactccaacgaagacgaaagtgaatctaaaacaagtgaggaactgcaacaagattttgtgtag

SEQ ID NO: 120830 - DNA, 1491 bp, Artificial Sequence
  Description of Artificial Sequence: Synthetic coding sequence
atgatggtcgtactgctgggcgccaccacacttgtgcttgtggctgtcgccccatgggttctgagtgctgcggctggtggaaagaatctaaaaagcccacaaaaggtggaggtggacattattgatgataacttcatcttaaggtggaaccgctccgatgaatctgtcgggaatgtcacattcagctttgattaccaaaagaccgggatggacaattggatcaagctcagcggctgtcagaacatcaccagtactaaatgtaacttcagttccctgaagctgaacgtctacgaagaaatcaagctgcgtattagagctgagaaagaaaacacatcctcctggtatgaggttgatagctttacacccttccgcaaggcccagataggccctccagaggtgcacttagaggccgaagataaggcgatcgtgattcacatctcgccaggcaccaaagattccgtgatgtgggccttagacggactctccttcacctactccctggttatatggaagaatagctccggcgtggaggaaaggatagaaaacatctatagtagacacaagatctacaaactttccccagagaccacgtactgtcttaaagtgaaggcagctctcctcaccagttggaagatcggtgtgtactcccccgtgcattgcataaagacaaccgtggaaaacgagttgcctccacctgagaatatcgaagtttccgtacagaaccaaaattacgtgttgaagtgggactatacttacgctaacatgacatttcaggtgcagtggttgcacgcctttctgaagcggaatcctggcaatcacctttacaagtggaagcagatcccagactgcgagaatgtaaagactacccagtgcgtttttccacagaacgtgttccaaaaagggatttacctccttagggtgcaagcctccgatgggaacaacactagtttctggagtgaggagatcaaatttgacacagagatccaggcctttctcctgcctcctgtgttcaacataagatctctgagcgactcgttccacatctatattggcgcccctaaacaatcaggaaacacgcctgtcattcaggattacccccttatctacgagatcatattttgggagaacacctccaacgccgaaagaaaaattattgaaaagaagacagatgttactgttccaaacctgaagcccctcacagtctactgtgtgaaggcacgtgcccacaccatggacgagaatgatgctgtctgtgaatacttttcagaacaaccgctgaagaatctcctactgagcacaagtgaggagcagattgagaaatgtttcatcattgagaacatatctacgatcgccacagtagaggaaactaaccagactgacgaggatcacaaaaagtattcctcccagacaagtcaggactcagggaactattccaacgaggacgagagtgaatccaagacttccgaagaactgcagcaggattttgtgtag

SEQ ID NO: 120831 - DNA, 1548 bp, Artificial Sequence
  Description of Artificial Sequence: Synthetic coding sequence
atgttactcagtcagaacgccttcatcttccggagcctaaatctggtgttgatggtctatatctcattggtattcggcatctcttacgacagccccgattacacagacgagtcttgcacgttcaagataagtttgcgaaatttccgcagtatactctcgtgggagctgaaaaaccactctatcgtgcccacacactataccctgctgtacacaataatgtctaagcctgaggacttaaaggtagttaagaattgtgccaataccacccgcagtttctgtgacctgacagatgagtggcgaagcacgcacgaagcatacgtgacagtgttggaaggattttccggcaacaccacacttttctcttgcagccacaacttctggttggcgatcgatatgtcatttgagccaccagaatttgaaatcgttggctttacaaatcacatcaacgtcatggtgaagtttccctctatagtggaggaagagcttcagtttgatctatctctagttatcgaagaacagtcagaaggtatagtgaagaaacacaaaccagagataaaaggaaatatgtcaggaaatttcacttatatcattgacaagctgatacccaatacgaactattgcgtttctgtgtacttagaacactcagacgagcaggcagtgatcaagtcccctcttaagtgcaccctgttgccacccgggcaagaatcggaatctgcagagtccgcaaagatcggtgggatcattaccgtgttcttaattgccctggtcctgacttcgactatcgtgacgcttaagtggattgggtatatctgcttacggaatagtctgcccaaagttctgaatttccataacttccttgcatggccctttcccaatcttcccccactcgaggccatggatatggttgaagttatttacattaacagaaagaagaaggtgtgggactataactatgacgacgaaagtgattccgataccgaggccgcccctagaactagtggcggcggatacacaatgcatggcttaacagtgcggcccctggggcaggcatctgccacttccactgagagtcagttgatagaccctgaatctgaggaggagcccgacctcccagaggttgacgttgagctaccgaccatgcccaaagacagccctcagcagctagaactactgtcaggaccctgtgaaagaagaaagtcccctttgcaagacccattccccgaagaagattacagttccaccgaggggtccggcgggcgcatcactttcaacgtggatctgaatagcgtgttcctcagagtcctagatgatgaagatagtgacgatctagaggccccacttatgctgtcaagccatctcgaggagatggttgatcccgaagacccagacaatgtgcagagtaatcatcttcttgcctccggggagggaacgcaacctacatttccatcaccttccagcgagggcttatggagcgaggatgcaccttctgaccagtcagacacatcagaatctgatgtggatttgggtgacggctacattatgcgctag

SEQ ID NO: 120832 - DNA, 1548 bp, Artificial Sequence
  Description of Artificial Sequence: Synthetic coding sequence
atgctccttagtcaaaatgcttttattttcaggtcactcaacctggtgttgatggtctatatttccctggtgtttggtatcagctacgactcaccagactacactgacgagagctgcacttttaagatctccttgcggaattttcggtctattcttagttgggagctgaaaaatcatagcattgtgcccacacactacacactgttgtacactattatgtctaagcctgaagatcttaaggtcgttaagaattgtgccaacactactaggagcttttgtgatctgacagatgaatggcgatccacccacgaagcctacgtgaccgtgttggaaggttttagcggaaacacgactctcttttcatgttcccacaatttttggctggcaatcgatatgtccttcgagcctccagagttcgagattgtggggttcacgaaccacatcaacgttatggtgaaattcccatcaattgtcgaagaagagctccagtttgacctgagtttggtaatagaggaacagtcagagggtattgtgaagaagcacaagccagagattaagggaaatatgtccggcaatttcacctacattatagacaagctgatccctaatactaactactgcgtgtctgtttacttggaacactcagacgaacaggcggttatcaagtcccccctgaagtgtacactgctcccaccagggcaggaatcggagagcgccgaatcagcgaaaattgggggcataattacggtgttcttgatcgccttggtcctcacctctacgatcgtcaccctgaagtggattggatacatctgcctgcgcaacagcctgccgaaggtgctgaatttccataattttctcgcttggcctttcccaaatctgcctcccctcgaggccatggacatggtcgaggtgatttatatcaatagaaagaagaaggtgtgggactacaattacgatgatgagtctgattccgataccgaggcagccccaagaacatctggcggtggctacactatgcacggactcaccgtacgccctcttgggcaggccagcgctacatctaccgaaagtcagctgatcgatcccgagagcgaggaggagcccgatctgccagaggtggacgtggagctgcccacaatgcccaaggatagtccacagcagctcgaactgctctccggtccttgtgaacgacgaaagagtccactccaggatcctttcccggaggaggattattccagcacagaaggatccgggggcagaatcactttcaatgtcgatctgaattcagtgttcctgagagtccttgacgacgaggattctgatgatctggaggcaccactgatgctgagctcacatctggaagaaatggtggatccagaagatcctgacaacgtccagagcaatcatcttctggcatctggtgagggtacccagccgactttcccttcaccttcctcggaaggcttgtggtctgaggatgccccgtccgatcagtcagacacatccgaatcagacgtggatctcggggacggatacataatgagatag

SEQ ID NO: 120833 - DNA, 996 bp, Artificial Sequence
  Description of Artificial Sequence: Synthetic coding sequence
atgctgctgtcacagaacgcctttatcttccggtcgctcaacctcgtgctgatggtctacattagtttggtgttcggcatctcctacgatagccctgactacacagatgaatcttgtacattcaaaatttctcttcggaacttccggagtattctttcatgggagctcaaaaaccatagcatcgtgcccacacactacacactgctgtatactatcatgtccaaaccagaggatctgaaagtggtgaagaattgtgctaatacaactagatcattttgcgatcttacagacgagtggagaagcacccatgaggcatatgtgacggttctcgaaggattctccggcaatactaccctcttttcatgctcccacaatttctggctggcaatagatatgtccttcgagccacccgagtttgagatcgtaggctttacgaatcatattaacgtgatggtgaaatttccttcaattgttgaagaggaactgcaattcgatctgagcctagtgattgaggagcagtctgagggcatagtaaagaaacacaagccagagataaagggcaacatgtctgggaattttacttatataattgacaagctaatccccaacactaattactgcgtctccgtatatctggagcattccgacgaacaggctgtgatcaagagccccctgaagtgtacacttctgccccccggccaggaatctgagtcggcagaatccgccaagattggcggcattatcacggtatttctcattgcactggtccttactagcacaatcgttacgttaaagtggattggatatatttgtcttcgaaactccttgcccaaagtcctcagacagggcctcgcaaaagggtggaatgccgtcgctatccacaggtgctctcacaacgctctccagagcgagacccccgagctgaaacaatcttcatgtttatcattcccatcatcctgggactacaagcgagcctcgctctgcccaagcgactag

SEQ ID NO: 120834 - DNA, 996 bp, Artificial Sequence
  Description of Artificial Sequence: Synthetic coding sequence
atgttgctgagccaaaacgctttcatcttcagaagcctgaacctcgtgctgatggtttatatttctcttgtctttggcatctcttacgattcccccgattacacagatgagtcttgtacatttaaaatatccttaagaaacttccggtctatccttagctgggaactcaagaatcactcaatcgttccaacccactataccctactgtacactattatgagtaagccagaggatctgaaagttgtgaagaactgcgctaacaccacccggtccttctgcgacctgaccgacgagtggcgctctacccacgaagcttatgtcaccgtgttagaaggattctcaggcaacacaaccttgttctcttgttcacataacttctggcttgcgattgacatgagctttgagcctccagagtttgaaattgtaggctttacaaaccatatcaatgtgatggtgaaattcccttcaatcgttgaagaagagctgcagttcgacttaagcctcgtgatcgaggagcagagtgagggcatagttaaaaagcacaagcctgaaatcaaaggcaatatgtccggtaatttcacatacatcatagataagctgattccgaacaccaactattgcgtgagtgtttacctggagcatagtgatgaacaagccgtgatcaagtcacccctgaagtgtaccctgctgccaccaggccaggaatctgagagcgccgaaagcgctaagatcggaggcatcatcaccgttttccttattgcccttgtgctgacctccacgatcgtaaccctaaaatggatcggatatatttgcctgcgtaattcattaccaaaagtcttaaggcagggacttgcgaagggctggaatgcggttgccatacacaggtgcagccacaacgccttgcagtccgaaacccccgagctgaaacagagctcgtgtctttcttttcccagctcttgggattacaaaagggcctctctgtgcccaagcgattag

SEQ ID NO: 120835 - DNA, 561 bp, Artificial Sequence
  Description of Artificial Sequence: Synthetic coding sequence
atgctcctgaagtcacccgaaaacagtcttctgcagtttcagttcaaatatggcgtcccaactcctactaacgtgacaattgaatcctataatatgaatcctatcgtgtattgggagtaccagatcatgccacaggtccccgtatttacggtcgaagtcaagaattatggtgtgaagaactcagaatggatcgacgcgtgcataaacattagccatcactattgtaatattagtgaccacgtgggagatccttcaaacagcttgtgggtgagggtgaaggctagggtcgggcagaaagaatcagcatatgccaaatcggaggaattcgccgtgtgtagggatggcaagataggcccccccaaactggatatccgcaaagaagaaaagcagatcatgatcgacatcttccatccctctgtgttcgtgaacggtgacgagcaggaagttgattacgatccagaaacaacatgctacataagagtgtacaacgtgtatgtgcggatgaatggatcggagatcaagagatcttgcgcgttcagcctgtttagctttttcatctag

SEQ ID NO: 120836 - DNA, 1470 bp, Artificial Sequence
  Description of Artificial Sequence: Synthetic coding sequence
atggccctgttattcctacttccccttgtcatgcagggcgtctcccgagccgaaatgggcactgcagatctcgggccttctagtgtgcccacgcctactaacgtgaccatcgagtcctacaatatgaaccccatcgtgtattgggagtaccaaatcatgccccaggtcccggtctttaccgtcgaggtcaagaactatggcgtcaaaaattcagaatggatcgacgcatgtatcaacatttcccaccactactgcaacataagtgaccatgtcggcgacccgtcaaatagtctgtgggttagagtcaaagcccgcgttggacaaaaagaatctgcatatgcgaagtcggaagagttcgccgtgtgtagagacgggaaaatagggccccccaaactggacatacgtaaggaggaaaagcagatcatgatcgatatatttcatcccagcgtttttgtcaacggcgacgaacaggaggtagattacgaccccgagaccacctgttatattcgcgtgtataacgtgtatgtgaggatgaatggctctgagatacagtataaaatcttaactcagaaggaggatgattgtgacgagattcagtgtcaattagctattcccgtcagttctctcaacagtcagtactgcgtgtcagccgaaggcgtgctgcatgtttggggtgtcactactgagaagtcgaaagaggtatgcatcacgatcttcaactcatctatcaagggaagtttatggatccctgtcgtggccgccctcttactgtttttggtgctgtcactcgtgtttatctgcttctacatcaagaagatcaatccgttaaaggaaaaatcaattatactgcctaaatccttgatctctgtggtgcgctctgctaccctggaaacaaagcccgagagtaaatacgtgtcgttgattacctcttaccagcccttttccctggagaaagaggtggtctgcgaagaacctttgtcacccgctaccgttcccgggatgcacactgaggataacccaggtaaggtggaacacacggaagagctctcctcgattacagaagtcgtcacgaccgaagaaaatatcccagatgtggttcccggatcccaccttactccgatcgaaagggagagcagtagtccactgtcgtctaaccagagcgagcccgggagtatcgcgcttaattcctatcatagtagaaactgctccgaaagtgatcattcacgtaacggctttgacactgactcctcttgtcttgaaagtcacagtagcctgtccgacagcgaattcccaccaaacaacaaaggcgaaataaagacagagggtcaggagctgatcaccgtgataaaggctccaacttcttttggatatgataagccacacgtactggtggatctacttgtggatgattctggtaaagaatcgctcatcggctaccgccccacagaagactcaaaggagttttcgtag

SEQ ID NO: 120837 - DNA, 486 bp, Artificial Sequence
  Description of Artificial Sequence: Synthetic coding sequence
atgctgctcaagtcccctgagaattctctccttcagttccagttcaagtacggtgtgccaactcccacaaacgtgaccatcgagtcctataatatgaatcctattgtgtactgggagtaccagataatgccccaggttccggtgtttacagtggaagtgaagaactatggggtgaagaatagtgaatggattgatgcttgcataaacatctcacaccactattgtaatatcagtgaccacgtgggagatccctctaactctttgtgggtgagagtgaaggcacgggtaggtcaaaaagagagcgcttatgccaagtcagaagaattcgcagtttgccgggatgggaaaatcggtccccctaagttagatatccgcaaggaagagaagcagatcatgatcgatattttccacccaagtgtgttcgtgaacggggacgagcaagaagtggattatgaccccgaaacgacatgctatatacgggtctag

SEQ ID NO: 120838 - DNA, 825 bp, Artificial Sequence
  Description of Artificial Sequence: Synthetic coding sequence
atggcccttctttttctccttcccctcgtgatgcaaggagtgtcccgggcagaaatgggtaccgccgatctaggaccctccagcgtgccaactcctacaaacgtgactattgagtcatataacatgaatccaattgtgtattgggaataccagattatgccacaggtgccggtgtttaccgtggaggtaaaaaattacggcgtgaagaactctgagtggatcgacgcatgtatcaatatcagtcaccattactgcaacatcagcgatcacgtgggggatcctagtaactcactttgggtgagggtaaaagcccgagtgggacagaaggagtctgcatacgcgaaaagcgaggaattcgccgtgtgcagagatggaaaaataggtccaccgaaactcgacattcggaaagaagaaaagcagatcatgattgatattttccacccatccgtctttgtaaacggagatgagcaggaggtagactatgacccagaaactacctgctacatacgtgtgtacaatgtgtatgtgcgaatgaatggcagcgagatccaatacaaaattctgactcagaaagaggacgactgcgacgaaatacagtgccagttggctattcccgtgtcgtcattgaattctcagtactgtgtgagcgccgaaggcgtgcttcacgtgtggggggttactactgagaagtccaaagaagtctgcatcactatctttaattccagcataaaaggctccctgtggataccagtggtggctgccctcctgctcttctgcttggcctggtactccagtgtttttattctgcggaaactgatccattag

SEQ ID NO: 120839 - DNA, 633 bp, Artificial Sequence
  Description of Artificial Sequence: Synthetic coding sequence
atggctcttctttttctgctccctctggtgatgcagggggtgtcgcgcgccgaaatggggaccgctgatcttggaccatcttctgtccctacgccgacaaacgttaccatagaaagttacaacatgaaccctatcgtttactgggagtaccagattatgcctcaggttcctgtgttcaccgtggaggtcaagaactatggcgttaaggcccgcgttggccagaaggaaagcgcgtacgccaagagcgaagagttcgcggtgtgcagagatgggaagattggaccccccaagctggatattaggaaggaagagaagcaaatcatgattgacatcttccatccatcagttttcgtgaacggtgacgaacaagaagtggattacgaccccgaaacaacatgttatatccgggtatacaatgtgtacgtgaggatgaatggcagtgaaatccaatacaagattctgacgcaaaaagaggatgactgtgacgagattcagtgccaattagcaatcccggtctctagcttgaattcgcagtattgtgtttccgcggagggagtgcttcacgtgtggggggtgactacagaaaaaagtaaagaggtgtgcattacaatattcaactcaagcatcaaatag

SEQ ID NO: 120840 - DNA, 1386 bp, Artificial Sequence
  Description of Artificial Sequence: Synthetic coding sequence
atgcctacacctaccaatgtgactatcgaatcctataatatgaacccgatagtgtattgggaataccagattatgcctcaggtgcccgtttttacagttgaggtgaagaattacggcgtgaaaaactccgaatggattgacgcttgtataaacatttcccaccactactgcaatatcagcgatcatgtgggagacccgtcgaactccctttgggttcgagtgaaagcccgtgtcggccagaaggaatcagcatacgcaaagtccgaggagtttgcagtgtgccgcgacggcaagattggtccacctaaacttgacataagaaaggaggagaaacagattatgatcgacatttttcaccctagcgtgttcgtcaacggagacgagcaggaggtcgactacgaccctgagaccacgtgttacatccgcgtttacaatgtctacgtaaggatgaatggatccgaaatacagtataagatcctgacccagaaggaagatgattgtgatgagattcaatgccagctcgccattcctgtgtcctcgctgaattcacaatattgtgtctctgctgagggtgttctccatgtttggggagttaccactgaaaaatctaaagaagtttgtataaccatctttaatagctccattaaggggtccctgtggatacccgtggtggccgccctgctacttttcttggtgctgagtcttgtctttatttgcttttacatcaaaaaaattaatcccttgaaggagaagagtataattctacctaaatccctgatcagcgtggtgcgctccgccactctggaaacaaagcccgaatctaagtatgtttccctgattacatcctatcagcctttctctttagaaaaggaagtcgtctgtgaagaacctttatcccccgctacagtgccaggcatgcatacagaagataatccagggaaagtcgagcatactgaggagctttcctctatcacggaagtcgtcacgaccgaagagaatatccctgatgtagtgccgggttcccacctaacccccattgagcgcgagagctccagcccactcagcagcaaccaatcggaacctgggagcatagcccttaattcttaccatagccgcaattgttccgaatccgatcactctcgtaatgggttcgataccgactcttcgtgcctggaaagtcacagtagcttgtccgactctgagttcccacctaacaataagggagagatcaagactgagggtcaggaactaatcacggtgatcaaagcacccacaagctttggttatgataaaccacatgtactggtagatctccttgtggatgactcaggcaaagagagccttattggctaccgacccacggaagatagtaaggagttcagctag

SEQ ID NO: 120841 - DNA, 1014 bp, Artificial Sequence
  Description of Artificial Sequence: Synthetic coding sequence
atgcgccccactctgttgtggtctttattgctgctgctcggtgtttttgcagccgcggccgcggccccgccggaccctctgtcacagcttccagccccccaacacccgaagatccgtctttacaatgccgagcaagttttgagttgggagccggttgccttgtccaatagcacccggcccgtggtgtatcaagtgcaatttaagtatactgattctaaatggtttacagcggacattatgtcaattggcgttaactgtacgcagattaccgctactgaatgcgattttacagctgcctcgcctagcgcaggtttcccgatggacttcaacgtgacacttcgcctgagagctgaactgggcgcactgcacagcgcttgggttacaatgccgtggtttcagcattaccgcaacgtcaccgtaggacctccagaaaacattgaggtaacgccaggggaaggaagcttaattatcaggttctcatcacccttcgatattgcagacaccagtacggcttttttttgttactacgtccactactgggagaagggcggtatccagcaggtgaagggcccattccggtccaattctatctcgctggataatctgaagccctctagggtttattgtcttcaagtgcaggcacagctcctatggaacaaatccaacatatttcgtgtgggacatctttctaatatttcatgttacgaaacaatggccgatgctagtactgaattgcagcaggttatcttgatctccgtcggaacattcagcctgttgtccgtcctggccggcgcctgcttctttctcgtacttaagtatcgaggacttattaagtattggtttcatactcctccttccatccctctgcagattgaggagtatctgaaagaccccacacagcccatcctggaggctcttgataaggattccagcccaaaggatgacgtatgggactctgtgtcaattatatcatttcccgaaaaggaacaggaggatgtgttacagactctgtag

SEQ ID NO: 120842 - DNA, 378 bp, Artificial Sequence
  Description of Artificial Sequence: Synthetic coding sequence
atgcacaaagaagaacacgaggtagcagtcttaggccccccccccagtaccatcctgccccgaagcactgtgatcaacatacactccgagactagcgtgcctgaccacgtcgtttggtcactttttaacactctatttctgaactggtgttgcctggggttcattgcatttgcttacagcgtgaagtcgcgcgaccggaaaatggtcggagacgttacgggagcccaggcctacgcttccaccgcaaagtgtctcaacatatgggctctcattctgggtatcttaatgacaatcggattcattttgctgctggtcttcggttctgtgacagtgtatcacattatgctgcaaatcatccaagagaaacgcggttactag

SEQ ID NO: 120843 - DNA, 378 bp, Artificial Sequence
  Description of Artificial Sequence: Synthetic coding sequence
atgcataaggaagagcatgaagtcgcagtgcttggacctccaccttcgactattctcccccgctcaaccgtgatcaacattcactctgaaactagcgtcccagatcacgtggtgtggagtctgtttaatactctttttctgaattggtgctgcctaggttttatcgccttcgcatactccgtgaaaagcagagaccgcaagatggtaggcgacgtgactggcgcgcaggcatacgcaagcactgccaagtgtttaaacatatgggccctgatcctggggatactcatgactattggattcatactgctgctcgtgttcggttccgtgacagtttatcatattatgctgcagattattcaagagaagagagggtactag

SEQ ID NO: 120844 - DNA, 300 bp, Artificial Sequence
  Description of Artificial Sequence: Synthetic coding sequence
ccccagtctcagaaaatgcacaaggaagagcacgaagtcgcggttctgggcccacctccttctacaatactgcctcggagcacggtgatcaatatccactccgaaacctctgtcccggaccatgttgtagtgccagttcaacaccctcttctcgaatgctgcctcggatttatcgcctttgcctactccgtcaagtctcgggacagaaagatggtcggtgacgtcacaggggcccaggccctccatcgccaggtgccggagcacttagggccagactctggccatccccatgaccactag

SEQ ID NO: 120845 - DNA, 378 bp, Artificial Sequence
  Description of Artificial Sequence: Synthetic coding sequence
atgcacaaagaagagcacgaagtggcagtactcgggccgccaccctctactattctcccacgatctacggtgattaatattcattccgagaccagcgtgcccgaccacgtggtgtggtcactgttcaacacgcttttcctgaactggtgctgtctaggcttcatagcatttgcatactctgtgaaatctcgagaccgaaaaatggtgggtgatgtgacaggagctcaggcttatgcttccactgccaagtgtctgaacatatgggcacttattctcggcattctgatgacgattggatttatattacttctagtatttggatccgtgaccgtttatcacatcatgctacagatcatccaagagaagcggggatattag

SEQ ID NO: 120846 - DNA, 495 bp, Artificial Sequence
  Description of Artificial Sequence: Synthetic coding sequence
atgaatcacattgtgcagacgttttcacctgtgaattccgggcagccacccaactacgaaatgctcaaggaagagcaggaggttgccatgttaggggtcccacacaatcctgctccacccatgagtactgtgatccacattcggtccgaaacttccgtccctgatcatgtagtggtgccagtgcagcacccacttcacgagtgctgcttaggctttatcgcctttgcttactccgtgaaatcacgggacagaaagatggttggcgacgttacaggagcacaggcattgcacaggcaagtgcccgaacatctgggaccagactttggacatctacacgaccattctgctcaccaccacccctctgttggacgacctggacctgcaatcgaccaggaggctagcctgcggcctggcgccttacccgtgacatgcattcctcgcactctcagctccattccaagacccgctccccggggccaggagctgtgtccatag

SEQ ID NO: 120847 - DNA, 399 bp, Artificial Sequence
  Description of Artificial Sequence: Synthetic coding sequence
atgaaccacatcgttcagaccttctccccagtgaactcagggcagccaccgaactacgagatgctaaaggaggaacaagaagtggcaatgttaggggtgccccacaatccagctcctcccatgtctaccgtgattcatatccggtccgaaacctctgtgcccgatcacgtggtgtggtcactgtttaacactctgtttatgaacacgtgttgcctgggatttatcgcatttgcctacagcgtcaagagtcgtgaccggaagatggtcggcgacgtgacaggggctcaggcatacgcatctacagcgaagtgcctcaatatttgggctttaatattaggcatcttcatgacaattctgctgatcattatcccagttctggtcgttcaagcccaaaggtag

SEQ ID NO: 120848 - DNA, 447 bp, Artificial Sequence
  Description of Artificial Sequence: Synthetic coding sequence
ccccctaattatgagatgttaaaggaagagcatgaagttgcagtgttgggcgctccacacaatccagccccccctacatccactgtaatccacatccggtctgagacaagtgttcctgaccatgtcgttgtgccggtccagcatccacttcatgaatgctgccttggctttattgcgttcgcctactcggtgaaaagccgagaccgcaaaatggtaggggacgtgactggggctcaggccctccaccgccaggtgcccgagcacctcggtccagatagcggtcatcctcacgatcactccgcccaccggcatccttccgccgacttgccgggcctgtggattgatcaggaagccagcctgagaccgggggccttgcccatgacctgtattcctcgcacacctacaagtataccaagacctgcaccaggtgctgagtcatgcatttag

SEQ ID NO: 120849 - DNA, 402 bp, Artificial Sequence
  Description of Artificial Sequence: Synthetic coding sequence
atgaatcatacggtgcagacttttttctcgcccgtgaactccggtcaacctcctaattacgagatgctcaaagaagagcacgaggtagccgtgttaggggcacctcataaccctgctcctccaacttccacggtgattcacattcggagcgaaacctctgtccctgaccacgtggtctggtctctctttaatactctttttatgaacccttgctgcctgggtttcattgcttttgcctattctgtcaagagcagggatcgcaagatggtgggggatgtcaccggagcccaagcctatgcctccaccgctaaatgcctaaatatatgggccctcattctcggtattctgatgacgatcctccttattgttatcccagtcctgattttccaggcctatggctag

SEQ ID NO: 120850 - DNA, 3078 bp, Artificial Sequence
  Description of Artificial Sequence: Synthetic coding sequence
atgtcaaatggatactctaccgacgagaattttcgctatctcataagctgctttagagcccgcgtgaagatgtacattcaagttgagcctgtcctggactatctcacctttctgcccgctgaagtcaaggagcagatccagagaaccgtggctactagtgggaacatgcaggcagttgagctcctgttatctacactcgagaaaggggtgtggcatctgggttggacacgggaattcgtggaggccctgaggcggacgggatctcccttggctgcacggtatatgaatccagagctgacagacctgccaagtccgtcgtttgagaatgcacacgatgaatatctgcagcttctgaacttgctacagcccacactggtggataagctgctggtgagagacgtgctggataaatgtatggaggaagagttgctgaccatcgaagatcggaatcgcatcgccgcagccgaaaataatggaaacgagtcgggcgttcgcgagttgctgaagcgtatagtacagaaggaaaattggtttagtgccttcctgaacgttctgcgccaaacgggaaacaatgaactggttcaagagcttacggggtccgattgtagcgagagtaatgctgagatagagaatctgtcccaagtcgacggtccccaggtcgaggagcagcttctgtctaccacggtgcagccaaaccttgagaaagaagtatggggcatggaaaataatagctctgagtcttcattcgcagatagtagcgtcgtttccgagtcggataccagccttgccgagggttcagtatcttgtcttgatgagtccttaggccataactcaaatatggggagtgacagcggcaccatgggaagcgactctgacgaggagaatgtggctgctagagcctctccagagccagagctgcagctcagaccttaccagatggaagtggcacagcccgccctagagggcaagaacatcattatctgcttgccaacaggctccggcaagacgagagtggccgtttacatagctaaggatcacctggataaaaaaaaaaaggcatctgaacctggcaaagtgattgtccttgtcaacaaggtactcctggtggaacagttattccggaaggaattccagcccttccttaaaaaatggtatcgggtcattgggttaagtggcgacactcagctcaaaatcagcttccctgaagtggtgaagagctgtgatatcattattagcaccgcacagattctggaaaattctctgttgaacctagagaacggagaagacgccggcgtgcagctgtccgatttcagcctcattatcattgacgagtgtcaccacaccaacaaggaagccgtctataataacattatgagacactatctgatgcaaaagctgaaaaacaatcgcctcaaaaaggagaacaagccagtgatacctctgccgcagatcctcggtctcaccgctagccccggcgtagggggagcgaccaaacaggctaaggcagaggagcatatcttaaaactgtgcgcaaatctggacgcctttacgatcaaaactgtgaaggagaatctggatcagttgaagaaccagatccaggaaccctgcaagaagttcgctatcgccgatgccacgcgggaagacccttttaaggaaaaactgttagagattatgaccaggatccagacctattgtcagatgagccccatgagcgactttgggacccagccatacgagcaatgggccatccagatggaaaagaaggcagctaaggagggcaaccgaaaggagcgggtgtgcgcagagcacctgcgtaagtataatgaagccctccagatcaatgatacgatccgcatgatcgatgcatacactcacctcgagacgttttataacgaagagaaggacaaaaagtttgccgtgatagaagatgattcagacgagggcggagacgacgagtattgcgacggagacgaggacgaggatgatctgaagaagcctttgaagttagacgaaacagacaggtttcttatgactctgttttttgagaataacaagatgctcaagcggctcgccgagaatcctgagtacgaaaacgaaaagcttacaaagctgcggaacactataatggagcaatacactaggaccgaggagagcgctcggggaattatttttaccaagacccgtcagtctgcctatgcactctcccagtggattactgagaatgagaaattcgccgaggtgggagtgaaagcccatcatctaattggagccggtcattcctccgaatttaagccaatgacacagaacgaacaaaaggaggtcatttcgaaattcaggactggtaaaattaacttactgatcgcaaccactgtggcagaagagggcctcgatattaaggaatgtaatatcgtgatccgttacggactcgttactaatgaaatagcaatggtgcaggctaggggccgggcaagagctgacgagagcacgtacgttctcgttgcacacagtggaagcggagtaattgaacacgagacggtcaatgacttccgggaaaaaatgatgtataaggccatccactgcgttcagaacatgaaaccagaagagtatgcgcacaagatattggaacttcagatgcagagcattatggaaaagaaaatgaagactaaacggaatatcgcaaaacattacaaaaataacccgagcctgattaccttcctgtgcaagaattgcagcgtgttggcctgctctggcgaagatatacatgtgatcgagaaaatgcatcatgttaatatgacaccagagtttaaagagttgtatatcgtgagggagaacaaggccttacagaagaagtgcgcggactaccagattaacggagaaattatttgcaaatgcgggcaggcctggggaacgatgatggtgcacaaggggctggatctgccatgcctgaagatcagaaattttgttgtggtgtttaaaaacaacagcacaaagaagcagtataagaagtgggtggagctaccgatcacatttcccaatttggactactccgaatgctgtctcttcagcgacgaggattag

SEQ ID NO: 120851 - DNA, 666 bp, Artificial Sequence
  Description of Artificial Sequence: Synthetic coding sequence
atgtccaatggttactctactgatgagaatttcaggtacctgatctcctgctttcgtgccagggtaaagatgtacatccaggttgagccagttctggattatctcacttttctgccggctgaggttaaggaacagatccaaagaactgtggctacatcagggaacatgcaggctgtagagctgcttctcagcaccctcgagaaaggagtttggcacctgggctggacacgggaattcgttgaggccctgagacgaactggctccccactcgctgcccgctacatgaaccctgaattaacggatctgccatccccgtcatttgaaaatgcccatgatgaatatcttcagctgctgaacctcttgcagccgaccctggtggataaacttctggttagggacgtccttgataagtgtatggaggaagaattgctcactatcgaagaccgtaaccggatcgcagctgctgagaataacggaaatgaaagcggcgttagagagctcctgaagaggatcgtgcagaaggagaactggttctccgctttcctcaatgtcttaagacagacagggaacaatgagctggtgcaggaattgaccggaagtgattgctctgagtcgaacgcaggcatatgcaacttcacagaagaggactcttcaaactcagcgtag

SEQ ID NO: 120852 - DNA, 3078 bp, Artificial Sequence
  Description of Artificial Sequence: Synthetic coding sequence
atgtcaaatggatactccacggatgaaaacttccgatatctgatctcttgtttccgcgcacgagtgaaaatgtacattcaggtggaacctgtactggattatctgaccttcctcccagctgaggtaaaagagcagattcagaggactgttgcaacttccgggaatatgcaggctgtagagctgctgttgtctacactggagaaaggtgtctggcatttaggctggacacgagaattcgtggaagcgttgcgcagaaccggctctccactcgcggctcgctacatgaatcctgagctaactgacctcccctcgccctccttcgaaaacgcccacgatgagtacctccaactattaaacctcttgcagcccacgctcgtggacaagctcttagtccgcgacgtgctagataaatgcatggaggaagagctgctcaccatcgaggaccgtaaccggatcgcagctgcagagaacaatggcaacgaaagcggcgtacgggagttgctgaaacgcattgttcagaaagagaattggttcagtgcttttctcaacgtactgcgtcaaaccggtaataatgagttggtgcaggagctgaccgggtctgactgttctgaatctaacgccgagattgaaaacctgtcacaggttgacggtccacaggtcgaagagcaactcctcagcaccacagttcaaccaaatctggaaaaggaagtgtggggcatggaaaacaacagttccgagagcagcttcgccgactcaagtgttgtcagtgagtctgacacttcccttgcggaaggatcggtttcttgcttagatgaaagtctcggccacaatagtaatatgggctcagattccgggaccatggggagcgacagcgacgaagagaacgttgccgcaagagccagccctgagcccgagcttcagttgcgcccttatcagatggaggtcgcgcagccagcccttgagggaaagaatatcataatctgtctgccaaccggctcagggaagacgcgcgtcgcagtgtacatcgccaaggaccacctggacaaaaaaaaaaaggccagcgaacccggaaaagtgatcgtgcttgtaaacaaagtcctgctagttgagcaactgtttcgtaaagaatttcaaccgtttttgaagaagtggtatcgcgtgattggcttgtctggggacacacaactgaagatttccttccctgaggtcgtcaaaagctgcgatatcatcatatcgaccgctcagatacttgaaaactctctgctgaatcttgagaacggggaggatgcgggcgtccagctcagtgacttctccctgatcatcatcgatgagtgtcaccatacaaataaggaggccgtctacaacaatattatgcggcattacttgatgcagaagcttaaaaacaatcgactaaaaaaggagaataaacccgtgatcccactaccacaaatcctcggtttgacagcttcccctggagtggggggcgcgactaagcaagctaaggccgaggagcacatcctgaaactgtgcgcaaacctggatgctttcacaatcaagactgttaaagagaacctcgaccagctgaaaaaccagatccaagagccatgcaagaaatttgctattgcagacgctactagggaagaccccttcaaggaaaagttactggaaattatgacccgaatacaaacgtactgtcagatgagccccatgtctgattttgggacgcagccttacgaacagtgggctattcaaatggaaaaaaaagcggccaaggaaggcaatcggaaagaaagggtgtgcgccgagcacctgagaaagtacaatgaagccctgcagatcaatgacacaatccgaatgattgacgcatatacccaccttgagaccttctataacgaggaaaaggataaaaagtttgccgttatcgaagacgacagcgacgaagggggagatgacgaatactgcgacggtgacgaggacgaagatgacctgaaaaagcccctcaagcttgatgagaccgatcgatttttgatgaccctatttttcgaaaacaacaaaatgttaaagcgcctagcagagaatcctgagtatgaaaacgaaaaactgaccaagctccgcaataccattatggaacagtacacccgaactgaggaatccgctcgcggaattatttttactaaaacgaggcagtctgcatatgcactgtcccaatggatcactgaaaatgaaaagttcgctgaagtgggcgtgaaggcccatcacctaatcggcgcagggcatagctctgaattcaaacccatgacccagaatgagcagaaggaggtaatctcaaaattcagaacaggtaagatcaaccttctcatcgccactaccgtggccgaggaaggcctggacattaaggagtgcaacatcgtcatcagatacggactggttaccaatgagatcgcaatggtccaggcgaggggacgcgccagagcagatgagtccacatatgtgctggtggcacactccgggagcggcgtcatcgaacacgagactgtgaatgactttagagagaagatgatgtacaaggccatacactgcgtccagaacatgaagcccgaggaatatgcacacaagattctggaactgcagatgcaatctatcatggagaaaaagatgaaaactaaacgaaatatagctaaacactacaagaataacccatcgttaattacctttctgtgcaaaaattgttccgttctcgcgtgctcgggagaggacattcatgttattgagaaaatgcatcatgtaaacatgaccccagagttcaaggaactctatattgttcgggagaataaggcgcttcagaaaaagtgcgcagactatcagataaacggtgaaattatatgtaagtgtggccaggcttgggggaccatgatggtgcataaaggcctcgatctcccttgtctgaagattcggaactttgttgtggtctttaaaaacaattccaccaaaaagcaatacaaaaagtgggtggagttgcccattacatttccaaatttagattactctgagtgttgtctgtttagtgacgaggactag

SEQ ID NO: 120853 - DNA, 1050 bp, Artificial Sequence
  Description of Artificial Sequence: Synthetic coding sequence
atgccagtagagcgtatgaggatgcggccctggttagaggaacagattaatagcaacaccatccccgggctcaagtggctgaacaaagaaaaaaaaatctttcagatcccttggatgcacgccgctcgccacggatgggacgttgagaaggatgcacccttgttccgaaactgggctatccacacaggtaagcaccagcccggtgtggacaagccagatcccaagacatggaaggcaaactttcggtgtgcaatgaatagcctccccgacatagaggaggtcaaggataaaagcataaagaaagggaataacgcttttagggtctaccgtatgctgcccctttctgaacgtccaagcaagaaggggaaaaagcccaaaaccgaaaaagaggacaaggtcaaacacattaagcaagaacccgtggagtcctctctcggcctgtccaacggcgtctctgatctcagccctgaatatgccgtgctcaccagtacaatcaaaaacgaagtggactcaacggtgaatatcattgtcgtcggccagagtcacttggactcaaatattgagaaccaggaaattgtgaccaacccaccggacatttgccaagtggtagaagtcactacggagtctgacgagcagccagtctccatgtctgaactatatccattgcagatctctccggtgtctagctacgcagaatctgaaacaaccgattcagtccccagcgacgaggagtcagctgagggccgtccccactggcgaaagaggaacattgagggaaagcagtacctctccaatatgggaactcggggctcatacttgttgcccggcatggcctcatttgttacatctaataaaccggacctccaggtgactattaaggaggagagtaatccagtgccatacaattcctcatggccacctttccaggatttaccgctgtcctcttctatgactcccgcaagctccagctctaggcccgacagagagactagagccagtgttattaaaaagacgtccgatataactcaagctcgcgtgaaaagctgttag

SEQ ID NO: 120854 - DNA, 414 bp, Artificial Sequence
  Description of Artificial Sequence: Synthetic coding sequence
atgcccgttgaaagaatgcgcatgcgcccttggttggaggagcagatcaattcaaataccattcccggcctaaagtggttgaacaaggaaaagaagatttttcagattccctggatgcatgccgcccgacatggatgggacgtcgagaaagatgcccctctatttcggaactgggccattcacacaggaaagcaccagcctggggtagacaagcccgatccaaaaacctggaaggccaattttagatgtgcaatgaatagtctaccagatattgaggaggtcaaggacaagtccattaagaaaggcaacaatgccttcagggtgtatcggatgctgccactgtccgagagacccagtaagaaaggtaaaaaaccaaaaactgaaaaggaagataaggtgaagcacattaagtag

SEQ ID NO: 120855 - DNA, 414 bp, Artificial Sequence
  Description of Artificial Sequence: Synthetic coding sequence
atgcccgtggagagaatgcggatgaggccctggttggaagaacagattaatagcaacacaatccccggcctgaagtggctgaacaaagaaaaaaagatatttcagatcccgtggatgcatgccgcgaggcatggctgggacgtcgagaaagatgcccccctgttcagaaattgggccatccacaccgggaagcaccagcccggagtggataagcctgacccaaaaacttggaaggccaattttcgctgcgccatgaacagtttgcccgacatcgaagaggtgaaggataaatctattaagaaaggtaataacgcctttcgtgtctatagaatgctgcctctctcagaaagaccctccaaaaagggtaaaaaacctaagactgagaaggaggataaggtgaaacatattaaatag

SEQ ID NO: 120856 - DNA, 531 bp, Artificial Sequence
  Description of Artificial Sequence: Synthetic coding sequence
atgccggtagagcgtatgcggatgcgcccctggctcgaggagcagatcaatagtaacactattcccggcctgaagtggctgaataaggagaaaaagatctttcagatcccctggatgcacgcggcgaggcacggttgggacgttgagaaagacgcaccccttttcagaaactgggcaatccacacagggaaacatcagcccggggtcgacaagcctgaccctaagacatggaaggctaacttccgatgtgcgatgaactcacttcccgacattgaggaagtgaaagataagagtattaagaaaggaaataatgctttccgggtctacagaatgctgcccctctctgagcgtccttcaaagaagggcaaaaagccaaaaacagaaaaggaagacaaggtcaagcacattaaacaggagcccgtggagagctctttaggcttaagtaacggggtgtctgatctgtcccctgagtacgccgtcttaacctctaccatcaaaaacgaagtggacagcaccgtgaatatcatctag

SEQ ID NO: 120857 - DNA, 486 bp, Artificial Sequence
  Description of Artificial Sequence: Synthetic coding sequence
atgcccgtggaacggatgagaatgcggccgtggctcgaggagcagatcaactctaatacaataccaggcctgaagtggcttaacaaagaaaagaagatcttccagataccttggatgcatgcagctcggcatgggtgggacgttgaaaaggacgcacctcttttcagaaattgggctattcacacaggaaagcatcagccgggcgttgacaagccagaccccaaaacatggaaagccaacttccgctgcgccatgaacagcttgccagatatcgaggaagtgaaggacaaatcaatcaaaaaaggcaataatgcttttagggtgtaccgcatgctccccctgagcgaaaggccatcgaaaaaagggaagaaacctaagacagaaaaagaggacaaggtaaaacacatcaaacaagaaccagtggaaagttctctaggactgagtaacggcgtttctgacctttcacccgagtacgctgtcctgtag

SEQ ID NO: 120858 - DNA, 1284 bp, Artificial Sequence
  Description of Artificial Sequence: Synthetic coding sequence
atgggcactcccaaacctcgcatattaccttggctggtgagccaactagacctgggacagcttgagggagtggcatgggtgaacaaaagtagaactagattcaggattccatggaaacacggcttaagacaggacgcacagcaagaggattttggaatttttcaggcatgggccgaagctactggagcttatgttccaggaagagataagccagaccttcctacatggaagaggaacttcaggagcgccctgaaccgtaaagagggtttgcgcctggctgaagacaggagcaaagacccgcacgatccacacaagatctacgagtttgtcaatagcggcgttggtgacttttcgcagcccgacacgagtccagacactaacggtggcggcagtacctccgacactcaggaagatatcctggacgagctgctcggtaatatggtgctggcccctttgcccgatcccgggcctccatcccttgctgtggcgcctgaaccatgcccccagcctctgcgcagcccaagcctggacaacccgacaccgttccctaacttgggaccaagcgagaatcctctgaaaagattgctagtgccaggagaagagtgggaattcgaggtgacggctttctaccgcggccgtcaggtttttcagcagactatctcttgtcctgaagggcttcgattagtcggctcagaggtgggcgatcgaaccctgccaggttggcctgtaaccctgcccgaccccggcatgagcttgaccgaccgaggtgtgatgtcctacgtgcgacacgtgctatcttgcctgggcggcggacttgcgctctggcgcgcaggccaatggctctgggcacagcggctgggacactgccacacctattgggccgtttctgaggaacttttgcctaatagtggtcacgggcctgatggtgaggtcccgaaggacaaggaaggcggtgtgttcgaccttggtccctttattgtcgatctaattacattcacagaagggagcggcagatccccccgatatgccctgtggttttgtgtgggcgaaagctggccccaggaccaaccctggacaaagcggctcgtaatggtgaaagtggtgccgacttgcctgagggctttggtggaaatggcgcgggttggtggagcgtctagccttgagaatacggttgatttgcacataagcaattcacatcctctctccctgacctctgaccagtataaagcctacctccaggacctagtcgaagggatggactttcaagggcccggcgaatcttag

SEQ ID NO: 120859 - DNA, 903 bp, Artificial Sequence
  Description of Artificial Sequence: Synthetic coding sequence
atgggaacaccaaagccacgcatcttaccatggctcgttagtcagctagatctcgggcagctcgagggggtggcatgggtgaataagtctaggacacgctttagaatcccgtggaagcacgggctgcgccaggacgctcaacaagaggattttggcatttttcaggcttgggccgaggccacaggggcgtacgtgcctggtagagataaaccagacctcccgacttggaagagaaattttaggtctgccctgaaccgaaaagagggcctgaggctcgcagaggacagatcgaaggatccgcatgatccccacaagatctatgaattcgtcaacagcggtgtcggtgatttttcacaaccagacacctcccctgatacgaacggaggtggcagtacatctgatactcaggaggacattctggatgagctcttgggcaacatggtcttggctccactgccggatccgggccccccgagtctggcagtggctcccgaaccttgtccgcagcctctacgcagcccctctttagataacccaactccttttcccaatctgggcccctctgagaaccccctgaagaggctgttagtgcccggcgaggatctaataactttcactgaaggatccgggaggtccccacgatacgctttgtggttctgcgttggagagtcgtggccgcaggatcaaccctggaccaaacgcctggtcatggtcaaagtggtgcccacctgtctgagagccttggtagagatggccagggtgggcggggcgtctagtcttgaaaacacagtggacttgcacatatccaacagccatccactgtccttgactagtgaccagtacaaagcttatctgcaggacctggtggagggcatggactttcagggacctggagaaagttag

SEQ ID NO: 120860 - DNA, 1284 bp, Artificial Sequence
  Description of Artificial Sequence: Synthetic coding sequence
atggggacacccaagccgagaattctgccctggctcgttagtcaactggacctggggcagttggagggcgtggcttgggttaacaagtccagaacccggtttaggatcccatggaaacacggacttagacaggacgctcagcaggaggactttggcatttttcaggcatgggcggaagccacaggagcttacgttcctggaagggataagccagatttgcccacatggaagaggaatttcagatcggcgctgaaccggaaggaggggctgcgcctggccgaagatagatccaaggatcctcacgacccacataagatatatgaattcgtgaattctggcgtcggtgatttcagccagccggacacatcccccgatactaacgggggaggcagcaccagcgacacccaggaggacatactcgacgaactacttggcaatatggtgctcgctcccctgcccgatccagggcccccaagcctcgctgtggccccggaaccttgtccacagcctctacgtagcccttccctggacaacccaacgccctttcctaatctgggcccttccgaaaaccccttaaagaggctgctcgtccctggcgaggaatgggagttcgaggtgaccgctttctataggggccgccaggtattccagcaaacaatctcgtgcccggaaggtcttcggctcgtgggctcagaggtgggcgatagaacactgccggggtggcccgtgactcttcctgacccaggaatgagcttaaccgacaggggggtcatgagctacgtgaggcatgttttgtcctgtcttggaggcgggctggctctgtggagagcaggccagtggttatgggcccagcggctcggccactgtcacacatattgggcggtctccgaggaactgctgcccaattccgggcatggtcctgatggcgaagtccccaaggacaaggagggcggggtgtttgacctgggcccgttcattgtggacctgattacatttaccgaaggatcagggaggtcaccccggtatgccctttggttctgtgtgggcgaaagctggccccaagaccaaccgtggacaaaacggctggtgatggttaaagtggtaccgacgtgcctccgagccctcgtggagatggccagggtagggggggccagctcactggagaatacagttgacctccacatctcaaacagccaccctctgagtctgacctcggatcagtacaaggcttatctccaggatctcgtagaaggaatggactttcagggacctggggaatcctag

SEQ ID NO: 120861 - DNA, 315 bp, Artificial Sequence
  Description of Artificial Sequence: Synthetic coding sequence
atgggaacacccaaaccccgtatactcccttggctagttagccagctggatcttggacagttagaaggcgttgcatgggtgaacaagtcaagaaccagattcagaatcccatggaagcacggactccggcaggacgcacagcaggaggatttcgggatttttcaggaacttggcacattcccgagtcagaccccactgaggaccccgatggtcgaagcagtgttgttgatccccaggaaaactttttggatgtcctactgggtgacttggtgttggccacatagccagattcgagaccctcaggcttggctttag

SEQ ID NO: 120862 - DNA, 846 bp, Artificial Sequence
  Description of Artificial Sequence: Synthetic coding sequence
atggtactggcgcccctgcctgatccaggcccgccttctctggctgtggccccagaaccttgcccccaacccctgcgaagtccttctctggataatcctacgccattcccaaatctcggcccaagcgaaaacccactcaagagattactggtgcctggagaagaatgggaattcgaggtgaccgctttttaccgcggtaggcaggtgtttcagcagaccatctcctgccccgagggacttagactggtcggttctgaggtgggcgacagaaccctgccaggctggcccgtgacattgcctgaccccggcatgagcctgaccgaccgcggtgttatgtcctacgtgcggcacgtgctgtcatgtctgggcggaggtctggcactgtggcgggccggtcagtggttatgggcccaacgacttggccattgccacacttactgggcggtttccgaagagttacttcctaattcagggcatggcccagatggagaagttcctaaagataaggagggcggcgtgttcgatttgggcccgttcattgtggacctgatcacgtttacagagggatccggcagatcccctagatatgctctatggttctgtgtgggcgagtcctggccgcaagatcagccctggactaagcgcctggttatggtgaaagttgtgccgacctgtctgagggcacttgtcgagatggcaagggtgggcggagcctccagccttgaaaatactgttgacctccacatttctaatagccaccctctgtctctcacatcagatcagtacaaagcctatcttcaggacctcgtggagggtatggacttccaaggacctggcgagtcttag

SEQ ID NO: 120863 - DNA, 465 bp, Artificial Sequence
  Description of Artificial Sequence: Synthetic coding sequence
atggtcctagccccactacctgatcctggacccccctcgctcgccgttgccccagaaccgtgccctcagcccctgagaagtccctctcttgacaaccctacaccatttcctaacctcggcccctctgaaaacccccttaagcgactcttggtgcctggggaggacctaatcacgttcactgaaggtagcgggcgaagtccccggtacgcgctgtggttctgtgtgggcgaaagctggcctcaggatcagccgtggaccaagcggctggttatggtgaaggtcgtgcccacatgcctgcgggcactggtggagatggctcgagttggtggcgcttcctctcttgagaatacggtggatctccatatttccaacagtcacccgctaagcctcactagtgaccagtacaaggcttatttacaggacctcgtggagggtatggacttccagggaccgggtgagagctag

SEQ ID NO: 120864 - DNA, 846 bp, Artificial Sequence
  Description of Artificial Sequence: Synthetic coding sequence
atggtgctcgcccctcttcccgaccctggccccccatccctggccgtggcccctgagccatgtccccagcccctccgatcacctagtctggataatccaacccccttcccaaatttgggccccagcgagaaccctttgaaacgcctgctggtgcctggagaggaatgggagttcgaggttactgcgttctacagagggaggcaggtatttcagcaaacaatctcgtgtcctgaagggcttagactggtaggaagcgaagtaggagatcgcacgctcccagggtggcccgtcactcttccggatccaggcatgagcctgaccgataggggagttatgagctacgttaggcacgtgcttagttgcctggggggaggcctcgccctgtggcgcgcggggcagtggttatgggcgcagcgacttggccattgtcatacctactgggctgtctccgaagaactccttcctaacagtggccacggtcctgacggagaagttccaaaggataaggagggtggcgtattcgacttgggcccattcattgttgacctgattacttttactgagggctctggacgctcaccgcgttatgctttgtggttctgcgtcggggaaagctggccccaagatcagccgtggacgaagagacttgttatggtcaaggtcgtgcccacttgtctgcgagctttggtcgagatggcgagagtgggtggagcctcatcactggagaacaccgtcgacttgcacatatctaactcccatccactgtcactgacgagcgatcaatacaaagcttatctccaggacctagtggagggcatggactttcaaggacccggggaatcttag

SEQ ID NO: 120865 - DNA, 903 bp, Artificial Sequence
  Description of Artificial Sequence: Synthetic coding sequence
atgggcacaccaaaaccaaggatcttgccatggctcgtttcccagctggatctgggccagcttgaaggagtagcctgggttaacaagtcaagaactaggtttaggattccttggaaacatggactccggcaggacgcacagcaggaagacttcggtatatttcaggcctgggcagaagctaccggagcctacgttcctggcagagataagccagacttgcccacctggaagagaaacttccgctctgccctgaatcgcaaggagggactgagactggctgaggaccgctccaaggaccctcacgacccccacaagatctacgagtttgtaaactccggtgtgggcgacttcagtcagccagatacttctccggatacaaatgggggggggtctacctctgatactcaggaggatatcctggacgaactcctaggcaatatggttctggcccctctgccagatccagggcctccaagcctagccgtcgcacccgaaccttgcccacagccactgcggagcccttccctcgacaacccaaccccttttcctaatctggggccaagtgagaacccactgaagcgcctcctcgttccaggcgaggacttgatcactttcacagaaggatcagggagaagccctcggtatgctctgtggttctgcgtgggcgagagttggcctcaggatcagccttggacaaaaagactggtcatggtgaaagtggtgcctacatgtctgcgggcacttgtagaaatggccagagtcgggggcgcaagcagccttgaaaacacggtggaccttcatattagtaactctcacccattgtctctaacctctgaccagtacaaggcctacctccaggaccttgtggagggcatggattttcagggccccggggagtcatag

SEQ ID NO: 120866 - DNA, 465 bp, Artificial Sequence
  Description of Artificial Sequence: Synthetic coding sequence
atggtgttagccccgctgccagaccccgggcctccgtctctcgccgtggctccagagccttgcccccagccactgcggagtccgtcgcttgataatccaactcccttcccgaatctgggaccgtccgagaatcccctgaagcggctcctggtgccgggcgaggacctcatcactttcactgagggttcgggtagaagcccccgatacgctttgtggttctgtgtcggggaatcttggccccaggatcagccttggacgaagcgtttggtgatggtcaaagtcgtgccaacctgtctgcgggcacttgtagagatggcccgcgtgggtggggcctcatcgttagagaatacagtggatttacatatttccaactcacaccccctcagtctcacctctgaccagtacaaagcatacttgcaagatttggtagaggggatggacttccagggtcccggggagtcctag

SEQ ID NO: 120867 - DNA, 1404 bp, Artificial Sequence
  Description of Artificial Sequence: Synthetic coding sequence
atggcactgcaccccagaagagtccggctgaagccctggttggtggcgcaggttgattccggcctctatcccgggctgatctggctgcaccgggactctaaacgcttccagatcccatggaagcatgctacccggcacagcccacagcaggaggaagagaacacgatctttaaagcatgggcagtggaaaccggtaaataccaagagggagtagacgatcctgatcctgccaaatggaaagcacagctgagatgcgctctgaacaagtcgcgagagttcaaccttatgtacgatgggactaaagaagtgcctatgaaccctgtaaagatctaccaggtatgcgacataccccagccccagggcagtattatcaatcccgggtctacggggagcgcaccttgggacgagaaggacaatgacgtcgacgaagaggacgaggaggatgagctcgaccagtcacagcaccacgttcccattcaggacacgttccccttccttaacatcaatggtagccccatggccccggcctctgtgggaaattgcagcgtaggaaactgtagtcctgaggctgtgtggcccaagaccgaacccctggagatggaagtgccccaggcgccaatccagccgttttattccagtcctgagctgtggatcagttctctgcctatgaccgacctcgacatcaaatttcaatacagaggcaaagagtacggccagactatgactgtgagtaatccccagggttgccggttgttttacggcgatctaggccccatgccggatcaggaagaacttttcggtccggtctctctagagcaggtgaagtttcctggaccagagcatataacaaacgaaaagcaaaaattgttcacaagtaaacttctggatgtaatggatcgcggtctgatattagaagtgtcaggccacgctatatacgccatccggctctgccagtgcaaagtctattggtccgggccctgcgccccttctttagtagctcccaatctgattgagcgacagaagaaggtcaaactcttctgtttagagacctttctgagtgacctaatagcccatcagaagggccagatcgagaagcagcctccatttgagatctacttgtgttttggagaagaatggcccgacggaaaaccactggaacgaaaactgatacttgttcaggtaatccccgtggtggcccgtatgatctacgaaatgttcagtggtgacttcacccgctcatttgactcaggatctgtacgactacaaataagcacacccgatatcaaggataacattgtggcccaacttaaacagttgtatcgcattcttcaaacgcaggaatcatggcaaccgatgcagcccacaccatcaatgcagctgcctcctgctttacccccccagtag

SEQ ID NO: 120868 - DNA, 831 bp, Artificial Sequence
  Description of Artificial Sequence: Synthetic coding sequence
atggctctccacccgcggagggtgagactgaagccttggttggtcgctcaggtcgactcgggattatatcctggtctaatctggctccaccgggacagtaaacgatttcagataccctggaaacacgccactcgccactctccacagcaggaggaggagaataccatttttaaagcatgggccgtggaaacaggtaagtaccaggaaggtgtggatgatccagacccggcaaaatggaaagctcaactgcgttgcgcgctgaacaaatcgagggaattcaacctcatgtatgacggcaccaaggaggtgcccatgaaccctgtgaagatttatcaggtgtgcgatatcccgcagccccaaggcagcattatcaacccgggctctacgggaagcgctccctgggacgaaaaggacaatgacgtggacgaggaggatgaggaagatgaacttgatcagagtcagcaccacgtgcctatccaggacacattcccatttctcaatattaacggctctcccatggcccctgcttccgttggaaactgctccgtcggtaactgcagccccgaggctgtgtggcccaaaaccgagcccctggagatggaagttcctcaggcaccgatccagcctttctactcctcgcccgagttgtggatctcatctctccccatgaccgatcttgacattaaattccagtataggggcaaggagtacggccaaacaatgactgtttcaaacccacaaggatgccggctgttctacggcgaccttgggcccatgcccgatcaggaggagctgttcggcccagtgagtctggagcaggtgaagttttag

SEQ ID NO: 120869 - DNA, 1119 bp, Artificial Sequence
  Description of Artificial Sequence: Synthetic coding sequence
atgtacgacgggaccaaggaagtccccatgaatcccgtcaaaatttaccaggtgtgcgacattcctcaaccccaggggtcaatcatcaatccagggagcaccggttcagctccctgggatgaaaaggataacgatgtggatgaagaagacgaggaagatgaactggatcaatcgcagcaccatgtgcctatccaggataccttcccgttcctcaacattaacggttccccgatggcaccggcatctgtgggtaattgttccgtgggcaattgctccccagaagccgtttggcccaagaccgaaccactggagatggaagtccctcaggcgcccattcagccattctatagtagcccagaactgtggataagctcactacccatgactgacttggatatcaaattccagtatcgtggaaaagagtacgggcagaccatgaccgtctcaaatcctcagggctgccggctgttctacggagacctcggtcctatgcctgatcaggaagaactgtttggaccagtttccttagaacaggtgaaattccctggacctgagcacatcacaaatgaaaagcagaagctctttaccagtaagctcctggacgtcatggatagaggtctcattttggaagtctccgggcatgccatttatgctattaggctgtgtcagtgcaaagtttattggtctggcccctgtgcgccaagccttgtcgctccaaacctaattgaacgccagaaaaaggttaaactattttgtcttgagacttttctgtcagatctgattgctcaccaaaaggggcaaatcgaaaagcagccccccttcgagatttacctatgtttcggggaggaatggccggacggtaagccactggagcgtaaactcatcttagtgcaggttataccagtggtcgctcgtatgatctatgagatgttctctggagatttcacaaggtcctttgattctggaagcgttcggctgcaaatctccacacctgatattaaagataacattgtcgcacaactcaagcagctttacaggatcctacaaacccaggaaagctggcagccgatgcagcctactccttccatgcagctgccccccgcgctcccacctcagtag

SEQ ID NO: 120870 - DNA, 1281 bp, Artificial Sequence
  Description of Artificial Sequence: Synthetic coding sequence
atgtgtgataggaatggcggtaggagactgcgccagtggttgattgaacaaatcgacagctcaatgtatcccggactgatctgggagaatgaggagaagtccatgttcagaataccctggaagcatgcaggcaagcaggattataatcaagaggtggatgcttcaattttcaaggcttgggccgtcttcaaaggaaaattcaaagaaggggataaggctgaacccgcaacctggaagacccgcctgaggtgtgcgctgaacaaatcccccgattttgaggaggtgactgacaggtctcagctggacataagcgaaccttacaaagtgtatcggatcgtccctgaagaggagcagaagtgtaagttaggagtggcaactgcaggttgcgtgaatgaggtcacagagatggagtgcgggagaagtgagatagacgaacttatcaaggagccaagcgtagatgactatatgggcatgatcaaaagatccccgtctccacctgaggcgtgccggtcccagcttttgcctgactggtgggcacagcagccctcaaccggcgtccctctggtgacagggtacacgacttacgacgcgcaccattccgccttttcccaaatggtcatcagcttctactatgggggtaagctggtgggtcaggcaaccaccacctgcccagaaggctgccgcttgtccctgtcccagccaggtctccctgggaccaaactgtacgggcccgagggcctcgaactggtgagattcccgcccgctgacgcaattccaagcgagcgacaaaggcaggtaactcggaaactgttcggacacttagagcgcggagtgctcctccattcatccagacaaggtgtgtttgtaaaacgcctttgtcagggccgagtcttctgtagcggcaacgccgttgtctgcaaaggcaggcccaataagctagagagagatgaagtcgtgcaagtctttgatacctcacagtttttccgcgagctgcagcagttttataattctcagggacgcctgcctgacggccgagtggtcttatgcttcggtgaagaatttccagatatggccccactgaggagcaaactgatcttggtgcagatcgagcagctgtatgtgcggcaactggctgaggaggcaggaaagagctgtggagcagggagcgtgatgcaggccccagaagaacccccaccagatcaagtttttcgtatgtttcccgacatttgcgccagtcatcagagaagtttttttcgcgaaaaccaacagattacagtatag

SEQ ID NO: 120871 - DNA, 546 bp, Artificial Sequence
  Description of Artificial Sequence: Synthetic coding sequence
atggctggttctagagaagttgttgctatggactgcgagatggtagggctcgggccccatcgggagtccgggctcgcgcgttgctcactcgttaacgtccatggggctgtgctctacgataaattcatacggccagagggcgaaatcactgactaccggacacgggtttcgggcgtgacacctcagcacatggtcggagctaccccgtttgcggtggcacgcctggaaatcttacagttattgaaggggaaactggtggtgggtcacgacttaaaacacgacttccaggcactgaaggaggatatgagtgggtatacaatttatgacacatcaaccgacaggctgctctggcgagaagctaaattagaccactgtaggcgggtctcattgagagttctcagtgaacggcttctccataaaagtatacagaatagtctgctgggacactcctctgtggaagacgcccgagccactatggagctgtaccagatttcccaacggatcagggctcgtcggggactaccacgtctcgcggtgagcgattag

SEQ ID NO: 120872 - DNA, 546 bp, Artificial Sequence
  Description of Artificial Sequence: Synthetic coding sequence
atggcgggctctagggaagtggtggccatggactgcgagatggtgggcctggggccccaccgcgagtccggacttgcccggtgcagcctggtcaatgtgcatggcgccgtgctgtatgataagtttatcagacctgagggcgaaattaccgattatagaactcgagtgtccggcgtgaccccacaacacatggtcggagccacccctttcgctgtagcccgcctggaaatccttcagctcctgaagggcaaacttgtcgtgggtcatgaccttaaacacgactttcaagctctgaaggaagacatgtctggttacacgatttacgacacgtcaacagatcgccttttatggcgcgaagctaagctggatcactgtaggagggtttccttgagagtgttaagtgaaagattgttacacaaatccattcagaatagcctgctgggtcactctagcgtcgaagacgcacgggccacgatggagttgtatcagatatctcagagaattagggcacgccgagggctgccacgacttgccgtttcagattag

SEQ ID NO: 120873 - DNA, 1062 bp, Artificial Sequence
  Description of Artificial Sequence: Synthetic coding sequence
atgagcaccctgctcttgaatctggattttggggaaccccctccaaaaaaggcgcttgaaggaaatgccaagcatcgaaattttgtcaagaaacggagattgctggagcgtagaggctttttaagcaaaaagaatcaacccccatcaaaggcaccaaagcttcactcagaacctagcaagaaaggcgaaaccccgacagtggacggcacatggaaaactccatcattcccgaagaaaaaaaccgctgcatctagcaacgggtctgggcagccccttgacaagaaagccgccgtttcgtggctcactcctgctccctctaagaaggccgacagtgtcgcagccaaggtggacttgcttggcgaattccagtctgctctgcctaagataaattcccatcccactcggagccagaaaaaaagcagccagaagaaaagcagcaaaaaaaatcatcctcagaagaacgctccgcaaaattctacacaagcgcactccgaaaacaaatgtagcggagcctcacaaaagttgcccagaaaaatggtcgctattgattgtgagatggtgggcactggcccaaaggggcatgtgtcaagccttgctagatgttccattgtgaactacaatggcgacgtcctatacgatgagtacattctacccccatgccacattgttgactatcggacacggtggtctggcatccgaaagcaacatatggttaacgctacaccttttaagatcgccaggggccaaatactgaaaattctgactggcaagatcgtggtagggcatgctattcacaatgattttaaggccttacaatacttccatccaaaatcactgacccgcgatacatctcatattccccccttgaatcgcaaggccgactgcccagagaatgcaactatgtcccttaagcacttaacgaagaaattgctgaaccgcgacattcaagtgggcaaatctggacattcctccgtggaggacgcgcaggcgactatggagctctataaacttgtggaggttgagtgggaggagcacctcgctcggaatcctccaacagattag

SEQ ID NO: 120874 - DNA, 1062 bp, Artificial Sequence
  Description of Artificial Sequence: Synthetic coding sequence
atgtctactctcctgttgaacctggacttcggagagcccccacccaagaaggcattggagggaaatgcgaagcacaggaacttcgtgaagaagcggagactgctggagcggcggggtttcctgagtaagaagaaccaacctccttccaaagcacctaagcttcattcagagccgagcaaaaagggtgagacaccaacggttgatggcacatggaagactccaagcttccccaagaagaaaacagcagcgagcagcaatgggtctgggcagccactcgataagaaagccgccgtgtcatggttaaccccagcgccgtcgaaaaaggcagactcagtggcagcgaaagtggaccttttgggggaattccaatcagccctgccaaagatcaacagccatccaactagaagtcagaagaaaagctcccaaaagaagtcctcgaagaagaaccatccacagaaaaatgccccgcagaacagcacccaagcccattctgagaacaaatgctccggtgcaagtcaaaagctccctaggaagatggtggccatagactgtgaaatggtcggcaccgggccaaaaggccatgtgtcctcactcgcaagatgtagcatcgttaattacaacggcgatgtcctgtatgatgagtacatccttccaccctgccacatcgttgattacaggaccaggtggtccggcatcagaaagcagcatatggtaaatgccactccgttcaagatagcaagaggccagatcttgaagattctgaccgggaaaattgtagtgggtcatgctatccataatgacttcaaggccttgcagtactttcaccctaagagcctgactcgagacacctctcatatcccgccattaaacagaaaggccgattgtccagaaaacgctactatgagtttgaaacatctcacaaaaaaactgctaaaccgggatatccaggtgggcaaaagcggtcactccagcgtcgaggacgcccaggcaaccatggaactgtacaagctggtggaggtggaatgggaagaacatttagctagaaacccccctaccgactag

SEQ ID NO: 120875 - DNA, 360 bp, Artificial Sequence
  Description of Artificial Sequence: Synthetic coding sequence
atggaggcttctgcccttacctcaagcgcggtaacgtccgtagccaaagtggtgcgtgtagcctccgggagcgcagtggtcctcccactggcgcgtattgcaactgttgtcatcggtggagtggtcgcggtgcccatggtcctgtccgcgatgggtttcactgctgctggcattgcttctagttctatcgccgccaagatgatgagtgccgctgctattgctaacggagggggtgtggccagcggatccctggttgccacactgcagtcgttgggggcaaccggactctccggacttaccaagtttattctcggaagtattggtagtgctatcgctgcagtgatcgcaagattttactag

SEQ ID NO: 120876 - DNA, 369 bp, Artificial Sequence
  Description of Artificial Sequence: Synthetic coding sequence
atggaagcttcggccctgaccagctcagctgttacttccgttgcgaaggtggtgcgtgtggcatccggctcggctgtcgtattaccgcttgctagaatcgcaaccgtggttattggcggcggcgagtcagttgtggctgtcccaatggtgctatcagccatgggatttacggcagccgggatcgccagttccagtatcgctgccaaaatgatgtccgcagccgccatcgccaatggtggcggtgttgcatccggctccttggttgccacactgcagagtctcggagcaactggattgagcggcctgacaaaattcatacttggttcaatcggctctgcaatcgccgccgtgatagctagattttactag

SEQ ID NO: 120877 - DNA, 369 bp, Artificial Sequence
  Description of Artificial Sequence: Synthetic coding sequence
atggaagcgtccgccctcacatctagcgccgtcacctctgtggcgaaagtggtccgggtcgctagcggctctgccgtggtgctacctctggctcgaattgccaccgtggtaatcggaggggtggctagcattgtggccgtgccaatggtgctctcagcaatgggcttcacagcagcaggcatagcaagttcctcgatcgccgccaaaatgatgtcggctgccgccattgccaacggtggcggggtggcttcgggctctctggtggctacacttcagagcctcggagctactgggctgagcggcctgactaaatttattctgggttccataggctccgccattgctgcagtcatagcaagattttactag

SEQ ID NO: 120878 - DNA, 189 bp, Artificial Sequence
  Description of Artificial Sequence: Synthetic coding sequence
atggaagcatctgccttgacgagctccgcagtcacctccgtcgcgaaggttgtaagggtggcttcagggtctgccgttgttcttccactggccaggatcgcgacggtggtaatcggcggggtggtggccgtccctatggtcctgagtgccatgggttttacggcagccggcattgcatcctcctcatag

SEQ ID NO: 120879 - DNA, 174 bp, Artificial Sequence
  Description of Artificial Sequence: Synthetic coding sequence
atggaagcctcagccctgacctcttccgcggtgacgagcgtggccaaagtggttcgcgttgcctctggttccgcagtagtgttaccgctggcgcgcatcgccacagtcgtcatcggtggcgtggtggccgtgcccatggtcctgtccgccatgggttttacggccgctggctag

SEQ ID NO: 120880 - DNA, 360 bp, Artificial Sequence
  Description of Artificial Sequence: Synthetic coding sequence
atggaggcttccgctctgaccagcagcgctgtcacatctgtggccaaggtggttcgggtggcttctggtagtgccgtggttcttcctctcgcacggatcgccacggttgtaatcggcggcgtcgtggctgtccctatggtcttgagcgctatgggttttactgcagccggcatcgccagcagttccatagccgcgaaaatgatgtccgctgcggctatagccaatgggggaggcgtggcctcgggcagtttagtcgctacactgcaaagcctgggcgccacggggctgtctggcctgaccaagttcatcctcgggtccatcggatctgctatagctgcagtaatagcacggttttactag

SEQ ID NO: 120881 - DNA, 123 bp, Artificial Sequence
  Description of Artificial Sequence: Synthetic coding sequence
atggaggcctctgcacttacttcatccgcagtgacttcggtcgccaaggtagtccgagtggcctccggcagcgcagtggtccttcctctagctaggatcgctacggtcgttattgggggatag

SEQ ID NO: 120882 - DNA, 282 bp, Artificial Sequence
  Description of Artificial Sequence: Synthetic coding sequence
atggaggcatctgccttaactagctccgcggttacctcagttgccaaagtcgtgcgggtcgcctcaggatcggcagtcgtgctccccctggctcgtatcgccactgttgtcattggaggtgtggtggccgtgcctatggtcctgtccgcgatgggtttcactgccgcaggcatcgcctcctcatcgatcgctgctaaaatgatgtccgcagcagccattgctaatggaggcggcgttgcctccggctctctcgttgctactttacaatcgctgggggcctag

SEQ ID NO: 120883 - DNA, 2358 bp, Artificial Sequence
  Description of Artificial Sequence: Synthetic coding sequence
atggggaagaagtataagaacattgtactgttgaagggactggaagtcatcaacgattatcatttccggatggtgaagtccctgctctccaacgatcttaagctgaatctcaagatgcgcgaggaatacgacaaaatacagatcgccgacttgatggaagaaaaattccgtggcgatgcggggctgggtaagcttatcaagatatttgaagatatcccgaccctcgaagatctcgcagagactcttaaaaaagagaagctgaaagtcaaagggcccgctctcagtagaaagagaaagaaagaggtggatgctacgtcacccgcaccaagcactagttccactgtgaaaacagaaggagctgaggccacaccaggagcacaaaaaagaaagaaatccactaaggaaaaagccggacctaaagggagtaaagtgtcagaggaacagacccagccccccagtcccgccggggcagggatgagcactgccatgggccgctcgcccagcccaaaaaccagcctgagcgctccccccaatagcagctcgacagagaatcctaagacagtggcaaagtgccaggttactccccggaggaacgttctccagaagcgcccagtgattgtgaaggtgctgtccacgaccaaaccatttgaatatgaaacaccggagatggaaaaaaaaatcatgttccacgccactgtcgccactcagactcagtttttccacgtgaaggtgctcaacacaagtctgaaggagaagttcaatggtaagaagataataataataagcgattatttggagtatgacagcctcctggaggtgaacgaagaaagtacagtttccgaggctgggccaaaccagacatttgaagtgcccaacaagattataaatagggctaaggagacacttaaaattgatattctacacaaacaagcgtcagggaatattgtgtatggagtattcatgctccataagaaaacggttaatcagaaaactactatttatgaaattcaggacgacaggggcaagatggatgtagtcggtactggacaatgccacaatataccgtgcgaggagggcgataagttgcagcttttctgcttcagactaaggaagaaaaatcagatgagcaagctcatcagtgaaatgcattcttttatacaaataaaaaaaaaaaccaatccaagaaacaacgatccaaagtctatgaagctccctcaggaacagaggcagctcccctacccctcggaggcgagtaccacatttcctgaaagccacctgaggactccacaaatgccacccaccacgccttctagctccttttttaccaagaagagtgaggacacaatttctaagatgaatgatttcatgcggatgcaaatcctgaaggaggggagtcatttcccaggaccatttatgaccagcattgggcccgcggaaagtcatccacacactccccagatgccaccctccactccttcctcgtctttcctgaccacaaaaagcgaggatacaatttctaaaatgaatgatttcatgcgcatgcaaatcttgaaagagggttcacactttcccgggcctttcatgacctccattggcccagcagagtcccatcctcatactccccagatgccaccctcaacacccagttcttctttccttacgactctgaaaccccgcttgaagacggaaccggaggaggtgagcatcgaggattctgcgcagagcgacctcaaggaagtgatggtcctgaacgcaacagaaagctttgtctatgaacctaaagagcagaagaagatgtttcacgccacagttgctacagagaatgaagtgttccgggtgaaggtgtttaatattgacctgaaagagaagtttacacctaaaaaaatcatcgccatcgcaaactatgtgtgtaggaatgggttccttgaagtgtatccatttaccttggtcgcggacgtgaacgcggaccggaacatggaaatccccaaaggtctcatcaggtctgcgtccgtgactcctaagattaaccagttgtgcagccagactaagggatccttcgtcaacggagtgtttgaggtacataaaaagaacgtgaggggcgaattcacctactacgaaatccaggacaacactggaaaaatggaagtggttgtgcatggtcgcctcaccacaataaactgtgaggagggcgacaagttaaaattgacttgctttgagttggccccaaaatctgggaatacaggtgagcttcggtccgtgatacattcccacattaaggtgatcaagacacgcaaaaataagaaggatatattaaatcccgactctagtatggagacttctcccgacttttttttttag

SEQ ID NO: 120884 - DNA, 2022 bp, Artificial Sequence
  Description of Artificial Sequence: Synthetic coding sequence
atgggaaaaaagtacaagaacatcgtcctgctaaaagggctggaggttatcaacgattaccactttagaatggtgaaatctttactttcgaacgacctgaagttaaatctaaagatgagggaggagtacgacaaaatacagattgccgatctgatggaggaaaaattccgaggcgatgccgggctgggaaaattgatcaagatttttgaggacatccccacccttgaggatcttgcagaaacattaaagaaggaaaaactaaaagtgaaaggtcctgcccttagtcggaagcggaagaaagaggtcgacgccacaagccccgctccatcgacgtcttccacagtgaaaacagagggggccgaggctactcctggcgctcaaaaacgtaaaaaatccacaaaggaaaaagccggtcctaaggggtccaaggtgagcgaggagcagacacagcctccaagcccggctggggcgggaatgagtaccgctatgggccgcagcccttcacccaaaacttctttgtccgccccacccaattcctcttcgacggagaatcctaaaaccgtagcaaagtgtcaggttactccaaggaggaatgtgctgcagaaacgcccggtcatcgttaaggtgctgagcactaccaaaccatttgagtacgagacacctgagatggagaagaagataatgttccacgccacagttgccactcagacacagttctttcacgtcaaagtgctaaatacaagccttaaggagaagtttaatggcaagaagatcatcattatctccgactatctggaatatgactccctgctcgaggtcaatgaagagagtaccgtttctgaggctggacccaaccagacttttgaagtgcccaataaaattatcaatagggcgaaagaaacattaaagatcgatatccttcacaaacaggcctctggaaatattgtgtacggagtgtttatgctgcacaagaagactgttaaccagaaaaccactatttacgagatccaggatgaccgggggaagatggatgtcgtgggaacaggccagtgtcacaacattccttgtgaggaaggagataagctgcagctgttctgctttaggcttcgcaaaaaaaaccagatgtccaagctgatttccgaaatgcacagctttattcaaataaaaaagaagaccaacccaaggaacaatgacccaaagagcatgaagttgccacaggagcagcgacagctcccttaccctagcgaagcctccacaactttccctgagagccacctgagaactccacagatgcccccgaccacacccagctctagtttcttcacgaagttgaaaccccgactaaaaactgaaccagaagaagtgagtatcgaagatagtgctcagtcagacctgaaggaggtgatggtcctgaatgccaccgagagctttgtttatgagccaaaagaacagaaaaaaatgtttcatgccaccgtggctaccgaaaacgaagtttttcgggttaaagtgtttaacattgacctaaaagaaaagtttactccaaaaaagatcattgcaattgccaactacgtgtgcagaaatgggtttctcgaggtatatccgttcaccctggttgcagacgtcaatgccgaccggaatatggaaattcctaaagggctgattcggagcgcatccgtaacacctaaaattaatcaactctgtagtcaaaccaagggttcttttgtcaacggtgtgttcgaggttcataagaaaaacgtgaggggagaattcacgtactacgagatccaagacaataccgggaagatggaagtagtggtgcatgggaggttgacgacaataaactgcgaggaaggcgacaaacttaagcttacatgctttgagctcgccccgaaatctggaaataccggtgagctgaggtccgtgatacattctcacataaaggtgattaagacccgtaaaaacaaaaaggacatcctcaatcctgactcctcaatggaaacctccccagatttctttttttag

SEQ ID NO: 120885 - DNA, 1245 bp, Artificial Sequence
  Description of Artificial Sequence: Synthetic coding sequence
atggggaagaaatacaagaacatcgtcctattaaagggcttggaagtcattaacgactatcacttcaggatggtgaaaagcctgctgtctaatgacttgaagctgaacctaaaaatgcgggaggaatacgacaagattcagattgcagatctgatggaggagaaattccgcggcgacgccggcctggggaaactcataaaaattttcgaggacattccgactctggaggacctggctgagactttgaaaaaggagaaactgaaggtcaaaggccctgccctgagcagaaaaaggaaaaaggaagttgacgctacatctccagccccttcgactagttcaaccgtgaagactgagggagccgaggccactccgggagcgcagaagagaaagaagagcaccaaggagaaagccgggccaaagggaagtaaagtgtcagaagaacagactcagcccccgagccctgcaggagctggtatgtctaccgccatggggaggtcacccagccctaaaacaagcttgagcgccccccctaactcaagttctaccgaaaatccaaagacggtggcaaagtgccaggtgactccacgtaggaacgtgctacagaagcgaccggtgatcgtaaaggtgctcagcacgacaaagccattcgaatatgaaacccctgagatggagaagaagatcatgttccatgcaaccgtggccacccagacccagtttttccacgtgaaggtcctgaacaccagtctgaaggagaaattcacacccaagaagatcatcgcgattgctaattacgtgtgcaggaatggctttctggaggtgtaccccttcaccctggttgccgacgtgaacgcggacagaaatatggagatccctaagggcctgattagatctgcgtcagtgactcctaagattaaccagctatgcagtcagaccaaaggatccttcgtcaacggggtgttcgaagtgcacaagaagaatgtacggggagagtttacttattacgagattcaagataacaccgggaagatggaggtggtagtccacgggcgcctgacaactatcaattgtgaggagggggacaagctgaagctcacttgcttcgaactcgcaccaaagagcggaaacaccggggaactccgatccgtgatccattcacatataaaggtgatcaaaaccagaaaaaataagaaagatatcttaaatcccgattctagtatggagacaagcccagatttcttcttttag

SEQ ID NO: 120886 - DNA, 2190 bp, Artificial Sequence
  Description of Artificial Sequence: Synthetic coding sequence
atgggcaagaagtataaaaatattgtcctcctcaaggggctcgaggttataaatgactatcatttcaggatggtgaaatctctgctgtcgaacgacctgaaactgaacctgaagatgagagaggagtatgacaagatacagattgcagaccttatggaggaaaagttcaggggtgacgcaggattaggtaaactcattaaaatctttgaggatattcccacacttgaggatctggccgaaaccctcaaaaaggagaagttgaaggtcaagggtccagcgttatctcggaagcgcaagaaagaagttgatgccacttccccagctccgtctacctccagcacagtgaagacggagggcgctgaagctacaccaggtgcccagaaacgaaaaaagtctacaaaggagaaagcaggtccaaaaggctctaaagtttcagaagagcagacgcaacctcctagcccagccggcgctgggatgtccaccgcaatgggtcgatctccaagccctaaaactagtctctccgctcctcctaacagctcctccaccgagaaccctaagactgtggctaaatgtcaggtcaccccacgccgtaacgtgttacagaaacgccctgtaatcgtcaaagttttgagtactacaaaacctttcgagtacgagacacctgaaatggagaagaaaataatgtttcacgccactgtagctacacagactcagttctttcacgtgaaggtgctgaatacctccctgaaggaaaagttcaacggtaaaaaaataatcatcattagtgactatttggagtacgactctctcctcgaagttaacgaggagtctacagtcagtgaagccggtccaaaccaaacctttgaagtcccaaataagataatcaaccgcgccaaggagacgttgaaaatagatatcctgcataagcaggcaagcgggaacatcgtgtatggcgtgttcatgcttcacaaaaagaccgtcaaccagaagaccaccatttatgaaattcaggacgaccggggtaaaatggacgtggtagggacaggtcaatgtcataatattccctgcgaggagggagacaaactgcagctcttctgcttcaggctgaggaaaaaaaatcagatgtcaaaactaattagcgaaatgcacagttttattcagattaaaaaaaagactaatccccgaaataacgatccgaaaagcatgaaactgcctcaggaacaacgccagcttccctacccatccgaggcctctactacatttccggagtctcaccttaggacacctcagatgcctcctaccacgcccagttcttctttcttcaccaaaaagtcagaagacacaattagtaagatgaacgacttcatgcgaatgcagatactgaaggagggttcccacttcccagggccatttatgacaagcatcggccctgcagaatctcacccccacacgccccagatgcccccttccacaccttcctccagctttttgaccaccctgaagccgaggctgaaaaccgagcccgaggaggtgtcaattgaagattccgcccagtcggacttaaaggaagtcatggtgttgaacgccaccgaatccttcgtctacgagccaaaagagcagaaaaaaatgttccacgcaactgttgcaactgagaatgaggtcttcagggtaaaagtctttaatattgacctcaaggagaagttcacgcctaagaagattatcgcgatagccaattacgtgtgccgtaacggctttttggaggtatatccttttacattggtggccgacgtgaacgccgatcgtaacatggagatccccaaaggcctgatacggtcagcatctgttacacctaaaatcaaccagctatgctcacagactaaaggaagcttcgtgaacggagtgttcgaggtgcataagaaaaatgtccgcggcgaatttacttactatgaaatccaagacaacaccgggaaaatggaggtggtcgtgcacggacggctgaccaccattaattgcgaggaaggcgacaaactcaagctgacatgttttgagcttgctccaaaatcgggaaacaccggagaactaagaagcgtaatacatagccatattaaggtgatcaaaactagaaaaaataaaaaggatattctgaacccggacagcagtatggaaacctcacctgattttttcttctag

SEQ ID NO: 120887 - DNA, 2190 bp, Artificial Sequence
  Description of Artificial Sequence: Synthetic coding sequence
atgggtaaaaagtacaagaacattgtgctgttgaaggggctggaggtcatcaacgactatcatttcagaatggttaagagtctgttgtctaatgatctgaagctgaacctgaagatgcgagaagagtatgacaagatccagatagctgaccttatggaggagaagttccggggagatgccggcttaggtaagttaatcaaaatattcgaagatattcctacgttggaagatctggcagaaacccttaagaaggaaaagctcaaagtgaaaggccctgccctgtcacgcaagcggaaaaaagaggtggatgccactagcccagctcctagcacctcttccactgtgaaaacggaaggtgctgaggcgacacccggcgcccagaaacgcaagaaatctaccaaagaaaaagcagggcccaaagggtccaaggtttccgaggagcaaacacagcctccaagccccgcaggagcaggtatgtccactgccatggggcggagtccatctcccaaaacgagcctgagcgccccccccaattcttcgagtactgaaaatcctaagaccgtggccaaatgccaggtcacacctaggagaaacgtgctgcagaagcgccctgtcatcgtcaaagtcctgagtactactaaaccatttgagtatgaaacacccgaaatggaaaagaaaattatgtttcatgctactgtggctacacagacccagtttttccacgtgaaagttctgaacacctcattgaaggagaaatttaatgggaaaaaaattatcatcatctctgattatcttgagtacgattccctgctggaggttaacgaagagtctaccgtctcagaggccggtccaaatcagacctttgaggtgccaaataagatcattaaccgggcaaaggagactcttaagatcgatatcctgcacaaacaggcatccggtaacatagtgtacggcgttttcatgctccacaaaaagacggtcaatcagaagaccacaatctacgaaattcaggatgaccggggcaagatggatgtggtgggaacgggccagtgccataatatcccctgtgaggagggggataagctgcagctgttctgctttcgccttaggaagaaaaatcagatgagtaaactgatctctgaaatgcatagtttcattcagataaaaaagaaaaccaatccacggaacaacgatcccaaatctatgaagctgcctcaggagcagcggcaactcccttatcctagtgaggcttccacaactttccctgagtcccacttacgcacgccacagatgccacccaccactccatcttcttccttctttacgaaaaaatccgaagatacaatttcaaagatgaatgacttcatgaggatgcagattctgaaagaaggaagccatttccccggccctttcatgacgtctattggaccagccgaaagtcatcctcatacgcctcagatgcctccttctactcccagctcatcattcctgaccaccctcaagcccaggctgaagacagagccagaagaggtgagcatcgaggactccgcccaaagcgatctcaaggaggtgatggtcctgaatgcaacagagtcttttgtgtacgaaccgaaagaacaaaaaaagatgttccacgctacggtggctaccgaaaacgaggttttccgcgtgaaggtgttcaacattgatcttaaggaaaaatttaccccaaagaagatcattgctattgccaattatgtatgccgtaatgggtttttagaggtttatcctttcactctggtggcagatgtgaatgccgatcgtaacatggagatccctaaggggttaatccggtccgccagcgtgaccccaaaaattaaccaattgtgttctcagacaaagggctccttcgtgaatggcgtgtttgaagtacacaagaagaatgtacggggggaatttacatattatgagatccaggacaacacgggaaagatggaagtggtagtgcacggaaggcttactaccatcaattgtgaggagggagataaactgaaacttacctgctttgagctggcacccaagtctggcaacacaggagagcttcgatctgtgatccatagccatatcaaagtgatcaagacacgtaaaaataagaaggacattctgaatccagactcatccatggagacatctcccgacttctttttttag

SEQ ID NO: 120888 - DNA, 384 bp, Artificial Sequence
  Description of Artificial Sequence: Synthetic coding sequence
atggggaaaaagtataagaatattgtactgttgaaaggtctggaggtaattaatgattaccattttagaatggttaagagtctcctatctaatgatctgaagctcaacctaaagatgagggaagagtatgataaaattcagatcgccgacctgatggaagaaaaatttaggggagacgctgggctcggtaaattaatcaaaattttcgaagatattcctacactggaggatctcgctgagacactcaaaaaagagaaacttaaagttaagggacccgccctgagccgtaagcgcaagaaggaggtcgatgccacatcccctgcacccagcaccagttctacagtcaagactgagggggctgaggccacacctggtgcacagtag

SEQ ID NO: 120889 - DNA, 2202 bp, Artificial Sequence
  Description of Artificial Sequence: Synthetic coding sequence
atgagcgtgaaaatggggaaaaaatataagaacattgtgctcctcaagggactagaggttattaatgattaccactttagaatggtcaagagtctgttatctaatgacttgaagctgaacctaaagatgagggaagagtatgataagattcaaatagctgaccttatggaggaaaaattccgaggcgacgctggactgggcaagctgatcaagatttttgaggatatcccaacacttgaggacttggcagaaacccttaagaaggaaaagttgaaagtgaaagggcctgccctatcacggaaacgcaaaaaggaggtcgacgcaaccagccccgcccccagcacctcctctacagtgaaaacagaaggcgctgaagcaacaccaggggcgcagaaccctaagaccgttgcaaaatgtcaggtgacacctcgccgcaatgttctgcagaaacggcccgtgattgtgaaagtgctctccacgaccaagcctttcgagtacgaaacgccagagatggaaaaaaaaattatgtttcatgctacagtggctacacaaactcaatttttccacgtgaaagttctaaacaccagtcttaaggagaagttcaatggaaagaagatcattattatcagcgactatctggaatatgactctctcttggaagtgaacgaggagtcaaccgtatccgaagcgggcccaaatcagactttcgaggtgcctaacaagataatcaaccgggcaaaggagaccctgaaaatcgatattctgcataaacaggcttcgggtaacatcgtctatggagtgttcatgctgcataaaaagacagttaatcagaagacaacaatttatgagatacaggatgacaggggtaaaatggatgttgtgggaactggccaatgccacaacataccatgtgaggagggcgataaactgcagttgttctgctttaggctgcgaaagaaaaaccaaatgtctaagcttatctccgagatgcatagcttcatccagatcaaaaaaaaaacaaatcctcgcaataatgacccaaagtcaatgaagcttccccaggaacagaggcaattgccctatcccagcgaagctagcaccaccttcccggaatcacacctgcgcaccccccagatgccccctaccacacctagttcaagcttcttcactaaaaagagtgaagacaccatctccaaaatgaacgactttatgaggatgcagatcttaaaagaagggtcccactttccgggaccgtttatgacctcaattggcccagccgagtcccaccctcacacaccacaaatgccgccgtccacccctagctcaagttttttaaccaccaagtcagaagacacaatttccaaaatgaacgactttatgcgcatgcagatcctcaaagaaggcagccatttccctgggccattcatgactagcatcggccccgccgagagccatccccacactcctcagatgcctccatccacaccgagctcatcgtttctcaccactttaaagccaagactgaagaccgaacctgaggaagtttccatagaagattccgctcagtcagatctaaaggaggtgatggtgttgaacgctactgagtcttttgtgtacgagcccaaggaacaaaagaagatgtttcatgccacagtggcaaccgaaaacgaggtttttagagtgaaagtgttcaacatcgacttgaaggaaaagtttacacctaagaagatcatcgccatcgctaactacgtatgcagaaatgggtttttggaagtgtacccttttactctggtggctgacgttaacgcagacagaaacatggagatcccaaaaggcctcattagatctgcgtctgtaactccaaagatcaatcagctgtgtagccagacaaaagggtcgttcgtcaatggtgtattcgaagttcacaaaaaaaatgtgaggggcgagttcacatactacgagattcaggataacacaggcaaaatggaggttgtggttcacggacgtttaactactataaactgcgaggagggtgataaattgaaattgacctgctttgagctagcacccaagagcgggaacacaggagaattgcgaagcgtgatacactcccacatcaaagtcattaagactcgcaagaataagaaggacattctcaacccggatagctccatggagacgagtcccgattttttcttttag

SEQ ID NO: 120890 - DNA, 543 bp, Artificial Sequence
  Description of Artificial Sequence: Synthetic coding sequence
atgggcaagaagtacaagaacattgtcctcctgaagggtctggaggtcataaacgactatcattttcgaatggtcaagtctcttctgtcaaacgacctcaaactcaatttaaaaatgcgcgaagagtacgataagattcagattgcagacttaatggaagagaaatttcgcggcgatgcaggtctggggaaactgataaagatatttgaggatatacccactctggaagacttggccgagacccttaaaaaagagaaattgaaggtgaagggccccgccctttccaggaagcgcaaaaaagaggtcgacgcaacgtcaccggcaccttctacctcctctacagttaaaaccgagggggccgaagctacccccggcgcccagaaacggaagaaaagcacgaaagagaaagctggtcccaagggctcaaaagtaagcgaagaacaaacccagcccccgtcacctgccggggctggcatgtctacagccatggggaggtctcccagcccaaagaccagcctgtccgctcctcctaatagtagctag

SEQ ID NO: 120891 - DNA, 1485 bp, Artificial Sequence
  Description of Artificial Sequence: Synthetic coding sequence
taatccacggagaaccctaaaacagtggcaaaatgtcaagtgacccctagaagaaatgtgttacaaaaaaggccagtgatcgtaaaagttctgtcaacaaccaaaccgtttgagtatgagacccctgagatggaaaaaaaaattatgtttcatgctactgtggcaacacagacccagttctttcatgttaaggttcttaacactagcttgaaggaaaaatttaatggcaaaaagatcatcatcatttccgactacctcgagtacgatagtctcctcgaggttaacgaggagtccacagtcagcgaagcgggaccaaaccagacgttcgaggttccaaacaaaatcatcaaccgggcgaaggaaacactaaaaatcgatattctgcacaagcaggccagcggcaatatcgtgtacggcgtgttcatgcttcataagaagaccgttaaccagaaaacgaccatttacgaaattcaagatgatagaggtaaaatggatgttgtgggcactggccaatgtcacaacattccatgcgaggaaggcgacaagctgcaactattttgcttccgcctgaggaaaaagaaccagatgtcaaaactgataagtgagatgcacagtttcattcagattaagaaaaaaacaaaccccagaaacaatgatccaaagtccatgaaacttcctcaggagcagcgtcagctgccatacccctctgaagccagcacgacatttccggagtcacacctgcgaaccccgcagatgccacctacaaccccctcctccagcttttttacaaagctgaagcctcgcctgaaaactgagccagaagaggtgtcaatcgaagacagtgcacagagcgacctgaaggaggtcatggtcctgaacgccactgaaagcttcgtatatgagcctaaagaacagaaaaaaatgttccatgctactgtggccacagagaatgaggtcttcagagtgaaggttttcaacatcgaccttaaggagaagttcacaccaaaaaaaattatcgccattgcaaactacgtctgcaggaacggattcctggaggtttatcctttcacactggtggccgacgtgaatgccgataggaacatggaaatccctaaggggcttatccggtcagccagtgtgacacccaaaatcaaccagctctgtagccaaaccaaggggagttttgttaacggggtcttcgaggtgcacaagaagaatgttcggggggaatttacttattacgaaatccaagacaataccggaaagatggaggtcgtggttcatgggcggctcaccaccatcaattgtgaagaaggggataaactcaaactgacatgctttgaacttgcccccaagtcagggaataccggagagctgagatctgtgatccattcccatatcaaggttatcaaaaccagaaaaaataaaaaagacatactgaacccggatagcagcatggagacttcccctgacttcttcttctag

SEQ ID NO: 120892 - DNA, 753 bp, Artificial Sequence
  Description of Artificial Sequence: Synthetic coding sequence
atgaccctctccccgttgctgttgttcttgccaccgctcctgctgttgttggacgtccccactgcagccgtacaagctagccccctgcaagcattagacttcttcggaaatggcccccccgtgaactacaaaactgggaacttatacctgcgcggacctctgaagaaatccaacgctccacttgtaaacgtcaccctgtattacgaagctctgtgtggtggctgtagggcatttctgatccgagaactgtttccaacttggctgctcgttatggagattcttaatgtcaccctcgtgccatacggcaacgcccaggaacagaatgtgtccggtagatgggaattcaaatgtcagcatggggaggaggaatgcaagttcaacaaagtagaagcctgcgtcctcgatgaactcgatatggagttggcttttctgacaatagtgtgtatggaggagtttgaagatatggaacgttccttacccctgtgtctccagttatacgcccccgggctaagtcccgacactattatggagtgtgctatgggggatcggggcatgcagctgatgcacgccaatgcgcagcgcaccgacgccctgcagccaccacacgagtacgtgccatgggtgaccgttaacggcaaacctctggaggaccagacccagctgctgacgctcgtgtgccaactgtatcagggtaagaaaccagacgtgtgcccctcctctacttcaagcttgaggagcgtttgctttaaatag

SEQ ID NO: 120893 - DNA, 588 bp, Artificial Sequence
  Description of Artificial Sequence: Synthetic coding sequence
atggcactgctgtttccactactggctgccctcgttatgacctcatactctcctgtggggtcactagggtgtgatctgccgcagaatcacggactgctgtcccggaacaccctggtgctgctgcaccagatgagaaggatcagccccttcctgtgtttgaaggacagacgtgacttccgatttccacaggagatggtcaagggatcccaactccagaaggcccacgttatgtctgtactacacgagatgttgcagcagattttctccctgttccacaccgaacgctcctctgccgcatggaacatgacacttctggaccagctgcacacgggcctgcaccagcagctacagcacctggagacttgcttgctgcaggtggttggtgaaggggaatctgccggcgccatttccagtccggctcttactttgagacgatatttccaggggatccgcgtgtatttaaaagagaagaaatatagcgattgtgcatgggaggtcgtgcgcatggagatcatgaaatctttgtttctgtctactaatatgcaggaacgcttgaggtccaaggatcgcgacctgggttcttcatag

SEQ ID NO: 120894 - DNA, 861 bp, Artificial Sequence
  Description of Artificial Sequence: Synthetic coding sequence
atgagcgcccctttggacgcagctctgcacgctctacaggaggaacaggcacgactgaagatgagactgtgggatctgcagcagctgcgaaaagaactcggtgactcccctaaggataaggtgcccttttccgttcccaaaatccctttggtgtttcgtggccacacgcaacaggacccagaggtcccgaaatcactggttagcaatctgagaattcattgccctcttctggctggctcagccctgatcaccttcgatgacccaaaggttgctgagcaggtactccagcagaaagagcacactataaatatggaggaatgccgactgcgggtgcaggttcagccgctggagcttcctatggtaaccactatccaaatgagtagccagctttccggccggagagtgctagtgaccggctttccagcatcgcttcgcttgagcgaggaagaactgctggacaaactggagatcttcttcggcaaaacgcgcaatggtgggggcgacgttgatgtgcgcgagctgctcccagggtcagtcatgctgggtttcgctagggacggtgtggcccagcgtctgtgccagatcgggcagtttacagtacctctagggggacagcaggtcccccttagagtctcgccctacgtgaacggagagatccagaaagccgagatcagatcccagcccgtgcctcgtagcgtgttagtactgaacatccccgatatcctcgatggacctgagctccatgatgtcctggagatccattttcagaagcccacgagaggtggaggcgaagtggaagcacttacagtggtgccccagggacagcaaggactggccgtctttacttctgagtctgggtag

SEQ ID NO: 120895 - DNA, 867 bp, Artificial Sequence
  Description of Artificial Sequence: Synthetic coding sequence
atgagtgcaccgctggatgctgccctccacgccctccaagaagagcaagccagactcaagatgagactctgggatttgcagcaactaagaaaggagctcggcgacagtcctaaggacaaagtgccgttttccgttcctaagattcctctagtttttaggggacacactcagcaggaccctgaggtcccgaaatcccttgtgtctaacttaagaattcactgccccctgttggctgggtccgctctgattaccttcgatgacccaaaggtcgctgagcaagttctccagcagaaagagcatacaatcaacatggaagagtgcagattgcgagtccaagtgcagccactggaactccctatggtgacaactatccaggttatgatgtctagccagttgtccggtcggagagtcttagttaccggatttcccgcgagtctacggctgagcgaggaggagctcctggacaaattagagatcttcttcggaaagacaagaaacggaggtggcgatgtggatgtgcgggagctcctgcctgggagcgttatgctgggatttgcgagagatggggtggcgcagcggttgtgccagatcggtcaattcacagtcccactcggtgggcagcaagtgcctctgcgagtctcgccatacgtaaatggggagattcagaaagcagagatcagatcccagcctgtcccacgctccgtgctagtcctgaatattccagatatcctcgatggtccagagctgcacgacgtgttggaaatccacttccaaaaacctactagaggcggcggggaggtggaggcactgacagtagtcccccaaggtcaacagggcctggccgtgttcacctctgagagtggatag

SEQ ID NO: 120896 - DNA, 1335 bp, Artificial Sequence
  Description of Artificial Sequence: Synthetic coding sequence
atggctgtcactacccgccttacatggctgcatgagaagatccttcaaaatcatttcgggggaaagagactgtctcttctctacaaagggtctgtacatggcttccgcaacggagtgttgcttgataggtgctgtaatcagggccctaccctgacggtgatctatagcgaagaccatattatcggggcttatgccgaagaatcgtatcaggaaggtaaatatgcctcaattatcttgtttgctctgcaggacacaaagatttctgagtggaagttagggctgtgcactcctgaaaccttattttgctgtgacgtcaccaaatataactcccccacaaacttccaaatagatgggcggaatcggaaggtaatcatggatttaaaaacgatggaaaaccttggattggcccagaattgtactatttcgattcaggattacgaggtgtttaggtgtgaggactccctggacgaaaggaaaattaagggcgtaattgagttgaggaagagcctgctttccgctttgcgcacatatgaaccctatggctctttagtccagcagattagaatcctgctgttaggcccgattggagctggtaagtccagtttttttaactccgtcaggagcgtgtttcaggggcacgtcactcatcaagctctcgttggaactaacacaaccggcatcagcgagaagtatagaacatacagcatccgcgacggcaaagacggaaaatatctgccattcatcttatgcgacagtctcggcctgtctgagaaggaaggtggcctgtgccgggatgatatcttttatattctgaacggcaacatccgagacagataccagttcaaccctatggagtcaattaagttgaatcatcatgactatattgacagcccaagcctcaaggaccgcatacattgcgtcgcattcgtcttcgacgcttcgagtatccagtatttttcttctcagatgatcgttaaaatcaaacggatcagacgggagctcgtcaacgccggagtcgtacacgtggcgctgttaacgcacgtggattcaatggacttaatcaccaagggggatctgatcgagatcgaaagatgcgaacctgtgcgctcaaaactcgaagaggtccagaggaagctaggctttgctctgagcgatatatcagtggtctccaactactcctccgagtgggagttagaccctgtaaaggatgtgcttatcttgagcgccctgagacgcatgctttgggcggcagatgatttcctggaggatctcccattcgaacagattggtaacctcagggaggagatcatcaactgcgcacagggcaagaaatag

SEQ ID NO: 120897 - DNA, 588 bp, Artificial Sequence
  Description of Artificial Sequence: Synthetic coding sequence
atggatctgaagaccatggagaacttaggcctggcccagaactgcacaatttctatccaggactacgaagtgtttcggtgtgaggacagccttgatgaacgcaagatcaaaggtgtgatcgagctccgcaagagcttactgtcagcactgagaacgtatgagccatatgggagcctggttcagcaaatcaggatactcctactgggacccataggggcgggcaaaagcagcttctttaactcagtgcgcagcgtattccagggacatgtgacccaccaggcgctggtgggcacaaatacgacagggatctccgagaaatatcgcacatactccatcagagacggcaaggatggcaaatatctgcccttcatcctctgcgacagtctgggtctgtctgagaaggaaggaggactctgccgggacgatatcttttacatcctgaacggaaacatcagggaccgctatcagtttaaccctatggaatccattaagctgaatcatcacgactatattgattcgcccagtttgaaggaccgcattcactgcgtggcctttgtatttgatgcttcctccattcaatacttctag

SEQ ID NO: 120898 - DNA, 231 bp, Artificial Sequence
  Description of Artificial Sequence: Synthetic coding sequence
tgactatccgatatttcggtggtttccaattattcctctgagtgggagttggatcccgtcaaggacgtgttgatcctttccgccctaagaaggatgttgtgggccgccgacgatttcctggaagacctccctttcgagcagattggacgttggtttggcggggttgaagcgtggaagcgtagcggcaaccttagggaagaaatcattaattgcgcgcagggaaagaaatag

SEQ ID NO: 120899 - DNA, 390 bp, Artificial Sequence
  Description of Artificial Sequence: Synthetic coding sequence
atggagtcaatcaaacttaatcatcacgactacatcgactctccttctctcaaggaccgtattcactgtgtggcatttgtgtttgacgcttctagtatccaatatttttcgtctcagatgattgtcaagataaagagaatccgaagggagcttgtgaacgctggcgttgtacatgttgctctactgacccatgtggacagtatggacctgatcacgaaaggagacctgattgaaattgagaggtgcgagccagtgcgatctaaggtgatgaacgacgctctgcgtaagcacatcttctggggtatgctgctccagtcacacactagcgtctacaaaaataaaaacaaacaactgctggggctccgacgcattacaaaactgttaaagtag

SEQ ID NO: 120900 - DNA, 585 bp, Artificial Sequence
  Description of Artificial Sequence: Synthetic coding sequence
atgctgtgcgataccatgggccttgacggcgcagaaggcgctggcctgtgcatggatgatatcccccatattcttaagggctgcatgcctgaccgatatcaattcaactcgaggaaaccgataactccagagcactcaacctttatcacctcgccttcactgaaggatcgaatccactgcgtggcctacgtgcttgacatcaattcaatcgacaacttatactctaagatgctagccaaagtcaagcaagtgcacaaagaggtgttgaactgtgggattgcctacgtcgcactactgaccaaggtggatgactgttcggaggtgctgcaggacaacttcctgaatatgtctagaagcatgacatcccagagcagagtaatgaacgtacataagatgctcgggatccctatttctaacattctgatggtcggaaactatgcgagtgacctggagttggaccccatgaaggacattctgattctaagtgcccttagacagatgctccgggccgccgatgacttcttagaggacctgccactggaggagaccggtgctatagaaagagctcttcagccttgcatatag

SEQ ID NO: 120901 - DNA, 1359 bp, Artificial Sequence
  Description of Artificial Sequence: Synthetic coding sequence
atggaggtgactacccgcctgacttggaacgatgaaaatcacctgcggaagctgcttggcaacgtctccctttccctactatacaagagctcggtacatggagggtctatcgaagacatggtagagcggtgcagtcgccaggggtgcaccatcaccatggcatacatcgactacaacatgattgtcgcttttatgctgggcaattacataaatctgcatgagtctagcactgagcctaatgatagcctttggttttctctgcagaagaaaaatgatactaccgagattgaaacgctcctcctcaacactgcccccaagattatagatgagcaactcgtgtgccgactttccaagactgacatttttatcatttgtcgagacaacaaaatttaccttgacaagatgatcacgcgcaaccttaagctgcgtttctatgggcaccgacaataccttgaatgcgaagtatttcgagtagagggaatcaaggataatctcgacgacattaaacgcatcataaaggcacgggaacacaggaaccgacttcttgcagatatcagagattataggccatacgccgacctggtgagcgaaattaggatcctacttgtaggcccggtcggctctggcaaatcctccttttttaatagtgtcaaaagcatttttcacggacacgttactgggcaagcagtggtgggctccgacattaccagcatcaccgagagatacaggatctattcggtgaaagatggaaagaacggcaagtccctcccttttatgttgtgtgacacgatgggactggacggcgctgagggagcaggtctctgtatggatgacattccacacatcctgaaaggatgcatgcctgaccgataccagtttaactcgcgcaaaccaattacccctgagcattctacatttatcacaagtccgtccttaaaagataggattcactgcgtggcatatgtgctggatattaattctattgataacctgtactccaagatgctggccaaagtgaaacaggtgcataaggaagtgctgaattgcggtatcgcctatgtcgctctcctgactaaggtagacgactgctccgaggtgctgcaggataattttcttaatatgtctcggtccatgacctcccagagccgcgtgatgaacgtgcataagatgctcggtatccctatcagcaacattctcatggtaggaaactatgccagcgacttggaattagatccgatgaaggacattttaatcctcagcgccctgaggcagatgttaagagcggcagacgacttcctagaggacttgccgctggaggaaaccggcgcaatcgaaagggcattgcaaccgtgtatttag

SEQ ID NO: 120902 - DNA, 294 bp, Artificial Sequence
  Description of Artificial Sequence: Synthetic coding sequence
atggaggtgaccacaagactcacatggaacgatgagaaccacttgcgaaaactactaggaaatgtctccctgagcttgctttataaatcttctgtgcacggcgggtccattgaggatatggtagaaaggtgttcccggcagggctgcactattacaatggcctacattgactacaatatgattgttgctttcatgctaggaaactacataaatctgcatgagagctctacggagccaaacgattccctgtggttcagtttgcagaagaagaacgataccaccgaaatcgaatag

SEQ ID NO: 120903 - DNA, 1437 bp, Artificial Sequence
  Description of Artificial Sequence: Synthetic coding sequence
atgagcactaacggggatgatcatcaagtcaaggatagcctggagcagctccgttgccacttcacatgggaactttcgatcgatgacgacgaaatgcctgaccttgagaatagagtactagatcagatcgagtttctcgataccaagtacagcgtggggatacacaatctcctcgcatatgtgaaacacctcaagggtcaaaatgaagaggctctgaaatccctcaaagaagcagagaatctcatgcaggaggagcacgacaaccaagcgaatgttagatcattggttacatggggcaacttcgcctggatgtactaccacatgggccgattagcagaagcccagacttatttggataaagtcgagaatatctgtaagaaactctctaacccattcaggtaccgaatggagtgccccgagatcgattgtgaggaagggtgggccttgcttaagtgcggcggtaagaattacgaacgagccaaggcttgctttgagaaagtactggaagtcgaccctgagaatccagagtcctcggcagggtatgcaatttctgcttataggcttgacggattcaagcttgccactaaaaatcacaagccgttttcactattgccccttaggcaggcagttcgtctcaatcctgataacggatacataaaggtgttgctggcccttaagttgcaggacgagggccaggaagcagagggagagaaatacatcgaagaggctctggctaatatgagctcgcagacgtacgtgttccgctacgctgccaaattctatagacggaagggcagcgtggataaagctctcgaactgctgaagaaggccctgcaggagacaccaacatctgtcctgctgcatcaccagatcggcctatgctataaggcacaaatgattcagatcaaggaagccacaaagggccagccacgagggcaaaatagagaaaaactcgacaagatgatcagaagtgccatttttcattttgagtccgcagtcgaaaagaagccaacttttgaggtcgcccacctggatctcgccagaatgtacattgaagcggggaaccacaggaaggcggaagaaaatttccaaaagctgttgtgtatgaaaccggtggtggaagagactatgcaggatatccacttccattatggccggtttcaggaatttcagaagaaaagcgacgtgaacgctatcatccattatctcaaagcaattaaaatcgagcaggccagcctcactagagacaagtcaattaactcactcaagaagctggtgctcaggaaactgcgtcgcaaggccctcgatctagagtcgctttcactgctcggctttgtctataagctggaagggaacatgaatgaggcccttgagtattatgaaagagcgttaaggctggccgcagattttgaaaattcagtgagacaggggccatag

SEQ ID NO: 120904 - DNA, 1344 bp, Artificial Sequence
  Description of Artificial Sequence: Synthetic coding sequence
atgccggacctggagaaccgcgtgctggatcaaatcgaattcttagatacaaagtacagcgttggtatccataatctgctggcctacgttaaacacctgaagggacagaacgaggaggcgttgaaaagcctaaaagaggcagagaatctgatgcaggaggaacacgataatcaggcaaatgtgaggagcctggtgacatggggcaatttcgcttggatgtattaccatatgggacgcctggccgaagctcagacatatctcgataaagtcgagaatatttgcaaaaaactctcgaaccccttcaggtatcgaatggagtgtcccgagatcgactgcgaagaagggtgggcactactgaagtgtggcggcaaaaattacgagcgcgctaaggcttgttttgagaaggttcttgaagtcgatccagagaaccccgagtcctctgctggatatgcaatctcggcctatcgtttagacgggttcaagctcgctacgaagaatcacaagcctttttcgcttctgcccctgaggcaggctgttagactcaacccagacaacggctacatcaaggttctcttagcactcaagctgcaggacgaaggtcaagaggctgagggtgagaagtacatcgaggaggccctggccaatatgtcctctcagacatacgtctttcgttacgccgccaaattctataggcgcaagggctctgtggacaaggcactcgaacttcttaagaaagcactgcaggagacaccaacctccgtgctgctgcatcaccagattggcctttgctataaggcccagatgatccagattaaggaagcgacgaaagggcagcctaggggccaaaaccgcgaaaaactggataagatgatccgctcagccatctttcacttcgaaagtgctgtcgagaaaaagcccactttcgaagtagcacacctggatctggctaggatgtatatcgaggccggcaaccatcgcaaggcagaggagaattttcagaaactcttgtgtatgaagccggtcgttgaggagactatgcaggatatccattttcactatgggagatttcaggagttccaaaaaaagtcggacgtgaacgccattatccactacttgaaagcaattaagatagaacaggctagtctgactagagacaagagcatcaattcactgaaaaagcttgtgttgaggaagctgaggagaaaagccctagatctggagtcactttcattattgggctttgtctacaagcttgagggtaatatgaatgaagcactggaatactacgagcgagcgctgcgcctcgctgccgacttcgaaaacagcgtgaggcaggggccttag

SEQ ID NO: 120905 - DNA, 1419 bp, Artificial Sequence
  Description of Artificial Sequence: Synthetic coding sequence
atgtctgagaacaacaaaaatagcttagaatcgagtctgcggcagctgaaatgccatttcacatggaaccttatggaaggagagaactcactcgacgatttcgaggacaaagtgttctacagaacggaatttcagaaccgggaattcaaagctacaatgtgcaaccttttggcttatctgaaacacttaaagggccagaacgaggctgcgctggagtgcctgagaaaagccgaagagttgatccaacaggaacacgctgatcaggccgagatcaggtctctcgtgacttggggtaactatgcctgggtgtattaccatatggggcgtctttctgatgtgcagatctatgtggacaaagtgaagcatgtctgtgaaaagttctctagcccctacaggatagagagtcccgaactcgattgcgaggaaggctggacccggctgaagtgcggcgggaatcaaaatgaacgggctaaagtatgctttgagaaggccctggagaaaaagcccaaaaaccccgagttcacttcagggctcgctatcgcaagttatcgcttagacaattggccaccgtcccaaaatgcgattgaccccctgagacaagcgattcgccttaaccctgataatcagtatctgaaagtgcttttggccttgaagcttcacaagatgagagaggaaggagaagaggagggggagggagagaagttagtggaggaggctttggagaaagccccgggcgtgactgacgtattgaggtctgccgctaaattctacaggagaaaggacgagcccgataaagctatcgaacttttaaagaaagctctagagtatatccccaacaatgcttatttacattgtcagattggatgctgctaccgcgctaaagttttccaggtgatgaaccttagggagaatggcatgtacgggaaaagaaagctgctggagctgatcggacacgccgtagctcacttaaaaaaggccgacgaagccaatgataatctgttccgggtatgctccattctggcttcactccacgctttagctgatcagtatgaggatgcggagtattacttccagaaagagttcagcaaggaacttacccctgtcgccaagcaacttttacatttgcgctatgggaattttcagctgtatcagatgaagtgcgaggataaagcaatccaccattttatcgaaggggttaaaatcaaccagaaaagccgggagaaggaaaaaatgaaagacaaactccagaaaattgcgaaaatgcgactgtcaaagaacggcgctgactcagaggccctccatgtgcttgcctttcttcaggagctgaacgagaagatgcaacaggccgacgaggactccgagcgcggtctggagagcgggagcctcattccctccgcctcatcctggaatggggagtag

SEQ ID NO: 120906 - DNA, 1356 bp, Artificial Sequence
  Description of Artificial Sequence: Synthetic coding sequence
atgcccaagaacaaaaagcgcaatacccctcatcgcggatcatccgctggcggcggaggaagcggtgctgctgcagccacagcggcaactgcgggaggacagcatcgaaacgtccaacccttttctgacgaggatgcctcgatcgaaacaatgtcacactgcagcgggtacagcgatcctagttcattcgcagaagacggacccgaggtactcgacgaggaaggtacacaggaggatttagagtacaaactgaagggacttatcgatctcactttggacaagagcgccaagactcgtcaggctgctttggaaggtatcaaaaatgccctggcgtccaagatgctctatgaattcattctggagcggcgaatgacactcacagacagtattgaacgatgcctcaaaaaaggtaagtcagacgaacagcgcgctgcagcggcactagcctccgtactgtgcattcagctgggtcccgggatcgaatcagaggaaatcctgaagacactgggtcccatcctaaaaaaaataatttgcgacgggtccgccagtatgcaggctagacagacatgtgccacttgtttcggagtgtgctgtttcattgcaaccgacgacattacggaactgtatagtactctggagtgtctggagaatattttcaccaaatcatatttaaaggagaaggatacaacggtcatttgctccaccccaaatactgtattgcatatctcaagtcttttggcctggactctcctcctgacaatttgtcctattaatgaggtgaagaagaagctggagatgcactttcataaactgccgagcttgctgagttgtgacgatgttaatatgaggatcgcagctggcgagtccctcgctctcctcttcgagttggcacggggcatcgaatcagacttcttctatgaagacatggaatctttgactcagatgttgcgcgctctcgccactgatgggaataagcacagagctaaggtggacaaaaggaagcaaagaagcgtttttagggacgttctccgagccgtggaggagcgcgatttccctaccgaaactattaagttcgggcccgaacgcatgtacatcgactgctgggttaaaaaacatacctatgacacttttaaggaagtgctcggtagcggaatgcagtatcacctccagtccaatgagtttctccgaaacgtctttgagttgggccccccggtgatgctcgatgctgcaacactcaagaccatgaagatttcccggtttgaaaggcacctctataacagtgctgcctttaaggctcgcacgaaagcgcgcagcaaatgccgtgataaaagggctgacgtgggtgaatttttttag

SEQ ID NO: 120907 - DNA, 1356 bp, Artificial Sequence
  Description of Artificial Sequence: Synthetic coding sequence
atgccaaaaaataaaaagaggaataccccacacagagggagttctgccgggggtggcggatcaggcgccgcagccgctaccgccgcaaccgcgggcggccagcatcgcaatgtgcagccgttctccgacgaggacgccagtatcgagactatgtcccactgtagcggttactctgaccctagctctttcgccgaagatggcccagaggtgctcgatgaggagggaacgcaggaagatctggagtataagctgaagggccttattgacctaaccttagataaatctgccaaaacacgccaggccgctcttgaaggcatcaagaatgccctagcctctaagatgttgtacgagtttattctagagagaagaatgacactgaccgatagcattgagagatgtctgaaaaagggtaagtcagatgaacagagagccgccgccgcactggcatccgttctctgcattcagcttgggcccggaatcgaaagcgaagagatactgaagacattggggcccatactaaaaaagattatctgcgatggatcagcgagcatgcaggctaggcaaacctgtgccacatgctttggagtttgttgctttatcgcgaccgacgatataaccgaactgtattcaactctcgaatgcctagaaaacatcttcacaaaaagttatttaaaggaaaaggatactactgttatctgttcaacccccaacacagtgctgcatatcagtagtctcctcgcgtggactctcctactgacgatttgccccattaacgaggtgaaaaagaagctggaaatgcattttcacaaattaccctcattactctcctgtgatgatgtcaacatgcggattgccgccggagagtcacttgcactgttgttcgagcttgcccgcggaattgagagtgatttcttctatgaggacatggagtctctgactcaaatgctaagggccttggccacagacggcaacaaacatagagcgaaagttgataagcggaaacagcgctccgtgtttcgggacgtcctcagagccgttgaggaaagagacttcccaacggagacaatcaagttcggaccggaacggatgtacattgactgttgggtaaagaagcacacctacgatacattcaaagaagttctggggtctggcatgcagtaccatctgcaatccaatgaattcttaagaaatgtgtttgaactgggccctcctgtcatgctcgacgcagcaaccctgaaaactatgaaaatcagccggttcgagcggcacctgtacaacagtgctgccttcaaagcccggacaaaggcgcgctccaagtgtcgcgataagcgggctgatgttggcgagtttttttag

SEQ ID NO: 120908 - DNA, 57 bp, Artificial Sequence
  Description of Artificial Sequence: Synthetic coding sequence
atgcccaagaataagaaaagaaataccccacatcgagggagctctgctgggggttag

SEQ ID NO: 120909 - DNA, 96 bp, Artificial Sequence
  Description of Artificial Sequence: Synthetic coding sequence
atgcccaagaacaagaagaggaacaccccacacagaggcagttcagccggcgggggcggttctggagcagctgcagcgacagccgcaaccgcctag

SEQ ID NO: 120910 - DNA, 189 bp, Artificial Sequence
  Description of Artificial Sequence: Synthetic coding sequence
atgcctaaaaacaagaaaagaaatacgccacaccgagggtctagtgcgggcggcggcggtagcggagcggcagccgccactgcggccaccgccggtgggcagcacagaaacgtgcagccattcagtgacgaagatgcttcgatcgagactatgagtcactgcagtggctattccgaccccagttcctag

SEQ ID NO: 120911 - DNA, 1206 bp, Artificial Sequence
  Description of Artificial Sequence: Synthetic coding sequence
atgagccattgttccggctattcggatccatctagtttcgcagaagatgggccggaggttctggacgaggagggaactcaagaggatttagagtataagctgaagggactaatcgatttaacgctcgacaagagcgccaaaaccaggcaggctgccctggaggggattaaaaacgcccttgcatctaagatgctctacgagtttatcctcgagaggcgcatgactctaaccgatagtatcgaacgatgtttgaagaagggcaagtcagacgagcagcgcgctgcagcggcgctcgcatctgtgctgtgcattcagttaggccccggcatcgagagtgaggagatactgaaaaccttagggcctatcctgaaaaagatcatctgtgatggatccgcatccatgcaggcaagacagacctgcgccacatgtttcggcgtgtgctgcttcatcgcaactgacgacataaccgaactctactccacacttgagtgtctggagaatatattcacaaaaagctatctgaaggagaaggacaccacagtaatctgctccacccctaacaccgtattacacattagcagcctgctcgcgtggaccctgttgttgacaatctgtccaataaatgaggtgaaaaagaaactggagatgcattttcataaacttcctagcctgctgtcttgcgacgacgtgaatatgcggatcgctgcaggcgagtctcttgccctgttgttcgaactagcacgtgggattgagagtgatttcttctacgaggacatggaaagtcttacacagatgctgagggccctcgccacggatggaaataagcatcgcgctaaggtggacaaaagaaagcaacggtccgttttcagagacgtgcttcgtgcggtcgaggagagagactttcccactgaaaccatcaagttcggcccggaaagaatgtatatcgactgctgggtcaaaaagcatacctacgatacatttaaggaggtgctgggctccggcatgcaatatcatctgcagagcaacgagttcctgcgtaatgttttcgagctgggccctcctgtgatgctggatgcagcaacattgaaaaccatgaaaatctctaggtttgagaggcacctgtacaattcagcagcttttaaggcccggacaaaagcacgatcaaagtgtcgtgacaagcgtgcagacgtcggagagtttttttag

SEQ ID NO: 120912 - DNA, 474 bp, Artificial Sequence
  Description of Artificial Sequence: Synthetic coding sequence
atgcacttccataaacttccgagccttttgtcatgtgatgatgtaaacatgcgaattgcagcaggcgagagtctggcccttctcttcgagttggcccgaggaatcgagtcagacttcttctatgaagatatggaaagcctgactcaaatgcttagagcactggcaaccgacggtaacaaacacagagccaaggtcgacaaacgcaagcagagatcagtgttccgagatgtgctcagagccgtggaggagcgagattttcccacagagactatcaaatttggcccagagagaatgtacatcgactgctgggtgaagaagcatacatacgacacatttaaagaggtgctaggaagcggtatgcagtaccacctgcaatctaatgagttcttgaggaacgtgttcgagctcggcccacctgtgatgctggacgcagcaacactgaaaacgatgaagatctcacggttcgagcgctag

SEQ ID NO: 120913 - DNA, 1827 bp, Artificial Sequence
  Description of Artificial Sequence: Synthetic coding sequence
atgggtcccaaaaagtcttggcggtcccacttcttcccgttaccagaagtctggctactactcctgctcagccaggccctgtcacccagtcacggaccccagacccaggctggggtgggcctagtttggagcgtgccacttcctagtgcactgcgcagccaaagttgtctcggcgcccccctgcgcgatgctagtgaactgaccacagtgcacctcttccccaccaggggatggggtgcacgacgggcgctgtgggttcatagttccgccagcgccagttctgccgcctctcgccgaagattgcgcgctcaagcgtcaggcatctcctcgttcagcctggtcgatggaggagccccccgggaagatggaggtgccagaggcgtctggcttccctcgagtggacaggtgagcgcccaaagaacgggccgcaggctcgtggggctcgagccgacaccgacggggtcattgacaccccgtcccccccgccccgtgcctggcatgcctcgcgccagaaaaggcaacaccctcagaaaaggcggtcagcgacgaggaggtggcgctagatctagtgcccaggccgattccgggagcagcgatgacgaagccgccagtgaggcaaggtccacagccagcgaatgcccttcgctcctgtcaacaactgcagaagactctctgggcggcgatgtggtggacgagcagggtcaacaggaggaccttgaggagaaattgaaagaatacgtcgactgcttaacggacaaaagtgcaaaaacccgccagggagccttggaaagcctgaggctcgcattggcttcgagactgcttccggacttcttactagagcgcaggctgaccttagctgatgcattggagaaatgccttaaaaaggggaagggtgaagagcaggcccttgccgctgcagtgctggggttattatgcgtgcaactgggacccggacctaagggcgaggaactctttcactcacttcagcctctgctcgtgagtgtactaagcgactctaccgcctctccagcagcccgacttcattgtgcatccgctctcggacttggctgctacgtggctgcagccgatatccaagacttggtcagctgcctcgcctgcctcgaatcggtctttagccgcttttacgggctgggcggaagttcaacaagccctgttgtccccgccagtctgcacggcctcctgagcgctgctctacaggcttgggccttacttttgaccatttgtccatctactcagattagccacatcctggaccgacagcttccgcgtcttccgcagctccttagcagtgagagcgtgaacctgagaatcgccgcaggcgagactatcgcgctgcttttcgaactggcccgagatctagaagaagaatttgtgtatgaggacatggaagctctttgctctgtgctgcgaacactggctaccgactccaataagtatcgggccaaggcggatagaaggcgtcagcgctccaccttcagagccgttctgcacagcgtcgaaggcggagagtgtgaggaagagatcgttagattcggctttgaggtgctgtatatggattcatgggcgagacataggatctacgccgcattcaaggaggtcctgggaagtggaatgcaccaccacctgcagaataatgagctgctacgcgatatcttcggactcgggcccgttctgctgcttgacgccaccgccctgaaggcttgcaaagtgccgcggtttgaaaagcacttgtacaacgcagccgccttcaaggcacgcacaaaggcccggagcagggtaagggacaaaagagctgatattctgtag

SEQ ID NO: 120914 - DNA, 1329 bp, Artificial Sequence
  Description of Artificial Sequence: Synthetic coding sequence
atgccacgcgcaaggaaagggaacacgcttaggaaaggaggacaaaggagaggcggtggagcccggtcatccgcacaagcagacagcgggagcagtgatgatgaagcggcttcggaggcacgcagcaccgcctctgagtgccctagcctgctgagtacaacggccgaggactcattaggtggcgatgtcgtcgatgaacaaggccaacaggaagatctcgaggagaagttaaaagaatacgtggattgccttactgacaagagcgcaaagacaaggcaaggtgctctcgaaagcttgaggctggctttagcatcgcgtctcctgcccgactttctccttgagagacggctaactctggccgatgctctggagaagtgtctgaaaaaaggtaaaggcgaggagcaggcgctggcagccgcggtactcggcctgctttgcgttcaacttggccctggccccaagggagaagaactgttccacagtctgcaacccctcctggtgtccgtgctttcagactccacagcgagccccgctgccagactgcactgtgcttccgctcttgggttaggatgctacgtcgcggccgcagacatccaagatttggtgtcttgcctggcatgcctggaaagcgtttttagccgcttttacggtctagggggatctagtacctcgccagttgtgcctgccagtttacacggcctgctgagcgcagctcttcaggcttgggctttactcctgactatctgccctagtactcaaattagccacatactcgaccggcagctgcctaggctcccccagctcctgtcatcggagagtgtgaacctccgcatcgctgctggggagacgattgctctgctctttgaactggcccgcgatctcgaagaggagttcgtctacgaggatatggaggctctgtgttcggtccttcgaacgctggctaccgacagtaacaaataccgggctaaagccgatcgcaggcggcagcggtctacgttccgggctgttcttcacagcgtcgaggggggggaatgtgaggaggaaatagtgaggttcggatttgaggtgttatacatggactcctgggcccgacatcgcatctatgccgcttttaaggaagtactgggaagcggaatgcatcaccacctgcagaacaacgaactgttgcgagacatattcggcctggggcccgtcctgctgctagatgccaccgctctgaaggcttgcaaggtacccagattcgagaaacacctgtataatgccgccgcgttcaaggcccggaccaaagcccgctccagggtgagagataaaagggctgatatactatag

SEQ ID NO: 120915 - DNA, 1521 bp, Artificial Sequence
  Description of Artificial Sequence: Synthetic coding sequence
atggcttggaactctccttcccgccgtccggtgtggcaaggcggcgccccacgcgaggatggcggggctcgcggggtttggctgcctagttccgggcaggtgagtgcgcagagaacaggcaggagattagtgggactggagcccacgcctactggcagcctcactcctcgccccccacggcctgtgccgggtatgcccagggcacggaaagggaacactttgcgcaagggaggtcagcggcgaggtggcggtgcccgttcaagcgcccaggcagatagcggcagctctgacgatgaggccgccagcgaagctagatctacggcatccgaatgccctagccttctgagtaccaccgccgaggatagcttgggcggcgatgttgtcgacgagcaaggccaacaggaagacctggaggagaagttgaaagaatacgtcgattgcttgactgacaaaagcgctaagacacggcagggcgctctcgaatccctccgactggctcttgcaagcaggctgctgcctgacttcctccttgagaggcggctgacccttgccgacgcactcgagaagtgcctgaagaagggcaaaggtgaagaacaggccctcgctgccgccgttcttggtcttctctgtgtacagttgggcccggggccgaagggtgaggagttattccatagcctccagccacttctcgtgtctgtcctgtctgactccaccgcatcgcccgctgcgagactgcattgcgcatccgctcttggattaggatgttacgttgctgcagcggacattcaggatcttgtcagctgcctggcttgtcttgaaagtgtcttttctcggttttatggactgggaggctcttcaacgagcccagtggtcccagcctcccttcacggccttctcagcgccgcccttcaggcctgggccttattgttgaccatttgcccttcaacgcagattagccatatcctggacagacaactcccgcggctgcctcaactcctgtcctctgaatctgtgaacctccgtatagctgccggagagaccatcgcattgctgttcgaactggcccgagacctggaagaagagttcgtatacgaagatatggaggccctgtgctcagtactgcgcaccttggccacagacagtaataaatatcgagcaaaggcagatcgccggcgtcagcgaagcacttttagggcggtgctgcactcggtggagggtggtgagtgcgaggaggagattgtgcggtttgggttcgaagtactctacatggatagctgggcccgacaccgcatctatgccgccttcaaggaagtcttgggatcaggcatgcaccaccaccttcagaataacgaactgctgcgggatattttcggcctgggccccgtgctgctccttgatgcgaccgcacttaaggcctgtaaagtgcctagattcgaaaagcacctgtataacgccgccgcttttaaagctcgaaccaaggcccggagccgcgtccgcgataaaagagccgacattctatag

SEQ ID NO: 120916 - DNA, 1329 bp, Artificial Sequence
  Description of Artificial Sequence: Synthetic coding sequence
atgcctcgggccagaaagggcaacaccctcagaaaaggcggccagcgacggggaggcggtgccagaagctcggcacaagcggattctggtagttcggacgacgaagccgcctcggaagcccggagtacagcttctgagtgccccagtctgctgtctactactgccgaggattctttgggaggcgacgtcgtggacgaacaggggcagcaggaggacctcgaagagaaactcaaggaatacgtggactgtctgaccgacaaaagcgccaagacgcgccagggagcgctggaatctctgaggctggccctggcaagccgactactccccgacttcctccttgaaaggcggttgaccctcgccgacgccctcgagaagtgtctgaaaaaagggaagggagaggagcaggcactcgctgctgctgttctgggccttctgtgtgtgcagttagggccaggccccaagggggaggagttgtttcacagccttcagccattgctcgtgtccgttctaagcgactctactgcttcccccgcagcaagactccattgtgcctctgccttggggttaggctgttatgtcgctgccgcagacatccaggaccttgtgagctgtcttgcttgtctcgagagcgtgtttagcaggttttatggactgggtggctcctctacgagccccgtggtaccagcctctctgcacggactgctctccgcagccctgcaggcctgggcattgctcctaactatttgtccgtcgactcagatcagccacatcctcgaccgccaactgcccaggctgccacagcttctgtccagcgaaagcgtcaacctgagaatcgctgcaggagagacaattgctttactcttcgaactggctagagacctggaagaagagttcgtgtatgaggatatggaggccctctgtagcgtgctcagaaccctcgccactgacagcaataagtatcgcgctaaggcggatcggcgtcgacagcgctccaccttccgcgccgtgctccacagtgtggagggaggcgagtgcgaagaggagatagttagatttgggtttgaagtattatatatggatagctgggcccgccatcggatttatgcagcctttaaagaggtcttggggtctgggatgcatcaccacttgcagaacaacgagctgctccgagatatttttggtttgggccccgttttgctcctcgacgccaccgctctgaaagcatgcaaggtgccacgatttgagaaacatctatacaatgcggcagcttttaaagcacggacgaaagcccggagcagggtgcgcgacaagagggctgacattctctag

SEQ ID NO: 120917 - DNA, 1713 bp, Artificial Sequence
  Description of Artificial Sequence: Synthetic coding sequence
atgacgctgctctggtgtgtggtatcactgtacttctatggcatcctgcagtcagatgcctctgaacggtgcgacgactgggggttagacacaatgagacaaatccaggtcttcgaagacgagccggcccggatcaagtgccctctcttcgaacattttttaaagtttaactatagcacagcccatagtgccgggttaaccttgatctggtattggaccaggcaggaccgcgacttggaagagcccatcaatttccggctacctgagaataggatttccaaggaaaaagacgtcttatggtttagacccacgcttctgaacgatacaggtaactatacctgtatgctgaggaacaccacctattgctctaaggtcgcttttcccttggaggtcgtacagaaggacagctgcttcaattctcctatgaaattgccagtgcataaactctatatcgaatatggtattcaaagaatcacatgtcctaacgtcgatggatactttccatcttcggtaaagcctaccattacctggtacatgggttgttacaagattcagaattttaataatgtcattcctgaaggcatgaatttgagtttcctgattgcactgatttcaaacaacggcaattacacatgcgtagttacataccccgaaaacggaagaacctttcaccttacgcggacactgaccgtgaaagtcgtgggcagccctaaaaatgccgtgcccccagtgatccacagtcccaacgatcatgttgtgtacgagaaggagcctggggaagaactgctgattccgtgcacggtatacttcagctttctgatggacagcagaaatgaggtgtggtggaccatcgacggaaaaaagccagatgatattacaattgatgtaaccatcaatgaaagcatctcccactctcggactgaggacgagactagaactcagattctgtcaattaaaaaagtaactagcgaagaccttaagagatcgtacgtgtgtcacgcacggagtgctaagggggaagtggccaaagcagcaaaggtgaaacagaaagtgcccgcccctagatacactgttgagctagcctgcggctttggggctaccgtcttgctggtcgtgatactcatcgtggtttaccatgtgtactggctggaaatggtgctcttctatcgcgcacattttggaaccgacgaaacaattttggatggaaaagaatacgatatatacgtaagctatgccaggaatgccgaagaagaagaatttgtgctcctgacacttcggggggtgctggagaacgagttcggctacaaactgtgcatatttgatcgcgacagcttgcctggaggcatcgttacggatgagaccctgagttttatccagaagtctagacggctcctcgtagtgctcagcccaaactatgtgctgcagggcacacaggcacttctggaactaaaagctggtctggaaaatatggcttcacgtggcaacattaatgtgatattggtgcagtacaaggccgtgaaagaaaccaaagtgaaggagctgaagcgggccaagaccgtccttaccgtgattaagtggaaaggtgagaagtccaaatatccgcagggacgcttttggaagcaactccaggtggctatgccagtcaaaaagtctccaaggcggtccagcagtgatgagcagggccttagctattcaagccttaagaacgtttag

SEQ ID NO: 120918 - DNA, 2064 bp, Artificial Sequence
  Description of Artificial Sequence: Synthetic coding sequence
atgacgctcctatggtgcgtggtctctttgtacttctacggaatccttcaatccgacgctagcgaaaggtgcgacgactggggcctggacacaatgcgccagatccaggttttcgaggatgagcctgctcgaattaagtgtccactatttgagcactttttgaagtttaactacagcacagcccacagcgccggcctgaccttgatttggtactggactaggcaagatcgtgatctcgaggagccgatcaactttcgattgcctgagaacagaataagcaaagagaaagatgtgctctggttcaggcctactctccttaacgacactggaaactatacctgcatgttgcgcaacaccacctattgctctaaggtcgcgtttcccctggaggttgttcaaaaagatagctgtttcaatagcccaatgaaactccccgtgcataaactttacatagagtacgggattcagcggatcacttgtccaaatgtcgatgggtactttccatcctcagtaaagccaaccatcacctggtacatgggatgttacaagattcagaatttcaacaatgtgatacctgagggtatgaacctgagcttcctgattgcattaatcagcaataatgggaactatacatgtgtggttacatatcctgagaatggcagaaccttccacctaaccagaactctgactgttaaggtggtgggtagcccaaaaaacgctgtgccgcctgttatacacagccccaacgaccatgtggtttatgagaaagaacccggagaagagctgctgatcccatgcacagtctacttttcttttctgatggacagcagaaatgaggtatggtggaccattgatgggaagaaaccggacgatattaccattgatgtcaccataaacgagtctatctcccacagtagaactgaagacgagacaaggacgcagattctgtccattaaaaaggtgaccagcgaggacttgaaaaggtcttatgtatgccatgcccgttcagccaagggcgaagtcgccaaagctgccaaggttaagcagaaggttcccgccccgcgatacacagtcgaactagcctgcggcttcggagccaccgtacttctggtggtgattttgatcgtggtgtatcatgtttattggctcgaaatggtgctgttttaccgggctcattttggaacagatgaaacaattctcgatggtaaggaatacgatatttacgtatcttacgctaggaatgcagaagaggaagagtttgtgctcctcaccctgcgaggggtcctggaaaacgaattcggctacaaactgtgcatcttcgaccgggattccttgcccgggggaaatactgttgaggcggtgttcgactttatccagcgctcacggagaatgatagtagtgttgagtcccgactacgttacagaaaaatccatatctatgctggagttcaagctgggagtaatgtgccagaatagcatagccacaaaacttatcgtggtggagtacagaccactcgaacacccccacccggggatcctccaattgaaagaatctgtctcatttgtttcctggaagggcgagaaaagcaaacacagcggcagcaaattctggaaggcccttcgcttagcccttcctctccgctctctctctgccagctccggatggaatgaaagttgctcaagtcagagcgatattagtttggaccacgtccagcgacgaaggtccagactcaaggagcctcctgagctacagtcctctgagagggctgctggttctcctcccgctccgggcaccatgtcaaagcacaggggcaagtcgtcagctacgtgtcgctgttgcgtgacctactgcgaaggtgaaaatcaccttagaaataaaagtagggccgagatccacaaccaaccccaatgggagacgcatctatgcaaacctgtcccacaggagtcagagactcagtggatccaaaatgggactagacttgaaccgcccgctccccagattagcgccttagccttgcaccatttcactgacctgagcaataacaacgacttctacatcctttag

SEQ ID NO: 120919 - DNA, 1713 bp, Artificial Sequence
  Description of Artificial Sequence: Synthetic coding sequence
atgacactgttatggtgcgttgtgtccctgtacttttatggaattctgcagtccgacgccagtgagcgatgtgatgattggggcctggacactatgcgccagattcaggtgtttgaggatgaacccgcaaggattaagtgtcctctgtttgagcattttctgaagtttaattacagcaccgcccactccgccggtctgactctgatttggtactggactagacaggatagggacctagaggaaccaattaacttccggcttccagagaaccgtatctctaaggagaaggatgtcttgtggtttcgtcccacgctgctgaacgacaccggtaactacacgtgtatgctgagaaacaccacctactgcagcaaagtcgccttcccactggaagtggtacagaaggactcatgctttaacagtcctatgaagttgccagtgcacaagctgtacatcgaatacgggattcagaggattacttgtcccaacgtggatggctatttcccctcatccgtgaaaccaacgattacatggtatatgggctgctacaagatccaaaattttaacaatgtaattcccgagggtatgaacctgtctttccttatcgcactgatctccaataacgggaattatacatgcgtcgtgacataccctgagaatggcaggacttttcatttaacaagaactctgaccgtcaaggtggtagggtctccaaagaatgccgtgccccccgtgatccactcacctaatgaccacgtagtgtacgagaaggagcctggcgaagaactgttgattccatgcactgtgtatttctcttttttaatggattccaggaatgaggtatggtggaccatcgacgggaaaaagccagacgacataacgatcgatgtcacaatcaatgagagcatctctcacagcagaaccgaggatgagacaaggactcagatcctgagcatcaaaaaggtgacgtccgaagatctgaaaagatcatacgtgtgccatgccagatccgcgaagggagaggtcgccaaagccgccaaagtgaagcaaaaagtgcccgccccccggtacactgtagagctggcttgcggcttcggagctactgtgctgttagtcgtcattttgatcgtggtatatcacgtatactggctcgaaatggtcttgttttacagagcacattttgggacagacgaaacgatcctcgacggaaaggagtacgacatctatgttagttacgctaggaacgctgaagaggaggagtttgtcttgctgaccctaaggggtgtactggagaacgaattcggctacaagttatgtatattcgatcgcgactcactccccggcggtatcgttaccgacgagaccttatctttcatccagaagagtagaagactcttggtcgtactctccccaaattacgtgctgcagggaacacaggcccttttagaattaaaggccggccttgagaacatggccagcaggggaaacataaacgtgatactggtgcaatacaaggcagtgaaggagactaaggtcaaagaactgaagcgcgcgaagacagtgcttactgttatcaaatggaaaggcgaaaagtccaaatatcctcaagggagattttggaaacagctccaagtggcaatgcctgttaagaaatcaccacgtagaagcagttctgacgagcaagggttgagttattcatccctgaaaaacgtgtag

SEQ ID NO: 120920 - DNA, 1071 bp, Artificial Sequence
  Description of Artificial Sequence: Synthetic coding sequence
atgactctgctgtggtgcgtggttagcctgtacttttacggcattcttcagtcagatgcctctgagagatgtgacgactggggccttgacaccatgcggcagattcaagtgtttgaagatgaacctgcaaggattaaatgcccactatttgagcatttcctgaagttcaactactctacagcccatagcgctggcctaacactaatctggtactggacccgccaagacagagacctggaggaaccaattaacttccggctgcctgagaaccggattagtaaggaaaaagatgtgctttggttccgccctacactcctcaacgatactgggaattacacttgcatgctcagaaatactacctattgctctaaagtcgcttttccactagaggtggtgcaaaaagatagctgctttaattcacctatgaagctacccgtccataagctgtatattgaatacggaatccagaggatcacttgcccaaacgtggatggatatttcccatcttcggttaagccaaccatcacctggtatatgggctgctataaaattcaaaacttcaataacgtcatacccgagggaatgaatctgagctttctcatcgccctcatctcaaacaatggcaactacacttgcgtcgtgacctaccctgagaacggccggacgttccacctcacacgcacgctgacagtgaaggtagttggttctcctaagaacgcggtgcccccagtgatccattctccgaatgaccatgtggtgtacgagaaggaaccgggagaagaactgctaatcccctgtactgtctactttagcttccttatggactcacgcaacgaagtgtggtggactattgatggtaagaagcctgatgacataaccatcgatgtcaccattaatgaatccatatctcacagcagaaccgaggacgagacgcgcactcaaatcctttctatcaagaaagtgacttcagaggacctgaaacggtcttatgtgtgtcatgccagatccgcaaagggtgaggtggcaaaggcagccaaggtgaagcagaaggggaataggtgtggtcagtag

SEQ ID NO: 120921 - DNA, 342 bp, Artificial Sequence
  Description of Artificial Sequence: Synthetic coding sequence
atgaccctgctgtggtgcgtggtttctctgtatttttatgggattcttcagtcggacgctagtgagagatgcgacgattggggtttggacactatgcggcagattcaggtgtttgaagatgagccagcaaggatcaagtgccccctttttgaacacttcctcaagtttaactactctacagctcactccgcagggctgactttaatctggtattggacaaggcaagaccgtgacctggaagagcccatcaatttccgtctgccggaaaatcgcatctcaaaagaaaaagatgtcttatggttccggccaaccttgttgaacgacactgggaactatacttag

SEQ ID NO: 120922 - DNA, 1071 bp, Artificial Sequence
  Description of Artificial Sequence: Synthetic coding sequence
atgacgctgctttggtgtgtggtgagtctctacttctatgggatactacaatcagatgcctccgaaaggtgcgatgattggggcctcgacacaatgcggcagatccaggttttcgaggacgaacccgccaggataaaatgccctctttttgaacacttcttaaagtttaactatagcacggcccacagtgccggtctgaccctgatatggtactggacccggcaagatcgcgatcttgaagagcccatcaacttcaggctccccgaaaatcgcatcagcaaggaaaaggacgtgctttggtttaggcccacgctgctgaatgatacagggaattacacttgcatgcttcggaatacaacctattgcagtaaggtagcctttcctttagaggtcgttcagaaagatagctgcttcaatagccctatgaaactccctgtgcacaagctttatattgagtatggtatacagcggatcacctgtcctaatgtagatggttacttcccttcctctgtcaagcccactatcacctggtatatgggctgttacaagatccagaattttaacaatgttatcccggaaggcatgaatctatcatttctgattgctctcatctccaacaatggcaactatacttgcgtcgttacctacccggagaacggcaggacatttcaccttacacgtaccctgaccgtgaaggttgtcggcagcccaaaaaatgccgtcccacctgtcattcattcacccaatgaccatgtcgtatatgaaaaggagcccggtgaagagttacttattccttgcactgtgtacttctcgttcctcatggattcacgcaatgaggtttggtggactattgatggtaaaaaaccagatgatattactattgacgtcacgatcaatgagagcatttctcactctcgaactgaagatgaaacacgaactcagattctttctattaagaaggtgacctcagaagacctcaagcggagctacgtttgtcacgcgcgcagcgcaaaaggcgaggtagccaaggccgccaaggtaaagcagaaggggaaccgctgtgggcagtag

SEQ ID NO: 120923 - DNA, 1713 bp, Artificial Sequence
  Description of Artificial Sequence: Synthetic coding sequence
atgaccttgctttggtgcgtcgtatccctgtacttttatgggattcttcagagtgacgctagcgaacgttgcgacgactggggtcttgacacaatgagacagattcaggtctttgaagatgagcctgcacgaataaaatgcccactgtttgagcactttctgaaattcaattattctacagcccacagtgccgggctcaccctgatttggtactggacccgccaggatagagacctagaagaacccatcaacttcagattgcccgagaaccgtatcagcaaggaaaaggacgttttatggttccgtcctacacttctgaacgatactgggaactacacctgtatgttacggaataccacttattgctctaaagtggcgttccctcttgaggtggtgcaaaaagactcatgctttaacagtccaatgaaactgccagtccataaactgtatatagagtatggaatccagagaataacgtgtcccaacgttgacggctactttccaagctcggtaaagccaaccattacatggtatatggggtgctacaagattcagaactttaacaacgtgattccagagggcatgaatctgagcttcctgatcgcactgatcagtaacaacggaaattatacctgtgtggtgacctatcctgagaacggaagaacgttccatctgactagaactttgacagtgaaagtcgttggtagccctaagaatgctgttcctcccgtcatccatagtcctaacgaccatgtggtctacgagaaggagcctggcgaagaactcctcattccgtgtaccgtttattttagtttcctgatggatagtcggaatgaggtgtggtggacaattgatggcaaaaaacctgacgacattacaattgatgtgacaatcaacgagtccatcagccatagccgaactgaggacgagacaaggacgcagatactgtctattaagaaagtgacttcagaggatctgaaaaggtcttatgtgtgccacgcccggtcagcaaaaggtgaggtggcaaaggctgccaaggttaagcagaaagtccctgcgcctaggtatactgtcgagctagcctgtgggtttggcgcgacagtgttgcttgtggtcattctaattgtagtgtatcatgtgtactggctggagatggtgctcttttatcgggcccattttggtactgatgaaacaattctggacggaaaggaatatgatatctacgttagttatgcccggaacgccgaggaggaggaatttgtactccttacccttcggggagtcctggaaaacgagttcggctacaagctgtgtattttcgatcgtgactctctaccaggtggaatcgtaactgatgagacgctatctttcattcaaaagtccaggagactgctggttgtactgagtccaaattacgtcctccaggggactcaagccctgctggagcttaaggcaggtctggaaaatatggcctctagaggtaatatcaacgtgattctggtccaatataaagccgttaaggaaacgaaagtcaaggaactgaagagagccaagactgtgctgacagttatcaaatggaagggagaaaagtcgaagtatccccagggccgcttctggaagcagttacaggtggcaatgcctgtgaaaaagtcgcctcggcggtcttctagcgatgagcagggcctgtcctactcttcactgaaaaacgtatag

SEQ ID NO: 120924 - DNA, 2064 bp, Artificial Sequence
  Description of Artificial Sequence: Synthetic coding sequence
atgacccttctctggtgcgtggtatccctgtacttctatggaattctccagtccgacgcctctgaaaggtgcgatgattggggcctggacactatgcgccagatccaagtttttgaggatgagccagcccgcatcaagtgccctctatttgagcatttcctgaaattcaactattctactgctcacagtgcaggattgacacttatctggtactggactcgccaggacagggacctcgaagaaccgatcaactttcgcctccccgaaaaccgcatcagcaaagaaaaggatgtactgtggtttcgtccaacactgttgaacgacacaggcaactacacctgtatgttaagaaacactacttactgttccaaggtcgcctttccgctcgaagtcgtccaaaaagattcttgcttcaacagtcctatgaagctgcccgtgcataagctgtacatcgagtacgggatccagagaatcacctgtccaaacgtggatgggtactttccaagtagtgtcaagcctacgatcacctggtacatgggctgttataagatccaaaacttcaataacgtgattccggaaggcatgaaccttagctttctgatcgctctgatttcgaataatggcaattacacttgtgtagtcacttaccctgaaaacgggcgtaccttccaccttacccggactttgacagtcaaggttgtcggaagcccgaagaacgcagtgccacccgtgattcacagccccaacgaccatgtcgtatacgagaaagagcctggtgaggagttgctgatcccctgtacagtttatttttccttcctaatggactcccgcaatgaggtctggtggactatcgacggaaagaagcctgatgatataaccattgatgtgacaatcaacgagtctatctcacacagccgaacggaggatgagacaaggactcaaatactgtccatcaagaaagtcaccagtgaagatcttaaacgaagctatgtctgccatgcgcggtccgcaaaaggcgaggtggccaaggcggcaaaagtaaagcagaaagttcctgcccctcgctatacggtcgagctggcttgcggcttcggggcaacggttttactggtggtgatattgatagttgtataccatgtatactggctggagatggttttgttctacagagcgcattttggaaccgacgaaaccatactcgacggaaaggagtacgacatctatgtctcctacgcaagaaatgccgaagaggaggagttcgtcctgcttactcttaggggggtcctggaaaatgaattcgggtacaaattgtgcatcttcgatcgagattctttacccggaggaaatacagttgaagcggtgttcgatttcattcagcggtctcgccggatgattgttgtcttatccccggattacgttacagaaaagagtatctctatgttggagttcaagctaggtgtgatgtgtcagaactctattgccaccaaactcattgtggtcgagtacaggcctctggaacatcctcaccccggaatcttgcagctgaaagagagcgtgtccttcgtctcatggaagggcgagaaatctaagcattcaggctccaaattttggaaagcactcagactcgccctcccccttaggtctctgtccgcttcgagcgggtggaacgagtcttgctcaagtcaatctgacattagccttgaccacgtgcagcgccggcgctctagactcaaggaaccacccgagttgcagtcgtcggagcgcgcagctggctcaccccccgccccaggaaccatgtccaagcataggggaaaaagcagtgctacatgcaggtgctgcgttacatactgcgaaggggagaaccacttgaggaataaatcacgtgcagagatacataaccagccgcagtgggaaacccacttatgtaagccggtgccccaggaatccgagactcagtggatccaaaacggcaccagactggagccaccagctccacaaatctccgctcttgcactacatcatttcacagatttaagcaataacaacgacttctacattttgtag

SEQ ID NO: 120925 - DNA, 1713 bp, Artificial Sequence
  Description of Artificial Sequence: Synthetic coding sequence
atgaccctcctgtggtgcgtggtgagcctttacttctatggaattcttcagagtgatgcatccgagcggtgcgacgattggggactggacaccatgcgacagattcaagtcttcgaagatgagccggcacgtattaaatgccctctgtttgagcacttcctgaaattcaattactcaaccgctcattccgccggcttgacgctcatttggtactggacccgccaggaccgagatcttgaggaaccaattaactttaggctgccagagaacaggataagcaaggagaaggacgttctttggtttaggccaaccttactcaacgacacgggaaattatacttgcatgctccggaacactacgtattgcagcaaagtcgctttcccgcttgaggtcgtgcagaaagattcgtgttttaattcccccatgaaactgccagtgcataagctatacatcgaatacggaattcaacggatcacttgtcccaacgtcgacggttactttccgtcctctgtcaagcccaccataacatggtacatggggtgttataagattcagaactttaacaacgtgattcctgaaggcatgaacctttctttcctgatcgctcttatatcaaataatgggaactacacctgcgtagtcacttatcccgagaatggacgcacgtttcacctcacaaggaccctgaccgttaaagtagtcggcagtcctaaaaatgccgtgccacccgttatccactctccaaacgatcacgttgtgtacgagaaggagcctggagaagagcttctcatcccatgcaccgtgtatttttcattcctaatggattcgcgcaacgaggtatggtggactatagacggaaagaagccagacgatataaccattgacgtgacaatcaacgaatccataagccacagccgtactgaggacgaaacacgaacccagattctctcgatcaaaaaggtcacctccgaggacctcaagcggagctacgtttgccacgccaggagcgctaaaggggaggtggccaaagcagctaaggtgaaacagaaggtgcctgcgccacggtacaccgtggagcttgcgtgcggctttggagcaacagtcctcctcgtggtcattctgattgtagtttatcacgtgtattggctagagatggtgttgttctatcgggcccacttcggcactgatgagacaatcctggacggcaaagagtatgatatatacgtcagttacgcccgaaatgcggaagaagaggagtttgtgctcctgacattaagaggtgtcctggaaaacgaattcggatacaagctctgtattttcgatcgcgactcactccctggcgggattgtgactgatgagacactttccttcattcagaaaagcaggcgattactcgtggtcctgtcgcccaactatgtgctgcaaggcacacaggcactgctggagcttaaagccggtcttgagaacatggcaagtagaggcaatatcaatgttatactggtgcagtataaggccgtgaaggagaccaaagtcaaggaattgaagagagcaaagaccgtgttgactgtaataaaatggaaaggcgagaagtccaagtaccctcaaggcagattctggaagcagctccaagtcgcgatgcccgttaagaagtctccgcgcaggtcaagcagtgacgaacagggcctcagttattcatctctgaaaaatgtgtag

SEQ ID NO: 120926 - DNA, 438 bp, Artificial Sequence
  Description of Artificial Sequence: Synthetic coding sequence
atgacattactctggtgtgtggtgagcctctatttctatggaattctgcagagcgacgcaagcgagcggtgcgacgactggggactggatacaatgagacagatccaagtttttgaggatgagcctgcacgtatcaagtgcccactgtttgagcatttcctgaagttcaattacagcaccgcccactctgccggactgacactcatttggtactggaccaggcaggaccgggatctggaggagccaatcaatttccgcctccctgaaaacaggatttccaaagagaaggatgtactctggtttagaccaacgctactcaatgacactggcaattatacttgcatgctgaggaatacaacctactgtagcaaggtggctttccccctcgaagtggtccaaaaggattcctgcttcaattcacccatgaaactgccatag

SEQ ID NO: 120927 - DNA, 2091 bp, Artificial Sequence
  Description of Artificial Sequence: Synthetic coding sequence
atgaaggctcccattccacaccttattctgctgtacgcgacctttacacagtctttgaaggtagtcacgaagaggggcagcgcagacggctgtaccgactggagcattgatataaaaaagtaccaggtcctggtgggcgagccggtccggataaagtgcgccctgttttacggatacatccgaacgaactatagcctggctcagagcgccggtctgagtctcatgtggtacaagtcctcaggacccggagactttgaggaaccgatcgctttcgacggatcacgaatgtcaaaagaggaagattctatttggttcagacccacacttctccaggactccgggctgtatgcctgtgtcattcgtaattctacttattgcatgaaggtatccatctctttgactgtgggcgagaacgacacaggactttgttacaacagtaagatgaagtactttgagaaggctgaactgagcaaatccaaagagatctcgtgccgggacatcgaggactttttgctgccaacgagagaaccagaaatcctctggtacaaagaatgccgcaccaaaacttggcgtccctccatcgtattcaagcgcgatacactgttgatccgtgaggtgcgcgaggacgacataggcaactacacatgcgagcttaaatatggcggcttcgtggtacgtcggacaactgaactaacagtgaccgccccattgacagacaaaccgcccaagttgctgtaccctatggagtccaaactcacaattcaggagacccagcttggggattcagcaaatctgacttgtcgggcattctttgggtattccggagacgtcagtcctttgatctactggatgaagggagagaagttcatcgaggatctcgatgagaaccgcgtatgggaatcggatataaggatcctgaaggagcacttgggcgagcaggaggtgtccatttctctaattgtggactctgtggaggaaggtgacttagggaactattcatgttatgtcgaaaatggcaatgggcgccgccatgcctctgtcctgctccataagcgcgaattaatgtacaccgtggagttggccggcggtctgggggcaatccttctgctactagtgtgtctggtcactatttacaagtgctacaagatcgagattatgcttttttacaggaaccactttggggccgaggaacttgacggggataataaggattacgacgcctacctctcgtacaccaaggttgacccggatcagtggaatcaggagactggcgaggaagaaaggttcgcactcgagattcttcccgatatgcttgagaagcactatggatataaactgttcattcctgatagagatctcattccaactggcacatacattgaggacgtggctaggtgtgtggaccagtctaagcgactaatcattgtgatgaccccaaactacgttgtgcgcagaggttggtcaatttttgaactcgaaacacgtcttagaaacatgttggtgactggagagatcaaggtgatcctcattgaatgtagcgaattacgcgggattatgaattatcaagaagtcgaagctctaaagcacacaatcaaactcttaaccgtcatcaagtggcacggccccaagtgcaacaagttaaattctaaattctggaaaaggttacagtacgaaatgcccttcaaaaggattgagccaattacccacgaacaagctctagatgtgagcgagcaaggccccttcggagaactgcagaccgtttcagctatctcaatggccgccgcaacgtctaccgcgctggcaaccgcccatcccgacctgaggtcaactttccataatacttatcattcacagatgaggcagaagcattattaccgctcatacgagtacgatgtgccacctacgggcaccctgcccctaacatctattggcaatcagcacacgtactgcaacatacctatgacactgatcaacggccagaggcctcagacaaaatcaagcagagagcaaaaccctgatgaagctcacactaattctgctatcctgccattgctgcctagagagacatccatctcctcggtgatttggtag

SEQ ID NO: 120928 - DNA, 2091 bp, Artificial Sequence
  Description of Artificial Sequence: Synthetic coding sequence
atgaaggctcccattccacacttgatcctgttgtacgccacattcactcagagtcttaaggtagtgaccaaacgaggcagtgcggatggatgcactgattggtccatagacatcaaaaagtaccaggtcttagtgggcgaacccgttcggattaaatgcgctttattctatggctacatccggacaaactactccctggcccagagtgctgggctgtctctgatgtggtacaaaagtagtggaccaggcgattttgaggaaccaatcgctttcgacgggtctagaatgtctaaggaggaagactctatttggtttcggccaaccctcctgcaagattcgggactttatgcctgcgtcatcaggaatagtacctactgcatgaaagtgtctatttcccttaccgtgggagagaacgatacgggcctgtgttacaactccaagatgaagtacttcgagaaagcagagttgtctaagagcaaagaaattagctgccgggacattgaggattttctgctgcccacacgggagcctgagattttgtggtacaaagaatgtaggaccaagacatggaggccatccattgtgtttaaacgcgacaccctcttgattagagaagtccgggaggacgatattggaaattatacctgcgagctcaagtacggcgggttcgtggtccgtaggactacagagctcaccgtgactgcacctctgaccgataagccacccaagctgctctacccaatggagagcaagctgactattcaggagacgcagctgggagactccgcgaatcttacttgccgcgccttttttgggtacagcggggatgtgtcgcctctaatctactggatgaaaggagagaaatttatcgaagacctggacgagaaccgcgtgtgggagagcgacattcgaattctgaaggaacacctaggagagcaagaggtgtccatcagtctgatagtagactctgttgaagagggggacctgggaaactacagctgctacgtggaaaacggcaatgggaggcgacatgctagcgttcttctccacaagcgagagctgatgtacaccgtggagttggccggtggcctgggcgccattctactgctattagtgtgtctggttaccatctacaagtgctacaaaatcgagatcatgctcttctaccggaatcactttggagctgaggagctcgacggcgacaataaagattatgatgcttatctcagctacaccaaagttgacccagaccaatggaaccaggagactggcgaagaagagaggttcgcacttgaaatccttccggacatgcttgagaagcattacggatataagctgttcattccagatcgggatcttatacccaccggcacttatattgaggacgtcgcgcgatgtgtcgatcagtctaagcggctgatcattgtgatgacacccaattatgtcgtgcgcagggggtggtctatctttgagctggagaccagattgcgcaatatgctggttacaggagagattaaggtgatcctgatagaatgctctgagcttcgcggcatcatgaactatcaggaagtggaagcccttaagcataccatcaaactgctgaccgttatcaagtggcacggcccgaaatgtaacaaattaaactcaaagttctggaagcggctccagtatgaaatgccctttaaacgtattgaacccatcacacatgagcaagctctggatgtgtcagagcagggaccctttggcgagttgcagaccgtgagcgcaatctctatggccgccgcgacaagtactgctctggccacagctcatcctgatcttcgttcaacttttcataacacctatcacagccagatgcggcagaaacactactacagatcatatgaatacgacgtgccaccgacaggcactctccccctgacctccatcggtaaccagcatacatattgtaacatccccatgactcttatcaacggacaacgcccacaaacaaaatcctcaagggaacagaacccagacgaggcgcacacaaactctgcaatcctgcccctcctgccaagagagacctcgatttcatctgtgatctggtag

SEQ ID NO: 120929 - DNA, 2061 bp, Artificial Sequence
  Description of Artificial Sequence: Synthetic coding sequence
atgaaacctcccttcctcttggcactggtcgtctgctcagttgtgtcaactaatctgaaaatggtcagcaagagaaactcagttgacggttgtattgattggtcagtggatctcaagacctacatggctctggctggagagcccgttagggtcaagtgcgccttgttttattcatatatcaggacaaactatagcaccgcccaatcaactggcttgcgcttgatgtggtataagaacaaaggtgatctggaggaacccatcatcttcagtgaagtgcgcatgtctaaggaggaagatagtatttggtttcactccgccgaagcccaagatagcgggttctacacttgcgtgctgaggaacagtacctactgcatgaaggtgtccatgagccttacagtcgctgaaaacgaatcaggcctgtgttataacagtcggatccggtacctggaaaaatccgaagtgaccaagcgcaaagaaatatcatgtccagacatggacgactttaaaaagagcgaccaggagcccgacgttgtttggtacaaggaatgtaagcctaaaatgtggaggtccattataatccagaagggcaatgctctgctcattcaggaggtgcaggaagaggatggcggaaactatacctgtgagttgaaatatgagggcaaactcgtaaggcgaaccactgagctcaaggtcaccgccttgctgactgataaaccccccaaaccgctctttccgatggagaaccagccttcagtgatagatgtgcagctgggaaagcctctgaatattccctgcaaagccttcttcggctttagcggcgagtctggacctatgatttattggatgaaaggggagaaatttatagaggaactcgctggtcacattcgcgagggggagattagactgcttaaggaacacctgggggagaaggaagtggaattagccctgattttcgattctgtggttgaagccgatcttgccaactatacctgtcatgtggaaaatcgaaacggtcgtaagcacgcgtccgtgctgctcagaaagaaggatcttatatataaaatcgaactagccggggggctcggggccatctttttgcttctcgtactgcttgttgtgatttacaaatgttataacattgagctcatgctcttctatcgacaacatttcggtgccgatgagacaaacgacgacaacaaagagtacgacgcttacttgtcttacacaaaagttgatcaagacacactggattgcgacaatcccgaggaagagcagttcgccctggaagtgttacccgacgtacttgaaaagcactacggctataaactgttcataccagagagggacctgatacccagcggaacttatatggaggacctaactagatacgttgaacaaagccggcggctcataattgtcttgactccagattacattcttagacggggatggagtatttttgagctggagagtaggctgcacaacatgcttgtgtcaggagaaataaaagtgattctcatcgagtgtaccgagttaaaaggtaaagtgaactgccaggaagtggagtcactcaagcggagcatcaaactgctcagcctgattaaatggaaagggtcaaaaagttcaaagctgaactccaagttctggaaacaccttgtttacgagatgcccataaaaaagaaggagatgctcccacgctgtcacgtgctggacagcgctgaacagggactctttggtgaactgcaacccatcccatcaatcgcgatgaccagtacctctgccaccctcgtgtcctcacaggctgacttgcctgagttccacccttcagatagtatgcagatccgacactgctgcaggggatataagcacgaaataccagcgacgaccctgcctgtgccatctttagggaatcatcacacgtattgtaaccttcccctcaccctgttgaacggccagctgccgctgaataacaccctgaaagatacacaggagttccaccgtaactccagcctgctgccactgtccagcaaagagttgtctttcacatctgacatatggtag

SEQ ID NO: 120930 - DNA, 2061 bp, Artificial Sequence
  Description of Artificial Sequence: Synthetic coding sequence
atgaagccaccttttctgttagcgttggtcgtgtgtagcgttgtcagcaccaacctgaagatggtatctaagcgaaattctgtggacgggtgtattgactggtctgttgacttaaagacatacatggccctggccggggagcctgtgcgtgtgaagtgtgcgctgttttattcatatattaggaccaactatagtaccgctcagtcaactggcttacggcttatgtggtataaaaataagggcgacctcgaggagccaataatattctccgaggtccgcatgtcaaaagaagaggactcaatctggtttcactctgcagaagcccaggacagtgggttttatacatgcgtgttaagaaactccacctactgtatgaaggtctccatgagtctcacagtggctgagaacgagtcagggttgtgctacaatagcaggatcaggtacctagagaagtctgaggtcacgaagcgcaaggaaatttcctgcccagatatggatgatttcaaaaagtccgatcaagagcctgacgtggtttggtacaaagagtgtaagcctaagatgtggaggtccattatcatccaaaaagggaacgccctcttgatccaggaggtacaagaggaggacggtggaaattacacttgcgaactgaaatatgagggcaaactggtacgtcgaaccaccgagctcaaagtgacagccctgctgactgacaaacccccaaagccgctattcccgatggaaaaccagccttcagtcattgacgtgcagttgggtaaaccattaaacattccctgcaaggcattctttggattttcaggggagtcagggcccatgatttattggatgaagggcgaaaaattcattgaagagctggccggccacattagagagggagagatacgtcttttaaaagaacatctgggggaaaaggaggttgaactggcattaatcttcgattctgtggtcgaagcagacctcgccaattacacgtgccatgtggagaacaggaatggccgcaagcacgcatcagtcttgctgagaaagaaggacctgatttacaagattgaactggctggcgggctgggagcaattttcctgcttctggttttgctagtagttatatataagtgctacaacatcgagttaatgctgttttaccgccagcatttcggcgccgatgagactaacgatgacaacaaggagtacgatgcttatcttagctatacgaaagtggaccaggatacactggattgtgacaacccggaggaagaacaattcgccttagaagtcctgcctgatgtcttagagaaacactacggatataaactgttcatcccagagagagaccttataccaagcgggacctatatggaggacctcaccaggtacgtggagcagagccggaggcttattatagtgctgacaccggactatatcttgcggcggggctggtctatttttgagctcgagagtcgactgcacaatatgctcgtcagcggggagattaaagtaatcctgatcgagtgcactgaactgaagggtaaagtgaactgccaagaggtggaatctctgaaacgctcaatcaaactgttatcactcatcaagtggaaggggtccaaaagctctaaacttaattccaaattctggaaacatctagtgtacgagatgcctatcaagaagaaggaaatgctccctcgctgccatgttctggatagcgccgaacaaggtctatttggggaactgcagcctattccttctattgcgatgacatcgacctctgccaccctggtatctagtcaggctgacctgcctgagtttcacccatccgattcaatgcagatcaggcattgctgcagaggctataaacacgagattcctgcgacaacactgcccgttccaagtctcggaaatcaccacacatactgcaatcttcccctgaccctcctgaatggccagttgcctcttaataatacactgaaagatacgcaggaatttcaccgcaattcctccctcctgccactgtcatccaaggagctatcattcacatcagatatatggtag

SEQ ID NO: 120931 - DNA, 876 bp, Artificial Sequence
  Description of Artificial Sequence: Synthetic coding sequence
atgagggataacaaggaatacgacgcgtatctttcttatacaaaagtcgaccaggacaccctggactgcgataaccccgaagaagaacagtttgccctggaagtcctgcccgacgttctcgaaaaacactatggatataagttattcatcccagaacgggatctgatcccatctggcacttacatggaagacctcacccgttacgttgaacagtctaggcggcttatcatagtgttgacacccgattatatcctccgcagaggatggtccattttcgagctggagtcaaggctgcataacatgctggtttcaggcgaaataaaagttatcctgatcgaatgcactgagttgaaaggcaaggtaaattgtcaggaagttgagtctctcaaaagatccatcaaactcctaagtttgattaagtggaagggctcgaagtccagtaagctgaacagcaagttctggaaacatctggtctacgagatgcccatcaaaaaaaaggagatgttgcctaggtgccacgtgcttgatagtgccgagcaggggctgttcggcgaactccagcctatccctagtatcgctatgaccagcacatctgccacacttgttagcagtcaagcggatttacccgagttccacccaagtgacagcatgcagatccgccactgctgcagggggtataaacatgaaattcctgctactaccttgcctgttccgtcactgggcaatcatcacacctactgtaatcttcctctaacacttctgaacggacaattgcctctgaataatactcttaaggatactcaggagtttcacaggaactcctctttgctacccctgagttccaaggaattgtcctttacgtccgacatttggtag

SEQ ID NO: 120932 - DNA, 1197 bp, Artificial Sequence
  Description of Artificial Sequence: Synthetic coding sequence
atgcttcgcctctatgtactcgtgatgggtgtgtctgcatttacgctccagcctgccgcgcacacaggggctgcgcgctcatgcagattccggggcaggcactacaaaagggaattccgattggaaggagagcctgtcgcgctgaggtgcccccaggtcccctactggttgtgggccagcgtttcccctcggatcaatctcacatggcataaaaacgatagtgccagaaccgtgcccggtgaggaagaaacccggatgtgggctcaggacggtgccctatggctgttgccagctctgcaggaggatagcggaacatacgtgtgtaccactagaaatgcatcttactgcgacaagatgtcaattgagttacgcgtgtttgagaatacagatgcctttttgccttttataagctatcctcagattctgacactttccacttcaggggttctcgtgtgccctgacctgtctgagttcacacgggacaagactgacgtaaaaattcagtggtacaaggactcattgttgctcgacaaagacaacgagaaattcctctccgtcaggggcaccacccacctgcttgtccacgatgtggctttggaggatgccggctactacaggtgtgttctgacctttgctcatgagggacaacagtacaacatcaccaggtctatcgagctgagaataaagaaaaaaaaggaggaaacaatacccgtcattatctcaccactcaagaccatatccgcatcattggggtctagactcactattccttgcaaagtcttcctcggcaccggtactccccttactacaatgctgtggtggactgccaatgacactcacatagagtccgcataccccggcggccgggtgaccgagggccctaggcaggagtattcagaaaataacgagaactacatagaggtcccacttatttttgaccctgttaccagagaggaccttcatatggattttaagtgcgtagtgcataacaccttatctttccaaactctgagaactacggtcaaggaagcctcatccacctttagctggggtatcgtgctggctcccctctccctcgccttccttgtgttaggtggcatctggatgcatcgtaggtgcaagcatcggacaggaaaggcagatggattgaccgtcctctggcctcaccatcaggacttccagagttaccccaagtag

SEQ ID NO: 120933 - DNA, 1197 bp, Artificial Sequence
  Description of Artificial Sequence: Synthetic coding sequence
atgctgaggctgtatgtcctggtgatgggagttagcgcttttaccctccagcctgctgcacatactggcgctgccagatcgtgcagatttcggggacgacactataaaagagaattcagactggagggcgaacccgttgccctgcggtgtccacaggtgccctactggttatgggcaagcgtctcccccaggattaaccttacgtggcacaagaacgattccgcgcgcactgtgcccggagaggaagagacccgtatgtgggcccaggatggggctctgtggctgctgcccgctctgcaggaagattccggcacttacgtgtgcacaacccggaacgcctcctattgcgacaagatgagtatcgagctgagggtgtttgagaataccgacgccttccttcccttcataagctacccccagatccttaccctgagtacctcaggagtattagtctgtcctgacctctccgagtttacacgtgacaagactgacgtgaaaattcagtggtacaaggactctctcttgttagacaaagataacgaaaaattcctgtcggtcagagggaccacacacctcctagtccatgacgtagcgttagaggatgcagggtactacagatgtgtccttacctttgcccacgaggggcagcaatacaacatcacccggtctatagaactgcgcataaagaaaaaaaaagaagagacaatccccgtcattatatctccattaaaaaccatctcagcctccttgggctctcgacttaccataccttgtaaggtgttcctgggaaccgggacaccactcaccaccatgttatggtggactgccaacgacacccacattgagtccgcctatcccggggggcgtgtcacagaggggccacgacaggaatattcagagaacaatgagaattatatcgaagtgcctttgatattcgatcctgtgaccagagaggacttacatatggacttcaaatgcgtcgtgcacaacacactgagtttccagactctgcgtactaccgtcaaggaagctagttctaccttttcctggggcatcgtcctcgctcccttaagcctggcatttctcgtgctgggggggatttggatgcatcgccgctgcaaacataggaccggaaaagccgacggcctcactgttttgtggccccatcaccaggatttccagtcataccctaaatag

SEQ ID NO: 120934 - DNA, 690 bp, Artificial Sequence
  Description of Artificial Sequence: Synthetic coding sequence
atgctgaggctgtatgtgttggtaatgggagtttctgcattcactcttcagcctgcagcccatactggggcagcccggtcctgcagatttcgcgggaggcattataaaagggaatttcggttagaaggcgaaccagtggcactgcgatgcccacaggtgccctactggttgtgggctagtgtcagcccgcggataaatctgacctggcacaagaatgacagcgcaagaaccgtccccggggaagaagaaactcgtatgtgggctcaggacggcgccctgtggttgctgccggctttgcaagaagactccggcacttatgtctgcaccaccaggaacgccagctattgcgacaagatgtctatcgaattgagggtgttcgaaaatacggatgctttcctgccattcatctcttacccccagatcctgacgctaagcacctctggcgttttggtttgtcctgacctcagtgagtttaccagagataaaaccgatgttaagatccagtggtataaagactccctgctgttggataaagacaacgagaaatttttgtcggtcaggggaactacacacttactcgtacacgatgtcgctttagaggacgctgggtactacaggtgcgttctgacctttgcccatgagggccagcagtacaatatcacgcgtagcatcgaactgcgaataaagtag

SEQ ID NO: 120935 - DNA, 1098 bp, Artificial Sequence
  Description of Artificial Sequence: Synthetic coding sequence
atgctgcctccgttaccctctagactgggcctgttgctgctgttactgctgtgtcccgcccacgtgggagggctatggtgggcagtgggctctccccttgtaatggacccaacctccatttgtaggaaagccaggagattggccgggagacaagcggagctttgccaggccgaaccagaggtggttgcagaactcgctagaggggccaggctcggagttcgggaatgtcaatttcagtttcgctttagaaggtggaattgctcctctcattccaaagcctttggcaggattctgcagcaggatataagagagacagcctttgtgttcgctatcaccgccgctggcgcgtcccatgccgtgacccaagcttgcagcatgggagagctactccaatgcgggtgtcaggccccacgtggccgggcccctccacgcccaagcggcctccctggaaccccaggcccccccgggccggcggggtctcccgaaggatctgcagcttgggaatggggcgggtgcggagatgatgtcgacttcggcgacgagaaatcacggttattcatggacgcacgccacaaaagaggtagaggggacatccgagctctcgtgcagctgcataacaacgaggcgggtaggctcgccgtgcggtcccatacaagaaccgagtgtaagtgtcatgggctaagcgggtcatgtgccttgcgcacctgctggcagaagctgcctccctttcgggaggtgggtgcccgattgttagaacgctttcacggagccagccgtgtaatgggcaccaatgacggaaaggcactgttgcccgcggtgaggactttgaagccaccggggagggccgaccttttatatgctgccgactctccggacttttgcgcccccaacagacgaactggatcccccgggaccagggggcgagcctgcaatagtagcgcgccagaccttagcggatgtgatctgttgtgttgcggaaggggccacagacaagaaagcgtgcaattagaggagaactgtctctgtcgctttcattggtgctgcgtggtgcaatgtcatagatgtcgagtgcgaaaagagctgtccctgtgcctgtag

SEQ ID NO: 120936 - DNA, 987 bp, Artificial Sequence
  Description of Artificial Sequence: Synthetic coding sequence
atggggttctggatcctggctattcttaccatcctgatgtactctacagccgccaagttctctaagcagagctggggcttagagaatgaggcgcttatcgtgcggtgcccacgtcagggcaaaccaagttacacagtagattggtattacagccaaactaataaaagcatccctacccaggagcggaatcgggtctttgcatcagggcagctgcttaagtttctgccagcagccgtggccgacagcggtatctacacttgtattgtgaggtctcccacatttaatcgcacagggtacgccaacgtgaccatctacaagaaacagtccgactgcaacgtacctgactacctgatgtatagcaccgtgtctggaagcgagaagaatagtaagatttattgtcccactatagatctatataattggactgcaccgctggagtggtttaagaactgtcaggctctgcagggctctcgatatcgggctcataagtcgttcctcgtaattgacaatgtaatgacagaagatgccggagattatacatgtaagtttattcacaatgaaaacggagccaattattccgtgactgcaacgcgatcctttactgtgaaagatgagcagggcttttcgttgtttccagttattggcgcccctgcgcagaatgaaataaaagaagtggaaattgggaaaaatgctaacctgacgtgctccgcgtgtttcgggaagggcacccagtttctggcagcagtgttatggcagcttaacggtacgaaaattacagacttcggagagccccggattcagcaggaagaagggcagaatcagagcttttccaacggtctcgcatgccttgacatggtgcttagaatcgccgatgtcaaggaagaggacctgctactccagtatgactgcctggccctaaacctacatggtctccgcaggcacactgtgaggctgagtagaaaaaacccctctaaggagtgtttttag

SEQ ID NO: 120937 - DNA, 780 bp, Artificial Sequence
  Description of Artificial Sequence: Synthetic coding sequence
atgggattctggatcctcgccatactcaccatactcatgtactccacagctgctaagttttcaaaacagagttggggtctggagaatgaagcactgatagtgcgctgcccgcggcagggcaagccttcctataccgtggactggtactactctcagacaaacaaatcaatccccacacaggaaagaaatagggtctttgcctcgggccaacttctgaagttccttcccgccgcggtggccgactcaggcatctacacatgcattgtgcggtccccaaccttcaatagaaccgggtatgccaacgtgacaatctacaaaaagcagtccgactgcaatgtgcctgactatctgatgtactcaacagtttctgggtcagaaaaaaacagtaaaatttattgtccaactatcgacctgtacaactggactgcaccactggagtggtttaaaaattgtcaagctttacaggggagccgttatagggcccacaagagtttcctcgttattgacaacgtgatgacagaggatgccggggactacacttgcaagtttattcataacgagaatggggccaattattccgtaaccgcaacccgtagttttaccgttaaggtttggtgtcaatctttctgtaaacttaagaagtcgctgattttctcaaatacgcactggatccagtctctcatgcgaggttttgtaatggtgtattacggcgtgcacaagtgttgtcgagtggtcttcaatctgtgtttacagtatttccagcaccatcagtggccgtag

SEQ ID NO: 120938 - DNA, 636 bp, Artificial Sequence
  Description of Artificial Sequence: Synthetic coding sequence
atgtattcaactgtcagcgggtccgagaaaaactctaaaatctattgtcctaccatagatctgtataattggactgctccactggagtggtttaagaactgtcaggcacttcagggtagcaggtacagagctcataagagcttcctagtaattgataatgtgatgactgaagatgccggggactacacctgtaagtttatccataatgagaacggagccaactactccgtgaccgcaaccaggtcttttacggtgaaagatgagcaaggatttagtctttttcctgtcattggggctcctgctcagaatgaaatcaaagaggttgaaattggaaagaatgcaaacctgacatgctctgcttgctttggcaagggcacacagttcctcgccgcagtattatggcagctgaacggcacaaagatcactgatttcggggaaccacggatccaacaagaagaaggacaaaatcaaagcttctctaatggcttggcatgcctggatatggttttgaggatcgccgacgttaaggaagaggacttgctgttacagtacgattgcctcgctctgaatctgcacggcttaaggcgacacactgtgagattgtcaagaaagaacccatcgaaagaatgcttctag

SEQ ID NO: 120939 - DNA, 945 bp, Artificial Sequence
  Description of Artificial Sequence: Synthetic coding sequence
atggggttctggattctcgccatcctaactattctcatgtattctactgccgctaaattttctaagcagagttggggtctggaaaatgaggccttaattgtgagatgtccacggcaaggaaaacccagttatacggtggactggtactactctcagacaaacaagagcatacccactcaggaacggaacagggtcttcgctagtggccagctgctgaagtttctgcctgctgctgttgctgactctggtatttacacatgcattgtgcggtcacctactttcaacagaaccgggtacgctaatgtgacaatatataaaaagcagtctgattgcaatgttcctgattatctgatgtattcaacagtttcggggtcagagaaaaacagcaaaatctactgccccaccatagatctctacaattggaccgcaccacttgagtggtttaaaaactgccaggcgctgcagggttcccgttatcgggctcacaagtctttcctcgtcatagataacgtcatgacagaggatgccggtgattacacgtgcaagtttatccataacgagaatggcgctaactacagtgtgaccgctacaaggagctttaccgtaaaagatgaacaggggttttcgctgttcccggttattggagcacccgcccaaaatgagattaaggaggtcgaaatcggcactcagttcctcgccgctgttctctggcagttgaatggcacaaagatcactgatttcggcgaacccagaatccagcaagaggaagggcagaatcagtctttttccaatggtttagcatgtctggacatggtgctgcggatcgccgatgtgaaggaagaagatctgctgctgcagtacgattgcttggcgttgaacttgcatggcctcagaagacatacagtacgtctttctagaaaaaatccatccaaggaatgtttctag

SEQ ID NO: 120940 - DNA, 117 bp, Artificial Sequence
  Description of Artificial Sequence: Synthetic coding sequence
atgggcttttggatcctggctatacttacaatactcatgtacagcacagccgcaaagttttccaagcaatcgtgggggctcgagaatgaagccctgattgtgcgttgcccaaggtag

SEQ ID NO: 120941 - DNA, 1728 bp, Artificial Sequence
  Description of Artificial Sequence: Synthetic coding sequence
atgtggtctcttctcctctgcgggttaagcatcgccctgcctctctccgttaccgccgacgggtgtaaggatatattcatgaagaacgaaatcttgtcagcttcccagcccttcgctttcaattgtacctttccgccgatcaccagcggggaagtttccgtcacttggtacaagaattcctccaaaattccggttagtaagattatccaatcccgcatccaccaagacgaaacctggatcctattcctgcccatggagtggggcgactcgggcgtatatcagtgtgtcattaaaggaagagactcctgccatcgcattcatgtcaacctcactgtatttgaaaaacactggtgtgatacaagtatcggaggcctgcccaacctctcggatgagtacaaacagatcctgcacctgggcaaggatgatagcctgacatgccacttgcactttcccaaaagctgtgtgctaggccctatcaagtggtataaagattgcaatgaaataaaaggagagcgattcacagtactggaaactcgcctgttagtgtctaacgtgtccgctgaggaccgaggcaactatgcctgtcaggcaattctcacacattctggcaaacaatacgaggtgttgaacggcataacggttagcatcactgaacgcgcaggctacggggggtcagtccccaagataatttatccgaagaaccatagcatcgaagtgcagctgggtactaccctaatagtggattgcaacgttaccgataccaaagataataccaatctgcggtgctggcgcgtgaataataccctggtcgatgactactatgacgagagtaaacgcatcagggaaggggtcgaaacccatgttagtttccgtgagcataacctgtatacggtgaatatcacgttcttggaagttaagatggaagattacggcctgccgttcatgtgtcacgccggcgtttcaacagcctatatcatcctgcaactcccagctcccgacttccgagcatatctgattgggggcctgatcgcacttgtggctgtggccgtctcagtcgtgtacatctataacatctttaagatcgatatagttctgtggtatcgcagcgctttccactcgactgagaccatcgtggacggtaagttgtatgacgcctatgtgctgtatcctaaaccccataaggagtcccaaaggcatgccgttgacgctctagtccttaacatcctgccggaggtgttagaacggcagtgtggatacaagttgtttattttcgggagggatgagtttcctggccaggccgtggctaacgtcattgatgaaaatgtgaaactgtgcaggcggctcattgtcatcgttgtgcccgagagcctcggatttggcctcctgaagaacttgtccgaggagcagattgccgtgtactcagcccttatccaggatgggatgaaagtgatcctgatagaactagagaaaattgaagactacaccgtgatgcccgagtcaatccagtacatcaaacagaaacatggcgcaatcaggtggcatggtgatttcacagagcagtcccagtgtatgaagactaaattttggaaaacggtcagataccacatgcctccacgtagatgccgccctttcccccctgtccaattgttacagcacacaccttgttacagaactgctggaccggaactcggcagtagaagaaagaaatgcacgctaacaactggctag

SEQ ID NO: 120942 - DNA, 519 bp, Artificial Sequence
  Description of Artificial Sequence: Synthetic coding sequence
atgtggtcgctgctgctctgcgggctttcaatagccttaccgctgtcagttactgctgacgggtgtaaggacatcttcatgaagaacgaaattctttccgcctcccagccgtttgcattcaactgcactttcccgccaataacctcaggcgaggtgagcgttacttggtacaagaactccagcaaaatccccgtgtccaagatcattcaatccaggattcaccaagatgaaacgtggattctattcctgcccatggaatggggggattcaggagtgtaccagtgcgtgatcaaggggcgcgatagctgccaccgaattcacgtgaacctaaccgtgttcgagaaacattggtgtgatacatccatcggcggactgcctaatttatccgacgaatacaagcagattctccacctaggcaaggatgactctctgacctgccacctgcactttccgaaaagctgtgtgctcggccccataaagtggtacaaggactgtaacgagataaagggcgagaggtag

SEQ ID NO: 120943 - DNA, 1374 bp, Artificial Sequence
  Description of Artificial Sequence: Synthetic coding sequence
atgactgggctggtttctctttcatattttccattatctactcgttcctgtgcactgcagagctgctctccggtgtggggttgcggtccttgctgcagcgcagggtgcccatcccccttccactgcctgagccagcaggactgtaacgaaatcaaaggcgaacgatttacagtgctcgagacccgtctgttggtctcaaacgtctccgccgaggatcgaggaaactacgcgtgccaggccatcttgactcactctggaaagcagtatgaagtgctcaatggaattaccgtgagtatcaaaagggccggatacggcggtagtgtgcctaaaattatttaccctaagaaccactccatagaggtccagcttggaaccacgttaatcgtggactgcaacgtaaccgacactaaagataacacaaatctgcggtgctggcgtgtcaacaacactctcgtcgacgactattatgacgagtcaaagcggatccgggagggagtggagacacatgtgtcctttcgggagcataatctctacacagtgaacatcactttccttgaggtgaaaatggaggattacgggctccccttcatgtgtcacgctggcgtatcaacggcgtatataatcctgcagctgcccgccccagacttcagggcatacctgatcggcgggctcatcgcactggtggcagtggccgtgagcgtggtttacatttataacatcttcaagatagacatcgtactgtggtatcgatcagcttttcacagcacggagacaatcgttgatggcaagctctatgatgcttacgtgctgtatcccaagccacacaaggaaagccagagacatgccgtggacgctctggttctgaatatcctgcccgaagttctggaaagacagtgcggctacaagttatttatttttggcagggatgagttccctggccaggccgtggccaacgtgattgacgaaaacgtgaagctctgccgcagactgatcgtcatcgtggtacccgaaagcttaggtttcggactccttaagaacctgtctgaggagcaaattgccgtgtatagtgcgcttattcaggacggtatgaaggtgattctgatcgagttggaaaaaatcgaagactacaccgtgatgcctgagagtattcagtatataaaacaaaagcacggggcaattcgctggcacggcgacttcactgaacaaagccagtgtatgaagaccaaattctggaagacagtccgctatcacatgccccctaggcggtgtagaccctttccgcctgtgcagctgctccagcatacgccatgctaccgaacggccggcccagaattgggatcccggcgaaaaaaatgcaccctaaccactgggtag

SEQ ID NO: 120944 - DNA, 1728 bp, Artificial Sequence
  Description of Artificial Sequence: Synthetic coding sequence
atgtggtccttgttgctatgcgggctctcaatagccttgcctttatctgtgaccgccgatggctgcaaggatatcttcatgaagaacgaaattctcagcgcatcccagccttttgccttcaattgcacctttcctccaatcacgtccggtgaggtgagcgtgacctggtacaagaacagtagtaagatacctgtcagcaagatcatacagagccggattcatcaggatgaaacatggatattgtttctgcctatggagtggggcgactccggagtgtaccagtgtgtcattaagggaagagattcatgccacaggatccacgtcaacctgacagtcttcgaaaagcactggtgtgatacaagcatcggaggactgcctaatctgagtgatgagtacaagcagattctgcatctcggcaaagacgactcgttgacctgccacttgcactttcctaagagctgtgttttgggccccattaagtggtacaaagattgcaatgagattaagggtgagcgctttacggtgctggaaacgaggctcctggtttccaacgtgagcgcggaagatagaggtaattatgcctgtcaggccattttgactcactcgggcaaacagtacgaggtgcttaacggcattaccgtatccattaccgagagagccggttacggcggatccgtccccaagattatataccccaagaaccactccattgaggtccagctagggaccacacttattgtggactgtaatgtgacagacactaaggacaacacaaacttgaggtgctggcgggtgaataacactctggtcgatgactactacgacgaatccaaacgcatccgagagggggtggaaacccacgtctcattccgcgaacataatttgtacacagtgaatatcacgtttctggaagtgaagatggaagattacggcctcccatttatgtgccacgcgggggtttctacagcctacatcattcttcagttgcctgcgccggacttccgggcatacttgattggtggtctgatagccctcgtagccgtagctgtgtcggtagtgtacatctacaacattttcaagatcgatatcgtactctggtaccggagtgccttccatagcacggagacaattgtggacgggaaactctatgacgcttatgttctataccccaaaccccacaaggagtctcagcggcacgctgtggacgcactcgttctgaacatcctgcctgaggtcttggaaaggcaatgcggatacaaattattcatattcgggagagacgagttcccagggcaggccgttgccaacgtaatagatgagaacgtgaaactatgtcgtcggttaattgttattgttgtccctgagtccttgggattcggcctgctgaaaaatctcagcgaagaacagatcgctgtctactcagcactcattcaagatgggatgaaagtcatcttaatcgaactggaaaaaattgaagattataccgtcatgcccgaatcaatccagtatatcaaacagaagcatggagcaatccggtggcacggagattttacagagcagtctcagtgtatgaaaaccaagttttggaagaccgtcagataccacatgccacctaggcggtgcaggccgttcccgccagtgcaactgctgcaacataccccgtgttataggacggccggccctgaattggggagccggcgtaagaagtgtactcttacaaccggctag

SEQ ID NO: 120945 - DNA, 300 bp, Artificial Sequence
  Description of Artificial Sequence: Synthetic coding sequence
atgcaacctagagtactcctggtggttgcccttctcgcgctcctggcctcagcgagagccagcgaggctgaggacgcttctctcttgagcttcatgcaaggttacatgaaacatgctaccaagacagctaaagacgcactcagttctgttcaagagagtcaagtcgctcagcaagcacgagggtgggtgactgacggatttagctcgttgaaagactactggtctaccgtgaaagacaaattctcggagttttgggatcttgaccctgaggtgcggcccacaagtgcagtcgccgcttag

SEQ ID NO: 120946 - DNA, 1500 bp, Artificial Sequence
  Description of Artificial Sequence: Synthetic coding sequence
atgtcccggactgagctgcccagtccccctagcgtttggtttgaggcagaatttttccaccacatcttgcattggaccccgattcccaaccagtccgaatcaacgtgctatgaggtggctctcttgaggtatggcattgaatcctggaattcaatctccaactgcagtcagacactttcatacgatcttactgcagtaacgctggacctctatcattcaaacggctaccgcgccagagtgagagccgtagacgggtcccggcacagcaactggaccgtgaccaacacccggtttagcgtcgatgaggtcactctcacagtcggctcggtgaacttggaaattcacaacggttttatcctgggcaagatccaactgccccgacccaagatggcgccagctaatgatacctatgaatctattttcagtcactttcgtgagtacgagatcgctatccgaaaagtccccggcaattttaccttcacgcataagaaggtgaaacacgaaaatttttccctgctgactagcggcgaggtgggagagttctgtgtccaggttaagccatcagtggcttcacgttcaaacaagggtatgtggagtaaggaagagtgcatctcactgacacggcagtacttcacggtgaccaacgtgattatattctttgcctttgttctcctgctatccggagcactagcctactgtttagctcttcaactctacgttaggcgccgcaagaaactgccaagtgttttactgttcaaaaaaccttcgccattcatctttatctctcagcgtccctctcccgagacccaagacactattcacccccttgacgaggaggcctttctgaaggtgagtcccgagctgaaaaatctggacttgcatggatcgactgacagtgggttcgggtctactaaacccagtctccagactgaggaacctcaatttctactgccagacccccatcctcaggccgaccggacactggggaacagagagccccctgttctaggcgactcgtgtagcagcggcagcagtaacagcaccgatagtgggatctgcctccaggagccctctcttagcccaagcactggacctacttgggaacagcaagtgggcagcaacagtcgggggcaggacgatagtgggattgacctcgtccagaacagcgaaggccgggccggcgacacgcaagggggaagcgcacttggccatcactcacccccagaacccgaggtccccggagaggaggacccagctgccgttgccttccaaggttacttgaggcaaactcgatgcgccgaggagaaagcgactaaaaccggatgcctcgaggaggaaagtcctctgacagacggtctcgggccgaaatttggtaggtgtctcgtggacgaagccggtctgcaccctccagcgctagcgaaaggctaccttaaacaggaccccctggagatgactttggcatcatccggccccaatggcaccgtagagcccgcccactag

SEQ ID NO: 120947 - DNA, 1677 bp, Artificial Sequence
  Description of Artificial Sequence: Synthetic coding sequence
atgagtcgcactgaactcccctcaccaccctccgtttggttcgaggcagagtttttccatcacattcttcactggactcctattccaaatcaatccgaaagcacgtgttatgaggtggctctgctgagatacgggatagagagttggaactccatcagcaattgctcccagaccctgtcttatgatctcacagccgtgactctcgacctgtaccactccaacggatacagagcccgagtccgggcagttgacggctctagacacagcaattggactgtgaccaacaccaggttttcagtggacgaagtgaccctcacggttggatcagttaatttggaaattcacaatggttttattctcggcaagatccagcttcctagaccaaaaatggctccagccaacgacacctatgagagtatcttttcacattttcgggagtatgaaatagcaatcaggaaagtcccaggaaatttcacatttacgcataaaaaagttaagcacgagaatttctcccttctcaccagcggggaagtcggcgagttctgcgtgcaagtaaagccaagtgttgcgagtaggtccaacaaggggatgtggtccaaagaagagtgtatctctttaaccagacagtattttacagtcacgaacgtgatcatcttcttcgcctttgtgctgctccttagcggcgccctcgcctactgcctggccctccagctttacgtcagaagaaggaaaaagctgcccagcgtgctcctgttcaaaaagccttccccattcattttcatctcccagagaccctctccggagactcaagataccatccatcctctggacgaggaggccttcctcaaggtgtctcccgaactaaaaaacctggacctgcatggaagcactgacagtggtttcggcagcactaaacctagtctgcagactgaggaaccccagttcctgttgcccgaccctcatcctcaggcagatagaacccttgggaacagagagccaccagtgctgggagactcctgctccagcggaagttccaactcaacggattctggcatctgtctgcaggagccttccctgtccccgagcactggtccaacctgggagcagcaggtcggaagtaactcaaggggacaggatgacagtggcattgatttggtgcagaatagcgagggacgagccggcgatacacagggaggttccgcgttaggccaccattccccgcctgaacccgaagtgcctggagaagaggaccccgcggcagtggccttccaaggctacctaaggcaaactcggtgcgccgaggaaaaggctacaaagactggatgcttagaagaggagtccccactgacggacggacttgggccaaaatttggccggtgtttagtggacgaagccggacttcacccgcctgcactcgccaaaggttatctgaagcaggatcctctggaaatgacattagccagcagtggggcacccaccggtcaatggaaccagccaaccgaggagtggagtctcttggcattgagcagctgctccgatcttgggatctccgactggtcctttgcacacgacctggctccacttggttgtgttgctgctcctggaggcctgctaggttccttcaattctgacctcgtgacactcccacttatcagttccctacagtcgtctgagtag

SEQ ID NO: 120948 - DNA, 1290 bp, Artificial Sequence
  Description of Artificial Sequence: Synthetic coding sequence
atggcgcccgccaatgatacatatgagtcgattttctcccattttcgggagtatgaaatcgcaattcgaaaagttcccgggaactttacatttacacacaagaaggtgaagcatgagaatttctccctactcactagcggggaagtgggcgagttttgcgttcaggtgaaacccagcgtggccagccggtctaacaagggaatgtggtccaaagaggaatgcatatcactgacgcggcagtactttaccgtcactaatgtgattatctttttcgctttcgtgctgctgctgtcaggggctttggcatactgcttggctctgcagctgtacgttcggaggagaaaaaaattaccttctgtgctgttgttcaagaaacccagcccgtttatatttatttcccagcggccaagccccgaaactcaggatacgattcaccccctggacgaggaggcctttttgaaagtgtctccggagctgaaaaacctcgatctgcacgggtcaactgactccggctttggcagtactaagcccagtctccagaccgaggaacctcagttcttactgcccgacccccatccacaggcagaccgcacgctggggaacagagagccgcccgtcctgggcgattcatgtagctcaggttctagcaatagtacagacagcggaatctgtctacaagagccgagcctttccccatccaccggcccaacttgggagcagcaagtgggctccaattcaaggggccaggatgattctgggattgacctcgtccagaattctgagggacgcgccggcgacacccaaggcggtagcgctttaggccaccatagcccacctgagcccgaggtaccaggcgaagaggaccctgctgcggtagccttccaaggctacctgcgacaaacacgctgcgcggaggagaaggctactaaaaccgggtgtttggaggaagagtccccactgaccgacggtctaggccccaagtttggtagatgtctggtcgatgaagccgggcttcatccccctgctctggctaaaggttacctgaaacaagaccccttagagatgacactggcctcctcaggggcaccaactggacagtggaaccagcctactgaggaatggtccctcctggcgctgagctcttgttctgatctgggaatttctgactggtcctttgcccacgatctagcgcctctggggtgtgtcgccgctcctggtggccttctcgggtcgttcaactccgacctggtgactctgccgctcatttcctcattgcagagctctgaatag

SEQ ID NO: 120949 - DNA, 1269 bp, Artificial Sequence
  Description of Artificial Sequence: Synthetic coding sequence
atgagctcatcctgcagcggcctttcccgagtgctggtggctgtcgccactgcgctggtgagtgcttcaagcccatgtcctcaggcctgggggccccccggggtacaatatggtcagccagggagaagtgtgaagctgtgttgtccaggcgtcaccgccggcgacccagtgagctggtttagagacggggagcctaaattactacaagggccggacagtggcctaggccacgaactggttctggcccaagccgactccactgacgagggcacttacatctgtcagacgctggacggagctctgggtggtacggtgaccctgcagctgggatacccacctgcacgacctgtagtctcatgtcaagctgcggactacgagaatttctcctgcacctggtcgccttcccagataagcggactgcccacacgctatctgaccagctataggaagaagacagtgctcggagcggatagtcaaagaagaagcccctctactggaccctggccctgtccccaagatccactgggcgcagcacgctgcgtcgtccatggggccgaattctggagtcagtaccgaattaatgttaccgaggtaaacccattaggtgccagtaccaggcttttggatgtctccctgcagagcatcctccggcccgaccctcctcagggcttgcgtgtcgaatctgtcccagggtaccctcgccgtttgcgggccagttggacatacccagcatcttggccgtgccagccacactttttactcaagttcaggctgcagtaccgcccggcccagcaccccgcatggtctacagtggaaccagctgggctggaagaggttataactgatgcagtggccgggctccctcacgcagtgcgggtcagcgccagagacttcctcgatgccggaacatggagcacttggagtcctgaggcatggggcacgcccagcaccggcaccatcccgaaagaaatccccgcctggggccagctgcacacacaacctgaagtggagccacaggtggactcgcctgccccccctaggccgtcccttcagccgcatccacgcctgctcgatcaccgggatagtgtagaacaagtagctgtgcttgcgtctttaggcatcctgtcatttctgggactcgtagccggcgcactcgccctgggcttgtggctgaggttgcgacgcgggggtaaggacgggagcccaaaaccagggtttcttgcatcggtgatacccgtggaccggagaccaggcgctccaaacctgtag

SEQ ID NO: 120950 - DNA, 1173 bp, Artificial Sequence
  Description of Artificial Sequence: Synthetic coding sequence
atgagtagctcatgctccggccttagtcgagtgctggttgcggtggccacagccctggtgagcgcctcttccccttgccctcaggcatggggccctcccggggtccaatacgggcaacctggtcggagtgtcaaactgtgttgccccggcgtaacagcaggtgatccagtcagttggttcagagacggcgagcccaagttgctccagggaccggattccggactaggtcacgagcttgttcttgcccaggccgattcgacagacgagggcacctatatctgccaaactcttgacggagctctagggggcacagtcaccttgcagctcggctacccgcccgcacgccctgtggtgtcttgccaagcagcagattatgagaatttttcctgcacctggagtccttcccagatcagcggcctgccaactcgatacttgacaagctaccgaaagaagaccgttctgggtgccgattcccagaggcgcagcccatccaccgggccctggccttgcccccaagacccactgggagctgcccgctgtgtcgtacatggcgccgagttctggtctcagtacaggatcaatgtcaccgaggtgaaccccctgggcgcttctactaggctgctggacgtgagccttcaatctatccttcgacccgaccccccccagggcctgagagtggagtctgtgcccggttacccacggcggctgcgcgcctcctggacctaccccgcaagttggccctgccagccacactttctactgaaattcagactacagtatcgacccgcacaacaccccgcatggagtacagtggagcccgccggcctagaggaagtgatcaccgacgccgttgctggacttccgcatgctgtgcgagtgagcgcacgagacttcctggacgccggaacgtggagtacatggagcccagaagcctggggaacccctagcaccgggacaatacccaaagaaatccctgcttgggggcagctgcacacgcaaccggaggttgagccccaggtggacagtcctgcaccccctaggccaagcctccagcctcacccaagactgctggatcatagagactctgtcgaacaggtggcagtcctcgcctccctgggcatcctgagttttctgggtctagttgcgggcgccttggccctcgggctatggtag

SEQ ID NO: 120951 - DNA, 1269 bp, Artificial Sequence
  Description of Artificial Sequence: Synthetic coding sequence
atgtcttcaagctgctccgggctttctagggttctggtggcagtagcaacagccctggtgagcgcatcttctccatgcccccaagcctggggaccgcccggcgtccagtatgggcaaccggggaggtctgtgaagttgtgctgtccaggtgtaactgctggagatcccgtgtcatggttcagggacggtgagcctaagcttctgcagggcccagattccgggctggggcacgaactggtgttggcccaggcagatagtactgatgaggggacctatatatgccagacgttagatggcgcactaggagggacagttactttgcaactggggtatccacccgcccgcccagttgtgagttgccaggcagctgactatgaaaattttagctgcacttggagcccaagccagatcagcggattacctacgaggtatctgacctcataccgaaaaaagaccgtcctcggtgctgactctcaacggcggtccccctccaccggcccctggccatgtccccaagacccattaggagccgcaagatgcgtggtacacggcgcagaattttggagccagtaccgcatcaacgtcaccgaggtaaatccattgggcgcctctactaggctactggatgtcagtctgcaaagtattctgcgccctgatcccccacagggattgagagtggagtctgtgccaggctatccacgccggctgagggcctcatggacctaccctgccagctggccttgtcaacctcattttctgctgaagtttcgccttcagtaccgccccgcacagcacccagcctggagcaccgtggaaccagccggccttgaagaagtcatcactgacgccgtcgcaggtctgccccacgccgttagggtatctgctcgggattttcttgacgcgggaacctggagcacctggagccctgaagcatggggaacccccagtaccgggacaatccccaaggagatccccgcttggggacagttacatactcagccagaggtggagccccaggtggattctcccgccccacctcggccttccctccaaccacatcctagactcctggaccacagggattctgtcgaacaagtggcagtgctagctagcctgggtattttgagctttttgggtctggtcgccggcgcgctcgccctgggcctgtggctaaggctccgcaggggggggaaggatggctcacccaagccgggattcctcgcttcagtgattcctgtggatcgtagaccaggcgcccccaatctctag

SEQ ID NO: 120952 - DNA, 1269 bp, Artificial Sequence
  Description of Artificial Sequence: Synthetic coding sequence
atgagctcaagctgcagtggactgtcccgcgttctcgtcgctgttgcaaccgcgcttgtgtccgcctctagcccctgccctcaggcatggggccctcccggcgttcagtatgggcagcccggccggtctgttaaactttgttgtcctggagtcaccgcaggtgaccccgtgtcctggtttagagatggcgagcccaagctgttgcaaggacctgacagcggactggggcatgaattagtgctggctcaagctgactcaaccgatgaaggcacttacatctgtcaaacactcgacggcgccctcggtggtactgtaactcttcagctaggctaccctccagccaggcctgtggtgtcgtgtcaggccgcggactatgagaacttctcgtgtacttggagtccaagccagatttcaggattgcctacaagatatcttacctcatacagaaagaaaaccgttctgggagcagacagtcaacgcagatcgccatcaacaggaccatggccatgcccacaggacccactcggcgctgcacggtgtgtggtgcacggagcagagttctggagccagtaccggataaacgtgaccgaagtgaaccccctcggggcctctacgagactgctggacgtctcattacagagtatactccgaccggatcccccacaggggcttagggtggagtcagtcccaggatatccacggcggctgcgcgcatcctggacctaccctgctagttggccatgtcagccacactttctgcttaaattccgcctgcaatacaggccggcccagcaccccgcttggtccactgttgagcctgctggcctggaggaggtgatcacagacgccgtggcaggtctgccccacgcagttagggtgagcgcccgcgacttcctggacgcggggacttggtctacttggtcaccagaggcctggggcaccccttctacaggaaccatccctaaggagattcccgcatggggacagctacacactcagcctgaggtggaacctcaagtagactcccctgctccaccccgcccctctctccagccacatcctagactcctggaccacagagacagtgtggagcaagtcgcggtgctggcttcactgggcatactgtctttccttggcttagtggcaggggcattggcactgggactttggcttcgtcttcgccgggggggcaaggatggcagtccgaaacccggctttttagcttcagtgataccggttgatcggcgacccggggctcctaacctctag

SEQ ID NO: 120953 - DNA, 813 bp, Artificial Sequence
  Description of Artificial Sequence: Synthetic coding sequence
atgtcgtcttcctgctcaggcttaagccgggtgctcgttgctgtcgccaccgctttggtaagcgcctcctccccatgtccccaggcatggggaccccccggggtccagtacggacagcccggaagatctgtgaaattgtgttgccctggcgtgacggctggagatcccgtctcatggttccgggacggcgaacccaaactactccaaggtccagactccggattaggacacgaactggtcctcgcacaggcggacagcacggacgagggcacgtacatttgccaaaccctggacggcgctcttggggggaccgtcacactacaactggggtaccctcccgctcggcccgtggtgtcttgccaagccgccgactacgagaatttctcatgtacatggtccccaagccagatctccgggttacccactagatatctgaccagctacagaaaaaaaacagttcttggggcagactcccagcgtagatcaccatcgaccggcccctggccctgtccacaggatcctctgggcgcggctagatgtgttgttcatggtgcagagttctggtctcagtatcgcatcaatgttacagaagtaaacccactgggggccagcacccgcctgctggatgtgtcgctccaatctatcctgagaccagaccccccacaaggacttagggtagagtccgtccctggttacccacgccgcttacgggcatcttggacatatcccgcgtcatggccctgtcagcctcatttcctgctcaaattccggttgcaatatcggcctgcccagcaccctgcctggtcaacttag

SEQ ID NO: 120954 - DNA, 504 bp, Artificial Sequence
  Description of Artificial Sequence: Synthetic coding sequence
atgtccagttcctgctctggactgtctagggttctcgtggctgtcgctacagcccttgtgtccgcttcatctccgtgtccgcaggcttggggaccacctggcgtccaatatgggcaacccggcagatccgtcaaattgtgttgtcctggagttaccgccggagaccctgtatcttggtttcgagatggagaacctaagctcctccaagggcctgactcaggtctgggacatgaactcgtcctcgctcaagcagactccaccgacgagggtacgtatatatgtcaaacgctcgatggagccctgggcggcaccgtcacactgcagctggggtatccgccggctcgtcctgtcgtgtcctgccaggccgctgactacgagaatttcagctgtacctggagccctagccagatctcaggtttgcccactcggtatctgactagttatcggaagaagacagtgctcggagcggactcccaacgtcgcagcccttcgacagggccttag

SEQ ID NO: 120955 - DNA, 420 bp, Artificial Sequence
  Description of Artificial Sequence: Synthetic coding sequence
atgagcagttcttgcagcggactgagcagggtgctcgttgccgtggcgaccgctctggtgagtgccagttcaccgtgtccacaggcttggggtcctcccggcgtacagtacggccagccggggcgaagtgtgaagttgtgctgcccgggggtgacagctggcgatcccgtctcctggtttagggatggagagcccaaactcctccagggccccgactccggcctgggacatgagctggttctcgcccaggctgatagcacagatgagggtacctacatctgtcagacactggatggcgcccttggggggaccgtgacccttcaattagggtacccccccgccaggcccgtagtctcttgccaggccgcagactatgaaaacttttcctgcacttggtccccgtcccagatcagtggttag

SEQ ID NO: 120956 - DNA, 1989 bp, Artificial Sequence
  Description of Artificial Sequence: Synthetic coding sequence
atggagcccctggtgacatgggtggttccactcctgttcttattcctactcagcaggcagggggcagcatgcaggacaagcgagtgctgcttccaggatccaccataccccgacgctgactcgggaagtgccagcgggccaagagacctcagatgctaccgcattagttcagaccgctacgaatgctcctggcagtacgagggccccacagccggtgtgtcacacttcctaaggtgctgcttgagtagtggccgctgttgctactttgccgccggtagcgccacccgactccagtttagcgaccaggctggggttagcgtcttgtataccgtgacactctgggttgagtcttgggctaggaaccaaactgaaaagtcacccgaggtaacactgcagctttacaacagtgtcaaatacgagcctccactgggcgacattaaggtcagcaagctggctggtcagttacgcatggagtgggagacgccggataaccaggtaggcgctgaggtgcagttccgccataggacccccagttccccttggaaactcggcgactgcggcccccaggacgacgacacggaatcttgtctgtgtccccttgagatgaatgttgcccaggagttccagcttcgcaggcggcagctgggtagccagggctcttcttggtcaaagtggagctcgcccgtttgtgtgccccccgagaaccctccacaaccgcaggtaagatttagcgtcgagcagcttggccaggacggacggcggcggctaactctgaaggagcagccaacccagctggaattgccggaggggtgccagggcctcgcaccgggcactgaggttacataccgcctccagctccatatgctcagttgcccctgtaaagctaaggccactcgcactctgcaccttggtaaaatgccgtatctcagcggcgctgcttacaacgtcgcagtaattagctccaatcagttcggccccggactgaatcagacatggcacattccagccgatacacacaccgaacccgtggcattaaatattagcgtcgggaccaatggcaccacaatgtactggcccgctcgtgcgcagagcatgacctactgcattgagtggcagccagtgggtcaagacggtggcctggccacctgctctttgactgccccccaggatcctgaccccgcaggtatggcaacctactcttggtcaagggagagcggggccatgggccaggaaaagtgctactatattactatattcgcgtctgcccaccctgagaaactgacactgtggtctacagtcctctccacctatcatttcggaggcaacgcctctgcggccggaacacctcaccatgttagtgtgaaaaaccacagcctcgatagcgtatcagtcgattgggcaccatctctactcagcacatgtcctggtgtgctgaaagagtacgtcgtgcgctgtagagacgaagacagcaagcaagtgagcgagcaccctgtgcagcccactgagactcaagtgacgcttagtggcctacgcgctggggtcgcgtacaccgtgcaagtgcgggccgataccgcatggctgcgaggagtatggagtcagccacagcgcttttcaatcgaggtgcaggtctccgattggcttatcttctttgcctcgctgggctcatttttgtccattttactggtcggggtgctaggctatttagggctgaaccgggccgccaggcatctatgtccccctctccctacaccctgcgccagtagcgcgatcgagttccctgggggtaaggagacttggcagtggataaatccagtcgatttccaggaggaagcttcgctccaggaggctctcgttgtggaaatgtcgtgggacaagggcgagagaacagaacccttggaaaagactgagttgcccgaaggagcacccgagcttgctttagatacagagctgtcgctcgaggatggggacagatgcaaagccaagatgtag

SEQ ID NO: 120957 - DNA, 1146 bp, Artificial Sequence
  Description of Artificial Sequence: Synthetic coding sequence
atggagcctctggtgacctgggtggtaccactactgttcctgtttctactgtctaggcagggcgcagcctgtaggacatcagaatgttgttttcaagaccccccctatccagacgccgatagcggctcggcgagcgggcctagagatctgcgatgctaccgaattagctctgatcgctatgagtgcagttggcagtacgaaggaccaactgcaggcgtgtctcacttcctcagatgttgcctctcaagcggacgctgctgctatttcgccgccggatccgccacacgcctacagttctccgaccaagccggcgtctctgtcctttacacggtcacactttgggtggaatcatgggcacgcaaccagacagaaaagtctcctgaagtgacattgcaactgtacaactctgtcaaatacgaacctcctctgggggacattaaggtgagcaagctagccggccaactgcgcatggagtgggagacgccagataaccaggtgggggccgaggttcagttccgacaccggactcccagctccccgtggaaactgggtgactgcggaccacaggatgatgataccgaaagctgcctgtgccccttagagatgaacgtcgctcaggagtttcagctgaggcgcaggcagctgggatcacagggatccagctggagtaagtggtcatccccagtctgtgtgccccccgagaacccacctcagccccaggttcgcttcagtgtggagcagttgggccaagatggcagaaggcgtctgaccctgaaagagcagcccacccagctggaattgccagaaggatgtcagggcctggcccctggcaccgaagtgacgtaccggttgcaactgcacatgctcagctgcccatgcaaggccaaagcaaccagaacactccatctgggtaaaatgccatacctctccggtgcagcctacaacgtcgccgtcattagctctaatcagttcgggccaggactgaaccagacctggcacatacccgcggatacacatactgatggtatgattagcgcccattgcaacctgcggctgcctgatagccgtgactcacctgcttctgcaagcagggtggctggaatcaccggaatctgccaccacacccgccttatcttgtatttctag

SEQ ID NO: 120958 - DNA, 1989 bp, Artificial Sequence
  Description of Artificial Sequence: Synthetic coding sequence
atggaaccactggtcacctgggtggtgccattgctcttccttttcctgctctcgagacagggggccgcgtgtcgcacttcagaatgttgttttcaagatccaccttacccagacgctgactcgggctcagcatcgggcccgcgcgacttgaggtgttatcgcatttcttccgatagatacgagtgttcgtggcaatacgagggccccacagccggcgtaagccatttcctgagatgttgcctcagttctggacgttgttgttattttgccgccggctctgctacacgactgcagttttcggaccaggcgggagtgagcgtcctttacacggtgaccctctgggtcgagagctgggcacgcaaccagacagagaagagccctgaggttactttgcagctctacaacagcgtgaagtacgagcctccgcttggcgacatcaaagttagcaaactggctggacagctgaggatggaatgggagactcctgataatcaggtcggcgcagaggtccagttccgtcacaggacaccttccagtccttggaagctaggcgattgtggcccccaagacgacgatacggagtcttgcttatgccccctcgagatgaacgtggcccaggaattccaactcaggcgcaggcagctcgggagtcaggggtcctcctggtcaaagtggtcctctcccgtgtgcgtgcctccggagaatccacctcagcctcaggtgagattttcagtggaacagctcggtcaggatggcagaaggcgactgacactcaaggagcaacctacccaactagaactgcctgaaggatgccaagggctggcccctggcactgaggtcacttaccgactgcaactgcacatgctgtcgtgcccctgcaaggccaaagctacccggaccctgcaccttggcaaaatgccttatctatccggggcggcctacaacgttgccgtcatctcatccaatcagttcggccctggcctgaatcagacatggcatattccagcagacactcatacagaacctgtagcgctcaacatcagcgttggtaccaatggcacgacaatgtattggccagccagagcacaaagtatgacttattgcatcgaatggcagccggtgggccaggacggcggcctggcaacctgcagcctgactgccccgcaggaccccgaccccgcagggatggccacatatagctggtcccgggaaagcggcgccatgggccaagaaaaatgttactatatcactatatttgcttctgcccaccccgagaagctgaccctgtggagtaccgtgctctcgacttaccattttgggggtaacgcctccgcagctgggactccccaccacgtgagtgtcaaaaatcatagcttggattcagtgagtgtggattgggcaccatcactgctgtccacttgccccggggttttgaaggaatatgtcgtcaggtgcagggatgaggactcaaaacaggtcagtgaacaccctgtacagccgactgagacgcaagtgactttgagcggcctgcgcgccggtgtggcctatacagtgcaggtcagggctgacaccgcgtggcttcgaggtgtttggtcccagcctcagagattctcaattgaggtgcaggtatcagactggctgatctttttcgcaagcctggggtccttcctgagcatcctgcttgttggagtcctgggatatctgggtttgaaccgtgctgccagacacctttgtcctcccctgcctaccccctgtgcctcatccgccattgagttccccggcgggaaagaaacatggcaatggattaaccccgtcgattttcaggaagaagcaagtctccaggaggccctggtggtcgaaatgtcatgggacaaaggagagagaacagaacccctagaaaaaacagaactcccagaaggtgcccctgagctcgcccttgacaccgagttgtccctggaggatggtgacaggtgcaaggccaagatgtag

SEQ ID NO: 120959 - DNA, 2589 bp, Artificial Sequence
  Description of Artificial Sequence: Synthetic coding sequence
atggcacacacattccgggggtgctccctggcgttcatgtttatcattacctggctgctgattaaagccaagattgatgcatgcaaacggggcgatgtgacagtcaagccgtcacatgtgattctcctgggcagcacagttaacataacctgttccctgaagccgaggcagggctgctttcactatagcagacgaaacaaactgatcctatataagttcgacaggcggatcaattttcatcatgggcattccttgaattctcaagtgaccggacttcccttaggcaccaccttgttcgtatgcaaacttgcttgtattaatagcgatgaaatccagatatgtggggcagagatctttgtgggagtcgcccctgagcagcctcagaatctctcctgtattcagaagggcgagcagggcactgtggcttgtacgtgggagagagggagagacactcatctgtacaccgagtatactcttcaactgagcggtccaaaaaatctaacttggcagaagcagtgcaaggatatctactgtgattatttagattttgggatcaacctgacacctgaaagcccggagagcaacttcaccgccaaggtaacagcagtgaactccctcggctcttctagttcactcccttctacgttcacctttctcgacatagttaggccattgcccccttgggatatcagaatcaagtttcagaaggcttctgtctcacgatgcactctttactggagggacgaagggttggtcttgctgaataggctccgctacaggccaagcaactccagactttggaatatggtgaatgtgacaaaggccaaagggcgccacgatctgctggatctgaagccttttacagaatatgagtttcagatttccagcaaattacacttgtacaagggaagttggtccgattggagtgaatccctaagggcgcaaaccccagaggaggagccgaccggtatgctggatgtgtggtatatgaagcgtcacatcgattactcccggcagcagatctctttattttggaaaaatctttccgttagtgaagctagagggaagatcctgcattaccaggtgaccctgcaagaacttaccggcggcaaggctatgacacaaaacattacaggccataccagctggacgaccgtaatccctcgcactggcaactgggcagttgcggtgtccgctgccaattctaaggggagttcgctaccaacaaggatcaacatcatgaatttgtgcgaggcaggacttctggcaccccgccaggtgtccgctaatagtgagggaatggacaatatcctagtgacgtggcagcccccacggaaggacccgtccgcagttcaagagtatgttgtcgagtggcgcgaactgcatcccggcggggacacccaagtccccttaaactggttaagatcaaggccctataacgtcagtgccctaatatctgagaacattaaatcttatatctgctacgagattcgggtttatgccctcagcggagatcaaggtggttgttcttcaatactggggaactcgaaacacaaggccccgctgagcgggccccatatcaatgcaataaccgaagagaagggttctattctgatctcctggaatagtatcccagtgcaggaacagatgggatgcctgctgcactaccgtatctactggaaggaaagagactcgaactcccaaccccagctctgtgagatcccttatagggtgagccaaaacagccacccaattaatagtctgcaaccccgggtcacctatgttttatggatgactgccctgacagccgccggcgaaagtagtcacggcaacgagcgcgagttctgtctgcagggcaaggccaattggatggctttcgtggcgccgagtatatgcattgcaatcattatggttgggatattttcgacccactattttcagcagaaagtgttcgtgcttctggccgcactcagaccccaatggtgtagcagggagattcccgatcccgccaacagtacctgtgcaaagaagtatcccatcgccgaggaaaagacacagctgcccttagaccggctcctaattgactggcccaccccagaagatcctgagcctcttgtgatttccgaggttctgcatcaagtaacaccggtctttagacaccctccttgcagtaattggccacagagggaaaagggaatacaggggcatcaggcaagcgaaaaggacatgatgcacagtgctagttcccctcctcctcctagagctttgcaggccgagagccgccagctggttgatctgtataaagtcctggagtcaaggggatctgaccccaaacccgagaacccagcctgcccttggactgtcttaccagcgggagacctgccgacacatgatggatatctcccaagtaacattgacgatctgcccagccacgaagcccctctcgccgactctctggaggagttagagccccagcacatcagtctgtcagtgttcccgagctcctccttacaccccttaactttcagttgcggggacaagctcacccttgaccagctgaagatgaggtgtgatagtttgatgctgtag

SEQ ID NO: 120960 - DNA, 1980 bp, Artificial Sequence
  Description of Artificial Sequence: Synthetic coding sequence
atggctcacacatttcgcggatgctccctggcttttatgtttattattacatggttactcatcaaggccaaaatcgacgcctgcaaaaggggagatgtcacggtgaagccctcccacgtcatcctgttgggcagcacagtgaacatcacatgcagcctgaagccacgtcaaggctgctttcactatagcagaaggaacaagttgatactgtataagttcgacaggcgcatcaatttccatcatggccacagtttgaactcccaggtcaccggcttgcccctgggaacaaccctctttgtctgtaagttagcctgtatcaattctgacgaaattcaaatctgcggcgctgagatctttgtcggggttgcaccagagcagcctcagaatttgagttgcattcagaagggggagcaaggaactgttgcatgtacctgggaacgtgggagagacacccacctgtacacggagtacacacttcagctgtcaggcccgaagaacttgacctggcaaaagcaatgtaaggatatctattgcgactatctggacttcgggattaatctcaccccagaatctccagaatccaactttaccgccaaggtgactgctgtgaactccttaggatctagctccagtctaccatcgacttttactttcttggacatagtacgtcccctgccgccttgggacatcagaattaagttccagaaggccagcgtgtcacggtgcaccctctattggcgggacgagggcctcgtacttctgaaccgcctcaggtacagaccaagtaatagccggttgtggaacatggtcaacgttacgaaagctaagggtaggcatgacctcttagatctgaagcccttcaccgaatacgagtttcaaatcagtagcaagctccatctgtataagggctcttggtccgattggtcagagagcctgagagcccagactcccgaagaggagccaaccggcatgttggacgtgtggtacatgaagagacatattgactattcgagacagcagatttcactgttttggaagaacctgtccgtgtccgaggcacgaggcaaaatcttacattatcaggtcactctgcaggagctgacaggtggaaaggctatgactcagaacataaccgggcatacatcctggacaacggtgattccgcgcacgggaaattgggcagtcgctgtatctgctgctaattctaagggctcttccctaccaactcgtatcaacatcatgaacctatgtgaggcgggattgttggctcctaggcaggtgagtgctaattctgagggcatggacaatatattggtcacttggcagccccctcgcaaggatccctcagccgtgcaagaatacgtggttgaatggagagaactgcaccccgggggtgatacccaagtcccacttaattggctccggagccggccctataacgtgtctgcgctgataagtgagaacataaaatcttatatctgctacgagatacgagtgtatgccctgtcaggtgaccagggtggctgctcttctattctcggaaattcaaaacacaaagccccccttagcggaccccatatcaacgctatcacagaagagaaaggttccatattgatttcctggaactccatccctgtgcaggagcaaatgggttgcttgctacattataggatctattggaaagaacgggactccaattctcaaccacagctttgtgaaattccttatcgtgtttcgcagaactcccaccctatcaattccctacagcctcgagtgacctatgttctctggatgaccgcccttacagctgccggggagtcttcccatggtaatgagcgcgaattttgcctgcaagggaaggcaaactggatggccttcgtggcaccttcaatttgcattgctattattatggtcgggatctttagcacccactatttccagcagaaacgaaggcatagctgtccctggaccggaagttag

SEQ ID NO: 120961 - DNA, 693 bp, Artificial Sequence
  Description of Artificial Sequence: Synthetic coding sequence
tagcagaaaggagagcaaggtaccgtagcctgcacttgggagagaggcagagatacccacctgtacacagaatacacactgcagctctcgggtcctaagaacctcacctggcagaagcagtgcaaggatatttattgcgattacctggacttcggaataaatctgacccctgagtctcctgagagcaacttcacagccaaagttacggcggtcaattccttgggctcttctagtagtctaccttctacctttacatttctcgatatcgtacggcccctgcctccgtgggacatccggatcaagttccaaaaagcctctgtctctcgatgtacactgtactggcgcgatgagggactggttcttctcaatcggctgcgctatcgaccatctaactctcggctgtggaatatggtgaacgttaccaaggccaaagggcggcatgatttacttgatctgaagccgttcactgaatacgaattccagatcagctctaagctgcacctctataaggggtcctggtctgactggtccgagtcattacgagcccaaacgcctgaagaggaacctactggcatgctggacgtttggtatatgaagcgccacattgattactcacgccaacagatctcccttttctggaaggtttctttcaagcgccagctgaagacacaggggaacaaaaccgagggatag

SEQ ID NO: 120962 - DNA, 1980 bp, Artificial Sequence
  Description of Artificial Sequence: Synthetic coding sequence
atggcacacacctttaggggttgcagcctggccttcatgttcatcattacatggctcctcatcaaagctaagatcgacgcttgtaagagaggcgatgttacagtcaaaccgtctcatgttatcctcctgggcagtactgtgaacatcacctgttccttgaaaccgcggcagggatgttttcattattcaagaagaaacaagctgatcctgtataagttcgaccggaggattaactttcaccatgggcactcactgaacagccaagtaaccggattacccttgggcacaactctgtttgtgtgtaaactggcttgtatcaactctgatgagatccaaatctgcggggctgaaatcttcgtcggagtggcccccgaacaaccccagaatctgtcgtgcatccagaagggtgagcagggaaccgttgcctgtacctgggaaaggggtagggacactcatttatataccgagtacacccttcagctaagtggacccaaaaatctgacctggcagaagcaatgcaaggacatctactgcgattatttggatttcgggatcaacctgactccggaatctcccgagtccaattttaccgctaaagttactgctgtgaatagccttggtagctcttcttccctaccctcgacattcactttcttggatatcgttaggccattgcccccatgggacatccggatcaagttccagaaagcaagtgtgtcacgctgcacattgtattggagggatgaagggctcgttctcctcaaccgtctccgatacagaccatctaactcacggttgtggaacatggttaatgtcaccaaggccaaaggtcgacatgacttattggatctgaaaccctttacagaatatgagtttcagatttcttccaaactgcacctgtacaaggggagttggtccgactggagcgagtcactccgagcccagactcctgaagaagagcccactggaatgcttgatgtttggtacatgaagcgccacatcgactactcaaggcaacagatcagtttattctggaagaatcttagcgtcagtgaagccaggggaaaaattcttcactatcaggtgaccctacaggagctgacgggcggaaaggccatgactcagaacatcacaggtcacacctcgtggaccacggtgatcccaaggaccggtaactgggctgtggccgtgtcggcggccaattccaaagggtcctctcttccgacacggatcaatatcatgaatctctgcgaggcagggcttctggccccgaggcaggtgtctgcaaattccgaaggaatggacaatattctcgtgacgtggcagccgccaaggaaggacccaagcgctgtccaggaatatgtcgtagagtggcgcgagctgcacccaggtggagatacccaggtccccctcaactggctgagatcccggccatacaacgtgtcagctctcatctccgaaaatatcaaatcgtatatctgttacgagatccgggtatacgcactcagtggagatcaaggtggatgctccagcatcctagggaatagcaaacacaaggcccccctgagcggcccacatatcaacgcgattaccgaggagaagggcagtatcctaatctcgtggaattctattcctgttcaggagcagatgggatgcctcctgcattatcggatatactggaaagagcgggactctaattctcagccgcaactgtgtgagatcccataccgggttagccagaattcccatcctataaacagcctccagccaagggtaacgtatgtgttgtggatgaccgcgctgactgctgcgggtgagagttcgcacgggaatgaaagagaattttgcttgcagggcaaagccaattggatggccttcgttgctccatctatctgcattgctatcatcatggtcgggattttctcaactcactacttccagcagaagcgcagacactcctgcccctggaccggaagctag

SEQ ID NO: 120963 - DNA, 2331 bp, Artificial Sequence
  Description of Artificial Sequence: Synthetic coding sequence
atggcccataccttccgaggctgctctctggccttcatgttcataattacctggcttctgatcaaagccaagatagatgcatgcaaacgcggcgacgttaccgtgaagccatcccatgtcatccttctaggttccaccgttaacattacgtgttcgttgaaaccacgccagggatgtttccactacagccgtagaaataaacttattctgtataaattcgatcgacgtattaactttcaccacgggcattcgctgaacagccaggtgaccggattgccgctgggcaccacacttttcgtatgcaaactggcttgtataaattctgatgagatccaaatctgtggcgcagagatattcgtcggagttgctcctgaacaacctcagaatctgagttgtatccaaaaaggtgagcaggggacagttgcgtgtacatgggaacgcgggagagatacacatttatatacagagtacacacttcaactgtccgggcctaagaatcttacttggcagaagcaatgtaaggacatctactgcgactacctcgattttggcattaacctgacaccagagtctcctgaaagtaacttcaccgctaaggtaactgccgttaactctttgggtagttcatcatccctaccaagtactttcacgtttctggatatcgtaagaccactgcccccttgggacatccgtatcaagttccagaaggcatccgtcagccgttgtacattgtactggcgggatgaaggcctggtgctactcaatcgcctccgatatcggccatctaacagtcgcctgtggaatatggtgaacgtaacaaaagcgaagggacggcatgatttactggacctcaagcccttcactgagtatgaattccagatatcgtctaaactccacctgtataaaggcagttggtctgattggagtgagtcactgagggctcagactccggaagaggagcctaccgggatgctggatgtttggtacatgaagagacatatagactacagccgacaacagatttcactcttttggaagaacttgagtgtgtcagaagcacgcggcaagattctgcattatcaagtgacattacaggagctgaccggcgggaaagcgatgacccagaacattacagggcacacctcttggacgacagtgatccctaggaccggcaactgggcagtggctgtcagtgcagccaactcaaaaggatcttcactgcccacacgcatcaacattatgaacctttgtgaggcgggattactggcacctcgccaagtgtctgctaattctgagggaatggacaatatattggttacctggcagcctccgaggaaggatccaagcgcggtccaggagtacgtggtggaatggagggagctgcatcctgggggagacacgcaggtgcccttaaactggttgcgctctcgaccctataacgtgtccgcactcattagcgagattccatacagagtgagccagaactcgcaccccattaatagtcttcaaccacgcgtgacctatgttctctggatgacagctttgaccgcagccggtgagtcctctcacggaaacgagcgagaattctgtctgcaggggaaggcaaattggatggccttcgtcgcaccttctatctgtattgcgattataatggtgggcatcttttctactcattattttcagcaaaaagtgttcgtgctcctcgctgcactcaggccacaatggtgctccagagagattcccgatcctgcgaattctacatgcgcgaagaagtaccccatcgctgaggagaagacacagctgcctctggataggctattaattgactggcctacacctgaggacccagagccactagtgatctcagaagttctacaccaggtgaccccagtgttcagacacccaccgtgttcgaattggccccagagggagaagggaatacaaggccaccaggcatccgaaaaagacatgatgcatagcgcatcctcacctccccctccacgtgcattgcaggcagaatcacggcagctagtggatctttacaaggtgttggaatcccggggctccgatccaaagcctgagaacccggcctgcccatggacagttttgcctgcgggcgatttacctactcatgatggatacctcccttctaacatcgatgaccttccaagccatgaagctcccctggcagattcacttgaagagttggaaccgcagcatattagcctatctgtgttcccatcaagctcgctccaccctcttacctttagctgtggagacaaactgacactggaccaactgaaaatgcgatgtgatagcctgatgttgtag

SEQ ID NO: 120964 - DNA, 681 bp, Artificial Sequence
  Description of Artificial Sequence: Synthetic coding sequence
atgtcttctccaaccgcatcgagtacaactccaagatgtggcacatccgctggcccggccagcccaacttggcgatgtagagctaccgcattgcaccttcatcacccagtcgatcagctcccacaccaggtgttacaacccacaacgggtcagcgccaaccgggaacaggcctgccctggcacagtacacccgcacaactcgccctagctggcctgaggcaggctcagccccacccacagcagcaaaggctgcaccaacctggactgagaggagtggacgcccatggtagtgccgcacatgtgccacaggctgtgccccaggctgtgcgagcccatccgcccggccagctattatcctgggcagccgccgtgtgtctgctatgccaacaccacttacagctgcccggaaagaagcgtaatagcaccctgtatattaccatgctgttgatcgtgccagtgattgtggcaggcgccatcattgtcttgctcttgtacctgaaaagattaaagatcataatttttcccccaattccagatcccggcaaaatctttaaagaaatgttcggagatcagaatgacgacaccctgcattggaagaagtacgatatctatgagaagcaaaccaaagaggagactgactccgtagttttaatagaaaatctcaaaaaagcatcacaatag

SEQ ID NO: 120965 - DNA, 840 bp, Artificial Sequence
  Description of Artificial Sequence: Synthetic coding sequence
atggagtggcccgctcggctgtgtggactgtgggcgctactgctctgcgctgggggtggagggggcggcggcggagcggcgcccaccgaaacgcagcccccagttacaaacctcagtgtgtcagtagagaatctctgcacagtaatttggacgtggaatcctcctgaaggagctagttcaaactgttctctttggtacttctctcattttggagataagcaggataaaaagatagcccctgaaactcgccggagtattgaagtgccactgaacgagcgtatttgtctccaggttggatcccagtgcagcaccaatgaaagcgaaaaacccagcatccttgtagagaagtgtatttcgccgcctgagggagatccagagagcgcggtgacggaacttcagtgcatatggcacaacctttcatacatgaaatgctcttggctccctggacgaaacacctcacctgataccaattacacgctgtattattggcatagaagtctcgaaaagatccatcagtgcgaaaacatcttcagggagggacagtacttcggctgtagctttgacttgaccaaagtcaaggactcatcattcgaacagcattcagtgcagattatggttaaagataatgctggtaaaatcaagccgtcttttaacattgtccctctcacctcccgggtaaaacctgaccctccccacattaaaaacctgagcttccataacgacgacctatacgtgcagtgggagaatccccagaactttataagcagatgtctgttctatgaagtcgaagtgaacaattcccaaacggagacacataatgttttctacgtaagattttag

SEQ ID NO: 120966 - DNA, 1284 bp, Artificial Sequence
  Description of Artificial Sequence: Synthetic coding sequence
atggagtggcctgcaagattatgcggtctgtgggctcttctgctgtgtgccggaggcggtggcgggggcgggggagccgcccctacagagactcaaccaccagtgaccaacttgtctgtttccgtggagaatttatgcacggtgatttggacctggaacccccccgagggggctagctccaactgcagtctgtggtacttttcacacttcggggacaagcaggataaaaagatcgcccccgagacccgtcgcagtatcgaggtgcctctaaatgaacgcatatgtcttcaagtcggctctcagtgttccaccaacgaaagtgagaagccatcaatcttggtcgagaagtgtatctcaccacctgagggtgatcccgaaagcgccgtgacagagctgcagtgcatctggcataatcttagttacatgaagtgctcttggttgcccggccggaatacttctcctgacacaaactacaccttatattactggcatagatccctggagaaaattcaccagtgcgaaaatatctttcgcgaaggacaatattttggatgctccttcgacctgaccaaagtgaaggactcatcgtttgagcagcactcagtgcagataatggtgaaggataatgccgggaagattaaaccctcgtttaatattgtgcccctgacaagtcgggtgaaacccgatccaccacatataaaaaacctgtcattccacaacgacgatctctatgtccagtgggaaaatcctcaaaactttatcagtcggtgcctgttctacgaggtggaggttaacaacagtcagaccgagacgcataatgtgttctatgtgcaagaggctaagtgtgagaatccagaatttgagcggaatgtcgagaataccagctgtttcatggtgccaggagtgctccctgacacactgaatacagtgcggattagggtgaagacaaacaagctttgttatgaagatgacaaactttggtcaaattggagccaagaaatgtcaatcggcaagaaacgaaactccacgctttatatcacaatgcttcttattgttcctgttattgtcgccggcgccatcatcgttctgcttctctatctgaagcgattgaaaatcatcattttcccccccattcctgatcccgggaaaatctttaaggagatgtttggggaccagaacgatgacacactgcactggaagaagtacgacatctatgagaaacaaacaaaagaagaaaccgatagcgtagtgctaatcgagaatcttaaaaaggcaagtcagtag

SEQ ID NO: 120967 - DNA, 1143 bp, Artificial Sequence
  Description of Artificial Sequence: Synthetic coding sequence
atggcgtttgtatgtctggctatcggatgcctgtacacctttctcatcagtacaacctttggttgcacaagctcatcagacactgagatcaaggtgaacccccctcaggatttcgagatagtcgatccaggctatttgggatacctttacctacagtggcagcctccattgagcctcgatcattttaaagaatgtactgtcgagtacgaattaaaataccggaatataggctcggaaacttggaaaacaattatcaccaagaatttgcactacaaggacggctttgacctcaataagggcattgaagccaaaatccacactctgttaccctggcagtgcacaaatggctcagaagtccaaagcagttgggcagaaactacatactggatctccccccaggggatcccagaaactaaagtacaggatatggattgtgtctactacaactggcaatatttgctttgttcttggaaaccaggtattggggtgctgctcgatactaactataacttgttctattggtatgaggggctggaccatgctctgcaatgtgtggactatatcaaagctgacggccagaatattggctgccggttcccctacctggaagcctcagattacaaggacttttatatttgcgtgaatggcagttccgagaacaaaccaatcagatcgagctacttcacttttcaactccagaacatcgttaagcccctgcccccggtgtacctcaccttcaccagagagtcctcttgcgagattaagttgaagtggagcatccctctgggacccattcctgctagatgcttcgattatgagatcgagattcgcgaagatgataccacgctcgttacagcaaccgtggagaatgagacttacacgctgaagaccaccaacgagacccgacaattgtgctttgttgtcagatcaaaggtgaatatttactgcagtgacgacggcatatggtccgaatggtctgacaagcagtgctgggaaggcgaagatctctcaaagaaaacccttctccgcttctggctgccttttgggtttattctcatactggtgatctttgttacagggctgctccttaggaagccaaatacttaccctaagatgatcccagagtttttctgcgatacctag

SEQ ID NO: 120968 - DNA, 1143 bp, Artificial Sequence
  Description of Artificial Sequence: Synthetic coding sequence
atggccttcgtgtgtctggcaataggctgtctgtatacatttttaatctctaccactttcggctgcacctcgtcttccgacactgagataaaggtcaatcctccccaggactttgaaatagtagatcccggatatctggggtatctgtacctgcagtggcagcctccactgtctctcgatcactttaaggagtgcaccgttgaatacgaactgaagtaccgcaacattggatcggaaacctggaagacaatcatcacaaagaaccttcactacaaggatgggtttgatctgaacaaggggatagaggctaaaatccatactctgctgccgtggcaatgcaccaatggatctgaggtgcaaagtagctgggcggaaactacctattggatatctccacagggaatccctgaaaccaaggtccaggatatggactgcgtctattataattggcaatatctgctgtgctcctggaaaccaggaataggcgtgctattagacacaaactacaaccttttctactggtacgagggcctggaccatgcgttgcagtgtgtcgactatattaaagctgacggtcagaatatcggatgccgctttccctacctggaagcatcagactataaagacttttatatttgcgttaatggcagctcagaaaataaacctatacgatcatcctactttacattccagctgcaaaacatcgtgaagccactgccaccagtctacctcacgttcactcgggagagttcatgcgagattaaacttaaatggagtattcccttgggccccatccccgccagatgcttcgattacgaaatagaaattagagaggatgataccaccctggtaacagccaccgtcgagaacgaaacgtacaccctgaaaaccacaaacgagacaaggcagctgtgtttcgtggttaggagtaaggtcaacatatactgttcagatgacggaatctggtctgagtggagcgataagcagtgctgggagggagaggacctgtcaaaaaagactctgctacgcttttggctgccatttggtttcatccttatcctggttatattcgtcaccggtctgctgcttagaaaaccaaacacctaccccaagatgatcccagaattcttctgtgacacctag

SEQ ID NO: 120969 - DNA, 465 bp, Artificial Sequence
  Description of Artificial Sequence: Synthetic coding sequence
atggcccccagacgtgctcgagggtgcaggactctgggcctgcccgccctgctgctattactgctgctgcgaccacccgcaactcgggagcctgcagcaagcagcccctccagcaacaatacggcggctacaaccgctgccatcgtaccagggagtcagcttatgccctccaagtctccttccaccggaaccacagaaatttcatctcacgagtcttctcacggaaccccaagtcagacgactgctaaaaactgggagttaactgcttcagcctcccaccaaccaccaggggtgtatccacaagggcacagtgatacaactgtggctatctctacttcaactgtgctcctgtgtgggcttagcgccgtcagccttctcgcttgttatctcaaaagcagagcatccgtgtgctcatgccaccccaggtccgccgggcatacttgttccgtgggctctgtgtgttag

SEQ ID NO: 120970 - DNA, 804 bp, Artificial Sequence
  Description of Artificial Sequence: Synthetic coding sequence
atggctcctcgtagggcccgggggtgccgcacactgggtctgcccgccttgcttctcttactgctgctgcggcctcctgctaccagaggcattacctgtccaccacccatgtctgttgaacacgccgatatctgggtgaaaagttacagcctgtactcacgggaaaggtacatatgtaattctggtttcaaaaggaaggccggtacaagttcactcaccgagtgtgtgttaaataaagctacgaatgtggcccactggacgacccccagtctcaaatgcataagagaccctgcgctggtccatcagaggcctgcgccaccttccacagtcacaacagctggggtcaccccccagcccgagtccctgtcgcccagcggtaaggagcccgccgcatccagcccttcgagtaataacacggcagccacgactgccgccatcgtacctggctcacagttgatgccaagcaagtcaccatccacaggcactactgaaatcagtagtcatgaatcatctcacggcaccccttcccaaaccacagcaaagaactgggagctgaccgcctctgcttctcaccaaccgccaggagtctacccgcaaggccacagtgacaccacagtcgccatcagtacctctacagtgctgctctgcggcttgagtgccgtgtcccttctggcatgttatctcaagtctcgtcagacaccacctctggcgagcgtcgaaatggaggcaatggaggcactccccgtgacgtgggggacctcttccagggatgaggacctggagaattgcagtcaccacctgtag

SEQ ID NO: 120971 - DNA, 612 bp, Artificial Sequence
  Description of Artificial Sequence: Synthetic coding sequence
atgagcgtggaacatgccgatatttgggtgaagagctactctctttacagtcgggaacgttacatttgtaactctgggtttaaaaggaaggccggaacgagcagcctcacagagtgtgttctgaacaaagctacgaatgttgcccactggaccacacctagccttaagtgtattcgagaccccgcacttgtgcaccaacgtcctgctcctccgagtactgtgactactgccggtgtgacgccccagcctgaatctttatcgcctagcggaaaggaacctgcagcttcgagccctagtagtaacaacactgccgccactaccgctgcaatcgtgcccggttcgcaactaatgcccagtaaatcaccctccacagggacaaccgagatcagctctcacgaatcttcccatggcactcccagtcaaactacagctaagaactgggaactcactgcgtcagcatcccatcagcccccaggagtttacccccaaggtcactcggatactacagtggcaataagcacttccacggtactgctttgtggtttatcagcagtcagcctgctcgcctgctatcttaagagcagtggagcagtgttaagctattctgggtag

SEQ ID NO: 120972 - DNA, 696 bp, Artificial Sequence
  Description of Artificial Sequence: Synthetic coding sequence
atgtctgtagagcatgccgacatttgggtcaaatcctattcattatatagtagggaaaggtatatctgtaacagtggattcaaaagaaaagccggcacatccagcctgactgaatgtgtgctgaataaagctactaatgttgcccattggaccacccctagcttgaaatgcatacgggaccctgccctcgtgcaccagcgtccagcacccccgtccaccgtgacaacagctggagtgacaccccaacccgagtctctctcacctagtggtaaggaaccagctgcctccagcccttcatctaataacaccgccgcaacaacggccgccatcgtgcctggctctcagctgatgccgtccaaatcccctagcacaggcactaccgagatcagtagtcatgagagctctcatggaacccccagtcagacaaccgccaagaattgggagctgacggcaagcgcatcgcaccagcccccgggcgtgtacccacagggacacagcgatacaactgtggcaatttccacgtccacagtcctgttgtgcggcctttcggcagtttcactcttggcatgctacttgaagtccagacagacccctcctctggcctcagtggagatggaggctatggaggccctgcctgttacctgggggacatctagtagggacgaagacctggaaaactgttcgcaccacttgtag

SEQ ID NO: 120973 - DNA, 510 bp, Artificial Sequence
  Description of Artificial Sequence: Synthetic coding sequence
atggccccaagacgtgctcgagggtgccgcacactcgggcttccagccctgcttctgctgctgctgctgagacctcctgccacaagggagcctgccgccagctctccctcaagtaacaacactgctgctacaaccgctgccattgtccccggcagccagcttatgccctcgaagtccccgagcaccggaacgaccgagataagctcacacgaatcttcccatggaaccccttctcagacaacagcaaaaaattgggagctgactgccagcgcgagccaccagccccccggcgtgtatccccaggggcattccgacactacggtagctatcagtactagcactgtgctgctatgtggactcagcgctgtttccctgctggcctgctatctcaaatcgaggcagacaccgcctctggctagcgttgagatggaagctatggaagccctgcccgtcacttggggaacatcctcgcgggatgaagatctggagaactgcagccatcatttatag

SEQ ID NO: 120974 - DNA, 609 bp, Artificial Sequence
  Description of Artificial Sequence: Synthetic coding sequence
atggcaccaagaagggctagggggtgccgcaccttggggctccctgctttgctcctattgctactgttaaggccccctgccacgaggggggatcctgctctagtgcatcagaggccagcacccccctcaaccgtcacaacagcaggcgtaaccccacagcccgaatcactgagccccagtggcaaagagcccgctgcctcttctcccagctcaaataacactgccgccactaccgccgccatcgtccctggatcccagttgatgccctccaaatcgccgagcactgggacaaccgagatctcatcgcatgagtctagccacggtactccaagccagacaactgccaaaaattgggaactgaccgcatccgcttctcaccagccacctggcgtttatccacagggccacagtgacactaccgtggccattagcaccagcaccgtgcttctttgcggcctctctgctgtaagccttctggcatgttacttaaaaagtaggcagactcccccgttggcatccgttgagatggaggccatggaggcccttccagtaacgtggggcaccagctctagggatgaggatctcgaaaattgcagtcaccatctctag

SEQ ID NO: 120975 - DNA, 759 bp, Artificial Sequence
  Description of Artificial Sequence: Synthetic coding sequence
atggccccacggagggcccgtggttgtcgcacactgggtcttccagctctgctgttactcttgctgttgcgtcctcccgctactagggggattacttgtccccccccaatgtcagtcgagcatgccgatatttgggtaaagagctacagtctctactcacgcgagaggtacatctgtaacagtgggtttaagaggaaagccgggacgtcatctttaactgaatgcgtattaaacaaggcaactaacgtggcccattggactactccaagtcttaaatgcattcgcgacccagccctggtgcatcaaaggcccgctccaccgtcgaccgtgaccacggccggagtgacgcctcagcctgagagcctctccccatccggcaaggaaccagctgcatcttcaccttcttcaaataacactgcggccaccacagccgccattgtacccggatctcagctgatgcccagcaaatccccctccaccggtacgaccgaaatttccagccacgagtcatcacacggtacccctagtcaaaccaccgccaagaattgggaacttactgcatcagccagtcaccagcctccaggtgtctacccgcaaggccacagcgacaccacagtagctatcagcaccagcacggtgttgctctgcgggctgtcggctgttagtttacttgcctgctacctcaaatcacgcgccagtgtctgttcttgccatccgaggtccgccgggcatacctgttctgtggggagcgtgtgttag

SEQ ID NO: 120976 - DNA, 564 bp, Artificial Sequence
  Description of Artificial Sequence: Synthetic coding sequence
atggcgccaaggcgcgcacgaggctgtcgaacactgggccttcccgccttgctgctgctgctcttgctccggcccccggcaacacggggtgacccagcgctggtccaccagcgccctgctcctccgtccacggtcacaacagcaggcgttacgccacagcccgaatcactgtccccatctggtaaagagcctgctgcctcctcccctagttctaacaataccgccgctactaccgccgcaatagtccctggaagccagctgatgccaagcaaatccccttccacaggcacaacagagatatctagccacgaaagcagccatgggacaccatcccagaccacagccaagaattgggagctgaccgccagcgcttctcaccagccgcccggggtctatcctcagggccactccgatactacagtggccatttccacttcgacagtactgctttgtggtttgtcagccgtgagcctgctggcttgttatctgaaatccagggcgagcgtatgttcctgccacccgcgaagcgcagggcatacgtgttctgttggctctgtatgttag

SEQ ID NO: 120977 - DNA, 705 bp, Artificial Sequence
  Description of Artificial Sequence: Synthetic coding sequence
atggcccctcggcgggccaggggatgtaggacccttggcctgcccgccctgctgctgctgctgctgctgaggcctccagcaaccaggggcattacctgtccccctccaatgtccgtggagcacgctgacatctgggtcaagagctatagcttatatagccgtgagaggtacatctgcaattcaggatttaaacggaaagctggcaccagctccctgaccgaatgtgtcttaaataaggctactaacgtggctcattggacaaccccttctctcaagtgtatcaagcccgctgcctccagtccgagtagtaacaacaccgccgcaactaccgctgccatcgtgcctggaagtcaattgatgcctagtaaaagtccatccacaggcaccacagagatatcctctcacgaatcttcacacggtacccctagccagacaactgctaaaaactgggagcttacagcctcagcttctcaccagcctccgggggtgtacccacagggccacagcgacaccacagtcgctatcagcacgtctaccgtgctgctgtgcggcctttcagccgttagcctcctagcttgctacctaaaaagcaggcagacccctccgctggcatccgtcgagatggaggctatggaagctcttcccgtgacctggggcacgagcagcagggacgaggacctggagaattgtagccaccacttatag

SEQ ID NO: 120978 - DNA, 660 bp, Artificial Sequence
  Description of Artificial Sequence: Synthetic coding sequence
atggctccccggcgcgcccggggatgtagaacccttggtctgccggccctgctgctgttgttgctcctgcggcctccagccacacggggcattacctgtcctccacccatgtctgttgaacacgccgacatttgggtgaagtcctattctctgtactcacgggaacgctatatttgtaatagtggcttcaagagaaaagctgggacaagcagtcttactgagtgtgtgttgaacaaggccactaacgtggcccattggaccaccccgagcctgaagtgtattaagcctgcagcctcctcccccagcagcaacaatactgcagccactaccgccgcaatcgttcctggcagtcaactgatgccgagtaagtccccatctactggtacgactgagatcagctcacacgagtcaagtcacgggaccccaagccagacgaccgctaaaaattgggagctgacggcttctgcgtcacaccagccccctggtgtatatccccaggggcactctgatacaactgtggccatctctacaagtactgtgttgctctgcggtctttctgccgtgtctctgctggcgtgctaccttaaaagtagagcctccgtgtgtagctgccatccccggagtgcagggcacacgtgttctgtcggaagcgtctgttag

SEQ ID NO: 120979 - DNA, 2601 bp, Artificial Sequence
  Description of Artificial Sequence: Synthetic coding sequence
atgggggctgcccggtctcctcccagcgccgtcccaggccccttactgggtctgctactgctcctgctgggagtacttgcccctggaggagcttctcttcgtctcctcgaccatagagcgttagtttgcagtcaaccagggctgaattgtacagtgaagaatagtacgtgcctggacgatagttggatacaccctaggaatcttacgccaagtagccccaaggatttgcagatacagctgcattttgcccacacccagcagggtgatctctttcctgtcgctcacatcgagtggaccctccaaactgatgcaagcatcctctatttggaaggcgccgagctgagcgtgctccagttaaatacaaacgaacgcctctgcgtgcgattcgagtttctctcgaaactacggcatcatcacaggaggtggcgctttacttttagtcattttgtggttgaccctgaccaggagtacgaggtgacagttcatcacctgccaaagcctatccccgatggagacccaaaccaccagtccaaaaacttcctggtccctgactgtgagcatgcccgcatgaaagtgaccaccccttgtatgtcctcaggttccctttgggacccgaacattactgtggaaacccttgaggctcaccaactgcgggtttctttcaccctgtggaacgaatctacccactatcagatcctgcttaccagctttcctcacatggagaatcacagctgcttcgagcacatgcaccacattccagccccaaggcccgaggagttccatcagcgctccaacgtcacattgacgctgaggaacttgaaaggctgctgtagacatcaagtccagattcagccatttttttctagctgcttgaacgactgtctgcgccatagtgccaccgtttcttgccccgagatgcccgacacgcccgaacctattccagactacatgcccctatgggtttattggttcatcaccggtatttcgatcctgcttgtgggcagtgtcattctgctgattgtttgcatgacctggcgacttgccgggcccgggagtgagaaatattccgatgacacaaagtatactgatggcctgcccgcagccgacctcattcctcctcccttaaagccccgaaaagtctggattatctatagtgcagatcaccccctatatgtagatgtagtgttgaaattcgcccaattcttgctaaccgcctgtgggaccgaagtggccttggatctgctcgaggaacaagccatttccgaagccggtgtgatgacatgggtagggcgacagaaacaggaaatggtcgaaagtaattcaaagattatcgtgctttgcagtcggggtaccagggcaaaatggcaggcccttttgggtaggggagcccccgtgcgtctgaggtgtgatcacgggaaaccggtgggggacttgtttacagcagctatgaatatgattctgcccgacttcaagaggccagcctgctttggaacctatgtggtctgttatttcagcgaagtgagctgcgatggcgatgtgcctgatctgttcggcgcggcccccaggtaccctctaatggataggtttgaagaagtctatttcaggatacaggatctggaaatgttccagccagggcgaatgcatagagtgggcgaactgtcaggggataattaccttaggagtcctggaggaaggcagctgcgtgccgccctggatcggtttcgtgattggcaggtgaggtgtccagactggttcgaatgtgaaaatctctactctgccgacgaccaggatgccccttctcttgacgaggaagtctttgaggagcctctgttgcccccgggtacaggaattgtgaaacgcgcgccgctggttagagagcctggaagccaagcatgtctagcgattgaccctctggtgggcgaagagggcggagccgccgtggccaagctagaaccacacctgcagcccagaggacaacctgcacctcaaccgctgcacaccttagtgctggccgcagaggaaggggctctcgtagctgccgtcgagccaggaccactggcagacggtgccgcagtcagattagctctggcaggggaaggggaggcatgtcctcttctgggaagtcctggagcaggtcgcaattcggtgcttttcttgcccgtagaccccgaggattcaccccttgggagttctactcctatggccagccctgatttactaccagaggatgtgagggaacacctggagggcctgatgctctccctgtttgagcagagtctgtcatgtcaggctcaaggcggctgttctagacccgcaatggttctgacagatccccatacaccatatgaggaggaacaaagacagtctgttcagagtgatcaggggtatatctcccgaagctcgccgcagccccctgagggtctcacagaaatggaggaagaggaggaggaagagcaggaccctgggaagcccgcactccctctgtctcctgaggatctggagtctttgcgcagcctgcagcgccagctgctcttccgccagctccaaaaaaactcaggatgggataccatgggaagtgaaagtgaaggaccttcagcgtag

SEQ ID NO: 120980 - DNA, 2445 bp, Artificial Sequence
  Description of Artificial Sequence: Synthetic coding sequence
atgggggccgcacggagtcctcccagtgccgtcccagggccactccttggcctgcttctgttgctgctcggcgtgctggctccaggcggcgcttccctgcgattgctcgatcatcgtgcccttgtctgcagccagcccggcctcaattgcacagtcaaaaactcgacttgtctggatgattcctggattcacccacggaacctcaccccgtcgagtcctaaagacttacagatccaactgcacttcgcccacacccagcaaggcgatttgttccccgtggcccatatcgagtggaccctgcagactgacgcctccatcctttacctcgagggtgcggagttatccgtcctgcaattgaacaccaacgaaagactgtgtgtgcggtttgaattcttaagtaaactgaggcaccaccaccgccggtggcgcttcacatttagccactttgtggtcgatcctgatcaggaatacgaagtgactgtccaccacttacccaagcctattccagacggagacccaaatcaccagtccaagaattttttggtaccagattgcgaacacgctcgcatgaaagttaccaccccttgcatgagtagcggctcattgtgggacccaaacatcacagtcgagacgctggaggctcaccaactgagggtatcctttaccctgtggaacgagtcaactcattatcagatcttgcttacctctttcccacacatggaaaaccatagctgctttgagcatatgcatcacatccccgccccacggcctgaggaatttcaccaacggtcgaatgttaccctgaccctgaggaatttaaagggttgttgcaggcatcaagtacagatccagcccttcttcagttcctgcctgaacgattgcttgagacattccgcgaccgtgtcttgccccgagatgcccgacacccctgacggactccccgcagcagatttgatccccccacccctgaaaccacggaaggtttggattatatactcagcagaccatccactgtacgttgatgtggtcctcaaattcgcacagtttttattgaccgcttgtggcaccgaggtcgccttggacctcctggaagagcaagccatatctgaggctggcgttatgacctgggttgggcgccagaaacaggaaatggtggaaagcaatagtaaaattatcgtgctttgctctagaggaacccgcgcaaagtggcaggccctgctgggcagaggggctcctgtgcgtctgagatgtgatcatggtaagcccgtgggcgacttatttaccgcagctatgaacatgattctccctgacttcaaaagaccggcttgttttgggacctacgtagtttgctatttcagtgaagtgagctgcgacggagatgtccctgatctcttcggtgccgctccgaggtacccgcttatggatcgcttcgaagaagtttattttcggattcaggacttagaaatgttccagcctgggcgcatgcatcgggtgggagaactgagtggcgataattacttacggagccccggtggccgccagttgagggctgcactagatcggttccgggactggcaagtgaggtgtcctgactggttcgaatgcgagaatctctactctgcagatgaccaagacgctcccagcctcgatgaggaggtttttgaggaacctctgttaccacccgggaccggaatcgtgaagcgggctccgcttgttcgtgagccgggcagccaggcctgccttgccatcgatcccttggtgggcgaggaggggggtgctgccgtcgccaagttggagccacatctgcagccgcgtggtcaaccggcccctcagccgttgcatacgcttgtgttagcggccgaggagggtgctcttgtggccgccgttgagcctggacccctggccgacggcgctgccgtgcgattggcactggccggcgaaggtgaggcctgtcctctgctgggaagccctggagcaggtcgcaactctgttctgttcctgccagttgacccagaggactccccgctgggatcaagcactcccatggcttctccagatcttctccctgaggatgtgcgggagcatctggaagggttaatgttgagcctgttcgagcaatctctcagttgccaggcacaagggggatgttcccgtcctgctatggtgctcacggatcctcatacaccttatgaagaggagcagcgacagtcggtgcagtctgatcagggctacattagtagatcctcacctcagccccccgagggcctgaccgagatggaagaagaagaggaggaggagcaggaccccggaaaacccgccctgccactttctcccgaggatcttgagtcgctgcgcagtctccaacgacagctgctgttcagacagctgcaaaagaatagcggttgggacacaatgggatccgagtcagaagggccctctgcttag

SEQ ID NO: 120981 - DNA, 1509 bp, Artificial Sequence
  Description of Artificial Sequence: Synthetic coding sequence
atgtctcttgtgcttctctcactagccgccttgtgtcggagtgccgtgccacgggagcccaccgtgcagtgcggaagcgagaccgggccgtctcccgagtggatgcttcagcacgatctgatcccgggcgatttgcgcgatctgcgtgttgaaccggtgactacatcagtggctactggtgactatagcatcctgatgaatgtttcctgggtgctgagggctgacgccagcattcgtttgttgaaggccactaagatatgcgttaccggtaaaagcaattttcagagctacagctgcgttagatgcaactatacagaggctttccagacacagacaagacccagtgggggtaagtggaccttctcatacattggtttccctgtggagttgaacactgtctactttatcggcgctcacaacattccgaatgccaatatgaacgaagatggccccagcatgtcagtgaactttacatcgcctggctgcttagatcacataatgaaatataaaaagaagtgcgtgaaagccggctctctttgggaccccaacatcaccgcctgcaagaagaacgaagagaccgtggaggtgaatttcaccacaacacccctgggaaacagatatatggctcttatacagcacagtacgattatcggattttcacaagtgttcgagccacaccaaaaaaaacagacacgggcgtcggtagtgatccccgttaccggggattcagaaggtgcaacagtccaattgaccccctattttcctacttgcggttctgactgtatacggcataaaggcacagtcgtcctttgcccccaaaccggagtcccgttccctctcgataataataagtctaagccaggtgggtggttaccacttctgcttttgagtttactggtggcgacctgggtgttagtagcagggatttacttaatgtggcgccacgaacggatcaaaaaaacaagctttagtaccactacactcctgccacctatcaaggtgcttgtggtctatccttcagaaatctgttttcaccacaccatttgttattttactgagtttctgcagaaccactgccggtcagaagtaattctggagaaatggcagaagaagaagattgccgagatgggccccgtgcagtggcttgccactcagaagaaagcggcggacaaggttgtcttcctgttgtcaaacgacgtcaattccgtgtgtgatgggacgtgcggcaaatctgaagggtcaccctccgagaatagtcaggacctgtttcctctcgcgttcaacctgttttgcagcgacctccgctcccagatacatctccataaatatgtggtggtgtattttcgggagattgacactaaagatgattataatgctctctctgtctgcccaaagtatcatttgatgaaggacgccaccgcgttttgtgctgagctactacacgtaaaacagcaagtgtcagccgggaaacgcagccaggcttgccacgacggatgttgcagcctgtag

SEQ ID NO: 120982 - DNA, 2376 bp, Artificial Sequence
  Description of Artificial Sequence: Synthetic coding sequence
atgccggtgccgtggtttctgctctctcttgcactggggagaagccccgtggtgctctcgctggagcgactggtgggcccccaggatgccacacactgttctcccgtatccctcgagccgtggggggatgaggagcgcctcagggtacagtttctggcacagcagtccctgagtttggcacccgtgactgccgcgactgccaggacggctttgagcggcttgagcggtgccgacggaagacgcgaagaaagaggacggggaaagtcatgggtttgtctctccctgggaggtagcggaaatacggaacctcagaagaagggcctctcatgcagactatgggactcggacattctgtgtctgcctggcgacattgtaccggcacccgggcccgtcctggcacccactcacctgcagaccgaactagtgctgcgatgccagaaggagaccgactgcgatttgtgcctgcgcgtagccgttcatctagctgtgcatggccactgggaggaaccggaggacgaggaaaagttcgggggagctgcggactccggggtggaggagcctcggaatgccagcctccaagcccaagttgtgctgtcattccaggcgtatccaactgctcgctgtgttcttctcgaggtgcaggtacctgccgccctggtacaatttggtcaaagcgttggaagcgtggtctatgattgtttcgaagctgctctggggtccgaagtaaggatttggtcatatacgcagcctcggtatgaaaaggagctaaatcacacacagcaactgcccgattgtcgcggacttgaggtctggaatagcatcccgtcgtgttgggctcttccatggcttaacgtgtcagccgatggcgacaatgtacacctggttttaaacgtaagtgaggaacagcattttgggctgagcctgtattggaatcaagtgcagggaccacctaaacctagatggcacaagaaccttaccggcccccagatcattactctcaaccatacagacctagtaccgtgtttatgcatacaggtttggcccctggagccggattcggtccgtactaacatctgtccatttcgtgaggaccccagagcgcatcagaatttgtggcaggctgctcgcctccaactgctaactctgcagagttggctactggacgctccttgctctctcccggccgaggcggcgctgtgctggcgcgccccaggaggagacccttgtcagccactcgtgccaccgctgtcatgggagaatgtgactgtcgacaaggtcctcgaattcccactccttaagggtcaccctaatctatgcgtgcaggtcaattctagtgaaaagctgcagttacaggaatgcctgtgggccgacagcctcgggccactcaaagatgatgtgcttctcttggagacgcggggacctcaggacaatcggtcactgtgtgccctagagcctagtggctgtacaagcttaccgtcaaaagccagcacccgggctgcaagacttggggagtacctgctccaggacctgcaatctggccaatgcctgcagttgtgggacgatgacctgggagctctttgggcttgcccgatggacaaatacatacataaacggtgggccctggtctggctcgcctgcttgctgtttgccgccgcactgtcactgatcctgctcctgaaaaaagaccacgcaaaaggctggctgcggttgctgaaacaggacgttcggagtggtgccgccgcaagaggccgagctgcactgcttctgtactcagcggacgattccggcttcgagcgcctcgtgggtgcgcttgctagcgccctttgtcaactgcctctgagagtggctgtggacttatggtcaaggcgcgagttatctgcccagggacccgtcgcctggttccatgcccagaggaggcagactttacaggagggcggcgttgtggtgctactgttctccccgggagccgtcgcactatgcagcgagtggctacaggatggagtgagtggcccaggggctcatggaccccacgacgctttccgcgcgagcctgagctgtgtcctgcccgacttcctgcaggggcgggcccctgggagttatgtgggcgcatgcttcgacagactcctccatccagatgcggtcccggcactcttcagaactgtacccgttttcacgttaccgtcacaactgcccgatttcctgggcgctctgcaacagccaagagcacccagatctggaagactacaagaaagagccgagcaggtgtccagagctctgcagcccgctctggatagttactttcatcccccaggcactccagcgccagggaggggcgtgggccccggtgctggccctggggctggcgacggaacatag

SEQ ID NO: 120983 - DNA, 2118 bp, Artificial Sequence
  Description of Artificial Sequence: Synthetic coding sequence
atgccagtcccctggtttcttctgagcctggctctggggcgcagtccagtggtcttgagcctcgagagattggtaggcccacaggatgctacccattgttctcccggactctcctgtaggttgtgggacagtgatattctttgcttgccaggagacatagtgcctgccccagggcctgtgctcgccccgacccaccttcaaacagaattagtgctgcgttgtcaaaaggaaactgactgcgacctctgcctccgagtcgccgtccaccttgccgtccatgggcactgggaggaacccgaggatgaggaaaagtttgggggagctgccgattccggtgtcgaagaacctcgcaacgccagtttgcaggcccaggtggtactttctttccaagcttaccccacagcgcgctgcgtattgctcgaagtccaggtgcctgcagctcttgtgcagtttgggcagagtgtgggtagtgtggtgtacgactgttttgaggcagctctgggaagcgaggtccgtatttggtcctacactcaacctagatatgagaaggagctgaaccatacacaacagctgcctgcactgccctggctaaatgtgtctgctgatggcgacaacgttcatctcgtccttaacgtctcagaagagcagcacttcggattgtctctttactggaatcaagtgcagggaccacccaaaccacgttggcataagaacttaaccgggccacaaataatcacactgaatcatactgacctggtcccctgtctgtgcattcaggtgtggccattagaaccagactctgttcggacaaatatttgtcccttccgcgaggatcctcgcgctcaccagaatctctggcaagctgcccgtctccagctactcactctgcagagttggctcctcgacgccccttgctcgctgcccgcggaggctgccctttgttggagggctccgggcggagacccttgtcagcccttagtaccacccctctcttgggaaaacgttacagtggacaaggtgctagaatttcctttgctcaaaggacacccaaacctgtgcgtgcaggtgaattccagcgaaaagcttcaactgcaagagtgtctgtgggctgactccttgggtcctctcaaggatgacgtcttactgctagaaacccggggcccacaggacaacagaagcttgtgcgcgctcgaaccctccgggtgtacaagcttgccaagcaaagccagcacacgagccgcgcgcttaggggagtatctgctccaagatctgcagagtgggcaatgcctgcaattatgggatgacgacctgggggccctgtgggcctgtcccatggacaaatacattcacaagaggtgggcgttggtgtggctcgcttgtctgcttttcgccgcagccctgtcgcttatactcctcctgaagaaagaccacgcaaagggctggctgcgtcttctcaaacaggacgtcagaagtggcgcagcagcgcgagggcgggccgctctcttactgtattcagctgacgatagcgggtttgaaagattggtgggggctttggcatccgctctgtgccagctccccctgcgcgtcgcagtggatctctggagtaggagagagcttagtgcccaaggtcctgtagcctggtttcacgcacaaagacggcagaccctccaggaaggcggagtggtagtgcttctgttctctcccggagccgtggctctgtgcagcgagtggctgcaggacggcgtcagcggcccgggcgcccacggtcctcacgacgcctttcgggcctccctgtcttgcgtgctgcctgactttcttcaggggcgagcccctggcagttacgtaggcgcatgtttcgaccgcttgttacatcctgatgccgttcctgccctctttaggaccgtccccgtgtttacacttccctctcagctcccagattttcttggggcactgcagcagcccagggcaccacgttcaggacgcctgcaggagagagccgaacaggtcagcagagctctccaacctgccctcgactcctacttccatccacccggaacaccagcgccaggccgcggagtcggtccgggagctggtcctggggccggtgacggaacctag

SEQ ID NO: 120984 - DNA, 2163 bp, Artificial Sequence
  Description of Artificial Sequence: Synthetic coding sequence
atgccggtgccgtggtttctcctgtccctggcccttggcagatcacctgtggtgctgagcttggaaagattagtgggacctcaagacgctactcactgctctcccggactgtcctgcaggctctgggatagtgacatcctctgcctgccaggcgatattgttcctgctcctgggccagtcctcgctcctactcaccttcagaccgagctggttctccgctgccagaaagagactgactgcgacttgtgcttacgagtggctgtgcacctggctgtgcatgggcattgggaggaacccgaggacgaggaaaaattcggaggggctgccgatagtggggtggaggagcccaggaacgcttctttgcaggcgcaggttgtactgtcttttcaggcatatcctactgccaggtgtgtgctcttagaggttcaggtccccgccgcattggtgcagtttggacagagtgtgggcagcgtcgtgtatgattgtttcgaggcggcactcggcagtgaagtgaggatctggagctacacacagccaagatacgaaaaagaactgaatcacacccagcaactcccagactgcagagggctggaggtctggaatagcatcccctcctgctgggcactcccatggctgaatgtcagtgcggatggggataatgtacacctggtcctgaacgtctcagaggaacagcatttcggactcagcctgtactggaaccaggtgcaaggtcctcccaagcctcgatggcacaagaatctgaccggcccccagataattacactgaaccataccgacctcgtgccttgtctttgtatccaagtgtggccgctcgaacccgattctgttcgcacaaatatttgtccgtttagagaggatccccgagcccaccaaaacctttggcaggcggcccgccttcagcttctgacactccagagctggctgttggacgctccttgttctctgccagcagaagcagccctctgttggagggcaccaggtggagacccatgtcagccactcgttccaccactgtcttgggagaatgtaaccgtggacaaggtcctggagttccccctgctcaaaggccacccaaatctctgcgtccaggtgaacagtagcgagaagcttcagctacaagagtgtctttgggccgacagcctgggtccgctcaaggatgacgtcctcctacttgagacacgcggaccccaagacaatcggtctctgtgtgctctggagcccagtggttgcacctctctgccatcaaaggcgtccacacgggccgcacggctaggcgaataccttttacaggacctgcagtctggtcagtgtttgcagctctgggacgatgaccttggcgctctctgggcatgccccatggacaaatacatccacaagcggtgggccttggtttggttggcctgtctgctcttcgccgctgctttatctctgatactcctgttgaaaaaggaccacgccaaaggctggcttagactgctgaaacaggacgtgcggtctggcgccgccgcacgagggagagccgcactgctcctttactcagccgacgatagtgggttcgagcgcctcgtgggggcgctggccagtgccctgtgccagctacccttaagagtggcagttgacttatggagtagaagggaactttccgcccagggcccggttgcttggttccatgctcagcgacgccagacccttcaagagggcggagtggtcgtactgttattttccccgggtgctgtggccttgtgttccgagtggttgcaggatggagtgagcggaccaggagcacatggccctcatgatgcatttcgggcctctctctcctgtgttctgcctgattttttacaaggtcgcgcccctgggtcatacgtcggcgcttgcttcgaccggttactgcatcccgatgccgtccccgctctcttcagaactgttccagtgttcactttaccaagtcagctgcccgactttctcggcgccctccagcagcctcgcgccccacggtccggcagactgcaggagagagctgagcaagtgagcagggctttacaaccggccttggacagctacttccacccacctggaaccccagccccaggacgtggagtggggccaggcgcaggccctggcgccggcgatgggacgtag

SEQ ID NO: 120985 - DNA, 1641 bp, Artificial Sequence
  Description of Artificial Sequence: Synthetic coding sequence
atggcttatcccaccgcgcggtgcgttctcttggaggtgcaggttcccgcagccctggtgcagttcggacagtccgtggggtcggtagtctacgattgtttcgaggcagcgctgggcagcgaagttcggatttggtcctatactcagccaagatatgagaaagaactgaaccatacccagcagctgcccgcactgccatggttaaacgtgtctgctgatggggacaacgtgcatttggttctgaatgtgtcagaggaacagcatttcggcctgagcctgtattggaatcaggtgcagggacccccaaaaccccgctggcacaagaatctcaccgggccgcaaattataacactcaatcatactgatctggtgccttgcctttgtattcaagtatggcccctcgagcccgacagcgttagaacaaacatatgtccatttcgtgaggatcccagagcacaccagaacctatggcaagcagctagactacagttgctgaccctccagtcctggctactggacgctccatgttcccttcccgcagaagcagcactctgttggcgcgcccctggtggggatccttgccagccgctggttccccccctttcctgggagaacgtgactgttgatgtgaactcctccgaaaagctacagctgcaggaatgtttgtgggcggacagcctgggccctctgaaagatgatgtgcttcttctagaaacccggggacctcaggataatcggtccctgtgcgccctggaaccgagtggatgtaccagcctgccctctaaggcctccacccgtgccgcccggctgggagagtatcttcttcaggatctacagtcaggccagtgcctgcagctctgggacgacgatctcggcgccttgtgggcatgtcctatggacaagtacattcataaaaggtgggcgttagtttggctggcctgcctcctttttgctgcagcattgtccctgatattgttactgaagaaagaccacgcaaaggctgcggctagaggcagggccgccttactcctttattcggccgatgacagtggatttgagcggcttgttggagcactggcttcagccctgtgtcaactccctctcagagtggccgttgacttgtggagcaggagggaactgtccgcccagggaccagtcgcatggttccatgcccagagaagacagaccctgcaagaggggggggtagtggtcctgctgtttagcccgggcgctgtcgcattgtgcagcgaatggctccaagatggagtttctgggccaggagcacatggcccacatgatgccttccgggccagtttgagctgtgtgctgcccgattttttgcagggcagagcgcctggttcttatgtcggcgcttgtttcgacagactgttgcaccctgacgctgttcctgcgctctttcgcaccgtgccggtatttacactaccctctcaactgcctgacttcctgggcgccctgcagcagccaagggctccccggtcgggaaggctgcaggaaagggccgagcaagtgtctagggccttgcagcccgccctcgacagctattttcatcctcctggtacaccagcccctggcaggggagtgggccccggcgcgggccccggcgctggggacggcacatag

SEQ ID NO: 120986 - DNA, 2124 bp, Artificial Sequence
  Description of Artificial Sequence: Synthetic coding sequence
atgcctgtaccttggttcctgctgtctctagcactgggtcggtcacctgttgtattgtcccttgagcgcttagtggggccccaggacgctacacattgcagtccaggtttaagctgtaggttgtgggacagtgacattctttgtttacccggtgatatcgtgccagctcctgggcctgtgctggctcccactcacctccaaacagaactggtgctccggtgtcaaaaggaaactgattgtgacctctgtctgagggtggctgtacacctagctgtgcacggacattgggaagaacctgaagatgaggagaagtttgggggtgccgccgactcgggtgtggaggagcccagaaatgccagcctccaggctcaagttgtcttatcgttccaggcttaccctacggccagatgcgtgcttcttgaggtgcaggtgccagcggctctcgtccagttcggacaatcagtggggtccgtcgtttacgattgctttgaagctgctctaggcagcgaggtgcgcatttggtcctatacacagccacgctacgagaaggaactgaatcacacacagcaactcccggactgcagaggtttggaggtatggaatagtatcccctcgtgctgggccctgccttggttgaatgtgagcgccgatggagataatgtccatctggtcctcaatgtgtccgaagagcagcactttggtttgtcactgtattggaatcaagtccaagggccacctaaacctagatggcataagaacctgaccggtccacagattatcacacttaatcatacagacctggtcccctgcctttgcatccaggtgtggccacttgagcccgactccgttcgaaccaacatctgcccattcagggaggatcctcgagcacatcaaaatttatggcaggccgctagactacagctcttgaccctgcaaagttggctcctggatgcgccttgttctctccccgcagaggctgctctctgttggcgtgcaccgggtggggatccctgccagcccctggtccctcccctgagttgggagaatgtcactgtagacaaggtgctcgaatttccgttattaaaggggcatcccaacctctgcgtgcaggtaaacagctccgagaagctacagctgcaagagtgcctatgggccgactcgctggggccactgaaggacgatgtccttctgctggaaacccgaggtcctcaagataaccgctctctgtgcgcgctggagccaagcgggtgtacctccctgccaagcaaagcatccacacgcgcggccaggcttggtgagtatctgctgcaggatctgcagagcgggcagtgccttcagctgtgggatgacgatctcggcgctctatgggcctgccctatggataaatatatccacaagcgttgggcattggtgtggctggcatgtctcctgttcgccgcggcactctctttaattcttctgttaaagaaagatcacgccaaggctgcggctaggggcagggccgcccttctgctatatagtgccgacgactccggttttgagagactggtgggcgcgctggccagtgccctctgtcaactgcccttgcgcgtggccgtcgatctatggtcccgaagagagctgagcgcccaaggaccagtagcatggttccacgcccagagacgccaaaccctccaggaaggcggagtagtcgtcctgttgtttagtcctggcgcggtagccctttgctccgagtggctacaggacggtgtttctgggcctggggcccacggcccgcacgacgcattcagagcatccctttcctgcgtcctgccagactttctacagggccgcgccccaggttcatacgtgggagcctgtttcgataggttgcttcacccagacgccgtgcctgccctgttccggaccgtacccgtcttcacactccccagtcagcttccggatttcctcggggccctacagcaaccacgggccccccgctctggtcggctacaggagcgcgctgaacaagtgtctcgtgctctgcagcccgccttggatagctactttcacccacctggcactccagcccctggtcggggtgtaggaccaggcgcaggaccaggggcaggtgatggaacatag

SEQ ID NO: 120987 - DNA, 213 bp, Artificial Sequence
  Description of Artificial Sequence: Synthetic coding sequence
atgcctgtcccttggtttctgttatcgctggcgttgggtcgctctcccgtggtgctatccctggagcgcttggtgggacctcaggatgcgactcactgctccccagggctgagctgtcgcctgtgggtcacatattctgcctgtttggggacttcatgtctgttacgcgccccatgctggaggctgcgaacctgtcggcagtcatggtgttag

SEQ ID NO: 120988 - DNA, 2067 bp, Artificial Sequence
  Description of Artificial Sequence: Synthetic coding sequence
atgccagtcccgtggtttttgttgtccctggcattgggaagaagtcctgtggtcctgtccttggaaagactcgtaggaccccaggatgccactcactgcagtcccggacttagctgccgactgtgggattccgatatcttatgtttaccaggagatattgtgccagcacccggaccagtcctggccccaacccatctgcagactgagctagtattacgatgccagaaagagaccgattgcgatctgtgcctgcgggtggctgtgcaccttgccgtgcacgggcattgggaggagcctgaagatgaagagaaatttggcggcgctgctgattccggtgtggaagagccccgcaacgcctccctgcaggcacaggtggttctgtcatttcaggcataccccacagctcgttgcgttctgctggaggtccaggtgccagccgctctggtacagttcggacaatctgtagggtccgtggtatatgattgtttcgaggctgccctcgggagtgaagtacgcatctggagttatactcaacccaggtacgagaaagagttgaatcacacccagcaactgcccgccctcccgtggctcaatgtctccgccgacggagataatgtacatttagttctcaatgtaagcgaagaacagcactttggtctctctctatactggaaccaggtgcagggaccacctaagcctagatggcacaagaacctgacagggcctcagataatcactctgaaccatactgacctggtgccctgcttgtgtatacaggtgtggccactggagcctgattcagttcgcaccaacatctgccctttccgggaggacccccgcgctcaccaaaatctgtggcaggctgcacgcctacagttactcactctgcagagctggctacttgacgccccctgctccttacccgccgaagcagccctatgttggcgagcccctggaggtgacccttgccagcccttagtgccccccctgtcttgggagaacgtcacagtggacgtgaattccagcgagaagctgcagctgcaggaatgcctatgggccgactcactcgggcctctgaaggatgacgtcttgctgttggagaccaggggcccacaagataaccggtctctgtgtgccctggaaccatctggatgtaccagtctgccctctaaagcaagtacaagggccgcgcggcttggagaatacctcttacaggaccttcagagcgggcagtgtttacagctttgggacgatgacctcggcgctttatgggcctgtcccatggacaagtatatccacaaaaggtgggcccttgtctggctggcatgtctcctgttcgccgccgcattgtcgctgatcctgctgctgaagaaggatcatgcaaaggggtggttgcgtttactcaagcaagacgttcggagcggcgccgccgcccggggccgggcagccctcttgctctactctgccgatgattcaggcttcgaaaggcttgtgggagccctcgcaagtgccctctgccagctgcctctgcgagtggcagttgatctgtggagccggagagagctttctgcccaagggccggttgcttggttccatgctcagcgcaggcagacgcttcaggaagggggtgttgttgtgctcctgttctcccctggcgccgttgcgctgtgcagcgaatggctgcaggatggagtcagtggccccggagcccacgggccacatgatgcatttagggcctccctgtcatgtgtgttacccgactttctgcaagggagagctcccggttcctatgtgggagcctgctttgacaggctgctccaccccgacgccgtgccagctctgttccgcacagtccccgtgtttactctgccatcccaactgcctgattttctcggggctctccaacagcccagggcccctaggtctggacgcctccaggagcgggccgagcaagtctcgagggcactgcaaccagctctagattcctacttccatccgcccggtacccctgctcccggccgaggagtggggccaggagctggtcctggggccggagatggtacgtag

SEQ ID NO: 120989 - DNA, 2220 bp, Artificial Sequence
  Description of Artificial Sequence: Synthetic coding sequence
atggccccatggctacagctctgcagtgtgttttttacagtgaacgcttgcctgaatggcagtcaactggccgtggcagctggcggctccgggcgcgctaggggagctgacacatgcggatggcgcggagtgggccctgccagccgcaacagcggtctttacaatattactttcaaatacgacaactgtacaacctaccttaaccctgtgggcaaacacgtcatcgctgatgcacagaatatcactattagtcagtacgcgtgtcatgaccaggtggcagtgactatcctttggtctcctggtgctctagggattgaattcctgaaaggctttagagtaatcttagaagaactgaagtccgaaggacgacagtgccagcaactgattttgaaagacccgaagcagctcaactcaagttttaagcggactggtatggagagccaaccctttttgaatatgaagtttgaaactgattactttgttaaagtggtccctttcccgagtattaaaaacgagtccaactaccatcccttctttttcaggacccgtgcctgtgacctcctgctccagccagacaatttggcttgcaagccattctggaaacccagaaatctaaacatttcccagcacgggtcagacatgcaggtttcttttgaccacgccccccacaatttcgggttccgttttttctacttgcactacaaactgaagcacgagggcccctttaaacgcaaaacatgtaaacaggagcagaccactgaaaccactagctgcctgctccagaatgtgagccccggagattatattattgagctggttgatgatacgaacaccacccgaaaggtgatgcattacgccctgaaaccggtgcattcaccctgggccggccccatccgggctgtggctatcactgtgcctctcgtcgttatatccgcctttgctactctttttaccgtgatgtgcaggaagaagcagcaggaaaacatatacagtcacctagacgaagagtcatccgagtcttccacatacactgccgctctcccgcgtgagcggctccggccaagacccaaagttttcctttgctactccagcaaggacggacaaaatcatatgaatgttgtgcagtgctttgcttatttcctccaggacttctgtggctgtgaggtggctctcgatctctgggaagacttctcgctctgccgagagggacagcgcgagtgggtcatccagaagattcacgagtcccagtttatcatcgtcgtgtgctcaaaggggatgaaatattttgtggacaagaagaactacaaacacaagggaggtggcagaggctctggaaagggagagctcttcttagtggccgtctccgcaatagcagagaagttaagacaggcaaagcagtctagttccgctgccctgagcaaatttatcgccgtttacttcgattactcatgcgagggtgacgttccaggcattctggatctgtccaccaagtacaggctgatggataacctcccgcagctgtgcagccatcttcacagccgggaccatggtttgcaggaacccggtcaacacactcgtcagggatcccgaagaaactacttccgctccaaatccggccgcagcctgtatgtggctatttgtaatatgcatcagttcattgacgaggagcccgactggtttgagaaacagttcgtgcctttccatcctcctcccttgcggtacagggaacccgtgctagaaaagtttgatagcgggttagtgcttaatgacgtgatgtgtaagcccggtccagagagcgacttttgtttgaaagtcgaagctgccgttctgggggccaccggcccagcggattctcagcatgagagtcagcacggcgggcttgaccaggatggcgaagctcggccggctcttgacgggtccgctgctttacagcctctccttcacactgttaaggcaggctcgccctcagacatgccacgagactctggtatttatgactcgtctgtgccatcttcagagcttagccttccgcttatggaagggctgagcaccgatcagactgaaacgtcttcattaacagagagcgtatcaagttccagtggattgggcgaagaggagccacccgcactcccatctaaactcttgagtagtggaagttgcaaggcagatctgggatgcaggtcttatacagatgagctccacgctgtggcacctctttag

SEQ ID NO: 120990 - DNA, 1788 bp, Artificial Sequence
  Description of Artificial Sequence: Synthetic coding sequence
atggagagtcagccctttcttaatatgaaattcgagaccgactattttgtaaaggtggtgccttttccgtcaatcaagaatgagtcgaattaccaccccttttttttcagaacacgggcctgcgacctcctgcttcagcccgataacctagcatgtaagcctttctggaagccccggaacctcaacatctctcagcacggaagtgatatgcaggtatcttttgaccacgcgcctcacaatttcggctttagattcttctatctccattacaagctgaagcatgagggtccctttaaacgaaagacatgtaagcaagaacaaaccacagagacgacctcatgccttctgcagaatgtgagcccgggagattacatcatagaactggtcgatgataccaatactacgcgcaaagtgatgcactatgctctcaaaccggtgcactcaccatgggctggtccaatccgcgctgtggccatcaccgttccacttgttgtaatttccgccttcgctactctgttcactgtcatgtgtaggaagaagcagcaggagaacatctactctcacctggacgaagaatcttcagaatccagcacgtacaccgccgccctgccgcgagagcgcctccggcctcggcccaaggtcttcctttgttactccagcaaagatgggcagaaccacatgaacgtggtgcagtgctttgcctatttccttcaggatttctgtggctgcgaagtcgctctcgacctatgggaagattttagcttgtgtagagagggtcagcgcgagtgggtcattcaaaaaatccatgagtctcagtttatcattgtagtgtgtagcaaaggcatgaaatacttcgtcgataagaagaactacaagcataagggcggaggccgtggtagcggcaagggcgaactgtttttagtggccgtgagcgctatcgctgaaaagttgaggcaggctaagcagagctctagcgcagcattaagtaagttcatcgcagtgtactttgactacagttgtgaaggcgatgtgccgggtatcttggacttgagcactaaatatcggctgatggataatcttccccagctgtgctcacacctgcattcaagggatcacggccttcaggagccaggacagcacacacgccagggctcacggcgaaactattttcgctcaaagtccggcagaagcctgtatgtagccatctgtaatatgcaccagttcatagacgaagagccagattggttcgaaaagcagttcgtcccgtttcacccacctccactgcgctaccgggagccagtcttggagaagtttgatagtggcctggttcttaacgacgtcatgtgtaagccagggcccgaaagtgatttttgcctgaaggtcgaggccgccgtgcttggtgcaacaggccctgccgacagccagcatgagtcacagcatggagggctggatcaagacggagaggcccgacccgccttggatgggtccgctgctctgcaacctcttcttcataccgtaaaggccgggtcgcctagcgacatgccaagggatagcggaatttacgacagctctgtcccctcctcagagctgtccttacccttaatggaagggttgtcaactgaccagacagaaacatcttctctgaccgaaagcgtgtctagttcctctgggttgggcgaagaagagcctccagcgctgccaagtaagctgctaagcagcgggagttgcaaagcagacctagggtgtagaagctatacagatgagctacacgccgtcgctcctttgtag

SEQ ID NO: 120991 - DNA, 2148 bp, Artificial Sequence
  Description of Artificial Sequence: Synthetic coding sequence
atgccccgagcaagcgccagcggggtgccagcgctttttgtgagcggagagcagggtgtcggacccgccagcaggaacagtggcctttataatatcacgtttaagtatgacaattgtacaacctacctcaatccagtgggcaagcatgtcatcgccgacgctcagaatattactatcagccagtacgcatgccacgatcaggtggccgtaactattctttggtctccaggcgctctgggcatcgaatttctcaaaggctttcgagtgattctggaggaactaaaaagtgaagggcgccagtgccagcaactgatccttaaggaccccaagcaactgaatagcagcttcaaacgcacaggcatggaatcccagcccttccttaatatgaagtttgaaaccgattatttcgttaaggtggtcccttttccctctattaaaaacgagtcaaactaccaccctttctttttcaggacgcgggcgtgcgatttgctgctacaaccggacaacctcgcttgcaagcccttctggaagcctagaaacctcaatatttcacaacacggctctgatatgcaagtctccttcgaccatgcgccccataactttgggttccggtttttctacttacactataagttgaagcacgaaggtcccttcaagcgcaagacttgcaaacaagaacaaaccacagagaccaccagctgtttgcttcagaatgtgtcaccaggggactatatcatcgagctggtggacgatactaacactacgagaaaggtgatgcattatgccttaaagcccgtgcatagtccttgggcgggccccatccgtgctgtggcaattacagtgccccttgtggtgatatcagcgttcgccacactgtttacggttatgtgccgaaagaaacagcaggagaatatctattcccacctcgacgaagaaagctcggagtcatctacctatactgcagcactacctagggaacggctgcgtccacgcccaaaagtcttcctgtgctattccagtaaagacggtcagaaccacatgaacgtggtgcagtgcttcgcctatttcctgcaggatttctgcggatgcgaagtggccctagacctttgggaagatttctctctgtgccgtgagggtcaacgggaatgggtgatacaaaagatccatgagagccagttcatcatcgtagtctgcagcaagggcatgaagtactttgtggacaagaagaattacaagcacaaaggcggtggccggggatccgggaagggagagttgttccttgtggcagtgagcgccatcgccgagaagttacgacaggccaaacagtcgagttctgcggctctctccaagtttatcgccgtgtattttgattacagctgtgagggggacgttcccggcatcctggacttatcgaccaagtataggctgatggataatctcccccagctatgttctcatctgcatagtagggaccatggtctccaggagccaggacaacacacaaggcagggaagtagacgtaattattttaggagcaagtccggtagatcactctatgtcgctatctgcaacatgcaccagtttatcgatgaggagcccgactggttcgagaaacagttcgtgccttttcacccaccacctcttcgctatcgggaaccagtcttagaaaaattcgatagcgggctcgtgttgaatgacgtgatgtgtaaaccaggacccgagagcgatttttgcctgaaggtcgaagccgctgttctcggggctactggacctgcagatagccagcatgagtcgcagcacggcggactcgaccaggacggagaggcccgccccgcactagacgggagcgcggccttgcagcctctgctccacaccgttaaagccgggtcgccatccgacatgccccgggactcaggcatatatgactcatctgtgccctctagtgaactttccctgccccttatggaaggcctctccaccgatcagaccgaaacttcgtctctcacagagtccgttagtagtagcagcggtttaggtgaagaggagccaccggctctaccgagtaagctcctaagcagcggctcatgtaaagccgacctggggtgtcggtcctacactgacgagctgcatgcagtggcaccactttag

SEQ ID NO: 120992 - DNA, 1788 bp, Artificial Sequence
  Description of Artificial Sequence: Synthetic coding sequence
atggagtctcagccctttctcaacatgaagtttgaaacagattattttgtaaaagtggtcccgtttccttccattaagaatgaaagtaattaccaccctttttttttccgcactcgcgcctgtgatcttctgctgcaaccagataatctcgcatgcaaaccattctggaagcctcgcaacctgaatattagtcagcatggatcagacatgcaagtgtcctttgaccacgccccccataatttcggcttcagattcttttacttgcactacaaactgaagcacgagggccccttcaaacggaagacgtgcaagcaggaacagaccacagagaccacatcatgtctgctgcaaaatgttagcccaggtgactacattatagaattggtggacgataccaatacaacgagaaaggtgatgcattatgccttgaagccagttcatagtccctgggccggacctatccgtgccgtggcgatcactgtcccacttgtcgtaatcagcgcatttgccacactgtttaccgtcatgtgccgaaaaaagcagcaggagaatatttactctcacttggatgaggagtcttccgaaagctctacatatacagctgctctgccacgggagaggcttaggcctaggcccaaggtctttctctgctattctagcaaggacggtcagaatcacatgaacgtcgtgcagtgctttgcatatttccttcaggacttttgcggctgtgaggttgctctcgatctctgggaggacttcagtctctgtcgggaggggcaaagggagtgggtgatccagaagatccatgagagccaatttataatcgtggtttgctcaaagggcatgaagtattttgtcgacaaaaagaactacaaacataagggaggtggcagaggttctgggaaaggagagttattcctcgttgctgtgtcagccatcgccgagaaactgcgacaggcaaaacagtccagttccgcagcactcagcaagtttatcgcagtgtatttcgactattcttgcgagggcgacgtgcctggtatactggacctgtcgacaaagtatcgccttatggataatctgccccagctctgttcgcatctgcactctagagaccatgggcttcaggaaccaggccaacatacccggcaagggtctcgcaggaactatttcagatccaaatctgggaggtccctctacgttgccatatgtaacatgcatcaattcattgacgaggagccagactggtttgaaaagcagtttgtaccttttcatccgcctcctctccgatacagggagcctgtcctcgagaaattcgacagtggcctcgtcctgaacgatgttatgtgcaagccagggcctgagtctgacttttgcctgaaagttgaagcggcagtcctgggcgcaacgggcccagccgacagccagcatgaatcacagcacggcgggctggaccaagatggcgaggcccgtccagccttggacgggtctgccgcgttgcagccactgttacacacggtgaaggctggaagtccctccgacatgcctagagactccgggatatatgacagctccgtaccaagctcagaactcagcctgcctctcatggagggtttgagcaccgatcagaccgagacaagctctctaacagagtccgtcagttcgtcgagcggactcggggaggaggagccgccagctctgcctagcaagctcttgagtagtgggtcatgcaaagcggaccttggatgcaggtcatacaccgacgagctacatgccgttgccccgctatag

SEQ ID NO: 120993 - DNA, 222 bp, Artificial Sequence
  Description of Artificial Sequence: Synthetic coding sequence
atggaatcgcagccattcctgaatatgaagtttgagaccgactactttgtaaaagtcgtcccctttcccagcatcaaaaacgagagcaattatcatccattttttttcagaaccagagcttgcgatcttttgcttcagcccgacaatctggcgtgtaaaccattctggaagccccggaaccttaatatcagtcagcacggttctgatatgcaagtgagctag

SEQ ID NO: 120994 - DNA, 1671 bp, Artificial Sequence
  Description of Artificial Sequence: Synthetic coding sequence
atgggtttttggattctcgcaatcctcactatcctcatgtattctaccgctgctaagttctccaagcagtcatggggtcttgaaaatgaggcgctaattgtgcgatgccctcgtcagggcaaaccaagctacacagtcgattggtactattctcagacaaacaaatccattccaacccaagagcgaaatcgagtttttgcctccggtcagctactgaagtttctgccagctgccgttgccgactctggtatttatacatgtatagttcgatcccctacatttaatagaaccggttacgccaatgtgaccatctacaaaaagcagtccgattgcaacgtacccgactatctcatgtattcaacagtgagtggcagcgagaagaactcgaagatttactgtcccacgattgatttgtataattggactgcaccactggaatggttcaagaattgtcaagctctccagggatcacgatacagggctcataagtcgttccttgttatagataatgtgatgaccgaggatgcaggagattacacctgtaagtttatccacaatgagaatggggctaactatagcgtcacagcgaccaggtcctttaccgtgaaagacgagcagggctttagcctcttccccgtgattggtgctcctgcacagaatgaaattaaagaggttgagatcggcaaaaatgcgaacctgacctgttccgcttgcttcggcaagggaacacagttcctggctgctgtcttgtggcagctgaacgggactaagataacagacttcggagaaccaaggattcagcaagaagagggacaaaatcagtccttttcaaatggccttgcgtgcttggacatggtgctgagaattgccgatgtgaaagaagaagatctcctgctgcaatacgattgcttggccctcaacctgcacgggttgcgacggcacacagtgcgtctgagtcgaaaaaatcctattgaccaccacagtatttactgtattatcgcggtgtgcagtgtgtttctgatgttaatcaatgtcctggtgatcatcctgaagatgttttggatcgaagcaacactgctgtggcgcgacatcgctaaaccctacaagacacggaatgacggaaaactctatgacgcgtacgtggtttatcccagaaactacaagagcagtacagacggtgcatcacgcgtcgaacactttgtacatcaaattctgcctgacgttctggagaacaagtgtggttacaccctctgcatctacgggagagatatgctaccaggggaagatgtggtgaccgcagtagagacaaacattcggaagtccagaaggcatatctttatactcacaccccagattactcataataaagaatttgcctacgaacaggaagtagcgctacactgcgcgctcattcaaaacgatgccaaggtcatcctcattgagatggaggccctgagtgagctggatatgctgcaagctgaggcactccaggacagtctgcagcaccttatgaaggtgcagggcactatcaaatggcgcgaggatcacatcgccaacaaacgctcgttaaattcaaaattttggaagcatgtcagataccagatgcctgtccctagtaagatccccagaaaagcttcttccctgacgcctctggccgctcaaaagcagtag

SEQ ID NO: 120995 - DNA, 513 bp, Artificial Sequence
  Description of Artificial Sequence: Synthetic coding sequence
atgaactgtcgggaattgcccctaacgctctgggtcctcatcagcgtctcgaccgccgaaagttgcactagtcgtcctcatatcaccgtggtggagggagagccattttacttaaagcactgcagctgctctctcgcgcacgagatcgaaaccaccaccaagtcctggtacaagtcatcaggatcccaggaacatgtggagctgaatcctagaagctccagccgcatcgctttgcacgactgtgtcctggagttctggcctgtggagcttaacgacactggctcctacttcttccagatgaagaactacacacagaaatggaagttgaatgtgattcgccgcaacaaacattcttgctttacggagcggcaggttactagcaagattgtggaggtcaaaaagttttttcagatcacctgtgagaattcatattaccagacgctggtgaattcaacctccctctacaagatcggtccacctatttgtaggaagacttctagcggcttgcactag

SEQ ID NO: 120996 - DNA, 1626 bp, Artificial Sequence
  Description of Artificial Sequence: Synthetic coding sequence
atgaattgccgcgaactgccccttaccctttgggtgctgatttccgtaagcacagccgagagttgcactagtagaccccacataacggttgttgaaggcgagcccttctatttgaaacattgcagctgctcactcgctcacgaaatcgaaacgactaccaagagctggtacaaatcatcagggtctcaggaacatgttgagctgaatccacgatctagctcccgtattgctctccatgactgtgtgttagagttctggcctgttgaattaaatgacaccggttcttatttttttcagatgaaaaattacacacagaaatggaaactgaatgtgatcaggaggaataagcacagctgctttacagaaaggcaggttaccagcaagatcgtcgaggtcaagaagttttttcagattacatgtgaaaacagctactaccagaccctggttaattcgactagtttgtacaagaattgtaaaaagttgctcctagagaacaacaaaaatcctactatcaagaaaaacgctgaattcgaagaccagggttattacagttgcgtccattttctgcaccacaacgggaaactgttcaacataactaaaacctttaatataaccattgtcgaggacagatcgaacatcgttcctgtgcttttaggtcccaagctgaatcatgtagcggtggagctgggaaaaaacgttagacttaattgctctgccctgctgaacgaggaagatgtgatctattggatgtttggagaggaaaatggtagcgaccccaacatccacgaagaaaaagagatgcggatcatgacccccgagggcaagtggcatgcaagcaaagtattgcgtattgaaaacatcggtgagagcaatctcaatgtgctgtataactgcaccgtagcgtcaactggtggtacagacaccaaatccttcatcctggttagaaaggcagacatggctgacataccaggccacgtgttcacacggggtatgatcatcgccgtcctcattctcgtggccgtggtgtgtctggtgaccgtctgcgtgatataccgggtagatctcgtgctcttttacaggcacctcactcgtcgcgatgaaacgctgaccgacggaaagacttatgatgcattcgtgtcttaccttaaagagtgtaggcccgaaaatggggaggagcacaccttcgccgtagaaattctgcctcgagtgctggagaagcacttcgggtataaactctgcatcttcgagagggatgttgtaccaggaggggcagtggtggatgagatccacagtttgatagaaaaaagtagacgcctaattatcgtgttaagtaagagctatatgtcaaatgaggtccggtatgagcttgagtctggcctgcacgaagcactggtagaaagaaaaattaaaattatcctgattgaatttaccccagtgactgattttacattcctaccccagagcctaaagctgctgaagtctcatagagtgctaaaatggaaggccgataaatccctgtcctataacagccgattttggaaaaacctcctatacctcatgcccgcgaagaccgtaaaaccggggagggatgagcccgaagtcctgcccgtcttgtccgagtcttag

SEQ ID NO: 120997 - DNA, 1626 bp, Artificial Sequence
  Description of Artificial Sequence: Synthetic coding sequence
atgaattgcagagagcttcctctgacactgtgggtcctcattagtgtgtcaaccgccgaatcatgtacatcgcgcccacatataaccgtggtggagggggagcctttttacctgaagcactgctcatgctcgctcgcgcacgagatcgaaaccaccactaagagctggtacaaatcgtccgggtcccaagaacatgtcgagctgaatccaaggtcctccagtcggattgcgttgcacgattgcgttctcgaattttggccagtcgaattgaatgatactgggtcctatttttttcagatgaagaactatacccagaaatggaagctgaatgtaatccgccgcaacaagcactcctgctttacggagcggcaggttaccagcaagattgtggaggttaagaagttctttcagattacatgcgagaatagttactaccagaccctggtgaacagcacgtccctgtataaaaattgcaaaaaacttctgctcgagaacaataagaatcccacaatcaagaagaatgccgaattcgaagatcagggctattacagctgcgtgcactttctccaccacaatgggaagctcttcaatataacaaaaacttttaacatcactatagtagaggaccggagcaatattgtcccagtgctgcttggccctaagctcaatcacgtagccgtggagctggggaaaaatgtaagactgaactgttctgcgctcctgaatgaggaggacgtgatttactggatgttcggagaggaaaatggcagcgatccaaatatccacgaggaaaaagaaatgagaataatgacaccagagggaaagtggcacgcctcaaaggtgctgcgaatagagaacataggagaaagcaacctgaatgtgctctataattgcaccgtggccagtactggaggaacagacacaaaaagctttatcctggttagaaaagcagatatggccgatattccaggccacgttttcacgcgcggtatgattatcgcagtgctcatcctcgtcgcggtagtatgtctggtgacagtctgcgtgatttaccgcgttgatcttgtcctgttttaccggcacctgacacgacgagatgagactctcacagatggtaaaacctatgatgccttcgttagctacctgaaagagtgtcggccagagaacggagaagagcacacattcgccgtagagattctcccccgcgtcctggagaaacattttgggtacaaactgtgtattttcgagagggatgtggttcctggcggggctgtggtcgatgaaatccactcactgattgaaaagtcccgacgacttattatcgtgctgtctaagtcctatatgtcaaacgaggttaggtacgaactggagagcgggcttcacgaagcactcgtggagcgaaaaatcaagataatcctgatagagtttaccccagtgaccgacttcacattcctcccccagagtcttaagctcttgaaaagtcacagggtgctgaaatggaaggcggacaaaagcctctcgtacaactctaggttttggaaaaatctactctatctcatgcctgccaaaacagttaagccaggccgcgacgaacctgaggtgttgcccgtgttatccgagagctag

SEQ ID NO: 120998 - DNA, 1800 bp, Artificial Sequence
  Description of Artificial Sequence: Synthetic coding sequence
atgctctgcctaggatggatcttcctttggctggttgccggggagcgaatcaagggattcaacataagcggatgttctacaaaaaagctgctctggacttattcgacaagatccgaggaagaattcgtgctgttctgcgatcttcccgaacctcagaaaagccacttctgccaccgaaatagactgagccccaaacaggtgcctgaacacctcccattcatggggtcgaatgatttgtccgatgtgcaatggtaccagcaaccttcgaatggcgaccccctggaagacatcaggaaatcttacccacatattattcaagacaagtgcactttacattttctgacaccaggcgtgaacaattcaggaagttatatctgccgaccaaagatgatcaagagtccatatgacgtcgcatgctgcgttaaaatgattcttgaagtgaaaccacagacaaatgcaagctgtgagtattccgctagccacaagcaggacctgttgctgggtagcaccgggtcaatctcttgcccgagccttagctgccaaagcgacgcgcaatctcctgcggttacctggtataagaatggtaaactcttgagcgtggagagatcgaatcggatagtcgtggatgaggtgtacgactatcaccagggcacctatgtatgcgattatacccagtccgacactgtttccagctggaccgtgcgggctgtcgtgcaagtgcggaccatagtgggagatactaagctaaaacctgatattctggaccctgtcgaagacacactggaagtggaactgggaaagccccttaccatatcctgtaaagcccggtttggctttgaacgagtgtttaacccagttatcaagtggtatatcaaagactcagatctcgaatgggaggtctccgtaccagaggctaagtcgatcaagtcaactctgaaagacgagatcatcgagcggaatattatactggagaaagtaacacaaagagacttgagacgaaaattcgtgtgctttgtccagaacagcatcggcaacacaacacagtcagtgcagctgaaggaaaaacgtggcgtggtgctattatatatcctgttgggcaccatcggtacgttggtggcagtcttagctgcttccgcgctgctgtatcggcactggatcgagatcgtgctcctgtacaggacttatcaaagcaaagatcaaacactcggagacaagaaggacttcgacgctttcgtgagttatgctaagtggagcagttttcccagcgaggcgaccagctctctatctgaggaacatctcgctctttctctctttccagacgtcctggagaataagtatggttattctctgtgcttgttggaacgcgatgtcgcgcccggtggtgtgtacgcagaggacatcgtttcaatcattaaacggtcaaggcgcgggatctttatcctcagtcccaactacgtgaacgggccgtcgatttttgagctccaggccgccgtaaacctggccctggacgaccaaactctgaagttgatcctcatcaagttctgctacttccaagaaccggaaagcctgccacacctggtcaagaaggcactccgtgtcctgccaacagtcacttggaggggcctcaagtctgtccctcccaactctagattttgggccaagatgagatatcatatgcccgtcaagaattcccagggattcacctggaatcaactccggatcacttccagaatattccaatggaaaggcctgtccaggacagaaacaactgggcggagtagtcagcctaaagaatggtag

SEQ ID NO: 120999 - DNA, 1374 bp, Artificial Sequence
  Description of Artificial Sequence: Synthetic coding sequence
atgatcctcgaagtcaaaccccagactaatgcctcgtgcgagtactcagcttcccacaagcaggaccttttgctaggatcgactgggtccattagttgcccttctctctcctgtcagtcagacgcgcaatctcccgctgtgacatggtataagaatgggaagctgttgagtgtggaaagaagcaaccggatagtggtcgacgaggtatacgattaccaccaagggacatatgtgtgtgattacactcaatctgacaccgtcagcagctggacagttcgggctgttgtgcaggtgcggaccattgtcggagacacgaagctgaaaccagatatcctggatcctgtagaagatacattggaagtggagctcgggaaacccttaaccatttcctgcaaggcccgatttggctttgaacgcgtcttcaaccccgtcatcaaatggtatataaaggatagtgacttggaatgggaagtttcagtgccagaagcaaagagcattaaaagcacgctgaaggatgaaattatcgagcgcaatatcatcctggagaaggtgactcagagggacctgagacgaaagttcgtttgtttcgtacagaatagcatcggcaataccactcagtctgtgcagttaaaggagaaacgcggcgttgtcctcctctatatcctgctgggaacaatcggtaccctagtggccgtcttggctgccagtgccttgctgtataggcactggatcgagatagtgcttctttaccggacataccagagcaaagaccaaacccttggagataagaaggacttcgatgccttcgtgtcttacgctaagtggtcgtccttccccagcgaggccacctccagcctgagcgaagagcatctggcccttagcctcttccccgacgtgctggagaataagtacgggtactctctgtgcctgcttgagagggacgttgcgcctgggggggtgtatgccgaggacatcgtcagcatcatcaagaggagccgtcgaggaatcttcattttgagccccaattatgtaaatgggccctccattttcgagttacaagcagccgtgaacctggccttggatgaccagactcttaagctgatactgatcaagttttgttactttcaggagcccgagtcccttcctcatctggtaaaaaaggctttgcgagtgctgcccactgtcacctggaggggactgaagagcgtgcctcctaacagcagattctgggctaaaatgcgctatcatatgcctgtcaagaacagccagggcttcacgtggaaccagctgcgtattacctcccggatatttcagtggaagggactgagcagaactgagaccacaggtcgatcttctcagcctaaagagtggtag

SEQ ID NO: 121000 - DNA, 135 bp, Artificial Sequence
  Description of Artificial Sequence: Synthetic coding sequence
atgttatgcttgggctggattttcctctggctcgtcgcaggagagcggattaagggttttaatatttctggttgttccactaaaaagctgctgtggacctatagcacgcgatctgaggaggagttcgtgctgtag

SEQ ID NO: 121001 - DNA, 534 bp, Artificial Sequence
  Description of Artificial Sequence: Synthetic coding sequence
atgaaattacaatgtgtgagcttatggctgttgggcaccatactgatcttgtgctccgtggataatcacgggctccgaagatgtctgatctccacggacatgcaccacatcgaggaaagcttccaggagattaaacgagcaatccaggcaaaagataccttcccgaacgtgacaatcttgagcacactcgagaccctgcagataatcaagcctctggatgtttgctgcgtaacaaagaatctattagccttttacgtggatcgcgtgttcaaggaccaccaagagcccaatccaaaaattctccgcaagattagcagtattgcaaacagctttttgtatatgcagaaaaccctccgtcaatgccaggaacagcggcagtgccattgtcgccaggaagccacaaacgctaccagggtgattcacgataattatgaccagttagaagttcacgctgccgccattaagagtctcggtgaactagacgtttttctagcgtggataaataagaaccacgaggttatgttttcagcttag

SEQ ID NO: 121002 - DNA, 648 bp, Artificial Sequence
  Description of Artificial Sequence: Synthetic coding sequence
atgtgcactgaaggggcctttccccatcgtagtgcgtgctctctgcctcttacccatgtgcatactcacatccatgtttgcgtgcctgtgctttggggctcagtcccaagggggatgaaactgcagtgtgtgagcctttggcttctaggcacgatcctcatcctgtgcagtgtagataatcacggtctcagacggtgtctgattagcactgatatgcatcacattgaggaaagtttccaggaaataaagcgggcgatccaggccaaagatactttcccaaacgtcaccatcctctcaacattggagacattgcagattataaaaccactcgacgtgtgctgcgtgacgaagaacctacttgctttctatgtcgaccgggtcttcaaagaccatcaggagcctaaccccaagatactcagaaaaattagttccatagcaaattccttcctgtacatgcaaaagactcttagacagtgccaagaacagcgtcagtgtcactgcaggcaggaggccacaaacgccaccagagtgattcacgataactacgaccagctggaggtgcacgctgctgcaatcaagagtttgggagaactggatgtctttctggcatggatcaataagaaccatgaagtcatgttctccgcgtag

SEQ ID NO: 121003 - DNA, 792 bp, Artificial Sequence
  Description of Artificial Sequence: Synthetic coding sequence
atggactcttatttactaatgtggggcctgctgactttcattatggtgcccggttgccaagcagaactgtgcgacgacgatcctcccgagatccctcacgcaaccttcaaggccatggcctacaaggaagggacgatgcttaactgcgaatgcaagcggggtttccgcagaataaagagcggcagcttgtatatgctatgtaccggaaacagctcccatagctcttgggataaccagtgccagtgtacttcctcagctactcgaaatactactaagcaggtgacacctcaaccagaagaacagaaggagcggaaaacgaccgagatgcaaagcccgatgcagcccgtggaccaagccagtctgccaggccactgtcgcgagccccccccgtgggagaacgaagctaccgaaagaatttatcattttgtggtgggtcagatggtgtattaccagtgcgtgcaggggtacagagcccttcaccgcggaccagcagagagcgtgtgcaagatgactcatggcaagacgcgatggacacagccccagctcatttgtacaggtgaagaaaagcctcaggcttccccggaaggacggcctgaatctgagacgtcttgtcttgtcacaacaactgactttcagatacagaccgagatggccgccacaatggaaaccagcatatttaccactgaatatcaggtggcagtagctggctgcgtcttcctgcttatctcagtcctgctactcagtggtctcacctggcagagaaggcaaaggaaatcaagacgtacgatttag

SEQ ID NO: 121004 - DNA, 603 bp, Artificial Sequence
  Description of Artificial Sequence: Synthetic coding sequence
atggattcctaccttcttatgtggggtttgttgacattcattatggtgcctggctgtcaagccgagctgtgcgacgacgatccacccgaaatccctcacgccaccttcaaggcgatggcttataaggagggtacaatgctcaattgtgaatgtaaacggggctttcggaggataaagagcgggtctttatacatgctatgtacgggaaattcatcgcattccagctgggataatcaatgccaatgcactagttccgcgaccagaaacactacaaaacaagttactccccagccagaagagcagaaggagaggaagacgaccgagatgcagtctcctatgcagcctgtggatcaggcctccctacccggagaggagaaaccgcaagctagccccgagggccgtccagaatcagagacatcctgtcttgtcacgaccacagactttcagattcagacagagatggcagcaactatggagactagtattttcactacggaatatcaagtagccgtcgcagggtgcgtgtttctcttgataagcgtacttctgttgtcagggctcacatggcagagaaggcagaggaaaagccgcagaaccatctag

SEQ ID NO: 121005 - DNA, 819 bp, Artificial Sequence
  Description of Artificial Sequence: Synthetic coding sequence
atggattcttatctgctcatgtggggtctcctgacatttatcatggttcccggctgccaggccgagttgtgcgacgacgatccacccgagattccccacgcaacctttaaagctatggcatataaggaaggcaccatgctcaattgtgaatgcaagcgcgggttcaggaggatcaaatccggaagcctgtacatgctttgcacggggaacagttctcattccagctgggacaaccagtgccagtgtacttccagtgccacaaggaacaccacaaaacaggtcaccccccagccagaggagcaaaaggagcgaaagacaacagagatgcagagtcccatgcagcccgttgatcaggcatctttgcccgggcactgccgagagccaccgccctgggaaaatgaggccacggaacgtatttatcacttcgttgtggggcagatggtatattatcagtgcgtgcaaggctatagggctctgcaccgaggccccgccgaaagtgtttgtaagatgactcacggaaagacacggtggacacagccgcagctgatatgtaccggcgagatggagacatcacagttccccggggaagaaaagccacaggcttcgcccgaaggcaggccagagagtgagacatcgtgtctggtcactactacagattttcagatccagacagagatggctgcaacaatggagacttctatattcacaaccgagtatcaagttgccgtggctggttgcgtctttctcttgatttctgtactgctgttatccggactgacttggcagagaaggcagaggaagtcacgccgaaccatatag

SEQ ID NO: 121006 - DNA, 489 bp, Artificial Sequence
  Description of Artificial Sequence: Synthetic coding sequence
atggtgcccggttgtcaagcagagctgtgcgatgatgacccaccagagattcctcacgcgaccttcaaggcaatggcttacaaagagggaacgatgctaaattgcgaatgcaagcggggcttccgcagaattaaaagtggctcactgtacatgctgtgcaccggaaactcctcccatagtagctgggacaaccaatgtcagtgcacctctagtgctacccgaaacaccacgaagcaggtcacacctcagcccgaagagcagaaggaaagaaaaaccaccgaaatgcagagtccaatgcaacccgtggaccaggctagcctccctgattttcagatacagacagagatggcagctacgatggagacgtcaattttcaccaccgagtaccaggtggccgttgcaggatgcgtgtttttactgatctcggttctgctgcttagcggactgacttggcagcggaggcagcggaagagcaggagaacaatatag

SEQ ID NO: 121007 - DNA, 330 bp, Artificial Sequence
  Description of Artificial Sequence: Synthetic coding sequence
taaataccgcatgccaccttcaaagctatggcttataaagaaggaactatgcttaactgcgagtgtaaacgcggattccgaaggattaaatccggctctctgtacatgttgtgcactggtaacagctcgcactcatcatgggataaccaatgtcaatgcacctcctcagccactcggaataccaccaaacaagtaaccccacagccggaagagcagaaggagagaaaaactaccgaaatgcaatccccaatgcagcccgttgatcaggcttctctcccagattttcagatccagacggagatggctgcaacaatggagacttctatatag

SEQ ID NO: 121008 - DNA, 1110 bp, Artificial Sequence
  Description of Artificial Sequence: Synthetic coding sequence
atggatcctcgcaaggtgaacgagctgagagcctttgtgaagatgtgtaagcaggatccctctgtgctgcacaccgaggagatgcggtttctgagagaatgggttgagtctatggggggcaaggtgcccccagccacacaaaaagccaaaagcgaggagaacaccaaagaggagaaacccgactcgaagaaagtcgaggaggacctgaaagctgatgaacccagtagtgaggagagtgacctggagatcgataaggagggcgtcattgagccagacactgatgccccacaggagatgggggatgaaaacgcggagataaccgaagagatgatggatcaggccaatgacaaaaaggttgccgccatcgaggctttaaacgacggtgaactgcagaaagcaattgatcttttcaccgacgccatcaagctgaacccacgcctagcgatcttgtatgccaagcgggcctccgtatttgtcaagctgcaaaaacccaatgccgccatcagagattgtgatcgcgcgatcgaaataaatcccgatagtgcacagccctataagtggaggggaaaagcccaccgcctgcttggccactgggaggaggctgcacacgaccttgctctagcctgcaagctagattacgatgaagatgccagtgctatgttgaaagaggtgcagccgagagcacaaaagatcgcagagcatcgaaggaagtatgagcggaaaagggaagagagggaaataaaggagcgtatcgagagggtgaagaaggccagggaggaacatgagcgtgctcaaagggaggaagaagcccgcagacagagcggtgctcaatatggctccttcccgggcggatttcccggggggatgcccggtaatttccccgggggcatgcctggtatgggcgggggaatgccgggcatggcagggatgcccgggctgaatgagatcctgagcgatccggaagtgttggcagcaatgcaagacccagaggttatggtagcattccaggatgtcgcccagaaccccgcgaatatgtcaaagtaccagagtaatcccaaggtaatgaacttaatctccaaactgtcggcgaaattcgggggccaggcttag

SEQ ID NO: 121009 - DNA, 441 bp, Artificial Sequence
  Description of Artificial Sequence: Synthetic coding sequence
atggcggctcccgccctatcttggcgcctgccattgctcatcttgcttttacccctggccactagttgggcctctgcagccgtcaatggcacatcccagtttacctgcttttataactctagagccaacatctcctgtgtatggtctcaggatggggctctgcaagacaccagttgtcaggttcacgcgtggcctgatagaaggcggtggaaccagacctgtgaactgttgcccgtgtctcaggcaagctgggcctgcaatttaattctgggagcacctgattcacaaaaacttaccactgttgatatcgtgacactgagagttctttgtagagagggtgtacgctggcgcgtgatggctattcaggatttcaaaccttttgagaatctccgactgatggctcctatttctctgcaggtcgtacacgtggaaacacactag

SEQ ID NO: 121010 - DNA, 267 bp, Artificial Sequence
  Description of Artificial Sequence: Synthetic coding sequence
atggctgcaccagccctgagctggcgtctgcccctgcttatactccttctgccgctggccacctcatgggcttccgccgccgtgaacggtactagtcagttcacttgtttctataattctagagcgaacatatcctgtgtctggagccaggacggtgctctgcaagacacctcttgccaggtgcatgcttggccggacaggagaaggtggaatcagacctgcgagttactgccagttagccaggcctcgtgggcatgcaatctgtag

SEQ ID NO: 121011 - DNA, 567 bp, Artificial Sequence
  Description of Artificial Sequence: Synthetic coding sequence
atggccgcccctgcactaagttggagacttcctctgctgattctcctgctgccactcgcgacctcatgggctagcgccgctgtcaacggcaccagccagtttacctgcttttacaattcgcgggctaacatttcatgtgtttggtcgcaggatggagcgctgcaggacacctcctgtcaggtacacgcatggccagatagaaggcggtggaaccagacctgtgagctcctccctgtttctcaagcgtcttgggcctgtaatctcatcctgggagctcccgactctcagaaattgactactgttgacatcgtcaccttgcgcgttctctgcagagaaggggtcaggtggcgggtgatggcaatccaagatttcaagcccttcgaaaatctgcggctcatggcaccaatcagtctgcaggtcgtgcacgttgagacacacaggtgcaatataagctgggagatttctcaggccagccactacttcgagaggcatctggaattcgaggcacgcacactttccccaggccacacctgggaggaagccccattgctgacactcaagcagtag

SEQ ID NO: 121012 - DNA, 297 bp, Artificial Sequence
  Description of Artificial Sequence: Synthetic coding sequence
atggaaccacccaatccacttggggagcagtacttcaaacgtacaatgccaaggatacctacactgaaaaatttggaagatctcgtgacggaataccacggcaactttagtgcttggagtggggttagtaagggactggctgagtctctgcagcccgattactctgagcgcttatgcttggttagtgagatcccccccaagggtggtgcccttggtgagggcccgggggccagcccatgcaatcagcactcaccttattgggctcctccgtgctatacgctcaagcctgagacctag

SEQ ID NO: 121013 - DNA, 474 bp, Artificial Sequence
  Description of Artificial Sequence: Synthetic coding sequence
atgctcaaaccttcactcccttttacgtcacttctgttcctgcagttgccccttctgggggtgggcttaaacaccacgattctcactcccaatgggaacgaggacacgacagctgactttttccttacgacaatgcccacggattctctatcggtaagtaccctccccttgccagaagtacaatgtttcgtcttcaatgtcgagtacatgaattgtacctggaattcctcgtcagagcctcagcccactaaccttacattgcactactggtacaaaaatagcgataatgacaaggttcagaaatgctcacactatcttttttcagaagagataactagcggatgccagctgcagaaaaaagagattcacctgtaccagacctttgtggtgcaactccaggacccacgggaacccagaaggcaggccactcagatgctcaaattgcagaatcttggcacgatttctgggctgtag

SEQ ID NO: 121014 - DNA, 1110 bp, Artificial Sequence
  Description of Artificial Sequence: Synthetic coding sequence
atgctgaaaccctccttgccgttcacatctctgctgtttctgcagctcccactgttaggcgtaggacttaacactactatcctgactcccaacgggaacgaagacactactgctgatttcttcttaaccacaatgcctacggacagcctctctgtctcaacactacctctccccgaagttcagtgtttcgttttcaatgtggagtatatgaactgtacatggaattcatcgagtgaaccccagcccactaacctcaccctccactattggtataagaactccgacaatgacaaagtgcagaaatgctcccattatctcttctctgaagaaattacctccggatgtcagctccaaaaaaaggaaattcacctctaccagacgttcgtggtccagttacaagacccgcgagagcctagaaggcaagcaacccaaatgctgaagctccaaaacttagttataccctgggccccagaaaatctgacactgcacaagctgagcgaatcgcagttagaattgaactggaacaatagattcctcaatcattgcctcgagcatctggtgcagtaccgcaccgactgggatcactcctggaccgagcagtcagttgattatagacataagttctcactgccgtccgtggatggccagaagcgatacacatttcgggttaggtcccgctttaatccactctgtggcagtgctcagcattggtcggagtggagccatcccatccattgggggtcaaatacatccaaggagaatccttttctgttcgctctggaggccgttgtaatctccgttggaagcatgggcctgattatctcattactgtgtgtctacttctggctggagaggactatgccaagaatacccaccctgaaaaacctagaggacctggtcacagaataccatgggaattttagtgcctggtcgggggtgtctaagggcctcgccgagtccctgcagcccgattactccgaacggctgtgcctggtgagcgagattccccctaagggcggcgccctgggcgaaggcccaggggcttccccatgcaaccagcactctccatattgggctccaccttgttatacccttaagccagaaacatag

SEQ ID NO: 121015 - DNA, 540 bp, Artificial Sequence
  Description of Artificial Sequence: Synthetic coding sequence
atggggatgaaaacgccccagttggaacaaagcgtggactacaggcacaaattctccctcccgagcgtcgatggtcagaaaagatatacatttcgagttaggtcgagattcaacccgttgtgcggttcagcccagcactggtctgaatggagtcaccccatccactggggcagcaatacgtctaaggaaaacccttttctgtttgccctagaggccgtagtgatatcagtcggaagcatgggactgatcatctcactgctgtgtgtgtacttttggttggagagaacaatgccaagaatcccgacgctaaagaatttggaggatctggttacagagtatcacggcaactttagcgcctggagcggcgttagcaagggacttgccgaatcacttcagccggattactctgagcgactgtgtctcgtgtcagagatccccccaaaaggaggagccctgggagagggccccggggcttcaccatgcaatcagcactctccttattgggcccccccttgctacacactgaagcctgaaacatag

SEQ ID NO: 121016 - DNA, 1662 bp, Artificial Sequence
  Description of Artificial Sequence: Synthetic coding sequence
atgagggcacctgggcgacccgctctgcggccactgccactgccccctctcctgctgcttctgctcgcggccccttggggccgagcagtgccttgtgtgtccgggggtctccctaagcctgctaacattactttcctgagtattaatatgaaaaacgtcctccagtggacgccgcccgagggacttcaaggagtgaaagtgacctataccgtgcagtactttatctatggacagaagaaatggctgaacaagagtgaatgtcggaacatcaataggacttactgcgatcttagcgccgagacctcagactacgagcaccaatactatgccaaagttaaggctatttggggtacaaagtgttcaaagtgggcagagtcagggcgcttctatcctttcttggagacccagataggcccacccgaggtagccctgaccactgacgagaaaagtatctcagtggtcctcacagcacctgagaaatggaaaagaaaccccgaagatctgcccgtctcgatgcagcagatttattcgaatctgaagtataacgtaagcgtactgaatacaaagtcaaaccgcacctggtcccaatgcgttaccaatcacactctggtgttgacatggctggagccgaacacactatattgcgtgcatgtggagtcctttgtgcccggtcccccccgacgcgcccagcccagcgagaaacagtgcgcaaggaccctgaaagatcagtcaagtgagtttaaggctaagattatcttttggtatgtcctccctgtatctataactgtatttctgttttctgtgatgggatactccatttacaggtacatccatgttggcaaagagaagcaccccgccaatctgatccttatctacggcaatgagttcgacaagcggttttttgttcctgccgaaaagatcgttattaatttcataacgctgaacatcagcgatgacagcaaaatttcacaccaagatatgtcccttttgggtaagagtagcgatgtcagttcattaaacgacccccagcccagcgggaacctacgcccgccccaggaagaagaggaagtgaagcaccttggttacgcatcacacttgatggaaattttctgcgattccgaggaaaataccgagggcacaagcctgactcaacaggagtccctatctcgtaccataccccccgacaaaaccgttatcgagtacgaatacgatgtccggactactgacatctgtgcaggccccgaagagcaggagctcagtctgcaggaagaggtgtctacacagggtacccttttagaaagccaggctgcgttagctgtgctgggtccccaaacactgcaatactcgtacactccacagctccaggacttggatcctctcgcccaagagcatacggacagcgaagagggcccagaggaagaaccctcaaccacgttggtggactgggacccgcagacaggcagactctgtatcccctctctcagtagcttcgatcaggattccgaggggtgtgagccttccgaaggcgacggcctgggagaagaaggcctgttgagcaggctctatgaagaacctgccccagaccgaccacctggggaaaatgagacctacttgatgcaatttatggaggagtggggattgtacgtgcagatggagaactag

SEQ ID NO: 121017 - DNA, 630 bp, Artificial Sequence
  Description of Artificial Sequence: Synthetic coding sequence
atgagagcacctggaagacctgccttaagaccgctgccccttcccccattattattactactgttagccgccccctggggtcgggctgtcccttgcgtgagcggtgggttaccaaagcccgccaatatcacctttctgtccatcaatatgaagaacgtgttgcaatggacccctccagaaggactgcaaggtgtgaaagtcacatacactgtccagtattttatctacggccagaaaaagtggctaaataagagcgagtgccgcaatatcaaccgcacatactgtgatctttcagctgaaacttctgactacgagcaccagtactatgctaaggtgaaggctatatggggaacaaagtgctctaaatgggctgaatccggcagattctacccgttcctggagactcagatcggacctccagaagtggctctgactactgatgaaaagagcatctccgtcgttcttacggcccccgagaaatggaagcgcaaccccgaagatctgcccgtgtcaatgcagcagatctattctaacctaaaatataacgtgagtgtgcttaatacaaaaagtaataggaccgtttccctgaagtggaatggcgcctacatacacgtacctctatgctcctag

SEQ ID NO: 121018 - DNA, 1329 bp, Artificial Sequence
  Description of Artificial Sequence: Synthetic coding sequence
atgtcttataatggcttacatcagagggttttcaaagaacttaaactgctcaccttatgctcaatcagcagtcaaattgggcctcctgaagtggccctcaccacagatgaaaaaagtatttccgtagttttaacagctcccgaaaaatggaaacgaaatccggaggacttacctgtgtccatgcagcagatctattccaacctgaagtacaacgtgtctgtgctgaacacaaaaagcaataggacgtggtctcaatgtgttaccaatcatacactcgtgcttacatggctggagcccaatactctgtactgcgtccatgtagaatcatttgttcccggccccccgagacgggcgcagccctccgaaaagcagtgcgccagaacgctcaaagatcaatcctccgagttcaaagccaagatcattttttggtatgttctgcccgtgtcgatcacagtattcttgtttagtgtgatgggatacagcatttataggtacattcatgtggggaaggaaaaacaccccgctaacttgatactcatttacggcaatgagttcgacaaacggttctttgttccggcagagaagattgttattaactttattacactgaacatcagcgatgactccaaaatatcccaccaggatatgtctctgcttggtaaaagttccgacgtcagtagtcttaatgatccacaaccctctggcaacttgcgaccgccacaggaggaggaggaggttaaacacttgggttacgcttcccacttaatggaaattttttgcgattctgaggagaacaccgagggaacctcactcacccagcaggagagcctatccagaacaatccccccagataagacagtgatcgagtatgagtatgatgtccggaccactgatatctgcgccgggcccgaggagcaggagctgtctttgcaggaagaagtgtctacacagggcacactgttagagtctcaggccgccctggccgtcctcggcccccagaccctccaatactcatatacgcctcaattgcaggatctcgatccgctcgctcaggagcacaccgattcggaggagggcccagaggaggagccttcaacaaccctcgttgattgggatccacagaccggccgcctgtgcatcccttccctgtccagtttcgatcaggactcagagggctgcgagccctcagagggagacgggcttggggaggaaggtttacttagccgactctatgaggagcctgctcctgaccgtccaccaggtgaaaatgagacttatttgatgcagttcatggaggagtggggcctgtacgttcagatggaaaattag

SEQ ID NO: 121019 - DNA, 1515 bp, Artificial Sequence
  Description of Artificial Sequence: Synthetic coding sequence
atgaagaatgtgctgcagtggacgccgccagagggactccagggggtaaaagtgacctataccgtccagtattttatttacggacagaaaaaatggttaaacaaatccgagtgccgcaatatcaatagaacctactgcgacctgagcgctgagaccagcgactacgaacatcagtattacgctaaggtgaaggctatttggggaactaagtgctccaagtgggctgaatccgggcggttctatcctttcttagagacccaaattggacctcccgaggtcgcactgacgacagatgaaaaatctatttctgtagttcttaccgctcccgaaaagtggaaacggaatcccgaagacctgccggtgtctatgcagcagatttatagcaatttgaaatacaacgtcagtgtgcttaatactaagtctaacaggacctggtctcaatgcgtcactaaccacaccttggttttaacatggctggagcccaatactctttattgtgtgcatgtggagtcattcgtgcccggcccccctcgccgagctcagcctagcgagaaacaatgcgccagaaccctcaaggatcagagcagtgaattcaaggcaaagataatcttctggtatgtcctccccgtgtctatcactgttttcctgttttccgtcatgggatattcaatttaccgctatatccatgtcggaaaggagaaacatccagccaacctgatcctgatttatgggaatgaattcgacaagcgcttctttgtgccagccgagaaaattgtgattaactttatcactctcaatatctcagacgattcaaagatttctcaccaggacatgtccttgttaggcaaaagttctgacgtaagcagcctgaatgacccccagccctccgggaatcttcgaccacctcaggaagaggaagaggtcaaacaccttgggtatgctagccacttgatggaaatcttttgcgatagtgaggaaaacactgaaggtacatctctgacccaacaggaatccctgagccgcacaatccctcctgacaaaactgtaattgagtacgagtatgacgtgcgcactactgacatctgtgcaggtccggaggaacaggaattgtccttacaagaggaggtcagcacgcagggaacgctgctggaatctcaagctgcactggcggttctcggcccccagaccctgcaatattcctatacacctcagctgcaggacctggaccccctggcccaggagcacaccgactcggaggaaggacccgaagaagagccgtctactactctggtagattgggatcctcaaactggccgcctgtgcatcccctccctgagttcctttgaccaggattcagagggctgtgaaccgtctgagggagatgggctgggggaagaaggtctgctgtcacggttatatgaggagccagcccctgatcgtccgcctggagagaatgagacctacttgatgcagtttatggaagagtgggggctctacgttcagatggagaactag

SEQ ID NO: 121020 - DNA, 1617 bp, Artificial Sequence
  Description of Artificial Sequence: Synthetic coding sequence
atgccccgagggtgggctgcacccctgctgctgcttctgttgcagggcgggtggggctgccctgacctggtgtgttatacagactatctgcaaacagtaatttgcattctggaaatgtggaatctgcatccaagtacgctcactctgacctggcaggaccagtacgaggagttgaaagatgaggctacatcttgctcacttcataggtcagcccataatgctacccatgccacgtatacctgccatatggatgtgtttcattttatggcagacgatatcttcagtgtcaacattactgaccagtccggtaattattctcaggagtgcgggtcattcctgttggcagaaagtattaagcctgcacctcccttcaatgtcacggtgactttttccggacagtataacatttcttggcgctccgattatgaggaccctgccttttatatgttgaagggcaagctgcagtatgagctacaataccggaataggggggatccctgggccgtctcgcctcgcagaaaactcatttctgttgactctcgctccgtgtccctcttgcctctggagtttcgaaaggactccagctatgaactccaagtgagagcaggtcccatgcctggtagcagttaccaaggaacttggagcgagtggtccgacccggtgatctttcagacccaaagcgaagaactcaaagaaggctggaacccccacttgctacttctcctgttgttggtaattgtctttataccagctttttggtccctgaagacccatcccctgtggagactgtggaagaagatatgggcagtgccttctcctgagagatttttcatgcccttgtataagggctgcagcggagatttcaagaagtgggtgggggcccccttcacggggagctcgttagagctaggtccgtggtcacccgaggtcccatcgacattagaggtgtatagttgccatccgcctagaagtcccgcaaagaggctccagctgaccgagttgcaggaacctgccgaattagtggaatcggatggcgtgcctaaacccagtttttggccaacagctcagaactcaggcgggtcagcttacagcgaggagcgggacagaccgtatggattggtgagcatcgacaccgtgaccgtgctcgacgcagaaggtccttgtacgtggccctgttcttgtgaggacgatggctacccagcattagacctggatgctggtctggaaccaagccccggacttgaggatccccttttggacgctggcaccacagtactctcctgtgggtgtgttagtgctggaagtcctggattaggaggacctctcggcagcctcctggatcggctcaaacccccgctggctgacggagaggattgggcgggcggactgccttggggagggcgtagccctggaggcgtttccgagtctgaagctggctcgcctctagccggcctcgacatggacacattcgactcgggatttgtgggaagtgattgcagtagcccagtagagtgtgatttcaccagccctggagacgagggcccaccgcggtcctacttgagacagtgggttgtgatacccccacctttgtcttcacctggccctcaggcatcctag

SEQ ID NO: 121021 - DNA, 1617 bp, Artificial Sequence
  Description of Artificial Sequence: Synthetic coding sequence
atgccaaggggttgggccgcccctttgctgctgttactactgcagggtgggtggggctgccctgacttagtgtgctatacggactatctccagacggtgatctgcatcctcgagatgtggaatctgcacccgtcgaccctgacgctgacctggcaagaccaatatgaggaacttaaggatgaagccacaagttgcagtcttcacaggagtgctcataacgctacacatgctacttatacttgtcatatggatgtctttcacttcatggcagacgacatcttctccgtgaacattactgaccaatcaggcaattactcccaggagtgtggctccttccttctcgctgaatcaattaaacccgcacctcctttcaatgtaactgtgactttttccggacaatataatatctcatggaggtcagactacgaagatcctgccttctacatgttaaaggggaagttacaatacgaattacagtatcgcaaccgcggagacccttgggccgttagcccgcggcggaagctgatctctgtcgattctcgaagcgtctcgttgcttccgctagagttccgcaaggattcctcctatgagttgcaggttagagccggacctatgccaggatcctcatatcaagggacttggtctgaatggagcgacccagtcatttttcaaacacaatcggaggaactgaaggaaggatggaacccccaccttctactgctgcttcttctggtcatcgtctttattcctgcattctggagtttgaaaacacaccctttgtggagactttggaagaagatttgggctgtgcccagccccgaaagattcttcatgcctctctataaaggctgctcaggggatttcaaaaaatgggtcggcgcaccatttaccggcagttcgttagaactcggcccgtggtcacccgaggtgccctctactctcgaagtatactcctgtcatcccccccggtcgcctgctaaaaggctccagctgaccgagctgcaagaacctgcagagctggtcgaaagcgatggtgtgccgaaaccaagtttttggcccaccgctcagaactcaggcggaagcgcctactcagaagagagggatcgcccatacggtctggtttcaatcgataccgtaaccgtgcttgacgcagaagggccttgcacatggccgtgttcctgtgaagatgatggttatccagctctagacctggacgctggactggaaccgtctccaggtctagaggatcccctgctagacgcaggcacgacggtcctcagctgcgggtgcgtgtccgctggcagcccaggtcttggcggtccactcggcagtctccttgacagactgaagccacctctggcagacggcgaggactgggcgggcgggttaccgtggggaggccgctcccccgggggggtgtctgagtcagaggcaggaagcccactggccggcctcgatatggacacattcgattccggttttgtaggaagcgactgtagctcgcccgttgagtgtgattttacaagtcccggggacgaaggcccacctaggtcctacctgaggcagtgggtagtgattccaccaccactcagctctccagggccacaggcttcctag

SEQ ID NO: 121022 - DNA, 1617 bp, Artificial Sequence
  Description of Artificial Sequence: Synthetic coding sequence
atgccccggggctgggcagcccctttattattactgctgcttcagggtggctgggggtgccccgacctcgtctgctatactgattacctccagaccgtcatctgtatcctggaaatgtggaatctgcatccgtcaactctgaccctaacatggcaagaccaatatgaggaattaaaggatgaagcgacgtcatgttctctgcatcggtctgcacataacgcaacccatgccacatatacctgccacatggatgtctttcatttcatggccgatgatatcttttctgttaacattaccgaccagtctggcaactatagtcaggaatgcggctccttcctgctcgctgagtctatcaaacccgcacctccatttaatgttactgtgacatttagtgggcagtacaacatttcctggcggtccgactacgaggatccagcattttacatgctcaaggggaagttgcagtatgagttgcagtaccggaataggggagatccgtgggcagttagtcctaggcgcaaactgatctctgtggatagccggtctgtctcactgttaccactggaattccggaaggacagctcttacgaactccaggttagagctggccccatgccagggtcaagctatcagggtacgtggtccgagtggtccgaccccgtcatattccagactcaaagcgaagagctcaaggaaggctggaaccctcacctgctgcttctcttgctcctcgtgattgtgttcatccccgccttctggagtttgaagacccatcccctgtggcgcctctggaagaaaatctgggcagtaccatccccagagcgcttcttcatgccgttatacaagggttgtagcggcgatttcaaaaagtgggtcggcgcaccattcacaggcagttctcttgagctgggcccctggagcccagaggtgccatcaacattagaagtgtactcttgtcacccgcctaggtctcctgcaaaacgcctgcaactgactgagctccaggaacctgccgaattagtggaatccgacggtgttcctaaaccatctttctggccgacagcccagaacagtggcggatccgcctacagcgaggaaagagaccggccatatgggttggtgagtatcgataccgttaccgtattagatgccgaagggccctgcacttggccttgttcttgtgaggatgatggatacccggcactggatctggacgcaggtctggagccctctccaggactggaggacccactattggatgcagggacaaccgtgttatcttgtgggtgtgtctcagcaggtagtccgggactcggaggccctttggggtcgttactggaccggttgaaacccccattggcagatggcgaggactgggcaggcggtctgccatggggtggccgctcccccggcggggtgagcgagtcagaggcggggagcccactggccgggttagatatggacacattcgacagtgggttcgtggggagtgattgctcttcgccagtggaatgcgactttaccagtccaggcgacgagggtccccctagatcctaccttagacagtgggtggtgatccctccgcctctgtcctccccagggccacaggcatcatag

SEQ ID NO: 121023 - DNA, 792 bp, Artificial Sequence
  Description of Artificial Sequence: Synthetic coding sequence
atgatgccaaaacactgtttcctgggattcctgatcagcttcttccttactggcgtggcaggaacacagtcaacacacgagagcctcaagcctcagcgcgttcaattccagtctagaaacttccacaacatattgcagtggcagcctggacgagcacttacgggaaactcaagcgtgtactttgtgcagtacaagatcatgttctcttgtagcatgaagtcaagccaccagaagccctctggctgttggcaacacatttcctgtaactttcccggctgtaggaccctggcgaagtatggacagcgtcaatggaaaaataaagaggactgctggggaacacaggagctctcctgcgacctgacatctgagacctccgacattcaggagccatattacggacgtgtgcgggctgcttccgcagggtcttatagtgagtggagcatgacccctcgctttacaccttggtgggaaactaaaattgatccccctgtcatgaatattacccaagtgaatggtagcctcctggtcattctgcacgctcctaacttaccatacagatatcagaaagagaagaacgtctcaatcgaggattattacgagctcctgtaccgggtgtttattatcaacaattctctggaaaaggaacagaaagtttacgagggcgcacaccgtgccgtggagatcgaggccctgaccccgcattctagttattgcgtcgtggcagagatatatcagcccatgcttgatagaagatctcagagatctgaagagaggtgtgtggaaataccctag

SEQ ID NO: 121024 - DNA, 393 bp, Artificial Sequence
  Description of Artificial Sequence: Synthetic coding sequence
atgatgcccaaacattgcttcttgggtttcctaatcagcttttttctcaccggcgtggctgggacccagagtacccacgaaagcctgaaaccccaacgcgtgcagtttcaatcgcgcaacttccacaacattttgcagtggcagccaggtagagcccttactggcaactcatccgtctatttcgtccagtacaaaatatacgggcagagacaatggaagaataaggaggattgctggggcacacaggaactgtcttgcgacctgacttcggagacctctgatattcaggagccgtactacggccgagttagggccgcaagtgctgggtcatattcagagtggtccatgacacctcggtttacaccttggtgggagagggcaaagggtctctag

SEQ ID NO: 121025 - DNA, 696 bp, Artificial Sequence
  Description of Artificial Sequence: Synthetic coding sequence
atgatgccaaaacattgttttctcggcttcttgatcagcttttttctaactggggtcgcaggcactcagtccactcacgaatcactgaaaccgcaacgcgtgcaatttcagtcccgcaactttcataacattcttcaatggcagccagggagggctctcacaggaaatagctctgtttatttcgtgcaatataaaatatatggccaacgacagtggaagaataaggaggattgttggggaactcaagaactttcctgtgacctcacctccgaaacatcagatatccaggagccgtattatgggcgtgtgagagctgctagcgcaggaagttactcggaatggtccatgacaccacggtttaccccctggtgggagaccaaaattgacccgccagtgatgaatatcacacaggttaacggcagcctgctggtgatcctgcacgccccaaacctcccttaccgctaccagaaggaaaagaacgtgagtatcgaggattattatgagcttctgtaccgggtttttataatcaacaactctctcgagaaggaacaaaaggtttacgagggcgcccatcgtgcagtcgaaatagaggcactcaccccgcatagcagttattgtgtagtcgctgaaatctatcaaccaatgctcgacaggcgctctcagaggtcagaagagaggtgtgtagagattccttag

SEQ ID NO: 121026 - DNA, 1563 bp, Artificial Sequence
  Description of Artificial Sequence: Synthetic coding sequence
atggcaggtcccgaacgctggggtcccctcctgctgtgtcttttgcaggctgcccctggccgcccccgcttagcgccaccgcagaatgtcacgcttctatcacagaactttagtgtgtacctgacatggctgcccgggctggggaatccgcaagacgtaacctattttgttgcctatcagtccagccccacacgcagacggtggcgtgaggtggaagaatgcgccggcactaaggagctgctgtgctcgatgatgtgtctgaagaaacaggacctatataataagttcaagggccgtgttaggacggtgtcacccagctccaaatcaccctgggtggaatccgaatacctggactacctgttcgaagtggaacccgcaccaccagtcctggtgctgacccagacggaagaaattctctccgcaaacgctacttaccagcttcccccctgtatgccgcccctggatcttaagtacgaggtcgcattctggaaggagggcgccgggaataaaaccctgttccctgtcacgcctcacggccagccagtgcaaatcactctccagccagctgctagcgagcaccactgcctcagtgcgcggacgatttatacgtttagcgtaccgaaatacagcaagttcagtaagcctacatgctttctcctggaagttcccgaagcaaattgggcattcctggtcctgccaagcctcctgattttactgcttgtgatcgccgctggcggcgtgatctggaaaaccctcatgggaaacccttggttccagagagccaagatgccccgcgccttagacttttcagggcacacacatccagtggctaccttccagccctcccgccccgaatcagtaaacgatcttttcctgtgtcctcagaaagagctgaccaggggagtgaggcccacgccgagggttcgcgctcctgcgacccagcagactcgttggaaaaaggatcttgcggaagacgaggaggaagaggacgaggaggataccgaggacggggtctccttccagccatatatcgaacccccttctttccttggccaggaacatcaggcaccgggccactcagaggcaggtggagtggattccggacggccccgcgcacctctggtaccatctgagggtagcagcgcatgggattctagcgatcgctcatgggccagtacagtggacagtagttgggacagggcaggctcctctggttatctcgctgagaagggaccaggacagggccccggcggcgacggtcaccaggagtcacttccccccccagaattcagtaaagactctgggtttctggaggaactcccagaggacaatctctcttcctgggctacttggggaaccttgcctcccgagcccaatctagttcccggaggtcctcctgtgagcctacagaccttaaccttttgttgggagagttccccagaggaagaggaggaagctagagagagcgagattgaagacagtgacgcaggaagctggggcgcggagagcacacaaaggacagaagaccgcggaaggacgctcggccactacatggctcgatag

SEQ ID NO: 121027 - DNA, 735 bp, Artificial Sequence
  Description of Artificial Sequence: Synthetic coding sequence
atggctggccccgaacgttggggtcctttactgctatgtttgttgcaggccgcacctggccgccctagattggctcctcctcaaaatgtgacccttctgtcccagaacttttccgtctatttgacttggcttcccggtctgggcaatccacaggacgtgacatatttcgtggcctatcagtcatccccaacacgcaggcggtggcgcgaggtcgaggagtgtgccgggaccaaagagctcctctgttccatgatgtgtctcaaaaagcaagacctgtataataaatttaagggaagagtcagaactgtgtccccttcatctaagtccccatgggtcgagtcagaatacttagattacctgtttgaggtagaacccgcaccgccagtcctggtgctgacccaaactgaggagattctatctgcgaacgctacttaccaacttcccccttgcatgccacctcttgatctcaagtatgaagtcgccttctggaaagaaggggccggaaataaaactctgttccctgttacccctcacggtcagccggtacagattactctgcagccagccgcttccgaacatcactgcctgtcggcccgaacgatctacacattctctgtacccaagtattctaaattctctaaacctacgtgctttctgctggaggttcccggcctgttctggactcatacaccatgcggaaacttgtctgcacaacagacccgcgtcagggagtag

SEQ ID NO: 121028 - DNA, 636 bp, Artificial Sequence
  Description of Artificial Sequence: Synthetic coding sequence
atggccggaccagagagatggggccccttgctgttgtgtctgttgcaggccgctccaggaagaccgcgccttgcgccccctcagaacgtgaccctccttagtcaaaacttcagcgtgtacctgacttggctgccgggactcgggaatccccaggatgtaacctattttgtcgcctaccagtccagtcccactcgccgccgctggcgagaagtagaggagtgtgctggaaccaaggaactgctatgttccatgatgtgccttaagaagcaggacctctacaacaaatttaagggcagggttcgcaccgtctcaccttcaagtaagtccccatgggtggaaagtgagtacttggactacctgtttgaggtcgaacctgcccccccagtcttagtcttaacacagactgaagagattctaagcgcaaacgctacctaccagctgccgccatgcatgcctcctctagatctcaaatacgaggttgcattctggaaggaaggggccggaaataaggtgggatctagcttccctgcccctcggctgggtccgctgttacacccctttctattacgatttttttcacccagccaacctgcgcctgctcccttgcttcaggaggtattccccgtccactcgtag

SEQ ID NO: 121029 - DNA, 558 bp, Artificial Sequence
  Description of Artificial Sequence: Synthetic coding sequence
atgatgtgcctgaagaagcaagacctgtacaataaatttaagggccgggtgcggacagtctcacccagcagtaaatcgccttgggtcgagtcagaatatctggattatctgttcgaagttgagcctgcccccccagtgttggtattgacccagacggaggaaattctatcggcaaatgccacctaccagctgcccccatgcatgcccccactcgacctcaagtacgaggtggctttttggaaagagggggcgggcaataaaacactctttcccgtgactccgcatggacagcccgtgcagatcaccctgcagccagcggcctctgaacatcattgtctgtccgcgaggactatttatacattctcggtaccaaaatacagcaaattcagcaagccgacctgtttcctgctcgaagtgcccgaggcaaactgggccttcctcgtgttgccttccttgttaattctgctgttggtcatcgcagctggcggcgtgatatggaagactctgatggggaatccctggttccaacgcgccaagatgcctcgcgcacttgtttag

SEQ ID NO: 121030 - DNA, 1476 bp, Artificial Sequence
  Description of Artificial Sequence: Synthetic coding sequence
atggctggcccagagcgctggggtcctctattactatgcctgctccaggcagcgcctggcagacccaggcttgctcccccacaaaacgttacattgctgagtcagaacttctccgtgtatttaacctggctgccgggcctggggaaccctcaggacgtgacatactttgtagcctatcagtcctcccctacccgcagaaggtggcgcgaagtcgaggaatgtgccggtacgaaagaactcttgtgttccatgatgtgtctgaagaaacaggacctctataataagttcaagggccgggtgagaacagtgtctccgagttctaagtccccctgggttgaatctgaatacttagattatctgttcgaagtggaaccagccccacctgtcctcgttttgacccagactgaagaaatcttgagtgctaacgctacctatcagcttccaccttgcatgccacccctggacctgaagtacgaagtcgcgttttggaaggagggagctggtaataagacactattcccagtgacgccccacggtcagccggtgcaaatcacgcttcagcctgcggcctctgagcaccattgcctgagtgctagaacgatctatacattctcagtccctaagtactctaaattcagcaagcctacctgttttttgctggaggtgccagaggcaaactgggcatttttggtgctcccttcgctgctgatcctgctgctcgtgattgcagccggcggtgtgatctggaagactctcatgggtaatccttggtttcagagggcaaagatgccaagagctcttgagctcacacggggagtgcggcccacgcctagggtgcgagctcccgcaacacaacaaaccagatggaagaaggacctggcggaggatgaagaagaagaagatgaggaagacacagaagatggcgtgtctttccagccttacatcgaaccaccttctttccttggccaagaacatcaggcaccaggacactccgaggccggaggcgtcgatagtgggaggccgagagccccattggtgccctcagaagggtcgagcgcctgggattcaagcgaccgctcctgggcttccaccgttgatagctcttgggatcgggctgggagttccggctacctggccgagaagggaccaggccagggcccaggtggggatggccaccaggaatctctgcccccccctgagttcagcaaagacagcggatttctggaggagcttccggaggacaacttatcaagctgggccacttggggcacgctgccccccgaacctaatttggtacccggcggcccacccgtgtctctgcaaacactcaccttctgttgggaaagcagtccggaagaggaggaggaagccagggaatccgaaattgaggactccgatgccggaagctggggcgccgaatctactcagcggactgaagatcgggggcgcaccctaggacactacatggccagatag

SEQ ID NO: 121031 - DNA, 459 bp, Artificial Sequence
  Description of Artificial Sequence: Synthetic coding sequence
atgagccgactgcctgtgctgttactgctccaactgctggtcagacctggactccaggctccaatgacccagactacccccctcaagacctcttgggtaaactgtagcaatatgattgacgagatcattacacacctgaaacaacccccactgccactcctcgactttaacaacctcaatggggaggaccaggacatactgatggagaataatcttcggcggccgaacctagaagcgtttaatagagcagttaagagtctccagaatgctagcgcgatagagtcgattctaaagaatctgttgccctgtttgcccctggccactgctgcccctaccaggcatcccattcatattaaggatggagactggaacgagtttcgcagaaagctgaccttctacctcaaaactctcgagaatgcacaggctcagcaaaccactctgagccttgccatattctag

SEQ ID NO: 121032 - DNA, 1137 bp, Artificial Sequence
  Description of Artificial Sequence: Synthetic coding sequence
atggtgctactatggctgacactgctgctgatagcgctcccttgcctgcttcagacaaaagaggacccaaatccccccatcacaaacctccgtatgaaggctaaagcccagcagttgacctgggacctgaaccgcaacgtgacagatattgaatgcgtcaaagatgctgattacagcatgcccgccgttaataactcttattgtcagtttggggccattagcttatgtgaggtaaccaattataccgtcagagtcgcgaatccgcctttcagcacttggatcctttttcccgagaacagcgggaagccatgggccggtgcagagaatctgacatgctggattcacgatgttgatttcctatcgtgttcctgggccgtgggccccggggcccctgccgacgtccagtacgatctgtacctgaatgtcgcgaataggcggcaacaatacgagtgcctgcattataagaccgatgcacaaggcactcgcattgggtgtagattcgatgatatctctcggctctcctcgggaagccagtcctcccacatcctagtcagaggtaggtcagctgcatttgggatcccttgcactgacaagttcgtcgtgttcagccagatcgaaatcctgacgcctccgaacatgactgctaagtgtaataaaacacattcttttatgcactggaaaatgcgctcccattttaacagaaagtttagatacgagctgcaaatccaaaagcgaatgcagccagtcataaccgagcaagtgcgcgaccggaccagctttcaactcctgaatccggggacgtatactgtccagatccgagcacgagaaagagtgtatgaatttctgtccgcctggtccactcctcaacggtttgagtgtgaccaggaggagggcgcaaacacccgtgcctggcgaacatcccttctcatagcattggggactctcctcgccctggtttgcgtgttcgtaatctgtaggagatatcttgtgatgcagcgcctgttcccccgtatccctcacatgaaggatcccatcggggactccttccagaacgataaactcgttgtttgggaggctggcaaagcgggattggaggagtgtctggtaaccgaagtgcaggtggtacagaagacatag

SEQ ID NO: 121033 - DNA, 903 bp, Artificial Sequence
  Description of Artificial Sequence: Synthetic coding sequence
atggtgctgctgtggctgacactgctgctaattgccctgccttgccttctgcagacaaaggaaggtggtaagccctgggcaggtgctgagaatctgacatgctggattcacgatgtggacttcctttcttgcagttgggccgttggccctggtgcccccgcagacgtgcaatacgacctctacttgaacgtggccaataggcgtcagcaatatgaatgtttgcactacaaaacagacgcccaaggcactagaatcggttgtcgctttgatgatattagtagacttagctctggcagccagtcctcgcacatcttagtacgcggccggtcggctgccttcggtatcccgtgtactgataagtttgtggtgtttagtcaaatcgagatcctgacaccgccaaatatgaccgctaagtgcaataaaacccattcttttatgcattggaaaatgcgctctcactttaaccggaaatttagatatgagctccaaatccagaagaggatgcaaccagtaattaccgagcaagtccgagatcgcacctctttccaacttcttaaccctgggacgtacaccgttcagattagagcgagagaaagagtgtatgagttcctgagcgcatggtctaccccccagaggttcgagtgtgaccaggaggagggggctaataccagggcatggcgaacctccctgttaattgctctgggaaccttattagccctggtgtgtgtttttgtgatttgtcgtcgctacctagtcatgcagcggctgtttccccggataccgcatatgaaagatcctattggcgatagcttccagaatgacaaactcgttgtatgggaggcaggtaaggcggggctggaggagtgcctggttactgaggtccaggtcgtccagaaaacctag

SEQ ID NO: 121034 - DNA, 495 bp, Artificial Sequence
  Description of Artificial Sequence: Synthetic coding sequence
atggtactgctttggctgaccctcctactcattgcactgccctgccttctgcagaccaaagagggcgggaaaccatgggctggggcggagaacctcacgtgttggattcatgacgttgattttttatcctgttcttgggcagttgggcctggcgctccagccgacgttcaatatgacctgtacttaaacgtggccaatcgaagacagcaatatgagtgcctccactacaagactgatgcccaagggactcgtattggttgtaggtttgacgacatatccagacttagttctggcagccagagcagccatatcctcgttcgcgggaggagtgcagcattcggtattccgtgtaccgataaatttgttgtgttttcacagatcgagatcttgactccccctaatatgaccgcgaaatgcaacaaaacccactcattcatgcactggaaaatgcggtctcacttcaaccgtaaatttcggtacgagctccagatctag

SEQ ID NO: 121035 - DNA, 1323 bp, Artificial Sequence
  Description of Artificial Sequence: Synthetic coding sequence
atgacatattggcggctggaaaatatcgctaaaaccgaacctccgaaaatattccgcgtcaaacccgtgcttgggataaagagaatgatccagattgaatggatcaaaccagaactggctcccgtctcatctgacttaaaatacacactgcgctttcgtacggttaattcaaccagctggatggaagttaacttcgccaaaaataggaaagacaaaaaccaaacttataatctgacagggctccagcccttcacagaatacgtgatagccctgagatgcgccgttaaagagtctaagttctggtctgactggtcccaagagaaaatgggaatgacagaggaagaggcaccttgcgggttggaactgtggcgcgtcctgaagcccgctgaggcagacggtaggagacctgtccgcctattatggaaaaaagctagaggagccccagtccttgaaaaaacactaggctataatatctggtactaccccgagagcaacacaaatctcacggaaaccatgaacacgactaaccaacagctagagctgcacctcggtggcgagtctttctgggtaagcatgatatcatataactcactgggaaaaagtcccgtggcaaccttacggattcctgccatccaagaaaaaagcttccaatgcattgaagttatgcaagcatgcgtggctgaggatcagttggtggtcaaatggcagagttcagccctagacgtcaacacctggatgattgaatggtttccggacgtggattctgagcctactacactcagctgggagtcagtgagtcaggccaccaattggaccatacagcaggacaagctgaagcccttctggtgttacaacattagcgtgtatccgatgctgcacgacaaggtaggagaaccctactccatccaggcatacgctaaggagggggtcccctccgaggggccagaaacaaaggtcgagaacataggtgtgaagaccgttactattacatggaaggagattcctaagagtgagaggaagggaatcatttgcaactacacaatattctaccaggctgaaggcggtaaagggttctgcaaacacgctcactccgaggtggaaaagaatcctaaaccccaaattgacgccatggatcggccggtggtgggtatggcccccccatcacattgcgacctgcagccagggatgaaccacctggcgtcactgaatttaagcgaaaacggagcaaagtccactcatctcctcggattctggggcctgaatgaatctgaggtgaccgtcccggagcggcgagttctgaggaagtggaaggagctgctgtag

SEQ ID NO: 121036 - DNA, 1989 bp, Artificial Sequence
  Description of Artificial Sequence: Synthetic coding sequence
atgaagctctccccacagccttcttgcgtcaacctgggtatgatgtggacttgggcattatggatgcttccttccctgtgcaagttctcccttgccgcattaccagctaagccagaaaatatcagctgtgtgtattactaccggaagaacctcacctgcacttggtctccaggcaaggagaccagctacacgcagtatacggtgaaaaggacatacgcttttggagaaaagcatgataactgcactacaaactcctcgacatctgagaacagagctagctgttccttctttctgcctaggatcaccatccctgataactatacaatcgaggtggaggcagaaaacggagatggcgtaattaaatctcatatgacgtattggaggttggagaatattgccaaaactgagccacctaagatctttcgtgtgaaacccgtgcttggcattaaaagaatgatccagatagaatggattaaaccagagttagcgcctgtttccagcgacctgaagtacacactgcggtttagaactgtcaattctacaagttggatggaagtgaactttgcaaagaacaggaaggataagaatcaaacctacaacctcacgggcctacagccctttaccgagtatgtgattgccctgcgctgcgccgtgaaggagagcaaattctggtccgattggtctcaggagaagatgggtatgacagaagaagaggccccttgtggcctcgagctctggagagtgctcaagccagctgaagcagacggtcggaggccggtgaggctactgtggaagaaagcccgaggagccccagtgctggagaagacactgggttataatatctggtactatcctgagagtaataccaatttgacagaaaccatgaacaccacaaaccagcagcttgaactccaccttgggggcgagtccttttgggtgtcgatgatttcgtataatagtctcggcaagtccccagtggctacccttcgcattccagccattcaagagaagtctttccagtgcatcgaggtgatgcaggcatgtgttgctgaggatcaactcgtcgtaaagtggcaaagcagtgccttggacgtaaatacctggatgatcgagtggttcccagatgtggacagcgagccaacaaccttgtcttgggagagtgtgtcccaagcgacaaactggaccattcagcaagataaacttaaaccattttggtgctacaatatcagtgtctaccccatgctccatgataaagtcggcgaaccatactccatccaggcatacgctaaggaaggcgtgcctagcgaaggcccagagaccaaggtcgagaatattggtgtgaaaaccgtcacaataacctggaaagagatccctaaaagcgagagaaaagggatcatctgtaactacacaatcttctatcaggccgaaggcggcaaaggcttcagcaagaccgtaaattcaagcatcctgcagtacgggctggagtccctcaagcggaagacgtcctatatcgtgcaggttatggcaagtacctcagcaggtggtaccaacggcacaagcatcaattttaaaactttatcattctccgtattcgagattattcttattacttcactgatcggaggtggcttgttaattctgatcatcctaaccgtggcttacgggctgaagaagccgaacaagcttactcatttatgttggcccaccgtacctaatccagccgaatcgtccatagcaacctggcatggtgatgacttcaaggataaacttaaccttaaagagtccgacgactccgtgaacactgaggataggattctgaagccctgctccactccttccgacaagcttgtgatcgacaaattagtggtgaattttgggaacgtactccaggagatcttcaccgatgaagctcgaaccggccaggaaaataatctgggaggcgaaaaaaatgggactcgaatcctctcctcctgtcctaccagcatctag

SEQ ID NO: 121037 - DNA, 2046 bp, Artificial Sequence
  Description of Artificial Sequence: Synthetic coding sequence
atgtgcatccggcagttgaaattttttaccacggcctgtgtatgcgagtgccctcagaatatcctgtccccccagcccagctgtgtgaacctggggatgatgtggacttgggccctgtggatgctgccatctctctgcaaatttagcctggcagctctccctgctaaaccggagaacattagttgtgtttattattatcgcaagaacctgacctgcacatggtcgcccggcaaagagacatcctatacgcaatatacagtcaagcggacttatgcctttggcgagaagcatgacaattgtacaacaaattctagcacaagcgagaacagggcctcatgttcatttttcctgcctaggattactatccccgataattacacgatcgaagttgaagccgagaacggcgacggcgtcattaagagccacatgacttactggagattggagaatatcgccaagactgagccaccaaagatcttccgagtgaaaccggtgctgggtataaagagaatgatccaaatcgaatggatcaagcccgagctagcacccgtaagttccgacctcaagtacacccttagatttcgcaccgtgaattcgacttcctggatggaggttaatttcgccaagaacagaaaggataagaatcagacctacaaccttacaggtttacagccatttacagagtatgtcatagctttaaggtgtgctgtcaaggagagcaaattttggagtgattggagtcaggagaaaatgggaatgaccgaggaagaagcaccatgtgggttggaactctggcgagttcttaaacctgctgaagcggatggcagacgccccgtccgcctgctttggaagaaagcccgcggggcacctgtgctggagaaaacactgggttacaacatttggtattatccagaatctaacactaacctgactgagaccatgaatactactaatcagcagctggagttgcatcttgggggggaatctttttgggtcagtatgatcagttacaactctttgggaaaaagcccagtcgccaccctgcggatccccgctatccaggaaaaaagtttccagtgtattgaagtaatgcaggcctgtgttgcggaggatcagctggtggtgaaatggcaaagttccgctctcgacgtgaacacttggatgatagaatggttccctgacgttgatagtgaaccgacaactttgtcttgggagtcagtttcacaagcgaccaattggacaatacaacaggataagttgaaaccattctggtgttacaatatcagcgtgtaccccatgctgcatgacaaggtcggcgagccctattccatacaggcatacgcgaaggaaggagtaccttctgaggggccagagaccaaggtggagaacattggagttaagaccgtgacgattacatggaaggagatccctaagtcagagcgcaaaggcataatctgtaactatactatcttttatcaagctgagggcggcaaaggattcagcaaaaccgtgaatagttctattttacagtacggtttggagtccctcaagcgcaaaacctcatatatcgtacaggtgatggcctctacctcggccggtgggaccaatggtacctccatcaatttcaaaactctaagcttttccgtgttcgagatcatactgatcacctccctcatcggaggaggccttctgatactgattatcttaacggtagcatacggcctgaagaaacctaacaagttgacgcatctgtgctggcctaccgtgccgaaccccgccgagtctagcattgccacttggcatggagacgattttaaagacaaactgaaccttaaggagagcgacgacagcgttaacaccgaagatagaatccttaagccctgctcaacccctagcgataagctcgtgatagacaaacttgtcgtgaacttcggcaacgtcctacaggagatctttaccgacgaggctcggacaggccaggaaaataacttaggcggcgagaagaatgggacaagaatcttgtcctcatgccctacttctatatag

SEQ ID NO: 121038 - DNA, 1989 bp, Artificial Sequence
  Description of Artificial Sequence: Synthetic coding sequence
atgaaactgtcaccgcagcccagctgtgtcaatctgggaatgatgtggacatgggctctgtggatgcttccaagcctgtgtaagtttagtctcgccgcccttcccgccaaacctgagaatattagttgtgtctactactatcgcaagaacctgacgtgcacgtggtcgcctggcaaggagactagctatactcagtatactgtgaaaaggacatacgccttcggcgagaaacatgacaattgtaccacaaacagtagtacctccgagaatcgcgcaagctgtagctttttcctcccaaggattacaattcccgataactacacaatcgaagtggaagcagaaaacggagatggagtcatcaagagccatatgacttactggaggctggaaaatattgcgaagaccgaacccccgaagattttcagggtgaaacctgtactcggaatcaagaggatgatacagatcgaatggattaagccagaactcgcaccggtgagtagcgatttaaaatacacccttaggtttagaacagtgaatagcacttcgtggatggaggtcaattttgctaagaataggaaggacaagaatcagacgtacaatctcacaggtttacagccattcactgagtatgtcattgcccttagatgcgctgtgaaagagtcaaagttctggtcagattggtcccaggaaaaaatggggatgacagaggaggaagccccatgtggactcgagctgtggcgggtactcaaaccagctgaggcagacggacggagacctgtcagactcctttggaaaaaggcaaggggggcccctgtgttggagaagacactgggatacaacatctggtactatccggaatctaacaccaatttgacggagactatgaacacaaccaaccagcagcttgagctccacttgggtggcgaaagcttctgggtctctatgatatcttacaactccttgggaaaaagccctgtagccactttgaggattccagctattcaggaaaaaagcttccaatgtatcgaggtgatgcaggcctgtgtcgctgaagatcaattggtggttaaatggcagtcttctgcactcgatgtcaacacttggatgatcgagtggttccccgatgttgattccgagcccaccaccctctcctgggaaagcgttagccaggcgacgaattggaccattcagcaggataagctgaagccgttctggtgctataatatctccgtgtaccccatgctgcatgataaggtgggcgagccctactccattcaggcctacgccaaggaaggcgttccaagtgaaggcccggagacaaaggtggagaacattggcgtcaaaaccgtgacaataacctggaaggaaatccctaaaagtgaaaggaagggaattatctgcaattacactatattctaccaggccgaagggggcaaggggttttccaagaccgtgaatagcagcatcctgcagtatggtctcgaatccttgaagagaaaaacgtcttacattgtgcaggtgatggcttccacgtccgccggcggcacaaatggcacttccataaattttaagaccctgagcttttcagtttttgaaatcattctgatcacaagccttattgggggcggactgctgatcctcatcatcctgactgtggcatacggccttaagaagcctaacaagctgacacacctgtgttggcccactgtgcccaaccctgctgaatcttcaattgccacttggcatggggatgacttcaaagataaactgaatttgaaggaatccgacgactccgtgaacacggaggataggattctgaagccttgctccacgccgtctgacaagctggtgatcgataagttggtggttaatttcggcaatgtgctgcaggaaattttcaccgatgaggccaggactgggcaggaaaacaatttaggcggtgaaaagaatggcacacgaatactgtcaagctgtccaacgtcaatctag

SEQ ID NO: 121039 - DNA, 1749 bp, Artificial Sequence
  Description of Artificial Sequence: Synthetic coding sequence
atgtgcattcggcagctgaagttcttcacaaccgcatgcgtatgcgagtgcccacagaacatcctcagcccccagccatcttgcgtgaaccttggaatgatgtggacctgggccttgtggatgctgccctcgctgtgcaagttctcactggcggctcttcctgcaaaaccagaaaatatcagctgcgtgtactattatcgcaagaacctgacttgcacctggtcccctggcaaggaaacttcctatacacagtatactgtgaaaaggacatacgccttcggtgaaaagcatgataattgcactaccaacagtagcacatctgagaaccgcgcctcttgttccttctttctgcccagaataactattccagataattacaccatagaggtcgaggcagaaaatggagacggggtaatcaaatcacacatgacatactggaggctggaaaacatcgctaagaccgaacctcctaagattttccgcgtgaaaccagttctgggcattaaacggatgattcaaatagagtggattaaaccagagttggcacccgtgtccagcgacctgaaatacactctgcgtttcaggaccgtaaacagtactagctggatggaggtcaattttgcaaaaaaccggaaggacaaaaaccaaacatacaatctgacaggcctccaacccttcaccgaatacgtgattgccttacggtgcgcagtaaaggagtcaaaattttggtccgactggtcccaagagaagatgggaatgacagaggaagaggccccatgcggactagaactatggcgcgttttgaaaccggccgaagctgacggcaggcggccggtgaggttgttgtggaagaaggcgaggggtgcccccgtacttgagaagaccctgggctacaatatctggtactatccagagtcaaacactaatctgactgaaacaatgaataccacaaatcaacagctggagcttcacctcgggggtgagtctttctgggtgtcaatgatcagctataactctttaggtaagagtccggttgccacactccgaatcccggccatccaggagaagtcgttccagtgcatcgaggttatgcaggcctgcgtggcggaggaccaattggtcgtgaagtggcagagctcagcccttgacgtgaatacttggatgatcgaatggttcccagatgtcgactctgaaccgactacactctcatgggaaagtgtctcgcaggctaccaactggacaattcagcaggacaagttgaagccattttggtgctataatatcagcgtatatccaatgttgcacgacaaagtcggtgaaccctactcaatacaggcctacgcgaaggagggggtgccctccgaaggcccagaaacaaaggtggagaacatcggtgtgaaaaccgtcaccattacttggaaagaaatccctaagtcagagcgcaagggcatcatttgcaattatactatcttttatcaggctgagggcgggaagggcttttgtaagcacgcacatagcgaggtggagaaaaaccccaagcctcagatcgacgcgatggacagaccagttgtggggatggcgccaccttctcattgtgatctgcagccaggtatgaaccacctggcatcactcaaccttagcgagaacggggcgaagagcacacatctgctgggtttttggggtctcaacgaatcagaggtcaccgtccctgaacgccgcgtgctacgcaaatggaaggagctcttgtag

SEQ ID NO: 121040 - DNA, 2295 bp, Artificial Sequence
  Description of Artificial Sequence: Synthetic coding sequence
atgtgcatccgccagttgaaattcttcaccacagcttgcgtctgtgagtgtccccagaacatattaagccctcagccttcgtgtgttaatctggggatgatgtggacctgggccctatggatgttgcctagcctttgtaagttcagtcttgccgcccttccagctaagcctgagaacatttcctgcgtgtactactaccggaaaaacttaacatgcacctggtccccaggtaaagaaacgtcctacacccagtacaccgttaagcggacctacgcctttggcgaaaaacatgacaactgcaccactaatagctccacttctgagaacagagcgtcctgcagcttctttttgccgaggataaccattcccgataattacaccattgaggttgaggcagaaaacggtgatggggtgattaagtctcacatgacttattggcgactcgaaaacatcgcaaagaccgaaccccccaagatcttccgggtaaagcccgtgctcggaataaaaaggatgatccaaatagagtggataaaacccgaactggcgcctgtgtctagtgatctgaaatacaccctccgctttaggaccgtgaattccacttcctggatggaagtgaatttcgctaagaaccggaaagacaaaaaccagacctacaatcttaccggactgcagcctttcacagaatacgtcatagcgctgcggtgtgctgtgaaagaatctaaattctggagcgactggtctcaggagaagatgggaatgaccgaggaggaagcaccatgtggcctggaattgtggagagttctgaaacccgccgaagcggatggtcggagaccggttcgattgttgtggaagaaagcacgcggggccccggtcctggagaagacacttggatacaacatctggtattacccagagagcaacactaatctcacagaaacaatgaacacaactaatcagcaacttgaactacacttgggaggcgaatctttttgggtctctatgattagctataatagcttgggcaagtcacctgtcgctaccctgcgcattccagccattcaagagaaatctttccagtgcattgaggtgatgcaggcatgcgtggccgaggaccagcttgtggtgaagtggcaatctagcgctcttgatgttaacacatggatgatcgagtggtttcccgacgtcgactctgaaccaacaactctctcatgggagtctgttagccaggccactaattggaccattcagcaggacaagctgaaacctttttggtgttacaacatctcagtgtatcccatgttacatgataaagtcggggagccttactcaatccaagcatacgcaaaggaaggcgtcccatctgaaggcccagagactaaagttgagaacatcggggtaaaaaccgtcacaatcacatggaaggagattcctaaatcagaacgtaaaggcattatctgtaattatacaatattttaccaggctgaaggcggaaaaggattttcaaagacggtgaattcaagcatccttcagtatggcttggaatcactcaaacgcaaaacttcgtacattgtacaggttatggcctctaccagtgctggtggaacgaacggaacgtccatcaattttaagactcttagcttcagtgtcttcgagataatcctgattaccagcctgattgggggcggactgcttatcctaataattctgaccgtggcctacgggcttaagaagcctaataaattaacccacctctgctggccgaccgtgccgaatcctgcagaatctagcattgctacatggcatggggacgattttaaagataagctgaatctgaaagagagcgatgatagtgttaatactgaagaccggatactgaagccgtgcagcactccctctgataagctcgtgatcgataagttggtcgtgaattttggaaatgtgctgcaagagatctttactgatgaagcacgcaccgggcaagagaataatctcggcggcgagaagaacggttatgtgacatgtccattcaggcctgattgtcctttggggaaatctttcgaagagttgccggtatctcccgagattcccccacgtaaatcccagtacctccgtagtcggatgccagaaggtacccgcccggaggctaaagaacaactcttgttttctggacaatcgctcgtaccagaccacttgtgcgaggaaggcgcgcccaatccatacctgaaaaactccgttactgcaagagaattcttggtgtctgagaaactgcctgagcacacgaagggtgaggtatag

SEQ ID NO: 121041 - DNA, 1869 bp, Artificial Sequence
  Description of Artificial Sequence: Synthetic coding sequence
atgacatattggcgcttggagaacattgccaagacagagccccctaagatttttcgggttaaaccagtgttgggaatcaagcgcatgatccagatcgaatggatcaagcccgagctggcgcccgtcagctctgacctgaagtataccctcagattccgcacagtcaactccacatcctggatggaggtgaactttgctaagaatcgcaaggataagaaccagacctacaatctgactgggctccaaccatttacagagtacgtcattgcactgcggtgcgcggtcaaagagtccaagttctggagcgactggagtcaggagaaaatggggatgaccgaggaagaagctccatgcgggttagaactttggcgagtgctgaagcctgctgaggccgatggccggcgtcccgttcgcttactgtggaagaaggcccgtggggcacctgtactggagaaaacactcgggtacaacatatggtactatcccgaatcaaacactaacctcacagaaactatgaacactactaatcagcagttagaactgcacctgggaggtgagtccttttgggtctccatgatttcttataactccttgggtaagagtcccgtggcaactcttcggattcccgccatccaagaaaagtcttttcagtgtatcgaggtgatgcaggcctgcgtggccgaggaccagctcgtggtgaaatggcagtcctctgcgcttgacgtcaatacctggatgattgagtggtttccagacgttgactctgaacctaccaccctgagttgggagtccgtgtcccaggcgaccaactggacgatccagcaggacaaactcaaaccattctggtgttataacatcagcgtgtatcccatgctgcacgacaaggtgggtgagccttactccatccaagcatatgccaaagagggtgtgccttcagagggccccgagacaaaagtcgaaaatatcggagtgaagacagttaccatcacctggaaggaaatcccaaagtctgaaaggaagggaattatctgcaactacacgatcttttatcaagcagagggtggaaaaggattctctaaaaccgtaaacagctcaatcttacagtatggactggagtcattgaagcgtaagacctcctacatcgtgcaagttatggcttccactagcgcaggagggaccaatggtacgtcaattaattttaaaactctcagcttttctgtttttgagatcatcttgatcactagcctgattggcggaggtctcctcatcctgatcatcttgaccgtggcctacggtctgaagaagcccaataagctgacacacctttgctggcccactgtccctaatcctgctgagagctcgattgcaacatggcacggagacgattttaaagacaagctcaatctgaaggaaagcgacgactccgtcaacactgaggatcggatcctaaagccatgctccacacccagcgacaaactggttattgacaagctagtggtcaactttggaaatgtgctgcaggagatcttcacggatgaagctcgaactggtcaagagaacaatctcggcggtgagaagaatgggtacgtgacatgccctttccggcctgactgccccttgggcaagtctttcgaggagcttccagtctctccagaaattcctccaagaaagtcccaatacctgagatccaggatgccggagggaacccggcccgaagctaaggagcaattgctcttcagcgggcagtcactcgtcccagaccacttgtgtgaggagggagctcccaatccttacctgaaaaactctgtgaccgcaagagaatttctggtctctgagaaactcccagagcatacaaaaggtgaagtgtag

SEQ ID NO: 121042 - DNA, 468 bp, Artificial Sequence
  Description of Artificial Sequence: Synthetic coding sequence
atggtgttgagcggcgctctgtgctttcggatgaaagattccgcactcaaggtcctgtatcttcacaataaccagctcctcgcaggagggctgcacgctggtaaagtgataaagggcgaagaaatctccgtggtcccaaaccgatggttagacgccagtttatctcccgttatcctcggcgtgcagggcggcagtcagtgcttgtcttgcggggtgggccaggagcctactctgactcttgagcccgttaacatcatggagctctacttaggagcaaaggagagcaagtcctttacattttacaggagagatatgggtttaaccagctccttcgagtcagctgcctaccccggatggtttctgtgcaccgtacccgaggccgaccagcccgtcagactcacgcagctgccagaaaatggcggttggaacgcacccatcaccgatttttatttccagcagtgtgattag

SEQ ID NO: 121043 - DNA, 468 bp, Artificial Sequence
  Description of Artificial Sequence: Synthetic coding sequence
atggtgttgtcgggcgctctgtgcttcagaatgaaggattcagcactgaaggtgttatatcttcacaataaccagttactggcgggtgggctccacgccggaaaagtgattaaaggggaagaaatcagcgtcgtgccgaacagatggctcgacgcgtcactgtctccggtcatcctcggagtgcagggcggcagccagtgcctctcctgcggcgtagggcaagaaccgaccctgacccttgagccggtaaacattatggagctgtacctgggagcaaaagaaagtaaaagctttaccttctatcgccgagacatggggctgacctctagttttgaatcagccgcgtatcctggctggtttctctgcactgtcccggaagcggaccagcccgtgaggttgactcagcttccagaaaacgggggctggaacgcacccataacagacttttactttcagcagtgcgactag

SEQ ID NO: 121044 - DNA, 354 bp, Artificial Sequence
  Description of Artificial Sequence: Synthetic coding sequence
atggtgctcagcggcgcgttgtgtttcaggatgaaagactccgctctgaaagtcctgtatttgcacaataaccagttgctggctggaggcctccacgccggaaaggtcatcaaaggcgaggaaatctctgtggtcccaaacaggtggctggacgcatcattgtcgcccgtgatcctgggcgttcaggggggatcccaatgcctgtcctgtggcgttggccaggaaccaactcttaccctggagccagttaatatcatggaactctacctgggagctaaggaatccaaatcttttacattttacagacgcgacatggggcttacgagctcatttgagagcgccgcgtacccatag

SEQ ID NO: 121045 - DNA, 2478 bp, Artificial Sequence
  Description of Artificial Sequence: Synthetic coding sequence
atgggctggctgtgctctgggctgctttttccagtttcatgcttggtcttactccaagtggctagctctggcaatatgaaagtgttacaggaaccgacttgcgttagcgactacatgtctatctccacgtgcgagtggaagatgaatggcccaacaaactgtagcaccgagttgaggctgttataccagcttgtctttttgttgagcgaagcacacacatgcatacctgaaaataacggtggcgctggttgcgtttgtcacctcctgatggacgatgttgtgtccgctgacaactacacactggacctgtgggcaggccagcagctgctgtggaaggggagttttaaaccaagcgagcatgttaagccgcgtgctcctggcaatttaacagttcatacaaatgtttctgatacactgcttttgacctggagcaacccttatcctccagacaattatttatataaccatctgacatacgccgtcaatatctggtctgagaatgatcctgctgacttccggatttacaacgtgacctatttggagcccagcctgcgaatcgctgcatccacgctgaagtctggaatcagctatcgagcacgagtaagggcttgggcccagtgctacaacaccacatggagcgaatggagccctagtaccaaatggcacaacagctatagggaacccttcgagcagcatctgctgcttggagtgagcgtttcttgcatcgtcatcttggctgtgtgcctgctatgctacgtttccatcacaaaaattaaaaaagaatggtgggatcaaatccccaacccggcgcgatctaggctcgtggcgatcatcatacaggacgctcagggatcacagtgggaaaagcggtctcgcggtcaggaaccggccaaatgtccccactggaagaattgtcttacaaagttactcccctgctttctggagcataacatgaaacgcgacgaggaccctcacaaggctgccaaggagatgccttttcagggctccgggaagtccgcctggtgcccagttgagatctctaaaacagttttgtggcctgaaagcatatcggttgtgagatgcgttgaactattcgaagcccccgtggaatgtgaggaggaagaagaggtcgaagaggagaagggaagtttctgcgctagtcctgagagtagccgggacgacttccaggaaggtagggagggaatcgtcgcaagattgacagaatcactcttcctggatctgctgggtgaggaaaatggtgggttctgtcaacaggacatgggtgagtcttgcctgctacctccctcgggctctacctctgcccatatgccatgggatgagttcccttcagccggccctaaggaagcacctccttggggtaaggagcagcccttgcacctcgaaccctcaccaccagcgagcccaacccagtcacccgataatctcacatgcactgaaacgccgctggtcatagcaggtaaccctgcatatcgctccttcagcaacagcttgtctcagtcgccatgcccccgggagcttggcccagaccccctcctggcccgccacctagaagaggttgaaccagagatgccctgtgtcccccagctctccgagcccacgaccgtgcctcaacctgaaccagagacctgggaacagatcctgagacggaatgtccttcagcacggtgcggccgctgctcctgtttcagctcccacgtccggctatcaggagttcgtccacgccgtggagcagggaggcactcaggcttctgcagttgtgggtttgggcccccccggcgaagccgggtataaagccttcagctcactcctggccagctccgcggtgtctcctgagaagtgtggattcggcgcaagctcaggagaggaaggatacaaacctttccaggacctgatcccagggtgtcctggagacccagccccagtgcccgtgccgctgtttaccttcgggctggatagggagccgccacgttccccccagagttcccacctaccttccagttctcccgaacatctgggattagaaccaggtgaaaaagtcgaggatatgcctaagccccccctgcctcaagagcaggctactgatcctctcgtggatagcctaggaagtgggatagtgtattccgcactgacttgccacctctgtggacacttgaagcagtgccacggccaagaagatggagggcagacccctgtgatggcaagcccttgttgcggctgctgttgtggcgatcgcagtagtccgccaactactccactgagagctcctgatccttccccaggcggggtcccgctggaagcaagcctgtgtcccgcctccctggccccatccggtatttcagagaaatcaaaatcctctagcagcttccatcctgcgcctggcaatgcccagtcatcctctcaaactccgaagattgttaattttgtgtcagttgggcccacctacatgagggtttcatag

SEQ ID NO: 121046 - DNA, 2433 bp, Artificial Sequence
  Description of Artificial Sequence: Synthetic coding sequence
atgcaaaaagacgctagaagagagggcaacatgaaggtcctccaggaacccacgtgcgtttccgattatatgtccatctcgacctgtgagtggaagatgaacggccccactaactgtagcaccgagttacgactgctgtatcaactagtgttcctcctttccgaggcgcacacatgcatccctgagaacaacggaggcgctggctgtgtgtgtcatctgctcatggacgatgtagtctcagcagataactatactttggacctgtgggccggtcagcagcttctgtggaagggctctttcaaaccaagcgagcacgtgaagccacgggcccctgggaatctcaccgtgcacactaatgtatccgatactttgttactgacatggagcaacccgtatcctcctgacaactatctttacaatcacctcacctatgctgtaaatatctggtctgaaaatgatcctgcagacttcagaatttataacgtcacctacctggaaccctccttgaggatagcggcttcgactttaaagtccggcatttcgtatcgggctcgggtccgagcctgggctcagtgttacaataccacctggtcagaatggtccccatctaccaaatggcataactcctacagagagccgttcgaacagcacctcctcctcggtgtttccgtgagctgcatcgtgatcctggcggtctgtctgctgtgttacgtgtctatcacaaaaattaagaaagaatggtgggatcaaataccaaatcccgctcgatcccggctcgtcgccattattattcaggatgcgcagggatctcagtgggaaaaaagaagccgagggcaggagcccgcaaagtgcccgcattggaaaaattgcttaacaaagctattgccttgctttctggaacacaacatgaagcgcgatgaagatcctcataaagctgctaaagagatgcccttccagggctccggcaagtccgcgtggtgtccagtcgaaatttcgaagacggtcctctggcccgaaagcattagtgtcgtacgctgcgtcgagctctttgaagcccctgtcgaatgcgaagaggaagaggaggtggaagaggaaaagggcagcttttgtgcctctccggaaagcagccgggacgactttcaggagggccgtgaaggaattgtcgcaaggctgactgagtcactttttctggaccttctcggtgaggagaacggcgggttctgtcagcaggacatgggtgagagttgcctccttccccccagcggctccaccagcgctcatatgccttgggatgagttcccttctgccgggcccaaggaggcccctccgtggggaaaggaacagcccctgcacctggagcccagtcccccagcatctcctacacaaagccccgacaacctgacctgcactgaaaccccactggtaatagctggtaaccctgcctacaggagctttagcaattccttgagtcagtcaccatgccccagggagctgggccccgacccgctgctggcgcgccatctggaagaggtagaacctgagatgccatgtgttccacaactgagcgaaccgacaactgtaccacagccagaacctgaaacctgggaacagatccttagaaggaatgtgttgcagcacggcgcagccgcggctccagtgtctgccccgacttctggttaccaagagtttgtgcacgccgtcgagcaggggggaactcaggccagcgccgtggttgggttgggacctccaggggaggccggctataaggctttctcaagcctgttggctagttctgcggtctctcctgagaagtgtgggtttggcgccagctcaggcgaagaggggtacaagccgttccaagatctgatacctgggtgccccggagacccagctccggtgccggtgccgctcttcacatttgggctggatcgtgagcctccaaggagtccgcagtctagtcatctgccctcatcatctccagagcaccttggccttgagccaggtgagaaggtggaagacatgcctaaacctcctctaccacaggagcaggcgactgaccccctagtagacagcctcggtagcggaatcgtctacagtgcactgacatgccatttgtgtggccacctcaagcagtgtcacggacaggaagacggaggccaaacacccgtgatggcatccccgtgttgcggctgttgctgtggggatcgctcgtctccacctacgacaccactccgtgccccagacccttctccaggcggggtccccctcgaggcaagcctttgcccggcttcattggctccctcaggaatttcagaaaagtctaaatctagcagcagcttccatcctgcaccaggaaatgcccagtcaagcagccagacgccaaagatcgtgaacttcgtgagtgtcggccccacctacatgagggtgagttag

SEQ ID NO: 121047 - DNA, 684 bp, Artificial Sequence
  Description of Artificial Sequence: Synthetic coding sequence
atgggttggctgtgttctgggctgctgtttccagtatcttgcctcgtgctgctacaggtagctagttcagggaatatgaaggttctgcaggagccaacttgcgtgtccgactatatgtcaatctccacgtgtgaatggaaaatgaatgggccaaccaactgctcaaccgagctgagattattgtaccagctcgtatttctactgagcgaggcacacacttgcataccggaaaataacgggggagccggctgtgtgtgtcaccttctcatggacgacgtggtttcagccgataattatacactggatctgtgggcgggccagcagctgctttggaagggatcctttaagcccagcgagcatgtcaaaccacgggcacccgggaatctgactgtccacaccaatgtgtccgatactttgttgcttacttggtcgaacccatacccccccgacaattatctgtataatcatcttacatatgccgtgaatatttggtcggaaaatgaccctgcagacttccgcatttataatgtcacttatctcgagccgagcctgcgcatagcagcttctacacttaaaagcggaatcagttaccgggctagggtgagggcctgggctcaatgctacaacacaacttggtctgagtggtccccaagtacaaagtggcacaacttctctgtgtgctag

SEQ ID NO: 121048 - DNA, 2478 bp, Artificial Sequence
  Description of Artificial Sequence: Synthetic coding sequence
atgggttggctctgttccggcttgctgtttcctgtgtcatgtctggtcttgctacaggtagcctctagcggaaacatgaaggtattgcaggaacctacatgtgtcagcgactacatgagcatcagcacctgcgagtggaaaatgaatgggccaaccaactgcagcacagaactccgcttgctgtaccaactcgtcttcttgctttcagaggctcacacctgtattcctgagaataacggcggggccgggtgtgtttgccacttactgatggacgatgtggtgagtgccgacaactataccctcgacttatgggccggtcagcagttactttggaaaggctccttcaagccatccgagcacgtcaagccaagagcacctggaaaccttactgtacacaccaatgtctcagatacactccttctcacatggtcaaacccatacccacccgataattacttgtacaaccacttaacctatgcggtgaatatctggagcgagaatgatcctgccgacttcagaatctataatgtgacctatctggagccctctctgagaatagcggcctccactctgaaaagcgggattagctatagggcacgagtccgtgcctgggcacagtgctataatacgacttggtcagaatggtccccttccaccaagtggcataactcttacagagagcccttcgaacaacacctactgctgggagtctccgtgtcctgtatcgtgattctggccgtctgtctcctctgttacgtgtctatcaccaaaatcaaaaaagaatggtgggaccagattcctaaccccgcaagatcacggttagtcgctatcatcatacaagatgctcagggctctcagtgggagaaacgctcacgagggcaagaacccgccaaatgtccccactggaagaattgcttgactaagctgctaccctgcttcctggaacacaacatgaagcgagacgaggatcctcataaggcagcaaaagaaatgccgttccaggggtcaggaaaaagcgcctggtgcccagttgaaatttcaaagacagtcttgtggcccgagtcaatcagtgtggtgcgctgcgtggagcttttcgaagccccggtggagtgtgaggaagaagaagaggttgaagaagaaaagggctctttctgcgctagccctgagagcagccgagacgattttcaggaaggccgggagggcatcgtggcacgtttaaccgagtccctgtttcttgatttattgggggaagagaatggtgggttttgccaacaagacatgggcgagagttgtctgcttcccccttccggctcaacctccgctcatatgccttgggacgagttcccaagtgccggccctaaagaggcccccccttgggggaaagagcagcctctgcatctggaacccagtccgccggcttcaccaactcagagcccagacaacctgacatgtactgagacccccctggttatcgcaggaaatcctgcatacaggagcttctccaactcactctcccagtccccctgccctagagagctgggcccagacccattactggccagacacctggaggaagttgagcccgagatgccatgcgtgcctcaactatcggagcccacaacagtgcctcagccagaaccagaaacgtgggaacagatcctgcgtcgaaatgtgctccagcatggcgctgctgctgcccctgtttctgctcccacttcaggatatcaagaattcgtgcatgcggtggaacagggaggaacccaggcatctgctgtagtcgggctaggaccaccgggagaggccggctataaggcattctcgagcctactggcgtcatccgctgtgtccccggaaaaatgtggcttcggtgcgagctccggagaagaaggatacaaacctttccaagatttgatcccaggatgccccggcgacccagcccccgtcccagtgccgctgtttacattcggccttgatagagagccaccccggagtcctcagagctcccatctcccgtcatccagtccagagcacttagggttggaacccggggaaaaagtggaggatatgcctaagccacccttaccccaggagcaggcaacggatcccttagtagatagccttggctctggcatcgtctatagcgctttgacctgccacctgtgcggtcaccttaaacagtgtcatggacaagaagatggcggccagacaccagtcatggccagcccttgttgtggatgttgctgtggcgatcggtcttccccacccactaccccactgcgcgcacccgatccctccccgggaggcgtgccactagaagcgtcattgtgtcctgccagtctggctccgagcggaatatccgaaaagagtaaaagcagcagtagttttcacccagctcctgggaatgcccagtcctcgtcccagacgccaaaaattgtgaatttcgtgtccgtggggccaacgtacatgagagtgagctag

SEQ ID NO: 121049 - DNA, 684 bp, Artificial Sequence
  Description of Artificial Sequence: Synthetic coding sequence
atgggttggctctgtagcggcctgctctttcccgtgagttgcctggtcctcctgcaggttgcaagcagtggaaacatgaaagtcctgcaggaacctacatgtgtgtctgactatatgtccatctcgacgtgtgaatggaagatgaacggtccaacgaattgtagcacagagctgcggcttctatatcagctcgtgtttctattgtccgaagcccacacctgtatcccagaaaataatggcggtgccggctgtgtatgccacctgttaatggacgacgtggtctccgctgataattatactttggatctgtgggcaggacagcagctgttatggaaagggtcgttcaagccctccgaacatgtcaaaccacgcgctccaggaaatctcaccgtccataccaacgtgtctgacactctgcttttgacgtggtccaatccatacccccctgacaattacctgtacaatcatctcacctatgctgtgaatatatggtcggaaaacgaccccgcagattttcgcatttacaatgtgacttacctggaaccttcactcagaatcgccgcttccactctgaaatcaggaataagctatcgggcccgcgtgagagcatgggcccagtgctataatacaacctggtctgagtggagtccgagcaccaagtggcacaactccaacatatgctag

SEQ ID NO: 121050 - DNA, 2478 bp, Artificial Sequence
  Description of Artificial Sequence: Synthetic coding sequence
atggggtggctgtgttcgggacttctttttcctgtgtcatgtcttgttctgctccaggtggcttcctctgggaatatgaaagtgctgcaagagcccacctgcgtttccgattatatgagcatctccacatgcgaatggaaaatgaatggtccaaccaactgttccacagagttacgtctgctgtatcagctagtgttcttgttatccgaagcccacacttgcatccctgagaacaatggaggcgcaggctgtgtgtgtcacctcttgatggacgatgtggtgtcagccgataattacacactggacttgtgggcgggacagcagctcttgtggaaggggtcgtttaaaccctcagagcacgtgaagccacgcgcccccgggaacttaaccgtgcatactaacgtctccgacactctgctcttgacctggtcaaacccataccccccagacaattacctatacaaccacctgacgtacgcagttaacatttggagtgagaacgaccccgcagactttcgaatatataatgttacttatttggaacccagcttacgcatagctgcttctacactgaagtcaggtatatcctatcgcgctcgggtccgggcctgggcccaatgctataacactacttggtctgaatggtcgccctcaaccaaatggcacaacagctaccgggaacccttcgaacaacatctgttgctgggcgtgtcagtatcatgcatagtgattctggctgtgtgcctgctgtgttatgtcagcataacgaaaatcaagaaggagtggtgggaccaaatcccaaaccctgctaggagcaggctggttgctattattatccaggacgcacagggctcacagtgggaaaagagaagccgtggccaggaaccagctaagtgtccccattggaaaaattgcctgaccaaactcctaccctgcttccttgagcacaatatgaagcgagacgaagaccctcacaaggctgccaaggaaatgccctttcaggggtctggcaaatccgcatggtgtccggtagaaatctccaagaccgtcttatggcctgagtctattagcgtggttaggtgtgtggagttgtttgaggcccccgtcgagtgcgaggaagaagaggaggtcgaagaggagaaaggctcattctgcgctagtcccgagtcttcaagggacgattttcaagagggccgggaggggatcgttgctaggctgaccgagtcgctgtttttagacctgctcggggaggaaaacggaggtttctgtcagcaggatatgggcgagtcttgtctgctgccaccctccggatccacaagcgcacacatgccttgggatgaatttcccagcgccgggcctaaggaggctcccccttggggaaaggagcaacccttgcacctggagccctctcctcccgctagtccaacacaatcaccagacaacctcacatgcaccgagaccccccttgttatagccgggaaccctgcctaccgaagtttctctaactcccttagccagagtccctgccctcgcgagctgggacccgacccgctcctcgcccgtcacctcgaggaggtagaacccgaaatgccttgcgtcccacagctgtcagaaccaacaaccgtcccccaaccagagccagagacgtgggaacagatattaaggaggaacgtgctgcaacacggagccgcggccgccccggtcagtgcacctacctctggatatcaagaatttgtgcatgcagttgagcagggcggtacgcaagcctccgccgtggtcggactgggccccccaggcgaggctggctacaaggcgttcagctctttattagctagttccgctgtgagcccagagaagtgtggctttggcgcatcgtcaggggaagaaggctataagccgttccaggaccttatccccggatgtccaggcgacccagcgccagtgcctgttccccttttcacctttggcctggatagagagccccctcgaagcccacagtcgtcacacctgcccagttctagccctgaacatctgggccttgaacccggcgagaaagttgaggacatgcctaagccgcccttgccacaggagcaggcaactgatccactcgtggatagtcttgggagcggtatagtgtactcagctctcacttgccatctctgcgggcacctgaaacagtgtcacggccaagaggacggcggacagaccccagtaatggccagcccttgttgtggctgctgctgcggagacaggtcatctcccccaacaactcctctaagagctcccgacccttcccctggaggcgtgccattggaagcgagcctgtgtcccgcctcattagctccatcaggcatctccgaaaaatcgaaatccagttcttcattccacccagcaccaggaaacgcccagagctcatctcagactccgaaaatcgtgaattttgttagcgttggtcctacttatatgagagtcagctag

SEQ ID NO: 121051 - DNA, 1263 bp, Artificial Sequence
  Description of Artificial Sequence: Synthetic coding sequence
atgatcatcgtcgcccatgttcttttaatcctcctgggagcgactgaaatcctccaggcagacctgcttcctgatgagaagatctccctgttacctcccgtgaatttcacaattaaagttaccgggctcgcccaggtcctcttacagtggaagcctaaccccgaccaggagcagagaaatgttaatttggagtaccaagtgaagataaacgcccccaaggaagacgactatgagacccgcattacagaaagcaagtgcgtgaccattctccataagggctttagcgcaagtgtgcgaaccatcctacaaaacgatcacagcctgttagcatcatcctgggcctccgctgaactgcatgcaccaccaggctcccctgggacttcaattgtgaaccttacatgtaccacaaacacgactgaagataactattccagactgagaagttaccaagtgtcacttcactgcacttggttggttggcaccgatgcaccagaggatacacaatacttcttgtattaccgctatgggtcctggacagaggagtgtcaggaatactcaaaggacactctgggccgaaatattgcctgttggttcccgcgcacattcattcttagcaaaggccgggattggctggctgtcctcgttaatgggagtagtaagcactccgcaattaggccctttgatcagctcttcgctctgcatgctattgatcagatcaacccacccctcaacgtgaccgcggaaattgaagggactcgcctgtcaatacagtgggagaaacccgttagcgcctttccgattcactgtttcgactacgaggtgaaaatacacaacacacgtaacggctatctgcagattgaaaagttaatgaccaacgcgtttatatccattatcgacgatttatccaagtatgacgtccaagtccgggcagctgtgtcctctatgtgtcgcgaagccggcctctggtcagaatggtcccagcccatctatgtaggaaacgacgaacacaaacctcttagggagtggttcgtgattgtaattatggcaacaatttgtttcattctgttaatcttatccctcatttgtaagatctgccatctatggattaagctgtttccccccattcccgcgcctaaatcgaacatcaaagacctctttgtgacaacgaactacgaaaaagcaggatctagcgagaccgagattgaggtcatatgctacatcgaaaagccaggcgttgaaactctggaggattcagtcttttag

SEQ ID NO: 121052 - DNA, 1008 bp, Artificial Sequence
  Description of Artificial Sequence: Synthetic coding sequence
atgattatcgttgcccacgtcctcctgatcctcctgggagccacagaaatcttacaggccgacttgttgccagatgagaaaatttcactgctgccgcccgtcaactttactattaaggtcacgggcctggctcaggtcctgctgcaatggaagccgaacccagatcaagagcagagaaacgtcaatttggaatatcaagtaaagatcaatgcccccaaagaggatgattacgagacaaggattaccgagtcgaaatgcgttacaattctccataaagggttttctgcaagtgtgcgcaccattctacagaacgatcactctcttctggccagttcatgggcctcagccgaattacatgctcctccgggatctccagggacttcgattgtgaacctgacttgtacaaccaatacaacagaggacaactactcccgcttgagatcataccaggttagtctgcactgcacctggctcgtgggcaccgacgctcccgaggacactcagtacttcctgtactacagatacggctcctggaccgaggaatgtcaagaatatagcaaggatacactgggtcgcaacatcgcttgttggtttcctcggacttttatactgagcaaggggcgtgattggctcgcagtgttggtaaacggctcatctaagcattctgctatccggccttttgaccagctgttcgcacttcacgccattgaccagattaaccccccactgaatgttaccgccgaaatcgagggcactcgtcttagcatccaatgggaaaagcctgtctcagctttcccaatacattgtttcgactacgaagtcaaaatacataatactagaaatgggtatctgcagatcgaaaagctgatgaccaatgccttcatctctatcatcgatgacctaagcaaatacgatgttcaagtgcgggctgccgtgtcgagcatgtgccgcgaagccggcctctggagcgagtggagccagcctatctacgtgggcttctcacggtag

SEQ ID NO: 121053 - DNA, 453 bp, Artificial Sequence
  Description of Artificial Sequence: Synthetic coding sequence
atgaccaatgctttcatcagcattatcgacgacctgagtaagtacgacgtccaggtcagagcggcagtttcatctatgtgtcgagaggctgggctgtggagcgagtggagccagccgatttacgtgggcaacgacgaacataaaccgcttcgggaatggtttgtcatcgtgatcatggccacaatatgttttattctgctgatcctttcactcatttgtaaaatctgtcatctgtggatcaagctcttcccacccatccctgccccgaagtctaatatcaaagatctgtttgtgaccaccaattacgaagtcctgtgcatattcatctacattctcgattccgctgacaattttctgcagaagaagaaagctggatcttctgaaaccgagatcgaggtcatctgctacatcgaaaagcccggcgttgaaactctggaggatagcgtattctag

SEQ ID NO: 121054 - DNA, 1008 bp, Artificial Sequence
  Description of Artificial Sequence: Synthetic coding sequence
atgatcattgtcgcccacgtgctactcattctactcggggctactgagatcctgcaagccgacctcctgccagacgaaaaaatctcactcctccctccggtgaattttactatcaaagtcacgggcctcgcccaggtgctgttgcagtggaagcctaaccctgatcaggagcagcggaacgttaacctggaataccaggtcaagattaacgccccaaaggaagatgattatgagacacggattacagaatccaagtgtgtcacgattctgcacaagggattctctgcatccgtcagaactatcttgcagaatgatcatagcctcctggcctcgtcctgggccagcgccgaactgcacgcgcctccagggtcccctggaacctctattgtcaatctgacctgcaccaccaatacaaccgaggacaattattctcgccttcgatcatatcaggtgagcctccattgtacatggttagtagggacagacgcgcctgaggacacccagtacttcttgtattaccgctacggaagctggactgaagaatgtcaggagtatagtaaggatacactcggacggaatatcgcctgctggttccccagaaccttcattctgtccaagggccgcgattggctggcagtgcttgtcaatggcagcagcaaacactcagctatcaggccatttgaccagctgtttgctcttcacgcaatagaccaaattaaccccccgctaaacgtgacagccgaaatcgaaggaacacgcttaagcatccagtgggagaagcccgtatccgcctttcctattcactgctttgactatgaggtgaagatccacaacacccggaatgggtacctccagatcgagaaactgatgaccaacgcatttattagtatcattgacgacctgtcgaagtatgatgtgcaggtgcgtgcagctgtgtcatccatgtgcagagaggccggcctgtggagcgagtggtcccagcctatttacgtgggattcagtcgctag

SEQ ID NO: 121055 - DNA, 978 bp, Artificial Sequence
  Description of Artificial Sequence: Synthetic coding sequence
atgatcatcgtagcccacgtgctgctcatcctgctgggcgcgaccgagatcttgcaagccgacctgcttccggatgagaaaatcagtcttctccctcctgtgaattttacaatcaaagtcaccgggcttgctcaggtcttactccagtggaagcccaatcctgatcaggagcagagaaatgtcaatctggagtaccaagtcaagataaacgcaccaaaagaagatgactatgaaactcggatcacagagagcaagtgcgtcactatcttacacaaggggttctccgctagcgttaggaccatccttcaaaacgaccacagtttgttggcctcttcatgggcatcagccgagctccacgccccgcccggcagtcctggaacctccatcgtcaatctcacttgcactaccaatactaccgaggacaattattcccgacttagatcctaccaggtttctttgcattgtacttggctggtgggcacagatgcgcctgaggatacccagtactttctatattatagatatggcagttggacagaggaatgtcaggaatactccaaagacaccttaggtcggaacatcgcctgttggtttccaagaacttttatcctgtctaagggtcgtgattggctcgccgttctagtaaacggatcctccaagcatagtgccatccgtccgttcgaccagctattcgccctacacgccatcggtaatgacgagcacaagccccttagggaatggttcgtaatcgtgatcatggccaccatctgctttatcctcctgattctgtcattgatctgcaagatttgtcacctctggatcaaactcttccctcccattcccgccccaaagtccaacatcaaggacttgttcgtaactaccaattacgagaaagcaggcagctccgagaccgagatagaggtaatctgctacattgagaagccaggggttgagacgctggaagatagcgttttctag

SEQ ID NO: 121056 - DNA, 330 bp, Artificial Sequence
  Description of Artificial Sequence: Synthetic coding sequence
atgatcattgtggcccacgtcctgctcattctgctgggagcgaccgagatcctgcaggctgacctcctgccagatgaaaaaatatctctactgcctcccgtgaatttcactataaaggtgacaggcctggcacaagttctgctccaatggaagccgaacccagatcaagagcagaggaatgtcaatctggagtatcaggtgaagattaatgctcccaaagaggatgactacgaaactcgaataacagagtctaagtgtgtgaccatcttgcataaggggttttccgcctccgtgaggaccatcctgcaaaacgatcattccttactatag

SEQ ID NO: 121057 - DNA, 1002 bp, Artificial Sequence
  Description of Artificial Sequence: Synthetic coding sequence
atgatcatcgtcgcacacgtgctgctcatcctgttgggcgctactgagattctgcaagcagacctcctcccagatgaaaagatttctctgctcccaccagtaaacttcaccatcaaggttacgggcctggctcaggtgctgctgcagtggaagcctaatccggaccaagagcagcgcaatgtcaacctggagtaccaggtgaagatcaatgctcccaaggaagacgattatgaaacgcggataactgaatccaagtgcgtgacgattctccataagggtttcagtgcaagcgtcagaactatactgcagaacgaccacagtctgttggcttccagctgggcttcggcagaactgcatgctccacccggcagtccaggcacctctatcgtgaatctgacttgtacaacaaacactacagaggacaactatagtcggctgcgatcataccaggtgagcctccattgtacctggttagtcgggacagacgctcccgaagatacccagtattttctctattatcgatacggctcatggaccgaagaatgtcaggaatactcaaaagatacgctgggacggaatattgcatgctggttccccaggacatttatcttgtcaaaaggaagagactggctagctgtgttggtgaatggtagctccaaacatagcgccatccgcccctttgatcaactctttgctctgcatgccattgaccagatcaacccccccctcaatgttaccgccgaaattgaaggcactcgcctgtcaattcagtgggaaaagcccgtgtctgcttttccaattcactgcttcgactacgaagtgaagattcacaatacgcgaaacgggtacttgcaaattgagaagcttatgactaatgctttcatcagcattatcgatgatttatcaaaatatgatgttcaggttagagcagcagtgtcgagtatgtgtagggaagcgggcttatggagtgaatggagccaaccgatctacgtgggcaagtag

SEQ ID NO: 121058 - DNA, 1137 bp, Artificial Sequence
  Description of Artificial Sequence: Synthetic coding sequence
atgatcatagtcgcccacgtgctgctgatcctgcttggtgcaaccgaaatactacaggcggatctgcttcctgacgagaagatcagcctgctgcctcctgtaaactttacaatcaaagtaacaggattggcacaagtgctgctgcagtggaagcccaatcccgaccaggaacagagaaatgtcaatctcgagtaccaagtgaagatcaacgcccccaaggaggatgactacgagaccagaataaccgaatcaaagtgcgtcacgatccttcataaagggttctcggccagtgttaggacaatcctccagaacgatcacagtctcttggcttcctcttgggccagcgctgagctccatgcgccaccaggttccccaggaacaagcattgtcaacttgacctgtaccacaaataccactgaagataattacagtcgattgcgctcctaccaggtgtccttacactgtacgtggctcgttggcaccgatgcgcctgaagatactcagtacttcttgtactacagatatggttcctggacagaggagtgccaggagtattctaaggatactttggggcggaacatcgcctgctggtttcctaggacattcattctgtctaaaggtcgagactggttggccgttctagttaatgggtcatcaaagcacagtgccatacgtccttttgaccagctttttgcccttcatgcgattgaccagattaatccaccccttaacgttactgctgaaatcgaggggacacggctgtcaatacagtgggagaaacctgtgagtgctttccccattcactgtttcgactatgaggtcaaaatacataacacacgtaatggctacctgcagatcgagaaactcatgaccaacgcctttataagcattatcgacgatctctctaaatatgatgtgcaagttcgggccgcagtgtccagcatgtgcagagaggccgggctgtggtcagaatggtcgcagcctatctacgtgggcaacgacgaacataagcccttaagagagtggttcgtaattgttatcatggcaactatatgcttcatcctactgattctgagtctgatatgcaagatcaaactcggccccgtccgacgtaagctcaagtcgtccgttatctag

SEQ ID NO: 121059 - DNA, 591 bp, Artificial Sequence
  Description of Artificial Sequence: Synthetic coding sequence
atgataatagttgctcacgtgttattgatattactcggagctacagaaattctgcaagccgatctgctgccagacgaaaaaatcagccttttgcccccagtgaacttcactattaaggtgaccggcctcgctcaggtgttacttcaatggaagccaaatcccgaccaggaacagagaaacgtgaacctcgagtatcaggttaaaataaatgctccgaaagaggatgactacgagactcgcatcacagaaagtaagtgtgtgacaatactgcacaaagggttttcggcatcagtgcgcacaatcctacaaaacgatcattccctgctcgctagttcttgggcctcagccgaattgcatgctccacctggatctcccggcacgtcaatcgtgaacttgacctgcacaaccaatactactgaggataactacagtcgccttagatcgtatcaggtgtctctgcattgtacatggttagtcggcactgatgctccagaggacacacagtacttcctgtactaccgctatggatcatggacggaggagtgtcaggaatactccaaagacacattaggtcgaaacattgcatgttag

SEQ ID NO: 121060 - DNA, 636 bp, Artificial Sequence
  Description of Artificial Sequence: Synthetic coding sequence
atgatcatcgttgcccatgttttgttaatcctgctcggagctacagaaattctgcaggcggacctgctgcccgatgagaagatctccctcctgccgcccgtcaacttcacaattaaagtgaccggtctagcgcaggtgctgttgcaatggaagccgaaccctgatcaggagcagcgtaatgtgaatctggagtatcaagtgaagattaatgctccaaaggaagacgactatgagacaaggatcacagaatccaagtgtgttacaattctgcataaggggttctctgcaagtgtgaggacgatcctgcagaacgatcacagcctgctggccagttcttgggcaagcgccgaactccatgcaccacctggcaacgatgaacacaagccattacgcgaatggtttgtcatcgtgattatggccaccatatgctttattctgctaatcctgtctctcatatgcaaaatatgtcacctgtggattaaacttttcccacctattcccgcccccaagtcaaacatcaaggacctgttcgtcacaaccaactacgagaaagctggaagtagtgagacggaaatcgaggtcatctgctacatcgagaagccaggtgtggaaaccctcgaggactcagttttctag

SEQ ID NO: 121061 - DNA, 1263 bp, Artificial Sequence
  Description of Artificial Sequence: Synthetic coding sequence
atgatcattgtagcccacgttctattgatcctgctgggtgctaccgagattttgcaggccgacctgcttcccgacgaaaaaatatctttgctgccgcccgtgaattttacaattaaagtaaccggactggcccaggtgctcttacaatggaagccaaacccggatcaggaacagagaaatgttaaccttgaataccaagtgaaaataaacgcgcctaaggaagacgattacgaaaccaggattacagaaagtaaatgcgtgacaattcttcacaagggtttctcagcaagcgtacggaccattttgcagaacgaccatagtttgttggccagtagttgggcttcagcggaactgcatgcccctccaggcagcccagggaccagcatagttaacttgacctgtaccacaaatacaacggaagataattactctcgccttcgatcctaccaggtttctctgcactgtacttggttagtaggcacagacgcaccagaggatacacagtattttctatattataggtatggctcgtggacagaagaatgccaggaatatagcaaggacactctgggtagaaacattgcatgctggttcccgcgaacctttattctgtctaaaggccgagattggttagccgtcctagtcaatggatccagcaagcattccgctatacggccatttgaccaacttttcgccttacatgctattgatcaaataaacccacctctgaacgttaccgccgagatcgaggggaccaggctctcaatccagtgggaaaaaccagtgagtgccttccccatccattgcttcgactacgaagtgaagatccacaatacccggaacgggtatctccagattgagaagctcatgacaaatgccttcatctcaattatcgacgatctgagtaagtatgacgttcaggtgagagccgcagtgtccagcatgtgtcgagaggccggcctctggtccgagtggtcacagccgatttatgtagggaatgatgaacacaagcctctcagagaatggttcgttattgtcatcatggcgactatctgctttatccttttaatcctgagtcttatttgtaaaatctgtcacctctggattaagcttttcccccccatccctgcaccaaagtcaaacattaaggacctgtttgtaacgacaaattacgagaaggccggctccagcgagacggagatcgaggtgatctgctatatcgagaaacctggtgttgagacacttgaggactctgttttttag

SEQ ID NO: 121062 - DNA, 1002 bp, Artificial Sequence
  Description of Artificial Sequence: Synthetic coding sequence
atgattatcgttgcccacgttctgctgatacttttgggggccaccgaaatcctgcaggctgatttactcccggatgaaaagatttcccttcttcctcccgtgaatttcactatcaaggttaccggtcttgcgcaagtgctcctacagtggaagcccaatcctgaccaggaacagaggaacgtaaacctcgagtatcaggtaaaaattaatgcaccaaaggaagacgactacgaaacgcgtatcacagaaagcaaatgtgtcacaattctccacaaaggattttccgcgtccgttaggacaatcctccagaacgatcactcacttctggcttctagctgggcttcagcagagctccacgccccaccaggctcccctggtacttccatcgtcaaccttacatgcactacaaacacaacggaggataattattctagactacggagctaccaggtgtccttacattgtacatggttagtgggcaccgacgcacccgaagacacacagtacttcctatactatcggtatggatcttggactgaggaatgtcaagaatactcaaaagatacgcttgggaggaatatcgcttgttggtttcccagaacgttcattctttccaagggtcgagattggcttgccgtcctggttaacggctcatccaagcacagcgcaatcagaccgttcgaccaactgtttgctctccatgcaatagaccagataaaccctcctctcaatgtgaccgccgaaattgagggaaccagactttccatccagtgggaaaagcccgtgagtgcatttcccatacattgtttcgattacgaagtcaagatccacaacacccggaatggatatctgcagattgagaaactgatgaccaatgcattcatttccattatagatgatctgagtaaatacgatgtccaggtaagagccgcagtatcctctatgtgtcgtgaagcaggtctatggagtgagtggagccagcccatatacgtgggtaagtag

SEQ ID NO: 121063 - DNA, 1098 bp, Artificial Sequence
  Description of Artificial Sequence: Synthetic coding sequence
atgctggctgttggctgtgccctactggcagctttgctggctgctccaggagccgcactggcccctcgcaggtgccctgcccaggaggtggcccgaggcgtccttacctcgctccctggcgattctgtgactcttacctgcccgggggtggagccagaggacaatgccacagtacattgggtcctgcgcaaacccgccgctggatctcacccatctaggtgggcagggatggggcgaaggctcctgctaaggtcagtacagctgcacgacagtggaaattactcctgctaccgcgccggccggcctgctgggacagtgcaccttttggtggacgttcctcccgaggagccacaactgagttgtttcaggaagtctccccttagtaatgttgtgtgtgaatggggacctcgctccaccccttccttgactacgaaggccgtgctgctggtgcgcaagtttcagaattcacctgccgaggactttcaggagccttgtcagtactcacaggagagccagaagttcagttgtcaactggctgttccagaaggagacagttctttctatattgtgagcatgtgcgtcgcctctagtgtgggttcgaagtttagtaaaacgcaaaccttccagggatgcggcatactacagcccgatccaccagcgaatattacagtgaccgccgtggctcgcaatccaaggtggctctctgtgacgtggcaagatccccactcctggaactctagcttttataggctccgctttgaattacggtacagggctgagagatctaagacatttacaacctggatggttaaggatcttcagcaccactgtgtcatccacgatgcttggagtggactccgccatgtagttcaactcagggcccaggaggagttcggacaaggcgagtggtcggagtggtccccagaagctatgggtaccccttggacagagtctagatcgcctccagctgaaaatgaagtcagtactcccatgcaggcattgaccaccaataaagacgatgacaatatcttattcagagattcagctaacgctacttcgttacctggaagtagaaggagaggtagttgtggcctttag

SEQ ID NO: 121064 - DNA, 1407 bp, Artificial Sequence
  Description of Artificial Sequence: Synthetic coding sequence
atgctcgccgtcggctgtgcactattggccgccttacttgcagccccaggggcagctcttgcacctaggcgatgtcctgcacaggaggtggctagaggtgtgcttacatccctgcctggtgactctgtgacactcacctgtcccggcgttgaaccggaggacaatgccaccgtccactgggtgctgcgcaaacctgccgctgggtcacatccatcgcggtgggcaggtatggggcgccggttgctcctacgttcggtacagttgcacgacagcgggaattactcgtgttaccgtgccggcagacctgcagggactgtgcacctcctggtagatgtgccgcccgaggagccacagctctcttgttttcgcaaatcccctctgtcaaacgttgtttgcgaatggggtccaagaagtacgccctctctcacaactaaggcggtgctgctggtgcgcaaattccagaattcgccggcagaagattttcaggagccttgccagtatagtcaggagtcacagaaattctcttgccagctcgccgtgcctgaaggcgactccagtttctatatagtgtccatgtgtgtggcctctagtgtgggtagcaaatttagtaagacccagacatttcagggctgcggcattcttcagccagatcccccagccaacattacagtaacagcggtggcaaggaacccgcggtggttatcagtgacctggcaagacccccattcttggaatagttcattctatcgactgcgcttcgaacttcggtacagggctgaacgctccaagaccttcaccacttggatggtgaaggacctccagcaccactgtgtgattcatgatgcatggtctggcctacggcacgttgttcagctgcgtgcccaggaagaattcgggcagggcgagtggagcgagtggagtcctgaagctatgggcaccccctggaccgagagtcgctctccgcccgctgaaaatgaggttagtaccccgatgcaggccttaactacaaataaagacgacgataatatcttgttcagagattctgcaaacgcaaccagcctgcccgttcaagattcatcctcagtgcctctccctacatttctggtcgctggcggaagtttggctttcgggaccttactgtgtatcgcgattgtgttacgatttaaaaagacatggaaattgcgggcactgaaagagggaaagacgtcgatgcacccaccttacagtttaggacagctggtcccggaaagacccaggcccactccggtcctcgtgccgctgataagcccaccagtgtccccgtcttcgttaggttctgataacacctccagtcataaccgccctgatgctagggatccgaggagcccatatgacatctccaataccgattatttttttccacggtag

SEQ ID NO: 121065 - DNA, 2757 bp, Artificial Sequence
  Description of Artificial Sequence: Synthetic coding sequence
atgttgacccttcagacctggctggttcaagccctctttatatttctgacaacagaatctactggggagttgctcgacccctgtggatacattagtcctgagtctccagttgtgcaactgcacagtaatttcaccgctgtgtgtgtcttgaaggaaaaatgcatggactatttccatgtgaatgccaactacattgtctggaaaactaaccatttcaccatccccaaagagcagtacaccatcatcaatcggacagccagttctgtgactttcacggatattgcgagtttaaatatccagctgacatgcaatatcctgaccttcgggcagctggaacagaacgtgtacgggattactatcatatccggtttaccccccgagaaacccaagaatctgagttgtatcgttaacgagggaaagaaaatgagatgtgagtgggatgggggccgcgaaacgcaccttgaaaccaattttacgctaaagagcgagtgggctacccacaaattcgctgactgtaaagctaaacgggatacccctacctcttgtacagttgattacagtaccgtgtattttgtcaatatagaggtgtgggttgaagcagagaatgccctcgggaaagtaaccagcgatcatattaattttgaccccgtctacaaggtgaagcccaatccaccccataatctgagcgtgatcaacagcgaagagctgtcgtccatcctgaaattgacatggactaatcccagcatcaagtcagtgatcatcctgaagtacaatattcagtatcggactaaggacgcttcaacctggagtcagattcctcctgaagacactgcctctacgaggtcctcgttcacagtccaggacctgaaaccctttacagaatatgttttcaggatacgctgcatgaaagaggacggtaagggctattggagcgactggtctgaagaggcatccggtatcacttatgaggaccgtccttccaaggctccgagtttttggtataaaatcgatccctcccacactcagggctatcggactgttcaactggtttggaaaacactacctcccttcgaggccaacgggaaaatactggactatgaggttacgttaacccgatggaagtcacacctgcaaaactacactgtaaacgcgaccaagttgaccgtgaatctgacaaacgaccgttatctcgccaccctcactgtgcgaaacctcgtgggcaaatccgacgcagcagtcctgacaatccctgcttgcgatttccaggccacacaccctgtgatggacctaaaggcgttccccaaggacaatatgttatgggttgaatggacaacccctcgagagagtgtgaaaaagtacatcttggagtggtgcgtgctcagcgataaggccccctgcattacagattggcaacaggaggacggtactgttcatcgtacatatcttcggggaaacttagcagagagtaagtgctacttaattacagtgacacccgtgtatgccgatgggccagggagccccgagagtatcaaagcttatctaaaacaagctccaccatcaaaaggcccaaccgtgaggacgaagaaggtcggcaagaatgaggctgtgctggaatgggaccagctgccagtcgatgtgcaaaacggcttcataagaaactataccattttttacaggacaatcatcgggaacgagactgccgtcaacgtcgattccagccataccgagtacacgctatcctcgctgaccagcgacacgctctacatggtgagaatggccgcctatacagatgagggcggtaaggatgggcccgagttcacattcaccacacccaaatttgcacagggcgaaattgaagcaatcgtggtgccggtgtgtctggctttccttctgacgaccttattgggcgtcctcttttgcttcaacaaacgggaccttatcaagaagcacatctggccaaacgtccctgacccctctaagtctcacattgcccagtggtcaccccatacaccaccacggcataacttcaatagtaaagatcagatgtactccgatgggaattttaccgatgtgtctgtggtggaaatcgaggcgaatgacaagaagccctttcctgaagatctgaagagtctggatttatttaagaaagagaaaatcaatacagaaggccactcgtctggaatcgggggctctagctgtatgagttctagccggccttcaattagctctagcgatgaaaacgagtcatctcaaaacactagcagcactgtgcagtactcaacagtggtgcacagcgggtatcgccaccaagtcccttccgtgcaggtgtttagtcgttcagagtctacccagcccctgcttgacagcgaggagagaccagaggatctgcaactggtggatcacgtggacggcggcgacggaattctcccccgccagcagtatttcaaacagaattgctcccaacacgaatctagcccagatatttcacatttcgaacgttccaaacaagtgtcttcggtgaatgaggaagattttgtgcggcttaaacagcagatttccgatcatatttctcagagctgtggctctggacagatgaagatgttccaggaggtgtcagccgccgacgcattcggccctggtactgagggccaggtcgagcgttttgagacagtaggcatggaagctgcaactgacgaggggatgccgaagtcttacctgccacagacagtgcgccaaggaggctacatgccccagtag

SEQ ID NO: 121066 - DNA, 990 bp, Artificial Sequence
  Description of Artificial Sequence: Synthetic coding sequence
atgctgactctccagacctggctggtgcaggcactctttatcttccttacaaccgagagcactggtgaactacttgatccctgcggttatattagcccagaaagcccggtggtacagttgcatagcaactttaccgcggtctgcgtccttaaggaaaagtgcatggattactttcacgttaacgcaaactatatcgtctggaaaaccaatcactttaccattccgaaagaacagtacacaataataaaccgcactgcctccagcgtgacgtttacggatattgcctccctcaatattcagctgacctgtaatatcctcacgttcggacagttagagcagaacgtgtatgggattacgattattagcggtctgccaccagagaaacctaagaacctgtcctgtatagttaatgaggggaagaaaatgaggtgtgaatgggatggcggtcgggaaactcatcttgaaactaattttaccttgaagtccgagtgggctacccacaaattcgccgactgtaaggcaaagagagacacacccacgtcctgtaccgtagactatagcactgtctatttcgttaacattgaggtttgggtcgaggcggagaatgcgcttgggaaagtgacctccgatcacatcaactttgatcctgtatacaaagtcaaacctaatccacctcataatcttagcgtaattaacagcgaagagcttagttcaattcttaaactcacttggactaatccaagtattaagagcgtgatcatccttaagtacaacattcagtaccgcactaaagatgcttccacctggagtcagattcctccggaggacaccgccagtacacgatctagcttcactgttcaggaccttaagcctttcacagaatacgttttccgaattcgctgtatgaaggaggacgggaaggggtattggtcagattggtccgaggaagcctcaggaattacctatgaggataacatcgcctccttttag

SEQ ID NO: 121067 - DNA, 2574 bp, Artificial Sequence
  Description of Artificial Sequence: Synthetic coding sequence
atgctaaccctccagacatggttggttcaggctctatttatttttctaactactgagagcactggggagctgctggatccctgcggttacattagccccgaatctccagtggtgcaactacatagcaatttcaccgcagtttgtgtcctcaaagaaaagtgcatggactacttccatgtaaatgccaactacatcgtgtggaaaactaaccattttaccatccctaaggagcaatacactataataaaccggactgcttcctctgtcacctttactgacattgcaagcttgaacatacaactgacctgtaacatcctgacattcggccagctcgagcagaacgtgtatgggattacaataataagcggacttccccctgagaaacctaagaacctctcctgcattgtaaatgaaggcaagaaaatgcgctgcgagtgggacggtggcagggagacccacctggaaactaactttaccttgaaaagcgagtgggctactcacaagtttgctgactgcaaagcaaagcgcgacactcctacctcttgcacagtcgattactcaaccgtgtacttcgttaacattgaggtgtgggtggaggccgagaacgccctggggaaagtgacatctgaccatatcaacttcgaccccgtctacaaggtgaaacccaatcctccacacaatttaagcgtgatcaactccgaagaactgtcctccatcttgaaactgacatggaccaacccaagcatcaagtctgttattatacttaaatacaacatccaatataggaccaaggatgcctccacctggagtcagatcccccctgaggatacagccagcacacgctctagctttacggttcaagatctcaaaccattcacggaatacgtttttcgtatccggtgtatgaaggaagatgggaagggttactggtccgactggtcagaggaagcgagcggcatcacctatgaggacagaccctcaaaagctccttccttttggtataaaatcgatccttcacatacgcagggttataggaccgtccagctagtttggaagactctgccaccattcgaggctaatgggaaaattttggattacgaggtgaccttgacccggtggaagtcccatctgcaaaactacaccgtcaacgctactaagctgactgtgaatttaaccaacgaccgttaccttgcgaccctgacagtccgaaacctggtagggaaatccgacgctgctgttctaacgatccccgcttgtgacttccagggaaacctggccgagtccaagtgctatcttattactgtcacaccagtgtatgctgatgggcctggctcccctgaatctattaaagcctatctgaagcaagcacctccctccaagggtcccaccgttcgcacgaagaaagtcggcaagaatgaagctgttcttgagtgggaccagctgcccgtagacgtacaaaacgggtttatccgcaactataccattttctatagaaccatcattggaaacgagaccgctgtcaatgtggatagctctcacactgagtataccctgtcctcactaacaagtgataccctctacatggtacggatggcagcctacaccgatgagggcggaaaggatgggccagagttcacatttacaacaccaaagtttgctcagggcgaaattgaggcgatcgtggttccagtttgcctcgccttcctcctcacaacgttactgggggtgttgttctgctttaacaaaagagatctgattaagaagcacatctggccaaatgtcccagatccttccaaatcccacattgctcagtggtctccacacacccccccccgccacaactttaactcaaaggaccaaatgtactccgatgggaatttcaccgacgtttctgttgtggaaattgaagccaacgacaagaagcccttccccgaggacctcaaatctctggatctgtttaaaaaagagaaaattaacacggaagggcactcttcaggaatcggtggatctagttgcatgagcagttcccgtcctagtatcagcagcagcgatgagaacgagtcctctcaaaacacgagtagtactgtgcagtacagtacagtagtacattcagggtatcggcaccaggtccctagcgtgcaggtgtttagccgttctgagtctactcagcctttgcttgatagtgaggagcgtcctgaagatcttcagctcgtggatcatgtggacgggggcgacggcatactgcctagacagcaatactttaagcagaattgctcccagcacgagagctctcctgacatttcacattttgagcgatctaagcaggtcagtagcgtgaacgaagaggacttcgtacgtctcaaacagcaaatttctgatcacatttcacagtcttgtggatcaggacagatgaagatgtttcaggaagtgtcagctgcagacgcgtttggaccgggaactgaaggacaggtggagcgtttcgagactgttgggatggaagctgcaaccgacgaaggaatgccaaagagctatctgccacagaccgttcggcaaggcggctacatgccacagtag

SEQ ID NO: 121068 - DNA, 2757 bp, Artificial Sequence
  Description of Artificial Sequence: Synthetic coding sequence
atgctgaccctacagacctggctggtccaagccttgttcatttttctcacaactgaatctactggcgagcttcttgatccttgtgggtacatcagtccagagtccccggtcgtccagctgcattccaatttcaccgctgtctgcgtcctcaaagagaaatgcatggattactttcacgtaaatgctaactatatcgtgtggaagactaaccatttcaccatcccaaaagagcaatatacaatcataaatcgtactgccagctctgtaacttttactgacattgccagcctcaacattcagctgacctgtaacattttaacgtttggacagttagaacagaatgtgtatgggattaccatcatttcaggactaccaccagagaaacccaagaatctctcgtgtattgtcaacgagggcaagaagatgaggtgcgagtgggacggaggtcgtgaaacccatctggaaactaattttacactcaagtccgagtgggccacacacaagtttgccgactgtaaggccaagagggatacgcccacttcctgtacggttgattactccacagtgtatttcgtgaacatcgaggtttgggtcgaggccgagaacgcactgggcaaagtgaccagcgatcatataaatttcgaccctgtgtataaggtgaaacccaatccaccgcacaatctgagtgtcatcaacagcgaagaactgtcttctattctcaagctaacgtggacgaatccgtcgattaagtctgtcattatcttgaagtataatattcagtaccgtactaaggacgcctctacgtggagtcagattccaccggaagatactgcatcaaccaggagttcattcactgtgcaggacctgaagccctttaccgagtatgtctttagaatcaggtgtatgaaggaagatggaaagggttactggtcagactggtcggaagaggcatccggaatcacttatgaggacagaccttctaaggctcccagcttctggtataagatcgaccctagtcacacccaggggtatcggactgtccagctcgtctggaaaactttgcccccatttgaagcaaatggcaaaatccttgactacgaagtcaccctgactcggtggaaatctcacttacagaattatactgtgaacgctacgaaacttaccgtgaatcttaccaacgaccgctatctggccactctgacagtacgaaatctcgtcggtaaaagcgacgccgccgtgctgactattcccgcatgcgattttcaggctacgcaccccgtcatggacctcaaggccttcccgaaagataatatgctctgggtcgaatggacaacaccccgggagagcgtaaaaaagtatatcctggagtggtgcgtgctgagcgacaaagctccctgcattacagattggcagcaagaggacggtaccgtgcatcgcacatatctgcgaggcaatcttgccgagtcgaagtgctatctgattacagtcactcctgtttatgccgatggaccaggatctccagagtccatcaaggcatacctgaagcaggccccgccatccaaggggccaaccgtgagaaccaagaaggtcgggaagaacgaggccgtgttagaatgggatcagttgccagtagatgtgcaaaacggcttcattaggaattataccatattttaccgcactatcataggtaacgagactgctgtgaacgtggactcgtcacacacagagtataccctttccagcctgaccagcgacaccctgtacatggtgaggatggccgcatataccgacgagggcggcaaggatggcccagagttcacctttacaacccccaagtttgcccaaggagaaatcgaagctattgtggttccagtttgtttggcctttttgctgaccacactgctgggagtgctgttctgtttcaacaaaagggacttgataaagaagcacatctggcccaacgtccctgatccgtctaaatctcacattgcccaatggagcccccataccccacctagacataactttaactctaaggaccagatgtatagcgatggtaatttcacagatgtgtcggtggtcgagatcgaggctaatgataagaagcctttccctgaggacttgaagagcctggacctattcaagaaagaaaagattaatactgagggccattcttccggcatcgggggcagcagttgcatgtcctccagtcgtccgagcatttcatcctccgacgagaacgaaagctcccaaaatacgagctccaccgttcagtatagcaccgttgtccattccggctatcgccaccaggttccctccgtgcaggtctttagtcgaagtgaatccacacagccacttctggatagtgaggagcggcccgaggaccttcaacttgttgaccacgtggatggaggagatggtatactacctcgtcagcagtacttcaagcagaattgttcccagcacgaatccagcccggacatttcccattttgagagatcaaaacaggtgtctagtgtcaacgaagaggattttgtgcgccttaagcagcagatctctgatcacatctcccaatcttgtgggtcaggccagatgaaaatgttccaagaggtgtcggccgccgacgcttttggacccggaacggagggacaggtggagcgctttgagaccgtgggcatggaggctgcaaccgacgaaggcatgcccaaatcatacctgccacaaactgtgcgccaaggagggtatatgcctcagtag

SEQ ID NO: 121069 - DNA, 990 bp, Artificial Sequence
  Description of Artificial Sequence: Synthetic coding sequence
atgttaacactgcagacctggctggttcaggccctattcatattcctgaccacggaaagcaccggagaactcctggacccatgtggatatatttcacctgaatccccggtggtccagttgcatagtaattttaccgccgtctgcgtattgaaggaaaaatgcatggattatttccatgtaaatgctaactacattgtttggaaaacaaatcacttcacgatcccaaaagaacaatacactataattaatcggaccgcatcatccgtgactttcaccgatattgcctccctgaatattcaattgacctgtaacattctgaccttcggccagttggaacagaacgtgtacgggattacgattatttcagggctgcctcccgagaaacctaagaatctgtcttgtatcgtaaacgagggcaagaaaatgcggtgcgagtgggatggtggccgggagactcatctcgagacaaattttaccctgaagagcgagtgggcaacccacaagttcgctgattgtaaagcaaaacgggacacacccacctcatgtacagtggactatagtactgtctatttcgttaatattgaggtatgggtggaagcagagaacgcacttgggaaggtgacatcggaccatattaatttcgatcctgtgtacaaggtgaagcctaatccacctcataacttatctgtgatcaattccgaggagctttcatctattctcaagctgacctggaccaacccaagtattaaaagtgtgatcatacttaagtacaacatccagtacagaaccaaggacgcttctacctggtctcagattcctccagaagacacagctagtaccaggagcagcttcacagttcaggatctcaaaccatttacagaatacgtctttagaatccgctgcatgaaggaggatgggaagggatattggagtgattggtccgaggaagcatctggcatcacctacgaggacaatatcgcctccttttag

SEQ ID NO: 121070 - DNA, 990 bp, Artificial Sequence
  Description of Artificial Sequence: Synthetic coding sequence
atgctgactctgcaaacctggcttgtgcaagccctgttcatattcctaactactgagtcgacaggggagttactcgacccttgcggctacattagccctgaatcccctgtggtgcagcttcactctaatttcaccgctgtctgcgtattgaaggagaaatgcatggattattttcacgtgaacgctaactatattgtgtggaagactaaccactttaccattccgaaagagcagtatacgataataaaccggacagcaagttctgtcaccttcaccgatattgcaagcctcaacattcagctcacctgtaacatccttaccttcggccaactggaacagaatgtgtatggaatcacaataataagcggactgccgccagaaaaaccaaagaatctctcgtgtatcgtcaatgagggaaaaaagatgaggtgcgagtgggatggcggacgcgaaacccacttggaaacaaatttcacccttaagagcgagtgggccacacacaagttcgctgattgtaaagccaaaagagacacaccgacaagctgtactgtcgactactctaccgtctactttgtgaatatcgaggtctgggtcgaggccgagaatgcactggggaaggtgaccagcgaccacataaactttgacccagtgtacaaggtgaagccgaacccaccccataatctctccgtcatcaactcagaggagcttagtagcatactgaagctgacatggaccaaccctagcatcaaatcagttatcatcttgaagtataatatccaatacagaaccaaggacgcatccacttggtcacagatccctcccgaggataccgcaagcaccaggtcatcctttaccgtgcaggacctcaaacctttcacagaatatgtcttcagaataaggtgtatgaaggaggatgggaaagggtattggtccgactggtctgaagaagcgtctggaataacgtatgaagacaatattgcttctttctag

SEQ ID NO: 121071 - DNA, 990 bp, Artificial Sequence
  Description of Artificial Sequence: Synthetic coding sequence
atgctgacattgcagacctggctcgtccaggcactgtttatctttctcacgactgagagtacaggcgaactgctcgatccttgcggctatataagtcccgaaagtcctgttgtgcaattgcatagcaactttactgctgtatgcgtgctcaaggaaaaatgtatggactactttcacgtcaatgcgaactacattgtttggaagacaaatcactttaccatcccaaaggaacagtacacgattattaaccgcactgcttcctcagtcacatttacggatattgcctctttgaacattcagcttacttgcaatattctcactttcggacagctggaacagaatgtttacggaattactatcattagtggcctgccccctgaaaagcccaagaacttgtcgtgtatcgtaaacgaaggaaaaaaaatgagatgcgagtgggacggaggacgtgaaacccaccttgaaaccaattttactcttaaatccgagtgggccacccacaaattcgcagattgtaaggcaaagagagatacccctacaagttgcacagtagattactcgaccgtttatttcgttaacattgaagtttgggttgaggcagagaatgccctcggcaaggtgacatctgatcacattaacttcgatccagtttacaaagtcaaacctaaccctccacataatcttagcgtgatcaactctgaggagctgtcttccatcctgaagttgacttggactaatccttcgatcaagtccgtcattatcctgaagtataatatacaataccgcaccaaggacgcatccacatggtcacagatcccaccggaggacactgcgagcacgcggtcatcctttacggtccaggacctgaaaccctttaccgagtatgtgtttcgcattagatgtatgaaagaggacggaaaggggtactggtccgattggtcagaagaggcgtccgggattacatatgaggacacgatctttagtttctag

SEQ ID NO: 121072 - DNA, 1380 bp, Artificial Sequence
  Description of Artificial Sequence: Synthetic coding sequence
atgactatcttgggaactaccttcggcatggttttttccctactgcaagtcgttagcggggaaagtggctatgcacagaatggtgatctggaagacgctgagttagacgattacagcttttcatgctatagccagttggaggtgaatggaagtcagcacagtttgacatgcgcattcgaggatcctgatgtcaacattactaatctggagtttgagatatgtggggctctggtggaggtcaaatgcttaaacttcaggaaactccaggaaatctattttatcgagaccaagaagtttcttcttatcggtaagtccaacatctgtgtcaaagtgggggaaaaatctttgacatgcaaaaagatcgatctgacgactattgtgaaacctgaagcacccttcgatctgtcagtggtgtaccgtgaaggagccaacgatttcgtggtcactttcaacaccagccatctgcagaagaaatatgtgaaagtgctgatgcacgacgttgcgtaccgacaggagaaggacgagaataaatggactcacgtcaatctgagcagtacaaagttaacccttcttcagcggaaactgcagccggccgccatgtatgagatcaaggtacgatcgatccctgatcactattttaagggattttggagcgagtggagcccatcatactattttaggacaccagaaattaacaattcatcaggagaaatggatcctatactcttaacaatatccattctgagttttttcagtgttgccctgcttgtgatattagcttgcgtgctgtggaagaagagaatcaaacctatagtttggccatcgctgcctgatcataagaaaacgttagagcatttgtgtaagaagcctcgaaagaaccttaatgtttcattcaatcccgaaagctttctggactgccagatccatagagttgacgacatccaggcgcgtgacgaagtggaaggcttcctgcaggacacgtttccccaacaactagaggagtcagagaagcagcggctcggaggagatgtgcagtcccccaactgccccagcgaggatgtggtgataacacccgaaagttttggtcgtgacagcagtctcacctgtctggctgggaatgtcagcgcctgtgatgccccaattctgtcttcctcacgtagtcttgactgtcgcgaaagtggtaagaatggaccccacgtgtatcaggaccttttgttgtcactgggcaccactaatagcacattacctccccctttcagtctacaatctggcatactgactctgaatcccgtggcacaaggtcagcctattttgacctctctgggtagcaatcaagaagaggcgtacgttactatgagcagcttttaccagaaccagtag

SEQ ID NO: 121073 - DNA, 789 bp, Artificial Sequence
  Description of Artificial Sequence: Synthetic coding sequence
atgaccatcttgggcaccacattcggaatggtgtttagtctgttgcaagtagtcagtggagagagcggatatgcacagaatggagatttagaggacgctgaactcgatgattactctttttcctgctatagtcagcttgaggtgaatggctcccagcacagtctgacatgtgcctttgaggacccagatgttaatattaccaacctcgaatttgagatatgtggcgctctcgtcgaagtgaagtgtctaaatttccgtaaactccaagaaatctacttcatcgagaccaagaagtttctcctgatcggcaagtccaatatctgtgtgaaggtaggcgagaagtcacttacatgtaagaaaatcgacttgacaactattgtgaaacctgaggctcccttcgacctcagcgtggtttatcgggagggtgctaacgacttcgtcgtgaccttcaacactagccatctgcagaagaaatacgtaaaggtgctaatgcatgacgtcgcctacaggcaagagaaagacgagaacaagtggactcacgtcaatctgagctccaccaagttaacactgctgcagcggaaacttcagcccgccgccatgtatgaaattaaagtgaggagcattcctgaccattactttaagggtttctggtcagaatggtctccatcttattacttccggactcccgaaatcaataacagttccggtctctctttgtcgtacggccctgtgtctccaatcattagaagactctggaacatctttgttcgaaaccaggaaaagatctag

SEQ ID NO: 121074 - DNA, 786 bp, Artificial Sequence
  Description of Artificial Sequence: Synthetic coding sequence
atgaccatcttgggtaccaccttcggaatggtgtttagcctgctgcaagtggtttctggcgaaagcggttatgcccagaatggtgatctcgaagacgctgagctggacgactattcatttagctgctattcccagttggaagtgaacggatcgcagcatagcctgacctgtgccttcgaagatccagatgtgaatatcaccaatctggagttcgaaatctgtggcgcactagtggaagtgaaatgcttgaacttccggaagctccaggaaatttactttattgagactaaaaagtttctgctaatcgggaagtccaacatctgtgtcaaggtgggcgaaaaaagtttgacttgtaagaagatcgatctaaccacaatagttaaacctgaggctccgttcgatctgtcggtggtctatcgcgagggagcaaacgatttcgttgtcacattcaatacttcccacctacaaaaaaagtatgttaaggttcttatgcatgatgtggcctaccgacaggagaaagacgagaacaaatggacacatgtgaatctgagcagcactaaacttactctcctccagagaaagctgcagcctgctgcaatgtacgaaattaaagtaaggagtattcccgaccactactttaagggtttctggtccgagtggtcaccaagctactatttccgcacacctgagatcaataactctagcgggctgagcctttcgtacgggcccgtatccccaattattcggcgactgtggaatatcttcgtgagaaatcaggagaaatag

SEQ ID NO: 121075 - DNA, 180 bp, Artificial Sequence
  Description of Artificial Sequence: Synthetic coding sequence
atgacaatcctggggaccacattcggtatggtctttagcctgctacaggtggtgagcggcgaatccggctacgcgcagaatggggacctggaagacgctgagttagatgattatagcttttcctgttactcacagttagaggtgaacgggagtcaacactccctgacctgtgccttctag

SEQ ID NO: 121076 - DNA, 159 bp, Artificial Sequence
  Description of Artificial Sequence: Synthetic coding sequence
atgacaatcctgggaacaacgtttggcatggttttctcgttactgcaggtagtgtccggcgaatccggatacgctcagaatggagacctggaggacgcggaactcgacgactacagctttagttgttactcccagctagaggtcaatggctcacagtag

SEQ ID NO: 121077 - DNA, 1566 bp, Artificial Sequence
  Description of Artificial Sequence: Synthetic coding sequence
atgggactcgggcgctgcatttgggaggggtggacccttgagtcggaggcgctaaggagggatatgggtacatggcttctggcctgtatctgtatttgtacatgtgtgtgcctcggagtttcagtcacgggcgagggacagggcccccggtcccggacattcacttgcctgacaaacaacattcttcgaattgattgccactggagcgcacccgagctgggacagggaagcagcccctggttacttttcactagcaaccaagcacccggtggaacacacaagtgtatcttgcggggctcagagtgcacagtagtacttccacccgaggccgtgctggttccttcagataatttcacgatcacatttcaccattgtatgagtggccgagagcaggtgagcttagtggaccccgaatacttgccccggcggcacgtcaaattggatcctccatccgatctccaatccaatatatcgtcaggtcattgcattctcacttggtcaatctctcctgccctcgagcctatgacaacacttttgagttacgaactagccttcaaaaagcaggaggaggcttgggaacaagcccaacacagagatcacatcgttggcgtgacgtggctgatactcgaggcatttgagttagatcctggcttcattcacgaagcacgtctgcgggttcagatggctaccctggaggacgacgtggtggaagaagaaagatatactgggcagtggtccgagtggtctcagccggtctgcttccaagccccccagcgccaggggcccctaatccctccctggggatggcctggaaacacactcgtggctgtctcaatctttctgttgcttactgggcctacatatctgctgttcaagctgagccctcgggtgaaacgcattttttaccagaatgtcccttccccagcaatgtttttccagcccctgtactccgtacacaatggcaacttccagacctggatgggcgcacatggcgctggcgttctgctctcacaggattgcgccgggacaccacagggggccctggagccctgcgtgcaggaagccacagcattactcacctgcggccctgcgcggccttggaagtcagtagccttggaagaggaacaggaaggcccgggcacacgccttcccgggaatctgtccagcgaggacgtcctgccagccgggtgtaccgagtggcgcgtgcagacactggcttatcttccacaggaggattgggcccctacatctctgactagaccagcaccccctgatagtgagggatcccgcagctcatcaagctcttcaagcagtaataataataattactgtgccttgggttgctatggggggtggcacttgtccgccctgcctgggaacacccagtccagcggcccaataccagccctggcctgtgggttaagttgcgaccaccagggactcgaaacccaacagggggtggcctgggtcctcgcaggacattgccaaaggcctggcctccatgaggacctgcaagggatgctcttaccatcagtactgagcaaggctcgatcatggaccttctag

SEQ ID NO: 121078 - DNA, 1029 bp, Artificial Sequence
  Description of Artificial Sequence: Synthetic coding sequence
atgccccagacatgcgacgggaccgggcagatgcacctgggcagtaactgttgcaaaaacggtcagacgctgctgcaacggacctgccatggagtttcatgttgcggatggtggttccaagctgctcgctcgatacttggcaaaggtccatcagcccaatcactcgccggttggaccttggagagcgaagccctgagacgggatatgggcacctggctgctggcctgcatctgcatatgcacatgcgtatgcctgggcgtgtccgttacaggggagggacagggtccgcgaagccggaccttcacatgtcttaccaataacattctccggatcgattgccattggagtgcgcccgaattgggccaggggagcagcccttggctgctgttcacgcgacttctggccgcacacattagcgccagttgtggagctgtctcagccccctcgtgctgccatcttcggcaatgttcctgccacctcacgattagcccctcactgtccacgacagcgtgcctcgggggctctaggtctgcgtggtggacaaggagcacatgcccgggagatacgagcaacatttctagcggccactgtattctgacttggagtattagccctgctctggaaccgatgaccactctcctgagttatgagctagccttcaagaagcaggaagaggcatgggagcaggcccagcacagggatcacatagttggtgtgacttggctgattctcgaggccttcgaactggatcctggcttcatccacgaagctaggcttcgggtgcaaatggccaccctagaggatgatgtcgtcgaggaagaaagatacaccgggcaatggagcgagtggtctcagcccgtgtgctttcaggccccacagcgtcagggaccattaattcctccctggggctggcctggcaacacactggtggccgtgtcaatctttcttcttttgacaggtcccacttatttattatttaagctgtcccctcgacttggctggggtcctacaggacccgtgtgctgctag

SEQ ID NO: 121079 - DNA, 1503 bp, Artificial Sequence
  Description of Artificial Sequence: Synthetic coding sequence
atgggcacttggctgctggcctgtatctgtatatgtacatgcgtttgtctgggcgtgagtgtaaccggagagggccagggcccacggtcccgcacattcacatgtctcaccaataacatcttgagaatcgactgtcactggtccgctcccgagctggggcagggttcttctccatggctgctgttcacttcaaaccaagctcccggtgggacacataaatgcatcctgcgcggatctgagtgcacagtggtgctgcctccagaggccgttctcgtgccttctgataacttcaccatcacttttcatcactgtatgtccgggcgagaacaggtctctctcgtggatcccgaatatctaccccggaggcacgtgaagcttgaccccccctctgacttacagtcgaacattagcagcggacactgcatcctgacctggtctatctcccctgccctcgagccgatgacaacccttcttagttatgagctagcctttaaaaaacaggaggaagcatgggaacaagcacagcaccgagatcacattgtgggtgtaacctggctgattttagaggcttttgagcttgacccggggtttatccacgaggcccgattgagggtacagatggcaaccctggaagatgatgttgtagaggaggagaggtacactggtcaatggagcgaatggagccaaccagtctgttttcaagccccccaaaggcagggacccttaattcctccttgggggtggccaggcaatacgttggttgccgttagcatctttctgctcctgacaggccccacttacctgctctttaaactctcaccccgcgtgaaaaggatattctatcagaacgtgccatctcctgcgatgtttttccagccactctactcagtgcacaacggaaacttccaaacatggatgggcgcacacggagccggcgtgctgctaagtcaagattgcgcaggtactccacagggtgctctggagccatgtgtgcaggaggccactgctctgctcacctgtggaccagctagaccatggaagtcagtggctctcgaagaggaacaggaaggacccggcactcggctcccaggtaacctcagcagcgaggacgtgttacccgcaggctgtactgagtggagggtacagaccctcgcgtatctgcctcaagaggactgggcaccgacaagtttaacacgccccgcaccccccgactctgaggggagccggtcttcctcgtcttctagctctagcaataacaacaactattgcgccttggggtgctatggaggatggcaccttagtgcattgcctggcaatacacagtccagtggtcccatacccgccttagcttgcggattatcttgcgatcatcagggacttgaaacacagcagggtgtggcctgggtcttggccggccattgtcaacgccccggtctgcacgaggacttgcaaggcatgctactccctagcgtgctgtccaaggcaagatcttggacattctag

SEQ ID NO: 121080 - DNA, 990 bp, Artificial Sequence
  Description of Artificial Sequence: Synthetic coding sequence
atgggcacctggttacttgcctgcatatgtatatgcacttgtgtctgcctgggtgtgtcagtgaccggcgaagggcagggtcctcgaagcagaacctttacatgcctgacaaataacattctccgcatcgactgtcactggtcggcccccgagcttgggcagggttcttccccctggttactctttacttcgaatcaggcacctggcggcactcacaagtgtattctgcgaggcagtgagtgcaccgtcgttctacctccagaggccgtgctcgtgccctccgataattttactattaccttccaccactgtatgagcggaagggaacaggtgtccctcgtggaccctgaatatctccccaggagacatgtcaagctcgacccaccttccgacctgcagagtaatatcagtagtggccactgtattcttacctggtctattagcccagccctggaacctatgacaactttgctttcatacgaattagcttttaagaagcaggaggaagcatgggaacaggcccagcacagagatcacatagttggggtgacatggctgatcctcgaagctttcgagttggatcctggctttatccatgaggcaaggctccgcgtacagatggctactctggaggacgatgtggtggaagaagaaagatatactggccagtggtccgaatggtctcagccagtgtgctttcaggcccctcaacgtcagggacctctgatacccccttggggatggcctggcaacactttagtggctgtctcaatttttctcctcctgacaggcccaacatacctactattcaagctgtcaccacgtgtcaagcgcattttttaccagaatgtgccctcccccgccatgtttttccagccgttgtatagcgttcataatggcaacttccaagtgtgtgcggaaaccacagagggccacggagggcagggcctgccccgggcgctcgcttgtcctcgttgttggctgtcctag

SEQ ID NO: 121081 - DNA, 999 bp, Artificial Sequence
  Description of Artificial Sequence: Synthetic coding sequence
atgcaccttggttctaattgctgtaagaatggccagactctcctgcaacgcacatgtcacggggtatcatgctgcggctggtggtttcaagctgcgaggtctattttgggcaagggaccgagtgcacagtctcttgccggttggaccctggaatccgaagcacttagaagggatatggggacatggttgctcgcttgtatttgcatctgtacttgcgtgtgccttggagtctcagttaccggagaaggacagggccctcggtcccgtacattcacttgtctgactaataatattcttagaattgactgtcattggtcagcaccagaactgggccaaggctcaagcccgtggctgctgtttacaagattactggccgctcacataagtgcctcttgtggagcagtttccgccccttcgtgttgccatctgcggcaatgttcatgccatcttaccattagcccatctttatccacaaccgcctgtctgggagggagtcgttcagcttggtggacaaggtcaacatgtcctggagacacctccaatattagctcaggccactgtatcctaacctggagcataagtccagctttagaacctatgactactctgctgtcttatgagcttgcatttaaaaagcaagaggaggcatgggaacaggcacaacacagagaccatatagtcggcgtcacatggcttattctggaggccttcgagctcgatcctgggtttatacatgaggctcggttgcgggttcaaatggcaactctggaagatgatgttgttgaggaagagcgatacaccgggcaatggtctgaatggagccagcctgtatgcttccaagctccgcaacggcaggggcctctgattccaccttggggatggcccggcaacacactggtggccgtttctatttttcttctcctgactggacctacttacctgttgtttaagctgtcccctcgattgggctggggtcccacaggccccgtgtgctgttag

SEQ ID NO: 121082 - DNA, 1878 bp, Artificial Sequence
  Description of Artificial Sequence: Synthetic coding sequence
atggcatgctacatctatcagctgccttcgtgggtgctggacgacctctgcagaaacatggatgccctgagcgagtgggattggatggagttcgcgtcctacgtgatcacagacctgactcaactaaggaaaattaagtctatggaacgcgtgcaaggggtctcaataacccgcgagttactctggtggtggggcatgaggcaggcaaccgtgcagcagttagtagatttgctgtgccggcttgaactctatcgcgccgctcagattatcctgaactggaaacctgcccccgaaattcggtgtccaattcctgcatttcccgactcggtgaagcctgagaaaccgcttgctgcttccgtccgcaaggcagaggacgagcaagaagagggccagcctgtgagaatggctacttttcccggacctggctcaagtcccgccagagctcaccagccagcttttttgcagcctcccgaggaagacgcaccgcattctctacgttcggacctgccgaccagttcagactcaaaagatttcagcaccagtattcccaagcaagagaaactcctttctcttgcaggggatagcttattttggagtgaggctgatgtcgttcaggccaccgatgatttcaaccaaaatcgaaaaatctcccaaggcacttttgctgatgtatatcgggggcacagacatgggaagcccttcgtgtttaagaagctacgggagacagcctgttccagtccaggttccatcgaacggtttttccaagcagaattgcagatctgcctgcggtgttgtcatccaaatgtcttacctgtgttgggcttctgtgctgcccggcagttccactcgtttatctatccctacatggctaacgggagtctgcaggatagacttcagggtcaggggggaagcgatcccctgccctggccccagagggtctccatctgtagcggactcctgtgcgccgttgaatacctgcacggtctcgagatcatccacagcaacgtgaaatcatcaaacgtgctgctggaccaaaatctgacccccaagctggcacacccgatggcccacttatgcccagttaacaagcgcagcaagtatacgatgatgaaaacccatcttctccgaacatctgctgcatacctgcccgaggacttcattagagtaggtcaacttaccaagcgtgtggatattttctcctgcggtattgtcctggctgaggttctgactgggattcccgccatggacaataacagaagtcctgtctacctgaaggatctgctgctgtctgacatcccctcttcaaccgcaagtctttgttcaaggaaaaccggcgtggagaacgtgatggctaaagaaatctgtcagaagtacctcgaaaaaggagccggccgcctacccgaagattgtgctgaggctctggcaacagctgcttgtctctgtctgaggcgacgaaatacgtctctacaagaggtctgtgggtctgttgctgccgtggaggagaggcttaggggtagagaaaccctgctcccatggagcgggctgtccgagggcacgggcagttcctctaacacgccagaagagactgacgacgttgataacagctcgcttgatgccagcagcagcatgtcggtcgccccatgggcaggggcagctacaccattattaccgaccgagaacggtgaagggcgtttaagagtgatcgtcggtcgggaggccgacagcagtagtgaagcatgtgttggcctcgagccacctcaggacgttacagagacctcttggcagatcgagatcaacgaagcgaaaaggaaactgatggaaaatatactattgtacaaggaggaaaaggttgactcaatcgagctgttcggtccatag

SEQ ID NO: 121083 - DNA, 1791 bp, Artificial Sequence
  Description of Artificial Sequence: Synthetic coding sequence
atggccggaaactgtggcgccagaggtgcccttagcgcccacaccctcctgtttgatctgccccctgccctcttgggcgagttgtgcgcggttctggactcctgtgacggtgcactggggtggagagggctggcggagagactgtcaagtagctggcttgatgtgaggcatatcgagaagtacgtagatcaaggtaagtctggtacacgcgagctgttatggagttgggcacagaagaacaaaacaattggcgatctcctccaggtgttgcaagagatgggacaccgcagggccatccatctcatcaccaattacggcgctgtgttgtctcctagcgagaagtcttatcaggaggggggttttcccaatattctttttaaggagactgctaacgtcaccgtggacaatgtgctgattcccgaacataatgaaaagggcattctcctgaagtcctcgatctcttttcagaacatcatcgaggggactcgcaactttcataaagattttttgatcggcgaaggggagattttcgaggtatacagggttgagatccagaacctcacatacgctgttaaactgtttaagcaagaaaagaaaatgcaatgcaagaaacactggaagagattcctgagcgagttggaggttctgcttcttttccaccacccgaacatcctggagttagctgcgtattttaccgaaaccgaaaaattctgcctgatttacccgtatatgaggaacgggactttattcgaccgcctgcaatgtgtgggggacaccgccccacttccatggcacattcggattggcatcctgattggaatcagtaaagccatccattatctccacaatgttcagccgtgctcagttatatgtggcagcatctcaagtgcaaatatcctgctggatgaccagtttcagcccaaattgacagattttgccatggcacactttcgctcacaccttgaacatcagagctgcaccattaacatgaccagctcctcatcgaagcacctctggtacatgcctgaggaatatattcgccagggcaaactctcaattaaaacagatgtgtactctttcggcattgttatcatggaagtactgaccggctgccgggtcgtgctggacgatcccaagcacatccagctgagggacctgctccgagaattgatggagaaaagaggcttggacagttgtctgtcttttctcgacaagaaggtgccaccatgtccacgtaatttcagcgcgaaattgttctgcctggccggtcggtgtgccgcgacccgggctaagctgcgcccgagcatggatgaagttctcaacactctcgaatccacgcaagctagcttgtactttgccgaggacccccccacaagcttgaagtcattccgttgcccatccccactgttcctcgagaatgtacctagtatacctgttgaagatgacgaatcacagaacaataacctcctccccagcgacgaggggctgcgcattgaccggatgacacaaaagactcctttcgaatgcagccagagtgaagtaatgttcctatcgctggataagaagcccgaaagtaagcgcaatgaagaggcctgcaacatgccatcctcatcctgtgaagagagttggttcccaaagtatatcgtgccgagtcaggaccttaggccatataaggtgaacatagaccccagttccgaagcccccggccactcttgtcggagtcgtccagtagagtcgtcttgcagcagtaagttcagctgggatgaatatgaacaatataaaaaggagtag

SEQ ID NO: 121084 - DNA, 1608 bp, Artificial Sequence
  Description of Artificial Sequence: Synthetic coding sequence
atggcaggcaattgcggggcccgtggcgccctttcggctcacactctgttattcgacttacccccggctctgctcggggagctgtgtgcagtcttggactcctgcgacggggccttaggctggaggggccttggagctgttctgagtcccagcgagaaatcatatcaggagggtgggttccccaacatactgtttaaggaaacagccaacgtgacggtagacaatgtgctcattccagagcacaacgagaagggcatcctcctaaagagctctattagtttccaaaacatcattgagggaacaagaaatttccataaggattttttgattggcgaaggggagatcttcgaggtctaccgtgtcgagattcaaaatctgacctacgcagtcaaactattcaaacaggaaaagaagatgcaatgcaaaaaacactggaagcggtttctatcagaactggaagtattactgctgtttcatcatcctaacattttggagctggctgcatactttaccgaaacagagaagttttgcttgatatacccatacatgaggaatggcactctcttcgaccgccttcaatgtgtaggagatactgccccactcccatggcacattcggattggcattcttattggaatttcaaaggctatacactatttacataatgtccagccatgtagcgttatctgcggaagtatcagtagtgcaaatattctcctagacgaccaatttcagcctaagctgacagattttgcaatggcacattttcggtcccacctagagcatcagtcatgcacaatcaacatgacctcctcgagctcaaaacacctctggtatatgcctgaggaatatatccgccagggtaagctgtcaattaagacagatgtctactcatttgggatagttatcatggaagttctgacaggctgtagggtggtactagatgaccccaagcacattcaactgcgcgaccttcttagagagctaatggagaagaggggcctagacagttgtctttcattcctcgataaaaaagtgcccccgtgcccccgcaacttttcagcaaagcttttctgtctcgccggcaggtgtgccgccactcgagccaaattaaggccctccatggacgaagtgttaaacaccttggagagtacccaagcctctttgtatttcgccgaagatccccccacctcactgaaaagcttcagatgtccttctccactttttctcgaaaatgtgccaagtatccctgtcgaggatgacgaatctcagaacaataacctcctaccttctgacgagggactacggatagacagaatgacgcagaaaactcctttcgagtgctctcaatcggaagttatgttcctgtcattagacaagaagcccgagagcaagagaaacgaggaggcatgcaacatgcccagctctagttgtgaggagtcctggtttcctaagtacattgttccatcccaggacctacgaccctacaaggtcaatatcgatccgtcaagcgaagctcctggccatagttgcaggtcccggcccgtagagtcttcttgcagttctaagttctcctgggatgagtacgaacaatacaaaaaagagtag

SEQ ID NO: 121085 - DNA, 657 bp, Artificial Sequence
  Description of Artificial Sequence: Synthetic coding sequence
atgaacaagccgataactccttccacctacgtgaggtgcctcaacgtcgggctcattcgcaagctgtcagatttcattgacccacaggaaggctggaagaagctcgccgttgcaatcaaaaagccctccggtgacgaccggtacaatcagttccacatccgacggtttgaagccctgctacagactggcaagtcccccacctccgaacttttgtttgactggggcacaactaattgtactgtgggagacctggtagacctgttgatccagaacgaattctttgcacccgccagcctccttctgcctgacgcagttcctaagaccgccaacactctgccctcaaaagaagcaattacagtgcagcagaagcagatgcccttctgcgacaaggatcggactctcatgacacccgtccagaatctggagcagtcgtacatgccccccgattcatcatcccctgagaataaaagcctcgaagtatccgatacccgattccatagcttttctttctacgagctcaagaacgtgactaacaatttcgacgagcgacctatttccgtggggggcaataaaatgggcgaaggcggcttcggcgtcgtgtataagggatacgtcaacaataactgtgggtccgaggaggcctgttccaacgggtag

SEQ ID NO: 121086 - DNA, 1011 bp, Artificial Sequence
  Description of Artificial Sequence: Synthetic coding sequence
atgccgttctgcgacaaggatagaaccctaatgacgcctgtgcaaaatcttgaacaatcctacatgccccccgatagcagcagccccgaaaacaagagtctagaagtctctgatactcggttccattccttctctttttatgagctgaagaatgtcactaacaattttgatgaaagacctatttcagtcggcgggaataagatgggcgaaggaggttttggggtcgtctacaaaggctacgtgaataacaccaccgtggcagtcaagaagctagctgccatggtcgatatcactactgaggaacttaagcagcagtttgatcaggagatcaaagtcatggctaaatgccaacacgagaatcttgtggaactcctgggctttagtagcgatggcgacgatctgtgtcttgtttacgtgtatatgcccaacgggtcactcctggatcgcctgagctgcctagacgggaccccaccactgtcttggcacatgcgatgtaaaattgcgcagggcgcagctaatggaataaatttccttcatgaaaaccaccacattcatagggatattaagtctgccaacattctgcttgatgaagccttcacagccaaaatcagcgactttgggctcgcccgggcctcagaaaagtttgcccaaacagtgatgacctctcgcatcgttggaaccacagcttacatggccccagaagcacttcgcggagaaattacgccgaagtcagatatttactcctttggtgttgtgctcctggaaattataactggactgcctgcggttgacgaacaccgggagccccagctactgctcgacattaaagaggaaatcgaagatgaagaaaaaactattgaagactatatagacaaaaaaatgaacgacgctgattccacaagcgttgaagcaatgtactccgtggcaagtcaatgtctgcacgagaaaaagaacaagagaccggatattaagaaggtacaacagttacttcaggagatgacggcttcttag

SEQ ID NO: 121087 - DNA, 1011 bp, Artificial Sequence
  Description of Artificial Sequence: Synthetic coding sequence
atgcccttttgtgataaggatcggacattgatgacaccagtccaaaatctagaacagagttacatgccacccgattcctcttctccagaaaataaaagcttagaagtctctgatacacggttccacagtttctcattttacgaactaaagaacgtgacaaacaatttcgacgaaagaccaatatcagtcggtggaaataaaatgggggagggtgggttcggcgttgtgtataaagggtacgtcaacaatacgaccgtggcagttaaaaaattagccgccatggtcgacattaccaccgaggagctgaaacagcagtttgaccaagagattaaagttatggcaaaatgtcagcacgagaatctggttgagctcctgggatttagctcagacggcgatgacctgtgcctggtgtatgtttacatgccaaacgggtctctgctggataggctgtcttgcctggacggcacaccccccttgtcgtggcatatgcgatgcaaaatcgctcaaggagcggctaatggaatcaatttcctgcacgaaaatcaccacattcacagagacatcaagtccgccaacattctgcttgacgaggcttttaccgcaaagatctccgactttggacttgcgcgcgctagtgaaaagttcgctcagacggttatgacctctaggatcgtgggaaccactgcatacatggcgcccgaggctttgaggggcgaaattaccccaaagtctgacatatattcattcggtgtggtcttgctggagattataaccggtctccctgccgttgatgaacaccgcgagccacagctgctgctagacattaaagaagagatcgaagatgaggaaaaaacaatagaggattatattgacaaaaaaatgaatgacgccgacagcacctccgtggaagcgatgtacagcgtcgcctcacagtgcctccacgaaaagaagaacaaacgccccgacattaaaaaagttcagcagctgctgcaggagatgacagcatcgtag

SEQ ID NO: 121088 - DNA, 1383 bp, Artificial Sequence
  Description of Artificial Sequence: Synthetic coding sequence
atgaataaacctatcacaccctcaacttatgtgcgctgcctcaacgtcggcctgatcagaaagctgagtgactttattgatccacaggaaggttggaagaaattggccgttgccattaagaagccatccggagatgatcggtacaaccagttccacataagaagattcgaggccctcctgcagacaggaaaaagccctaccagtgagctgttgttcgactgggggacaaccaactgcacagtgggcgacctggttgacttactcatacagaatgaattctttgccccagcctctttgttgcttcccgacgcagttccaaagaccgctaacacccttccttccaaggaagccattacagtgcaacagaagcaaatgcccttctgtgacaaagatcggacattgatgacacctgtgcagaacctcgagcagagctatatgccacccgatagcagcagccccgaaaataagagcctggaggtatccgatacgagatttcactcattctcattctacgaattgaagaatgtcacaaacaattttgatgagcggcctattagcgttggcggcaacaagatgggagagggcggattcggtgttgtatacaaaggatacgtgaataatactactgtggcggtaaagaagctcgccgccatggtagatatcacaaccgaagaacttaagcagcagttcgatcaggagatcaaagttatggcaaagtgtcagcacgaaaacctggtggagctactgggattctcctctgacggtgatgacctgtgtctggtttatgtctacatgccaaatggatctcttctggataggttatcgtgtcttgatggcacgccgccgttgtcatggcatatgaggtgtaaaattgcccagggcgcggccaatggcataaactttctccatgagaatcaccacatccatagagatattaagtctgccaacattctgctcgacgaggcatttacagctaaaatcagcgatttcgggctggcacgcgcatctgaaaagtttgcacagacagtgatgactagtagaattgtcggcacgaccgcctacatggcccctgaggctttaagaggtgagattacacctaagtccgatatctactcattcggcgttgtcttgctcgagattatcactggcctgccagctgtggatgagcatagagaacctcaactgctcctcgatatcaaagaggagatcgaagatgaagaaaagacaattgaagactatattgataaaaagatgaacgatgcagattctaccagcgtcgaggctatgtactctgtcgcctctcaatgcttgcacgaaaagaagaacaagaggccggacattaagaaggttcagcagctattgcaggagatgacagcttcatag

SEQ ID NO: 121089 - DNA, 270 bp, Artificial Sequence
  Description of Artificial Sequence: Synthetic coding sequence
atgaacaaaccaatcacaccctctacttatgtgcggtgcctcaatgtcgggcttattaggaagttatcagatttcatcgacccacaggagggatggaagaagctggccgtggcgatcaaaaagccatccggcgacgaccgatacaatcagtttcatattagacgcttcgaggcgttgctacagaccggaaagagcccgactagtgagctgctgttcgactggggcacgaccaactgtaccgtgggagacctggtggatctgctcatctag

SEQ ID NO: 121090 - DNA, 1383 bp, Artificial Sequence
  Description of Artificial Sequence: Synthetic coding sequence
atgaacaaacccataacaccaagtacctacgtaagatgcctgaacgtgggactgatcagaaaactgagcgacttcattgacccacaggagggctggaaaaaattggcggtggctataaagaagccatccggcgatgatcgctacaatcaatttcatataagaaggtttgaagcactattgcaaactggtaaatcaccaacttccgagctactcttcgactggggcaccactaactgtaccgtgggggacctggtagacttgctgattcaaaacgagttttttgcacctgcgtctctgctgctccccgatgctgtgcctaagacagctaatactctcccttccaaagaagctatcacggtgcagcagaagcagatgccattctgcgacaaagacaggaccctgatgacacctgtgcagaatttagaacagtcatacatgccaccggactcttcctctcccgagaataaatccctggaagtgagtgatactaggttccattcattttccttctacgagctgaaaaatgtgacaaataattttgatgagagacccatttccgtgggcgggaataaaatgggtgaaggaggttttggtgtggtgtacaagggctatgtcaataatacaacagtggctgtaaaaaagttagcagcaatggttgatattacgaccgaggaactgaagcagcagttcgatcaggaaattaaagtcatggcaaaatgtcagcacgagaaccttgttgagctgctgggtttcagtagcgacggcgacgatttatgcctggtgtacgtgtacatgccaaatggatcactgcttgacagactaagctgcttagatggcacacccccgttgagctggcatatgcgatgcaagatcgctcagggcgccgccaacggtatcaatttcctgcatgagaaccatcatattcaccgcgatattaagtccgcaaatatcctcctcgacgaggctttcaccgctaaaattagcgacttcggactcgctcgagccagtgagaaatttgctcagacagttatgactagccggatcgtcggcacaaccgcctacatggcccctgaggcactgcgaggagagatcacccccaaatccgatatatacagcttcggcgtggtcttgctggaaatcattacaggactgcccgccgtggatgagcatagggagccccagttactgctcgacattaaagaagagatcgaggatgaagagaagaccattgaagactatattgacaagaaaatgaatgatgcagattctactagcgtcgaagctatgtacagcgtggcatcccagtgcttgcatgagaagaagaacaaacgcccggatattaagaaggtccagcaactactccaagaaatgacggcatcctag

SEQ ID NO: 121091 - DNA, 2394 bp, Artificial Sequence
  Description of Artificial Sequence: Synthetic coding sequence
atgtacctggagactcggcgcgctatatttgtgttttggatttttctccaggttcaggggactaaggatataagcatcaatatctatcacagtgagacaaaggatattgacaaccctcctcgaaacgaaaccaccgaaagcactgagaaaatgtataagatgtccaccatgcgacgcatttttgatctcgcaaaacaccgtacaaaacggtctgccttcttcccaacaggagttaaggtctgcccacaggagagcatgaaacagatcttggactctctgcaggcctactataggctgcgagtctgtcaggaggcggtgtgggaggcttaccggatttttctcgacaggatccccgacaccggtgagtaccaggattgggtatctatttgccaacaagagacgttctgcctgttcgacattgggaagaacttttcaaactctcaagagcatttagacttactccagcagcgcataaaacagcgctcttttcccgaccggaaagatgaaatctcagctgaaaaaactcttggggagccgggggaaactatcgtgatcagcacagatgtggctaacgtgtctctgggcccgttccccctaacccccgatgacacactgctgaacgagattcttgataatactctgaatgatacaaaaatgcccacaactgaaagagaaacggagttcgcggtcctagaggaacagcgtgttgaactctcagtaagtctggtcaaccagaagttcaaggccgaactggccgattctcagtcaccatactaccaggaactagccggcaaatcgcaactgcaaatgcagaagatcttcaaaaaattgcctggctttaaaaaaatacacgttctcgggtttcgtcccaaaaaagaaaaagatggctccagcagcaccgagatgcagctgaccgctatttttaagaggcactcggctgaggccaagtctccagcatctgacctgcttagctttgactccaataaaatagagagtgaggaggtttaccacggaactatggaagaagataagcagcccgagatatatctgaccgcaactgacctaaaacgcctgatcagcaaggccctggaagaagaacagagtctggatgtagggaccatccagttcaccgatgagatcgccggcagtctcccagcgttcggccccgatacccagtctgagctccccacctcttttgcagttataactgaagatgcaacattgagtccggaactgccccccgtggaaccccagttagagaccgtcgatggcgcagaacatggactgccagatacctcctggtctcccccagctatggccagtacttccctgtctgaggcaccaccattcttcatggccagcagcatttttagtctcaccgaccaggggacgactgacacaatggccacggaccagaccatgctggtgcccggtttgacgatacctaccagtgactattctgctattagccaactcgcactcggcatatcccacccccccgcgtctagcgatgacagccgcagctcggccggtggagaggatatggtgcgccacctcgacgagatggacctgtcagacacacctgccccatccgaggtgcccgaattaagtgagtatgtcagtgtgcctgatcacttcctcgaggacactacacccgtcagcgccctgcagtatataactacctcctctatgaccatcgcacctaagggtcgagaactggttgtgtttttttcacttagggttgccaacatggccttctctaacgatctgtttaataagtcaagcctggagtacagagcccttgagcagcagtttacacagcttctggtgccctatttgagatccaacctgaccgggtttaaacagttggagatccttaatttcaggaatggttccgtaatagttaattccaaaatgaagtttgccaagagcgtgccatacaatttgactaaggcagttcatggtgtcctggaggattttagatctgccgccgcccagcagttacatctggaaatcgacagctatagtctgaacatagaaccagcggatcaagccgacccctgtaagttcctcgcctgtggcgagtttgcccaatgcgtaaagaacgagcggacggaggaggcagagtgccggtgcaaaccagggtacgactcccagggcagtcttgatgggctggagcccggcctatgtggacctggcacaaaagagtgtgaggttttgcaaggaaagggtgcaccttgtaggcttcctgaccactctgaaaatcaagcctataaaacgagcgtaaagaagtttcaaaaccagcaaaacaacaaagtgatctcaaagcgcaatagcgagctgctcactgtcgagtacgaagagtttaaccaccaggattgggagggaaactag

SEQ ID NO: 121092 - DNA, 477 bp, Artificial Sequence
  Description of Artificial Sequence: Synthetic coding sequence
gaacggcctaacggaaccagtgcccaacctgcacaggtgaagcccgaattctaccggcaggcagaactgaagccctgtccttggaccgggtccaaccagagacgttgcataacattctgtcctaccccagaccaggcagacccctgtaagttcttggcctgtggggagttcgctcagtgcgtcaaaaatgaacgtacagaggaggctgaatgtcgctgcaagccaggatacgatagccaaggatcattggacggcctggaaccgggactttgtggccccggcactaaggaatgcgaggtattacagggaaagggggccccttgccgccttcccgaccattctgaaaaccaggcatacaagacgtcagtcaagaagtttcaaaatcagcagaacaacaaggtcatttctaaaaggaattcagagttgctgactgtcgagtatgaggaatttaaccatcaagattgggaaggaaactag

SEQ ID NO: 121093 - DNA, 444 bp, Artificial Sequence
  Description of Artificial Sequence: Synthetic coding sequence
atgtaccttgagaccagacgggcgatcttcgttttctggatatttcttcaagtgcagggaacgaaggtctgccaggaggccgtgtgggaagcctaccgcatctttcttgacagaatccccgacactggggagtaccaggattgggtgagtatttgccagcaggagactttctgtctgttcgatataggcaaaaatttcagcaatagccaggagcaccttgacttgctgcagcagcgcataaagcaacggagtttccctgaccggaaggacgagatcagtgctgaaaaaacccttggggaaccaggtgaaaccatcgtgatatcgactgagaaaaacaaaggaaagacaaaacctttcaacatcctgcagtttggcaataaccatcatgagcacttgttgccaatcttttgtttgctgtctagcatcatctacacgtactattag

SEQ ID NO: 121094 - DNA, 3726 bp, Artificial Sequence
  Description of Artificial Sequence: Synthetic coding sequence
atgataatgtttccgctgtttggaaaaatttcactggggatcctaatttttgttctgattgaaggcgacttcccaagcctcacggctcaaacctacctgtccattgaggagatccaggagccgaagtctgcggtgtccttcttgctgcccgaggagtctaccgatttgtctctggctacaaagaagaagcaacctctggatagaagggaaaccgagcgacaatggctcatccggagaagaaggtccattctttttcccaatggcgtcaaaatctgtccagatgaatctgtggcagaggctgtggctaatcacgtgaaatatttcaaagtccgagtgtgccaggaggccgtgtgggaggcttttcgaaccttctgggataggttaccaggccgagaagagtatcactactggatgaacttatgtgaggacggtgtaacgtctatttttgaaatgggaacaaacttttccgagtccgttgagcaccgctcactgattatgaaaaagctgacatacgccaaggaaacagtgagctcttccgaactcagttcacccgtcccggtcggtgacacttctactctcggagatactactctgtccgtgccacaccccgaggtggatgcgtacgaaggagcaagtgaatctagtttggaaagacctgaggagtctatcagcaacgagattgagaatgtgattgaggaagcaactaaaccagccggggagcagattgccgagttctctatccatctgctcgggaagcagtatcgcgaggaactgcaggacagttcctcgttccaccaccagcacttggaggaggagttcatcagcgaggtcgagaacgccttcacggggctgccggggtacaaagagattcgggtgctggaattccgctctccaaaggagaacgattccggtgtggatgtctactacgccgtgacattcaacggtgaggcgatcagtaacacgacctgggacctaatctcgctgcacagcaacaaggtagaaaaccacggtttggtagagctagacgacaagcccacagtggtctatactatatctaatttccgggattacatcgcagaaaccttgcagcagaatttccttctgggcaattcttcactcaaccccgaccctgactccctccaactcatcaacgtgcgtggagttctgcggcaccaaacggaggacctggtctggaatacacagagcagttccttgcaagcaacaccttcttccatcttagacaatacgttccaagctgcctggccgtcggctgacgagtccatcacaagcagtattccaccgctggacttctctagtgggccaccctctgccactggccgggaactgtggtctgagagtcccctgggagatctggtgagcacccataagcttgccttcccatccaagatggggctgagcagctctcccgaggtcctcgaagtaagcagtctgaccctacactctgttacccccgccgttctccaaacggggctgccagtggccagtgaagagcgcacgagcggatctcacctggttgaagatggactagcgaatgtggaagagtctgaggatttcctgtcgatcgactccttacccagtagttccttcactcagccagtgcctaaggaaaccatccccagtatggaggattctgacgtgagcttgacctccagtccttatctgactagcagcataccgtttgggctcgacagtttgacgagtaaagtgaaggaccagctgaaggtcagccccttcctgcccgatgccagtatggagaaggagttgatatttgacgggggtctaggcagcggcagcggtcagaaagtggacctcataacgtggccatggagcgagacctcaagtgaaaaaagcgcggaaccattgtcaaagccctggctggaagacgatgattccctgttgcctgccgaaattgaggacaagaagctggttttggtggataaaatggattccacagatcaaatttccaagcactctaaatacgagcacgatgacagaagcacccatttccccgaggaggaacctttatctggccccgccgtgccaatcttcgccgacacagctgccgaaagtgcctctctgacactacccaaacacatctccgaggtgccgggagtggatgactactccgtgacaaaggcccccctaattctgacatccgtcgccatctccgcttctaccgacaagtctgatcaggcggatgctattctgcgcgaagatatggaacagataacagagtcctccaactacgagtggttcgattctgaagtgtctatggtgaagcccgacatgcaaactctatggacgatcctgcccgagagtgagagagtgtggacaagaaccagcagtttagaaaagctctcacgagacatcttggccagtactccccaaagtgctgatcggttatggctttccgtcacccagtctacaaagctcccacctaccactatatctaccctcctggaggatgaggtgattatgggcgtgcaggatatttccctagagctagacaggattggcactgattattaccagcctgagcaggtgcaggagcagaacggtaaggtgggaagttatgtggaaatgtcaaccagcgtccacagcacagaaatggtgtcagttgcttggcccaccgaaggcggtgacgatttgtcctatacccaaaccagcggggcactagttgtgttttttagcctgagagtcaccaatatgatgttttccgaagatctttttaataaaaattctctcgaatacaaagctttggaacagcgatttcttgaactgcttgtgccctacctgcagtctaatttgaccggctttcaaaacctggagatcctcaatttcaggaacggaagtatagtggtgaattcaagaatgaagtttgccaactctgtgccccctaatgtgaataacgccgtgtacatgatcctcgaggatttttgtaccaccgcttacaacactatgaacctggcaatcgacaagtacagcctggacgtcgaatccggcgatgaggcgaacccttgcaaattccaggcatgtaacgaattctcggagtgtctcgtcaatccttggtcaggtgaggccaagtgtagatgctttcccggctatctctctgtagaggagcgcccgtgtcagagcctgtgtgatctgcagccagacttctgtctgaacgacggaaagtgcgacatcatgcctggacacggggctatctgcagatgtagagttggcgagaactggtggtataggggcaaacactgcgaagaatttgtgtcggagcccgttatcatcggaattacaatcgcgtccgtggtgggcctgcttgtgatcttctcagccataatttactttttcattcgaaccttgcaggcgcaccacgatcggagcgaacgagagtcacctttcagcggaagcagtcggcaacctgactccttgtcgagtattgaaaacgccgtcaagtacaatcctgtttacgaatcacatagggctggctgtgagaagtatgagggcccttacccgcagcatcctttctattcatctgcctctggtgacgtgataggagggctgtctcgtgaggagatccgacagatgtatgaaagcagcgagctttcccgggaggagatccaggagagaatgagggttctagaactgtacgcaaatgaccccgagtttgccgcttttgtgagagagcagcaggtcgaagaggtatag

SEQ ID NO: 121095 - DNA, 201 bp, Artificial Sequence
  Description of Artificial Sequence: Synthetic coding sequence
ggttacctgtctgtcgaggaacgcccctgtcaaagcttatgtgacctacagcctgacttttgtctgaatgatgggaagtgcgacatcatgccagggcacggggctatctgctccggcagctcacggcagccagacagtctctcttcaattgaaaatgccgttaagtataaccccgtgtacgaaagtcaccgcgctggttag

SEQ ID NO: 121096 - DNA, 2745 bp, Artificial Sequence
  Description of Artificial Sequence: Synthetic coding sequence
atggcccaatttcctaccccgttcgggggcagtctggacatctgggctattacagtggaagagagggccaaacatgatcaacaattccactctttgaagccgatatctggatttattaccggagaccaggcccgcaatttcttctttcagtccggcttgccacagccggtgctcgcccagatctgggcactcgctgacatgaacaatgatggaaggatggaccaggtcgagtttagtatagctatgaagctgatcaaattaaaactgcagggataccagctcccctctgcccttccccccgttatgaagcagcaaccagtggctatatctagcgctcccgcattcgggatgggcgggatcgctagtatgccgccactgacagccgtcgccccagtgcccatggggtctatcccagtggtggggatgagccctaccttggtttcctcagtccccacagccgccgtgccccctctcgccaacggagcaccccccgtcatccaacctttgcccgcttttgcccacccagctgcgactctgcctaaatcaagcagcttctcccggtctggcccaggctcccagctgaacaccaagctgcagaaggcccaaagctttgatgtcgcaagcgtgccccctgtggcagaatgggccgtgccccagagcagcaggttgaagtacaggcagctcttcaactcccacgacaagacaatgtctggtcatctcacagggccccaagcaaggacaatcctgatgcaatcttccctgccacaagcccaattggctagtatttggaacttgtcagacatcgatcaggatggtaagctcaccgccgaggaattcatcctcgcaatgcacctgattgacgtggccatgtcaggccaacccctgccgcctgtgctcccacctgagtatattcctccctcctttcgccgcgtaaggagcggatcaggcattagcgtcattagtagcacgagcgtggaccaacgcctcccagaagagcccgtgctggaagatgaacagcagcaactcgaaaagaaactgcctgtgacttttgaggacaaaaaacgagagaatttcgaacgcggaaacctcgagctggaaaagcgccgtcaggctctgctggagcagcaaagaaaggaacaggaacgtttggcccagctcgaacgggccgagcaagagcggaaagaacgagagagacaagagcaggaaaggaaaagacagcttgagctggagaagcagctggagaaacaacgtgagttagaacggcagagggaagaggaacggaggaaggagattgagcggcgagaggcagctaagcgcgaactagagaggcagaggcagctggagtgggagaggaatcggcgccaggagctcctcaaccagagaaacaaagaacaggaagatatcgttgtactgaaggccaagaaaaaaacgctggaattcgagctggaagcactgaacgacaaaaagcatcagctggaggggaaactgcaggatattaggtgtcggctcactacccagcgtcaggaaattgagagcaccaataaaagtagggagttgcggatcgctgagattactcacctccagcaacagctgcaagaaagtcagcagatgctggggagactcatcccagagaagcaaattctgaacgaccagttgaaacaggtacagcagaattcactccatcgagattcgcttgtcacattaaagagggccctcgaagccaaagaactcgcccgtcagcacttgagggatcagctggacgaggtagagaaggagacccgttccaaactccaggagatcgacattttcaacaaccagctcaaggagttacgcgagattcataataaacaacaactccagaaacaaaaatcgatggaggcggagagactcaaacagaaagagcaagaacggaagataatcgagctagagaagcagaaggaggaagcccagagacgagctcaggagagggacaaacagtggctggaacacgtccaacaggaggacgaacaccaacgtccgagaaaactgcatgaagaagaaaaactgaaaagggaggagagtgtcaagaaaaaggacggcgaagagaagggtaagcaagaagctcaggacaagcttggacgattatttcaccaacaccaggaacccgcaaagccggccgtgcaagccccctggagcaccgcagaaaagggacctctcaccatcagcgcccaggagaacgtaaaagtcgtctattaccgagctttgtatcccttcgagtcccgcagtcatgatgagatcaccatccagccaggggatatcgtcatggtcgacgagtcgcagacaggcgagccgggatggctcggtggcgaactgaaaggaaagactgggtggtttccagctaactatgcagagaagatccccgaaaacgaggtgcctgcacctgtcaagcccgtcaccgattcgaccagtgccccagcgccaaagctggcccttagagagacgccagcccctctggcagtgacctccagcgagccgtccaccacacctaataactgggccgattttagcagcacttggcccacttcgaccaacgaaaaaccggaaaccgataattgggacgcgtgggctgcacaaccctccctgacagtcccatcagctggacagctgcgacaaagatccgcatttacccctgccacggctaccgggtcgagcccttcacccgtactgggtcaacacggtttctggttctttagggagagctgctag

SEQ ID NO: 121097 - DNA, 954 bp, Artificial Sequence
  Description of Artificial Sequence: Synthetic coding sequence
taacccctgatggagtcagagctcctcacagaaaaagaggtggccatgatcttcgtcaactggaaggaactgatcatgtgtaacataaagctcctcaaggctctccgggtgaggaaaaaaatgtcaggggagaaaatgcccgtgaagatgatcggcgacatactgtcggcgcagctgcctcacatgcaaccctacattcggttttgctcccgacagctgaacggagctgccctgatccagcagaagactgacgaagcgccagactttaaggaattcgtgaaacggttggcgatggatcctcggtgcaaagggatgcctctgtcatcgttcatactgaaacctatgcaacgggtgactcggtaccctctcattatcaagaatcagctggtgtttaacagcgtgacgaactgcctcgggccccggaagtttttgcacagtgggaagctgtataaggctaagtccaacaaggaactgtacgggttcttgtttaatgactttctcttattaacccagatcaccaagcctctgggctcatccgggacagacaaggtgttttcacccaagagtaacctgcagtataaaatgtacaaaacacccatctttttgaacgaggtgctggtgaagctgcccactgatccgtctggtgacgagccgatttttcacatcagtcacattgatcgagtgtatacactaagggctgaatcaattaatgagcgcacagcgtgggtccagaagattaaggcagcttcagagttatatatcgagacagagaagaaaaagcgcgagaaagcctatttagtcagatctcagcgggcaactggaatcggccgacttatggtaaacgtcgttgagggcattgagttgaagccctgccgctcccacgggaagtctaatccctactgtgaggtgacaatgggcagtcagtgccatatcacaaagacaattcaggactag

SEQ ID NO: 121098 - DNA, 5166 bp, Artificial Sequence
  Description of Artificial Sequence: Synthetic coding sequence
atggctcaattccccacaccgttcggagggtccctcgatatctgggctattacagtcgaggaaagggctaagcacgatcaacagttccattctttgaaacccattagtgggtttatcactggagatcaggcgaggaatttctttttccagagcggcctcccacagcccgttctcgcccaaatttgggcccttgccgacatgaacaatgatgggcgaatggatcaggtcgagttttcaatagcaatgaaactcatcaagctcaaactccagggctatcagttaccaagcgccctccctccagtgatgaagcagcaacctgtcgccatctcctccgcacccgctttcggaatgggtggtattgcatctatgccgcctctgactgctgtggcccctgtgcccatgggttctatcccggtggtgggaatgagccctactttggtatcgtccgtgcccaccgcggcagtacctccactggctaatggcgccccacccgttatacagcctctgcccgctttcgcacaccctgcagccaccctgccgaaatctagctctttctcacggagcgggcctggaagtcagttaaacacgaagctacagaaggcccagtcattcgatgtagcctccgttcccccggtcgcagaatgggctgtgccacagtctagtcgccttaagtacaggcagctattcaattcccacgacaagacgatgagtgggcacctgactgggccgcaggccagaaccatcctgatgcagtcttccttgccacaggctcagttggcgtccatctggaatctgtcagacattgaccaggatggtaaattaacagcggaggagttcatactagcaatgcacctcatcgacgtggcaatgtccggccaacctttgccacccgtgcttccccctgaatacattccgcccagcttccggagggtgcgatccggctccggaatttccgttatttcgtctacctcagtggatcagcgactccctgaagaacctgtcctggaggacgagcagcagcaattagagaaaaaactgcctgtgacattcgaggacaaaaagcgcgaaaacttcgagcgtggaaatctggaactcgagaagagaaggcaagcattactcgagcagcagagaaaggagcaggaacggctggcccagttggaacgggcagaacaagagcggaaagagagagagcggcaagaacaagaacggaaacgacagttggaactagaaaaacaactggagaagcaacgagaactggaaagacagcgagaagaagagagaagaaaggagatcgagcggagggaggccgcgaagcgagaactcgagcggcaacgccaattggaatgggaacgcaaccgcagacaggagcttttaaatcagaggaacaaagagcaggaggacatcgtcgtgctaaaggctaagaagaagaccctggaattcgagctggaggctcttaacgacaagaaacaccagctggaagggaagctgcaagatatccggtgcaggctcactacacaacgacaggaaatcgagtccaccaacaagtcacgggaactccggatagcggagattacccatctacagcagcagttgcaggagtcacaacagatgctgggacgactcattccggagaagcaaatccttaatgatcaacttaagcaggtacagcagaactccctccatcgagatagtctggttactctaaaaagagctctggaggcgaaagagcttgcccggcagcatctgcgggaccagctggatgaagtggagaaagagacccgcagcaaactccaggaaattgacattttcaacaaccagctgaaggaactcagggagatccataacaaacagcagctgcagaagcagaaaagcatggaggccgagcgcctgaagcagaaggagcaggagcgcaagataattgagttagagaagcagaaggaagaagcgcagcgccgtgctcaagagcgcgacaaacagtggctggaacatgttcagcaagaggacgagcatcaaagacctcgcaaactgcatgaggaagaaaagctgaaacgcgaggaatccgttaaaaagaaggatggtgaggagaagggtaaacaggaggctcaagataaactcggaaggctgttccaccagcatcaagaaccagcaaagccagcggttcaggccccatggagcaccgctgagaaaggtcccttaaccatttccgcccaggaaaatgtgaaggttgtctactaccgtgctctctacccttttgagtcaaggagccacgacgaaataaccatccagcctggcgatattgtgatggtcatcggttgctgggtggatgagtcccaaaccggcgagcccgggtggctaggcggtgaactgaaaggcaagacgggatggttccccgcgaactatgccgagaagatccctgaaaatgaggttccggcgcctgttaagcctgttacagattccacatcagcccccgccccgaaactggcactgcgggagacgcctgctcctctcgctgtgaccagcagtgaaccatccaccacgccaaataattgggcagacttttcctcaacttggccaacgagtacgaatgaaaaacctgaaacggacaattgggacgcttgggcagcccaacccagcctaaccgtgccctcagcgggccaacttagacaaaggtcagccttcaccccagccaccgccacagggagctcaccaagcccagtcctgggtcagggtgagaaagtggaggggttacaggctcaggcactctacccttggagggccaaaaaagacaatcacttgaactttaataagaacgatgttatcactgttctggagcagcaggacatgtggtggtttggggaggtacaaggacagaaaggctggttccccaaaagctacgtgaaactgattagtggaccaatcagaaaatctaccagcatggacagcggatcctctgagtcacctgcgtccctgaagcgggtcgcttctccagctgcaaagccagtggtctccggggaagagttcattgcgatgtacacttacgaaagctcagagcaaggcgatctcacattccagcagggtgacgtcatcctcgtaactaaaaaggatggggattggtggaccgggactgttggagacaaggccggtgtctttccttcaaactatgtgagacttaaagacagcgaggggtcgggcactgccgggaaaacaggttctctaggcaagaaaccagagatcgcccaagtgatcgcctcctacaccgcgacagggcccgaacagctgaccctggcccccgggcaacttatactcattcgtaagaagaatcctggaggctggtgggaaggcgaactgcaggctcgcgggaaaaaaagacagatcgggtggttcccagccaattacgtgaaactcctgtccccaggaacatctaagataacacctaccgaacccccgaagagcactgcactggccgcggtgtgtcaggtaataggcatgtacgactacacagcacagaacgacgacgaactagccttcaacaagggtcaaattattaacgtcttaaataaagaagatccggattggtggaagggagaggtcaatggccaggttgggctgtttccctccaactacgtgaagttaaccactgacatggatccatctcagcaatggtgctccgacctgcatttgctggacatgcttaccccgactgagagaaagagacagggatacattcacgagctcattgttacggaagagaactatgtgaatgatctgcagctggtgacagaaatattccaaaaacctcttatggagtccgagctgctcaccgagaaagaggttgcaatgatcttcgtgaactggaaggagctaataatgtgtaatattaagctgctcaaagccctcagagtcaggaagaaaatgagtggagagaagatgccggtgaaaatgatcggggacatcctatctgcacagttgccccacatgcagccatacatacgtttctgctctcggcagctgaatggggctgctcttattcagcagaagaccgatgaagccccagattttaaagaattcgtgaaaaggcttgctatggatccccggtgcaagggcatgccactgagttcctttatcctcaagccaatgcagcgcgtgacaagatatccgctgattataaaaaacatcctcgagaacaccccagagaatcaccccgatcattcccatctcaagcatgcccttgaaaaggctgaggaactatgttcccaggtcaacgagggggtacgtgagaaagaaaacagcgatcgattggagtggattcaagcgcacgtacagtgcgaaggattatctgaacagctggtgttcaactccgtgacaaattgtcttggcccgcgtaagtttctgcacagcgggaagctgtacaaggcgaagtcgaacaaggaactgtacgggttcctatttaatgacttccttctgctgactcagattactaagcctcttggatccagtgggactgataaagtgttttcaccaaaatcgaatttacagtataaaatgtataagactcccatatttctgaacgaagtgctagtgaaactccctaccgatccaagtggcgatgaaccaatttttcatattagtcatattgaccgggtatacactctgagagctgaatctataaatgaacgcacagcctgggtccagaaaattaaagccgcgtccgaattgtatattgagacagagaagaagaagagagagaaggcatacctcgttcgttcccagcgggcgacaggaattggacgattaatggtgaacgtggtagaaggtatcgaattgaaaccatgccggtcccatggcaaatcgaatccctattgtgaggtgacgatgggatctcaatgccacattacaaaaactatacaagacacactcaaccctaagtggaacagcaactgtcagtttttcatcagagatttggagcaggaagtgctctgtatcacagtgttcgagagagatcagtttagtcccgacgattttctgggccgtacagagatccgggtggcagacattaaaaaagatcaaggtagcaaggggcccgttactaaatgtctcctcctccatgaagtgcctactggtgagatcgtggttagactcgatcttcagctcttcgacgagccatag

SEQ ID NO: 121099 - DNA, 4953 bp, Artificial Sequence
  Description of Artificial Sequence: Synthetic coding sequence
atggctcaattcccaacgccttttggtggcagtctggacatttgggcaataaccgttgaggagcgcgccaagcatgaccaacagtttcactcgctgaaacctatctccgggtttataacgggtgaccaggcgcggaatttttttttccaaagcggacttccgcagcccgtactggcccagatctgggctctcgctgatatgaacaatgatgggcgcatggatcaagtggaattcagcattgctatgaaattgatcaagctgaaacttcagggataccagcttccgagcgcgttgccaccagtcatgaagcagcaacctgtggccatctcatctgcccctgcatttggtatggggggcatcgcgtcaatgccacctctgactgcagtcgcccctgtgcccatgggctctatcccagtcgtaggcatgtcacctaccttagtcagcagcgtacctaccgcagccgtccctcccttagctaatggcgctccacccgtaatccagcctcttcccgcttttgctcacccggccgccaccttgccgaagtcctccagcttttcccgcagcgggccaggaagccaactcaacacaaagcttcagaaggcccagagttttgacgtcgccagtgtccccccagtcgccgagtgggcggtgccgcaaagttccaggcttaagtaccgccagctgtttaactctcacgacaaaacaatgtctggccacctgacaggccctcaggcacgcactattcttatgcaaagttcgctaccgcaagcccagctggcatcaatttggaatctgtcggacatagatcaggatggaaaactgacagccgaagagtttattctcgccatgcacctgatcgacgtggcaatgagcggacagcccctcccaccggtgctaccccccgagtacattccacccagctttagaagggtgagaagtgggagtggcatttcagtcatctcctccaccagtgttgatcagaggctgccggaggaacctgtgttggaggatgagcagcagcagctggagaaaaagctgcccgtaacttttgaagacaagaaacgggaaaacttcgagcgtgggaatctggaactggagaagcgacgccaggcactgctcgagcagcagaggaaagagcaggagcgcctggcacagctggaacgagcagaacaagagagaaaggaaagggagcgccaggaacaggagaggaagcgtcagcttgagttagagaaacagctcgagaaacagagggaactggagcgccaaagggaagaggagagacgcaaagaaattgaaagaagagaagccgcaaagagagagttggagcgacagcgccaattagagtgggagaggaaccgaagacaggagctcttaaatcagaggaacaaggagcaggaggatatcgtcgttctgaaagccaagaaaaagacacttgagttcgagctggaggcattgaatgataaaaagcaccagctggaagggaaactgcaggatatcaggtgtcgcctgacgacacaacgccaggagatcgagtcgaccaataaatcacgggaactgaggatcgctgagatcacacatctgcagcaacagcttcaggagagtcagcagatgctgggtcgattaatccccgagaagcagattctgaacgatcaactaaagcaggtgcagcagaattctttgcatagggattcactcgtgacactgaagcgagccttagaagctaaagagctcgcccgccaacacctcagagaccagcttgatgaagtggaaaaagagacaagatccaagcttcaggaaattgacatcttcaataaccagctcaaggaactgagggagatccacaataagcagcagttacaaaagcaaaagtcaatggaagccgagcggctcaagcagaaggagcaggagcggaaaatcattgaactggagaagcaaaaggaagaagcgcagcgcagggctcaggagcgcgataaacagtggcttgaacacgtgcagcaggaagacgaacaccagagaccacggaagcttcatgaagaagagaaactgaagagagaagagagcgtgaagaaaaaagacggggaggaaaaagggaagcaggaagcccaggacaaactgggtcggctgtttcaccaacaccaggaacccgctaagccagccgtccaagctccatggtccaccgccgagaagggcccactaaccatctccgcccaggagaacgtgaaggttgtgtactaccgtgcgctgtacccatttgaatcaagaagtcacgatgagattactattcagcccggtgatattgtgatggttattggctgctgggtggacgaaagtcaaactggtgagcctggttggttaggtggagagctgaaagggaaaaccggatggttccccgctaattacgccgagaaaatccctgaaaatgaggtgcctgcccccgtaaaaccggttaccgacagtactagtgcccctgcccccaagctggcacttcgagagacacccgcccctttggctgtgacctcttccgaaccgagtactacaccaaacaactgggcagacttttcgagcacctggcccactagtactaacgagaagccagagaccgacaactgggacgcctgggccgcacagcccagcctgactgttcccagtgctggccagctccgccagaggagcgcatttacccccgccaccgccactggctcatccccttccccagtattaggccagggagagaaagtggaaggcctgcaagcccaagccctgtacccatggagagccaagaaggacaaccatcttaattttaacaagaatgacgtgatcactgtgctggagcagcaggacatgtggtggtttggcgaggtgcagggtcagaaagggtggtttccaaagtcatatgtgaagcttatatctgggccaattaggaaaagcactagtatggatagcggttcttcagagtctcctgccagtctcaagcgggttgcgtcaccagccgccaaaccggtagtgagtggcgaggagatcgcccaagtgatcgcttcctacactgccacgggtcctgagcaactcacactggcccccggccagctgatactgatccggaaaaagaacccgggcggctggtgggaaggcgagcttcaggccaggggcaagaaacgccaaatcggctggtttcctgcaaactatgtaaagttactctcacctggcacttcaaagatcacaccgacggagccacctaagtcaaccgcactggccgccgtttgtcaggtgatcggcatgtacgactataccgcacaaaacgacgatgagctggccttcaacaagggacagatcataaacgtgctaaataaggaggatccagattggtggaagggagaggttaacgggcaagtcggacttttcccatcaaattacgtcaaattgacaaccgacatggacccatctcaacagtggtgttctgatctccatctcctggacatgctgaccccgacggaaaggaagagacagggctacatccacgagctgattgtgactgaggagaattacgtcaatgacctccagctcgtgacagagatcttccagaagcctctaatggaatcagaacttcttaccgagaaagaagtcgcaatgatctttgtcaattggaaagagctaatcatgtgtaacattaagctgctgaaagccctccgcgtcaggaaaaaaatgtctggggagaagatgccggttaagatgatcggggacatactatcggcccagctgcctcacatgcagccgtacatcaggttttgttctcggcaactcaatggagccgctcttatacagcagaagaccgacgaggcccccgattttaaggaatttgttaaaagactggcaatggaccctcgctgcaaaggtatgccactgagtagttttattctgaagcctatgcaacgggtcaccagatacccgctgattattaagaacatactggaaaatactccggagaaccaccctgatcactcccacttgaagcatgcccttgagaaggcagaagaactctgtagtcaggtgaacgaaggagtgagagagaaagaaaacagtgatcggttagaatggattcaagctcacgtccaatgcgaaggactttccgagcagctggttttcaactcagtgacaaattgtttaggaccgcggaagtttcttcactccgggaaactgtacaaagccaagagtaataaagaactatacgggttcctgtttaacgattttctgctgctgacccagattacaaaacctttaggttcttctggaacagacaaggtgttctcacctaagagcaacctccagtacaagatgtacaaaacacctatcttccttaatgaggtcctggtgaagttacccacagatcccagcggtgacgaaccaatttttcacattagccatatcgacagggtttataccctcagggccgagtctatcaacgagaggaccgcctgggtgcagaagattaaagctgctagcgaattgtatattgagactgaaaagaagaagagagaaaaggcttacctcgtgcggtctcagcgcgccaccgggattggccggctgatggttaatgtggttgagggaatcgagcttaagccatgtaggagccacggaaagagtaacccctattgcgaagtgacgatgggtagtcagtgccacatcactaaaacgatacaggacacactgaaccccaagtggaatagtaattgccaattttttatccgagatcttgaacaggaagtgctgtgtattaccgtgttcgaacgggaccagttctcacctgatgacttccttgggagaaccgagatccgggtggctgacatcaagaaagaccaaggctccaaggggcccgtcacaaagtgtctgctgctgcacgaagtgcccacgggagagatcgtggtgaggttggatttgcaattgtttgatgagccctag

SEQ ID NO: 121100 - DNA, 3237 bp, Artificial Sequence
  Description of Artificial Sequence: Synthetic coding sequence
atggcccaatttccaaccccctttggaggaagcctcgacatttgggccattacagttgaggaaagggccaaacacgatcaacagtttcacagcctgaagccgatttcgggcttcattacaggcgaccaagctaggaacttctttttccagagcggactgccacagcctgtgctcgctcagatctgggcactggctgacatgaacaacgatggtcgaatggatcaggtggagttttcgatcgcaatgaagctgatcaaactcaaactgcaggggtatcagttgccctccgccctgcctcctgtgatgaaacagcagccagtggctatatctagtgcacccgcattcgggatgggaggaatcgccagcatgccacctctgaccgccgttgcgccagttccgatgggctctattccagtggtgggtatgagcccaaccctagtctcctcagtaccgactgccgcagtgcccccgctcgccaatggtgcaccccccgtgattcagcctctgcccgcctttgcccatcccgccgctacactgccaaagtctagcagcttttcccgcagcgggcccggatctcagctcaacaccaaattacagaaagcccaaagcttcgacgtggcctctgtacctccggttgccgaatgggccgtgccacagagcagccgattgaagtaccggcagctcttcaactctcacgataaaactatgtccggccacctgactggcccacaggcccgaaccatccttatgcagtccagtttaccacaggcgcaattggcaagcatttggaatttgtccgatatcgaccaggacggtaaacttactgctgaggagtttattttagctatgcatctgattgacgtcgccatgtcagggcaacctcttccacccgtacttccaccagaatacatcccaccatccttccggagggtcagatccggatctgggatatctgtgatatctagcaccagcgtggaccagcggcttccagaggaacccgtcctggaggacgagcagcagcagctggaaaaaaaactacctgtcacttttgaggataaaaagcgtgagaatttcgagcgagggaacctggaactcgagaagcgtcggcaggcattgctggaacagcagcggaaggagcaggagaggcttgctcaattggaaagagctgagcaagagcgcaaggagcgggagcgccaggaacaggagagaaagcggcagttagagttagagaaacagcttgagaaacagagagagctagagagacagagagaagaggagcggcggaaagagatagagaggagagaagcagcgaagagggagctggagcgccagaggcagctggagtgggagaggaatagacgccaggagctgctaaaccagagaaataaagagcaggaagacatcgtcgtgctgaaggctaaaaaaaagactctcgaatttgaactggaagcactcaacgataaaaaacatcagctcgaaggaaagttgcaagatataagatgtagactaactactcagcggcaagagattgagagcacaaacaagagcagggagctacgcattgctgagattacccatctccagcagcaactgcaggagtcccaacaaatgctcgggaggctgatccctgagaagcagatcctgaacgaccagctgaagcaggtccagcagaactctctgcacagagacagcctggttaccctcaagagggccctggaagccaaagagctggcgagacaacatctcagagaccagcttgacgaagtggaaaaggagactcggagcaaactgcaggagatcgatatattcaataatcaattaaaggaactgcgcgaaatacacaacaagcagcaactccagaaacaaaagtctatggaggccgagcggcttaagcagaaagagcaggaaagaaaaattatagagctggagaaacaaaaggaggaagcccagaggcgggctcaggagcgggacaagcagtggctcgagcatgtgcagcaggaagacgaacaccagcgacctcgtaaactgcacgaagaggaaaagcttaagcgggaagaatccgtcaaaaaaaaggacggggaagaaaaaggcaaacaggaggctcaggataagcttgggcggctgttccatcagcatcaggagcccgctaaacccgctgtccaagctccctggtccacagcggaaaaaggccctctgaccatcagcgcccaggagaatgtgaaggtcgtttactatagggctctttacccctttgagtcgcgaagtcacgatgagataaccattcaacctggagatattgtcatggtcgacgagtcgcagaccggcgaacccggttggttgggtggggagctcaagggaaaaactggatggttcccagctaactacgccgaaaaaatacctgagaacgaagtacctgccccggtcaagcctgttaccgactccaccagcgcacccgctcccaagcttgcgctcagggaaaccccggcgccccttgcagtgacctcctctgaaccctcaaccacgcccaataattgggccgattttagctccacctggccgactagcacaaacgagaagcctgagacagataattgggatgcctgggcagcccagccatccctgactgtccccagcgcaggccaactcagacaacggtccgcatttaccccagccaccgctacagggagcagtccatccccggtcctcggtcagggagagaaggtggaaggcctacaggctcaggctttgtatccgtggcgtgccaagaaggataaccacttaaactttaataagaacgatgtcattacggttcttgagcaacaggatatgtggtggttcggggaggttcagggccagaaggggtggtttcccaaatcatacgtgaagctaatcagcggccccattcgaaagtccaccagcatggatagcgggagctctgagtctcctgccagtctgaaacgagttgcatcacctgcagctaagcccgttgtttctggggaggaattcattgccatgtacacctatgaatcatctgaacagggcgacttaacatttcagcagggagacgtgattcttgttacgaagaaggatggcgactggtggaccggaaccgtgggcgataaagccggcgtcttcccaagcaactatgtgagactaaaggattccgaaggaagtggcaccgcaggcaaaaccgggtctctgggaaagaagcccggcccttcatgcaacgtcaaatag

SEQ ID NO: 121101 - DNA, 3663 bp, Artificial Sequence
  Description of Artificial Sequence: Synthetic coding sequence
atggctcaatttcccacaccgttcggcgggtctctggatatatgggccatcacagtcgaagagagagccaaacacgatcaacagtttcattctctaaagccaatcagcggcttcatcacaggcgatcaagccaggaacttcttcttccagtccggactccctcagcccgtgctggctcagatctgggccctggcagatatgaataacgatgggaggatggatcaggtggagtttagcattgctatgaagcttatcaaactcaagttgcagggctaccagctcccttcagccttgccccccgtcatgaagcagcaacctgttgcaattagctctgctccagcatttggtatggggggcatcgcatccatgcccccactgaccgctgttgctcccgtgccgatgggctccatcccggtggtgggaatgagcccaacactagtgtcctcggtgccgactgcagcggtccctccattggcaaatggcgcccctccagtcattcaacccctgccggcctttgcccatccagccgccactctgcccaaaagtagctccttctcccggtctggccccgggagccagttaaacaccaaactgcaaaaagcacagtctttcgacgtagcaagcgtgccccccgtggccgaatgggccgtgcctcaatccagtcgattgaagtatcggcagctctttaatagtcacgataaaacaatgtccggtcacctgacagggccacaagctcggaccatcctgatgcaatcctcattgccccaggctcagctggcctccatctggaatctgagcgacatcgaccaggacggtaaactaaccgcagaggagttcatcctcgctatgcatctgattgatgtggccatgagcgggcagcctctgcctcccgtgcttcctcctgagtacataccaccctctttcaggcgagtgcggtccggtagcggcattagtgttattagcagcacatctgtggaccagaggctgcctgaggagcctgtgcttgaggatgaacagcaacaactcgagaagaaactgccagtaacgttcgaagataaaaaacgggaaaacttcgaacggggcaatctcgagctggagaagcgtcgccaggcactcttggagcaacagcggaaggagcaggaaagattggcacagttggaacgggccgagcaagaaagaaaggaacgcgagcgccaggagcaagagcggaagcgccagctggagctggagaaacagctggagaaacagcgggagcttgagcggcagcgggaagaggagagacgtaaggagatagagcggcgtgaggcggccaagcgggagctggagcggcagaggcagttggagtgggagagaaaccgacgccaagaacttttgaaccagcgaaataaagagcaagaggatatagttgtcttgaaagctaagaagaagactctggagtttgaattggaggccctgaatgacaaaaaacatcagctcgagggcaaactgcaggatattcgctgtagactgactactcagagacaggagatcgaatccactaataaaagccgtgagttgcgaatcgccgagatcacacacctacagcaacagctgcaggagtcgcaacagatgttgggtcgcctgatcccagaaaaacagattctgaacgatcaactgaagcaggtgcagcagaacagtcttcatagagattctctagtcactctcaaacgagccttggaggccaaagagctggcacgacagcacttgcgagaccaactggacgaggtagagaaggagacgcgctctaaattacaggaaatcgacattttcaacaatcagctgaaagaactgcgcgagatacacaacaaacagcagctgcagaaacaaaagtccatggaggctgagaggttgaagcagaaagagcaagaaaggaagataatcgaacttgagaagcagaaggaggaggctcagcgccgggcccaggagcgggataagcagtggctcgagcacgtgcaacaagaggacgaacatcagaggccacggaagctccatgaggaagagaaactgaagagagaggagtctgtcaagaaaaaagatggagaagagaaaggcaagcaggaagcgcaggataaactgggtagactttttcatcagcaccaggaaccggccaaaccagctgtgcaggcgccctggagcaccgcggagaaagggcccttaacgatcagcgcccaggaaaatgtcaaggtggtatattacagggccttataccctttcgaatcacgctcccacgatgagattacaatccagccaggagatatagttatggtaaagggcgagtgggtcgatgaatcccagaccggcgaaccagggtggctcggtggcgagttgaagggtaagactggttggtttccagccaattatgctgaaaaaattcctgagaacgaagtccctgctcctgtgaagcctgtcactgattcaaccagcgcaccagcccctaaactggctctgcgggagacccccgcccccctggcagtcacaagctccgagcccagtaccacacccaataactgggctgatttctccagtacctggcctacgtctaccaacgagaaacctgagacagataactgggacgcatgggctgcccaaccttcattgaccgtgccctctgcaggtcagctgaggcagcgttcagccttcacgcctgctaccgctacgggatcaagcccctcccctgtgctgggccagggggagaaagtagaagggttgcaggctcaagccctttatccctggcgagccaaaaaggacaatcaccttaacttcaataagaatgatgtgattactgtcttggaacagcaggacatgtggtggttcggcgaagtgcaggggcagaagggatggtttcccaagtcttatgttaagctcatttccggtccaattagaaaatctacctccatggattctgggagctccgagagcccagcctcgctgaagagagtggcatctcccgcagcaaaaccagtggtttctggcgaagagtttattgctatgtatacttatgagagttcagagcagggtgacctcacatttcagcaaggagacgtgatcttggtcactaaaaaagatggcgattggtggactggcactgtgggggataaggctggggtgtttccaagtaactacgttaggctcaaggattctgaaggaagtgggaccgctggcaaaacaggctctctgggaaaaaagcccgaaattgcccaagtgatagccagttacactgcgaccgggccagagcagctgactctcgcccctggccagctgatcttgattcgcaaaaaaaatcctggaggctggtgggaaggagagttgcaggcaagagggaagaagcgacagattgggtggttccccgccaattacgtgaagctgctctcgccaggaacatctaagattaccccaactgagccacccaagagtacagccttggcagcagtgtgtcaggttatcggaatgtacgactataccgcccagaacgacgacgagctagccttcaataagggacaaatcatcaacgtgttgaacaaagaggaccccgactggtggaaaggggaagtcaatgggcaggtgggcctcttcccatccaattatgtgaagcttaccaccgacatggacccctcacaacagtag

SEQ ID NO: 121102 - DNA, 5166 bp, Artificial Sequence
  Description of Artificial Sequence: Synthetic coding sequence
atggcacagttccctacaccattcgggggctcactagatatctgggcaatcaccgttgaggaacgggctaagcatgatcaacagttccattctcttaagcccattagcggttttattacaggggatcaggcccggaattttttctttcagtcagggcttccccagccggtactcgcacagatctgggcattagcagatatgaataacgacgggagaatggaccaggtcgagttcagtattgccatgaaacttataaagcttaagctgcagggctaccaactcccgtcggccctgccgcctgtaatgaaacagcaacccgtggctattagcagtgctccggcatttggcatggggggcattgcaagtatgccccctcttaccgccgtggccccagtgccaatgggctccatccccgtggtcgggatgagcccaactctggtttcctccgtgcctacagccgccgtgcctcccctggcaaatggcgcccctcctgtaattcaacccctacctgcattcgctcatcccgcggctacattgcctaagagctcttcctttagcaggtccgggccaggatcccagctgaacaccaaactgcagaaagcccagagtttcgatgtggcgtctgtgccgccggttgccgaatgggcagttccacaaagtagtagactcaagtataggcagctgtttaactcacatgacaagactatgagcggccacctgacaggcccccaggcacgtacaatcctcatgcagagttcactaccacaagcacagcttgcatcaatctggaacttatctgatattgatcaggacgggaagctgactgcagaggagttcatcctggctatgcatctgattgacgtggcaatgagtgggcagcccttgcctcccgtgctccctccggaatatattcccccttcatttaggagagtccgctctggcagcggaatcagcgtcatcagtagcacatccgtagaccaacgattacccgaggagcccgtactagaggatgagcagcagcagcttgagaaaaagctgcccgtgaccttcgaggacaaaaaacgtgagaattttgagcggggtaacttagaactggaaaagaggcggcaggcgttactggagcagcaaaggaaggagcaagagagactcgcccaacttgagcgcgctgaacaggagcgcaaggaaagggaaaggcaggaacaggaacgaaagagacagctcgagctggagaaacaactggagaagcaaagagaactggagagacagcgcgaagaagagcgcagaaaggaaattgagcgccgcgaggccgccaaacgggaattggagagacagcgccaactggaatgggagcggaacagacgccaggaattattaaatcagaggaacaaggaacaggaggacattgtcgttctgaaagctaagaaaaaaaccctggaatttgagctggaggctctcaacgacaagaaacaccaactggagggaaagctgcaggacattcggtgccggttgacaacccagcgccaggagattgaatctacaaataagtcacgcgaactgcgtatcgccgagattacacatttacagcagcaacttcaggaatctcagcagatgttaggccgcttaatcccggagaaacagattctcaacgaccaactcaaacaagtgcagcagaactcactgcacagagattccttggtgactcttaaacgagccttggaagcgaaggagctggcacggcagcaccttcgggatcagttggatgaagtggaaaaagaaacaaggagtaaactccaggagattgacattttcaataatcagctgaaagagctgagggagatccataataaacaacagctccagaagcagaagagcatggaggctgagcgccttaagcaaaaagagcaggagcgaaagatcatcgagctggagaaacagaaggaggaggcccagcgacgtgcacaggaaagggacaagcagtggctggaacatgtgcaacaggaggatgagcaccagcgtcctcggaagttgcacgaggaggagaagcttaagcgtgaggaatcagtcaagaagaaggatggggaagaaaaagggaagcaagaagctcaggataagctcgggagactgttccatcagcatcaggaacccgccaaacccgccgtgcaggcaccatggtccactgcagagaaaggccccctcaccatttctgcccaggagaacgttaaggtggtgtactaccgggccttgtaccctttcgaaagtaggtcacacgacgagatcacaatacagcccggggacattgtgatggttaaaggcgaatgggtggatgagtcccagacgggagagcccggatggctcggtggtgagctgaaaggaaagacaggatggtttcccgcaaactacgctgaaaaaatccccgagaacgaggtgccagcacccgtgaaacccgtgacagactccacaagcgcccctgctcccaaactcgccttgcgcgaaaccccggcccctctggccgtaacgtcatccgagccatctactactcctaacaactgggctgacttttcctctacctggcccacctcaaccaatgaaaagcccgagactgacaactgggatgcgtgggccgctcagccctctctcacagtgccaagcgccggacagttacggcagagatcagcattcacccccgcaactgccactggctcatctcctagccccgttctgggccagggggagaaggtagagggcctgcaggcacaggccctgtacccatggcgcgccaaaaaagacaaccacctgaacttcaacaaaaacgatgtaatcaccgtgttagagcagcaggatatgtggtggtttggagaggtacaaggtcaaaagggttggtttccgaagagctatgtgaagctcatcagtggccctatacggaaaagcacaagcatggactcgggcagctccgagtcccctgcaagtctcaagagggtggctagtcccgccgcaaaaccagtggttagcggcgaagaatttatcgcgatgtacacatacgagtctagtgagcagggggaccttactttccagcaaggagacgtaatcctcgtgacaaagaaggacggtgactggtggactggaacagttggtgacaaagcgggcgtgtttcccagcaactacgtgcgcctcaaggattcggaagggtccggaaccgccggaaaaacgggctctttaggaaaaaagccagagatcgcgcaggtgatagcttcctacactgctaccggccccgaacagctcaccctcgcgcctggacagttgattctgattagaaagaaaaaccctggaggttggtgggagggagagcttcaggcccgcgggaaaaagcgccagatcgggtggtttccagctaactatgttaaactgctgtctccaggaacaagcaaaatcacacccacagagcctcccaaatccacggctctggccgctgtctgccaggttatcgggatgtatgattatacagcccaaaatgacgacgagctggctttcaacaagggccagatcatcaatgttttaaacaaggaagatccagactggtggaagggcgaggtcaacggccaggtcggcctgtttcctagcaactacgtcaaactcaccaccgacatggatccctcccagcaatggtgcagtgatctgcacctgcttgatatgctgacacctacagagaggaaacgacaaggatacattcatgagctgatcgtgacagaagagaattacgtgaatgatctccagctcgtcactgagatctttcagaaaccacttatggagagtgagttactgactgagaaagaagttgccatgatatttgtgaattggaaagaactgatcatgtgtaacataaaactgctaaaggcactgagagtgcgcaagaagatgagcggggagaaaatgcccgtgaagatgatcggagacatactaagtgcccagttgccgcatatgcaaccttatatccgtttctgctctagacagctgaatggtgcagcgttgattcagcagaagaccgacgaggcgcccgatttcaaagaattcgtcaagcggctagccatggacccccggtgcaaagggatgcccctgagctcttttatcctaaagccgatgcagcgggtgactaggtaccccttgattattaagaacattctcgagaatacacctgagaaccacccggaccactctcacctgaagcatgcccttgagaaagcagaagaactatgttcgcaagtgaatgaaggggttagggaaaaggaaaacagcgatagacttgagtggattcaagcccacgtgcagtgtgagggtttatccgagcaactcgtcttcaattctgtcactaattgtctgggccccagaaagtttttgcatagtgggaagctgtacaaagcaaagtctaacaaggagctctacggctttctgttcaatgatttcctcctgctgacccaaattaccaaacccctcggtagctcagggaccgacaaggtgttctctcctaagtcaaacctgcagtacaagatgtacaagacgccgatatttttgaatgaggtgttagtaaagctgcctacagaccctagcggagacgagcccatctttcacatttcacacatcgatcgagtttatacgctgcgtgctgaatccatcaacgaacgtaccgcctgggtccagaagataaaagctgcttcagagctgtacatcgaaacagaaaaaaaaaagcgcgaaaaagcctacctggttcggagccagcgtgcaaccggaatcggacgtttaatggtgaacgtggtagagggaatcgagctaaagccttgccgtagtcacggcaagtctaatccctattgcgaggttacaatggggagccagtgtcatattaccaagacaatccaggacacactcaaccctaagtggaactccaactgtcaattttttatcagggatctggagcaagaggttttatgtattactgtatttgagagggatcaatttagtccagacgatttcctgggacgcaccgagatccgagtcgctgacatcaaaaaggaccagggtagcaagggcccagtgacaaagtgcctactgctccatgaggtgcctaccggggaaattgtagttaggttggacctgcagctattcgatgagccatag

SEQ ID NO: 121103 - DNA, 3048 bp, Artificial Sequence
  Description of Artificial Sequence: Synthetic coding sequence
atggctcagtttcctaccccattcgggggtagcttggacatatgggctatcaccgtcgaagagcgggccaagcatgatcagcaatttcacagtctcaagccgatttccggtttcataacaggagatcaagctaggaactttttctttcagagcgggttgccccagccggttctagcacagatctgggccctggcagacatgaacaacgatggccgtatggaccaagttgaattctcaatcgctatgaagctgataaagctgaagctccagggataccagcttcctagcgcactgcctccagtaatgaagcagcaaccggtggccatcagttcggcaccggcattcggtatgggtggcatcgccagtatgccccctctgactgccgtggcccccgtgccaatgggtagcatccctgtagtggggatgtcacctacgcttgtgagcagcgtgccgaccgcggccgtgcctcctctcgccaatggagccccccctgtgatccagcctcttcccgctttcgctcatcccgccgcaacactgccaaaaagttcatcctttagtagatccgggcctggctctcagctgaacacaaaactgcagaaggcccagtcttttgatgttgcctccgtgccccccgtcgctgaatgggcagtaccacagtccagccggctgaaatacagacagctgttcaactcgcacgataaaacaatgtccggccatctcaccggtccacaggcccgtacaatcctcatgcagtcctctttgccccaggcccaactggccagcatctggaacctgtctgacatcgaccaggacggcaagctgactgccgaagaattcatattagccatgcatcttattgacgtcgctatgagcggccagcccctccccccagtgctcccacccgagtacatcccaccatcgttcagaagggtccggtcagggtccggcataagcgtgatcagcagcacatccgttgatcaaagactgcccgaggaaccagtgttagaggatgaacagcaacagctggaaaagaagctacccgttacctttgaagataagaagcgggagaattttgaacggggaaatcttgagctcgagaagaggcgacaggctctccttgaacaacagaggaaagagcaggaaaggctggcgcaattggagcgggctgaacaggaacgcaaggagcgagagagacaggaacaggagcggaaacgacagcttgagttggaaaaacagttggagaaacagcgggaactggaacgtcagagggaggaagaaagaaggaaggagattgaaagacgcgaggcagccaaaagagagctggagagacagcgccagttggaatgggaaagaaatagacgtcaggagttgctcaaccagagaaacaaagagcaggaggacatcgtagttctgaaggccaagaaaaaaaccctggaatttgagttggaagcactgaacgacaagaagcatcagctggagggcaaactacaggacattcgttgcaggctgactacccagagacaggagatcgagagtaccaataagtcacgcgagttacgcatcgcagagattacacatctgcagcagcagctacaagagagccagcaaatgctgggacgcctaatcccagagaaacaaatcctgaacgatcagctgaaacaggtgcaacagaactcattgcatagggatagcctagtcacacttaaaagagcactcgaagccaaagagctggcccgacagcatctgagagatcagttagacgaggtggagaaagaaacccgctccaagcttcaggaaatcgatatttttaataaccaactgaaagaattgcgggagatccacaacaaacagcagctgcaaaaacaaaagtctatggaagctgagaggttaaagcagaaagaacaagagcggaagataatcgaactcgagaaacaaaaagaggaggctcagcggcgcgcgcaggaaagggataaacaatggctggaacatgtgcagcaggaggacgagcatcaacgcccaaggaaacttcatgaggaagagaaactcaagcgggaggaaagtgttaaaaaaaaagacggtgaagagaagggcaagcaggaggctcaggacaagctagggcgactgtttcaccagcaccaggaaccagccaagcccgccgtgcaggccccctggagcacagctgagaaaggaccactcaccatctccgctcaggaaaatgtcaaggtggtgtactacagggctctttatcccttcgagtctcgcagccatgatgaaatcactatccagcctggggatatcgtgatggtcgatgagagccaaacgggtgagcctgggtggttaggcggcgaactgaaaggaaagacagggtggttccctgccaattatgccgagaaaatcccagaaaacgaagtgcccgctcctgtgaaacctgtaacagactcaactagtgccccggcccctaagctcgccctccgagaaacccccgccccactcgctgtgacttcaagcgagccctccacgacaccgaataattgggccgatttttcctccacctggccgacttccaccaacgagaagccggaaacggataattgggacgcctgggcagcacagcccagtctcacagtcccctcggccgggcaactgcgccagcggtccgccttcacaccagctaccgccaccggctcctcaccaagccccgttttggggcaaggtgaaaaagtcgaagggcttcaagcccaggccctgtacccatggagggccaagaaggacaaccacctcaacttcaataaaaatgacgtgataaccgtgctggaacagcaggacatgtggtggttcggcgaggtgcagggccagaagggctggttccctaagagctatgtgaagctcatctcggggcccattcgaaagtccacgtcgatggattctggctcctcagagagtccagcatcccttaagcgagtagccagccccgccgcaaaaccagtcgtgtccggagaaggcctgtggaactgctgggagaatcgtgaattcagaaagaagacttag

SEQ ID NO: 121104 - DNA, 3063 bp, Artificial Sequence
  Description of Artificial Sequence: Synthetic coding sequence
atggctcaatttcccaccccattcggaggatctctagatatctgggcaataaccgtggaagagcgtgccaaacatgatcaacagttccactctctgaagccgataagcggctttattaccggagatcaggcgcggaatttttttttccagtctggcctcccgcagccagtgctggcgcagatatgggccttggccgacatgaataatgatgggcggatggaccaggttgagttttctattgccatgaaactcattaaacttaaacttcaaggttatcagctgccttctgccctccctcccgtgatgaagcagcagccagtcgccataagcagtgcacctgcctttggcatgggaggtattgcatcaatgcccccactgaccgctgttgcacctgttcccatgggtagcattcctgtggtgggaatgtcgccaactctggtaagctccgtgcctacagccgccgtacccccactggctaatggtgcacctcctgtcattcagccccttcctgccttcgcccaccctgccgccaccttgcctaagtctagttcattcagtagaagcggccccggatcccagctgaatacaaaactgcagaaagctcagagcttcgacgtggcctcagtaccgcccgtagcagaatgggcagtcccccagtcatcccgcttgaaatatcggcagttgttcaacagtcatgataagaccatgtcaggtcaccttactggccctcaggcaaggacgatcctgatgcagagtagcctcccccaggcccagctcgcgagtatttggaatctcagtgatattgaccaggacgggaagctcacggctgaggagtttatcctggccatgcatctgattgatgtggccatgtcaggacagccgcttcctcctgtgctccctcctgagtatatacctccatccttccgtcgggtgcggtcaggctctggcatctctgtgatttcttctacctccgtggatcagaggcttcccgaggagcctgtactggaggatgagcaacagcagttggagaaaaagctccccgtgacgtttgaggacaagaaaagggagaactttgagagagggaatctggaactggagaagaggaggcaagcgcttttagaacagcagcgtaaggaacaagagcgcctggctcagttagagagagcagaacaggagcgtaaagaaagagagaggcaggagcaggagcgaaagaggcagctggaattagaaaagcaactcgagaagcagagagagctggaacgccagagagaagaagaacgaaggaaggagatcgagcggagagaagcagcgaagagagagctggaaaggcaaagacagttagaatgggagcggaatcgcagacaggaattgctgaatcagcgcaacaaagaacaagaggatatagtggtgcttaaggctaagaagaagaccctggagtttgaactggaggcccttaatgacaagaagcaccagttagagggaaagcttcaagacatccgttgcaggctcacaactcaacgccaggaaatagaaagtactaacaaatccagagaactgagaatcgctgaaatcacccatttgcagcagcagttacaggagtctcagcagatgctgggtcggctgatccccgagaagcagattctgaatgatcagctgaagcaggtacagcagaacagcctacaccgcgattctctcgtcaccctgaaaagggcccttgaagcaaaagaattggctcgccagcacttgcgcgatcagctggacgaagtcgagaaagagacccggagcaagctgcaggagatcgacatctttaacaaccagctaaaagagttaagagagattcataacaagcagcagctacagaagcagaagtcaatggaagctgagaggttaaagcagaaagagcaggagaggaaaatcatagaattggagaaacagaaagaggaagcacagcgtcgggcccaagaacgcgacaaacagtggctggagcacgtgcagcaagaggacgagcatcagaggccgagaaaactgcatgaagaggagaagctgaaacgtgaagaaagcgtgaagaagaaggatggtgaggagaagggtaagcaggaggcacaggataagttaggtagactttttcatcagcaccaggaacccgcaaagcccgccgtacaggccccatggagcaccgcagaaaaagggcccctcaccattagcgctcaggagaatgttaaagtggtgtactacagagcactataccccttcgaatcaagaagtcatgatgagatcactatccagcccggcgacattgtcatggtagacgaatcccaaacaggagagcctggatggcttggcggggagctcaagggcaagacaggttggtttcctgcaaactatgctgagaaaatccccgagaacgaggtgcccgccccggtgaaaccagtgacggacagtacgagtgcgcccgctccgaaactggctttacgcgaaaccccggcccccttggcagtgacctcaagcgagccaagcactacacctaataactgggcagatttttcttccacctggcctacctcaacaaacgaaaagccagagactgataattgggacgcttgggcagcccaaccaagcctgacggtaccttcggccggacaactgcggcagcggtcagctttcaccccagccactgcaacggggtcgagtccatccccggtgttgggccagcccgatttccttctgcaccctagcatgcgcttaggccatatgcagccacgtattgttctgctcttccctgatccgctacagtgctccacaagtcgtcttctgcccatgctgcggcccaggccaggcgtgcctttcctccggagtccatcttgccaatcaccaagtcacccatcccgtcccatctctgatgcagcccctagcgtgaagtttaccctcatgccaccagggagaatacatccatgtttcttgtttatcccggccgtgaacagccggaactcattccttgtgtacttcatactgccgggcggtaccctagggtgtttttatctttgcctgccccactatctgtag

SEQ ID NO: 121105 - DNA, 3435 bp, Artificial Sequence
  Description of Artificial Sequence: Synthetic coding sequence
atggcacaatttcccacgcccttcggaggcagtttagatatctgggctatcaccgtggaagagagagccaagcatgaccagcagtttcactcactgaagcccataagtggtttcattacaggggatcaggcccgcaactttttctttcagagtggactgccccagcctgtcctggcacagatttgggccttggctgacatgaacaatgacggtcgaatggatcaagtcgagtttagcatcgctatgaaactgatcaaactgaaactgcaaggatatcagctgcctagcgctctaccccctgtaatgaaacagcagcccgtcgctatctcttctgcccccgccttcggcatgggggggattgccagtatgcccccacttaccgccgttgctcctgtgcccatgggatcaatacccgtggtcggtatgtcacctacacttgtgagctcagtcccaaccgccgcagtcccgccccttgccaatggtgccccacccgtgattcagccattgccagcattcgctcacccagctgcaactctaccaaaatcaagtagcttttctcgctcggggcccggcagccagctgaacactaagttgcagaaagctcagtcttttgacgtcgcgtccgtgcctcccgtggctgaatgggccgtccctcagagctccagacttaagtatcggcaattgtttaacagtcatgacaagacgatgtcaggtcacctgactggtccgcaggctaggacaattctaatgcagagcagtctccctcaagcgcagctggcgtccatctggaatctttccgatatagatcaggatgggaagcttacggccgaggagtttatcctggccatgcacctgatcgacgtcgctatgtccgggcagcctctgccccccgtgctcccacccgagtacatcccaccatcatttcgccgagtcagatctggttccggcattagtgtgattagcagcacctccgttgatcagcggcttcctgaggagcctgttctggaagacgaacagcaacagctggaaaaaaaactgcctgtgacatttgaggataagaaacgagaaaatttcgagcgcggcaacctggagctggaaaagagacgtcaagcgctgctggaacagcagcgtaaggagcaggagcgccttgcgcaattagagagagccgagcaggagagaaaagagagggagcgccaggagcaggaaagaaagaggcagctcgagctggaaaaacagctggaaaagcagagagaactcgagcgccagcgggaggaggagagacgtaaggaaattgagcgccgggaggccgccaaaagggagctggagcggcaaaggcagctggagtgggaaaggaacaggcgacaagagctactaaaccaaagaaataaagaacaggaggacatagtcgtgctgaaagccaaaaaaaagaccctggagtttgagttggaggcccttaatgacaagaagcaccagctggaaggcaaattgcaggacataaggtgtcgcttgacaacacaacgccaggaaatcgagagtacaaataagagccgcgagttgcgtatcgcagaaataacccatcttcagcaacagttacaggaatctcagcagatgctaggtcgactgatccctgaaaaacagatcctgaacgaccaactcaagcaggtccagcaaaattctctccacagggactcattggtcacacttaaaagggccctggaggccaaagagctggctcggcagcacctgcgcgaccaattagacgaggttgaaaaggagacgcggagtaagctacaggagattgacatctttaacaaccaacttaaggagcttcgcgaaatccacaacaaacagcagctgcagaagcagaaaagcatggaggcagagcggctcaaacaaaaagagcaggagcggaagatcatagagctggagaaacaaaaggaagaagcccagcgccgcgcacaggaaagagataaacagtggttagaacacgtgcaacaagaggacgaacatcaaagaccccgcaaactgcacgaggaagaaaagcttaagcgggaggagagcgtcaagaagaaagacggggaagaaaagggcaaacaggaggctcaggacaaacttgggcgcctgtttcatcaacaccaggagccggctaagccagccgttcaggccccctggtccactgcagagaaaggcccattaactatctccgcacaggagaacgtcaaggttgtttactatagggccttgtatccctttgagagtagatcccatgatgaaatcaccatccagccaggcgacatcgtcatggtggatgaaagccaaactggtgaaccaggctggcttggcggcgaattaaaaggaaagaccggatggtttcctgctaactacgctgagaaaatcccagagaatgaggtgccggctcccgtaaaacccgtcaccgatagcacctcagcaccagccccaaaactagcactgagagaaacccctgcgcctcttgcagtgacctccagcgagccttctactacacccaataattgggccgacttctcaagcacatggccaacaagtacaaatgagaagcctgagactgacaactgggatgcatgggccgctcagccgtcacttaccgtgccgtcagccggccagctgagacaacgatcagccttcacaccagccactgccaccggttcgtcaccatcacctgtgcttggccagggcgagaaagtggagggactccaggctcaggccctttacccctggagagccaagaaggataaccacctcaattttaacaagaacgatgttattactgtgctggagcagcaggatatgtggtggtttggagaagtgcagggccagaagggctggtttcccaaaagttacgtgaagctgatctctggaccaattcgtaagagcacatccatggattccgggagttccgagagcccagcatccctgaagcgggtcgcctcccccgctgctaagcctgtcgtcagcggtgaggaaatcgcccaggttattgcttcttataccgcaaccggacctgagcaactcaccttggcccctggccagctcatactgattcggaagaaaaacccggggggttggtgggaaggagagctccaggcacggggtaagaagcggcagattggatggttccccgccaattacgtcaaactgttgtcccccgggacatccaagataacgccgactgagcctcccaaatccaccgccttggccgctgtgtgtcaggtgattggtatgtatgattacacagcacagaacgacgacgaattggcatttaacaaaggtcaaattatcaacgtactgaacaaagaagaccctgattggtggaaaggcgaggtcaatggacaggtgggactgtttccttcaaactatgtcaagcttacaaccgatatggacccgtcacagcagtag

SEQ ID NO: 121106 - DNA, 3648 bp, Artificial Sequence
  Description of Artificial Sequence: Synthetic coding sequence
atggcccagtttccaaccccatttggggggtccctagatatttgggcaataacagtggaggaacgggccaagcatgaccagcagtttcactccctaaaaccaatttccggttttattacaggagatcaggccaggaatttcttcttccaaagtggcctgccccagccagtgctggcacagatttgggccctcgcagacatgaacaatgacggtaggatggatcaggttgagttctccatcgccatgaagctgatcaaactgaagttgcagggatatcagctgccctctgcactaccccccgtgatgaagcaacagccagtggctatcagctccgcgcccgccttcggcatgggtgggattgcatccatgccaccactgacagctgtggccccagtcccaatggggtctattcccgtggtaggaatgtctcctacgctggtgtcaagtgtgccgaccgccgccgtcccacctctggctaatggcgctccaccagtaatacagcccctcccagctttcgcccaccctgccgccaccctccctaagtcctcctcgttctcgcgtagtggccccggctcacagctaaatacaaagctgcagaaggctcagtcattcgatgtggcttcggtgccacctgtggccgaatgggcggtaccgcagtcgagtagactcaagtacaggcaactgttcaacagccacgataaaacaatgtctgggcacttaactggtcctcaagcacggacaatcctgatgcagagctccctgcctcaggctcagttggcttctatctggaacctgtcagacattgatcaggacggaaagctgaccgcagaagaatttatactggctatgcacctgatcgatgtggctatgtctggacaaccactgccacctgtgctgccgccggagtacattccccccagttttagaagggtcaggtcaggatccgggatctcagtgatttctagcacgtctgtcgaccagcgcctccctgaggagccagttctagaagatgaacagcagcagctggagaaaaaacttcctgtgactttcgaagacaaaaagcgggagaattttgagaggggaaatttggaactcgagaagcggagacaggctcttcttgagcagcaacggaaggaacaagaaagactggcacagctggagagagccgagcaggaaaggaaggagagggagcggcaagagcaggagcgaaaaaggcaactggagctagagaaacagttagagaaacaacgcgaacttgaaagacagagagaggaggagcgtaggaaagaaattgagcgccgtgaagccgcaaagcgggagctggagcgtcagagacaacttgagtgggagcgaaatagacggcaggaactcttgaatcagcgcaataaggagcaggaagacatcgtggtgctgaaagccaagaagaagactctcgagtttgaactggaggcactcaacgataagaaacatcaattggaaggcaagctccaggatatacggtgtcgattgactacacagcggcaggagatcgagtcaactaataaatctagagaactgagaatagcagagataacacacctccagcaacagctccaggagagccagcagatgctcgggagactgatacccgagaagcagatattgaacgatcagctgaagcaggtccagcagaattccctgcaccgggattccttggtgacgctcaaaagagccctggaggccaaggagttagccaggcagcatctccgcgaccagctcgacgaagtcgagaaggagactagatcgaagctgcaggaaattgacatctttaataatcaactgaaggaactccgggaaattcacaacaaacagcagcttcaaaaacagaaatctatggaagccgagaggttgaagcagaaggagcaggaaagaaagatcatcgagcttgaaaagcagaaggaagaggcacagagacgagcgcaggaacgcgacaaacagtggctggagcatgtgcagcaggaggacgagcaccagaggcctcggaaattgcacgaggaagagaagctcaagcgtgaggaatctgtcaaaaagaaagatggagaagaaaaggggaagcaggaagcccaggacaaattgggtcgtcttttccaccagcaccaggagcctgccaaaccagcggtgcaggctccctggtccacagctgagaagggtcccttgacgatttctgcccaagaaaacgttaaggtggtgtactacagagcgctgtatcctttcgagagccggagtcatgatgagattacaatccagcccggtgatatagtgatggtcgatgagagccagacaggggaacccggctggctcggaggtgagctcaagggcaaaaccggatggtttcctgctaactatgccgagaaaatacccgagaatgaggtgccggccccagtgaaacccgtgacggattccaccagcgcacccgcccctaaactagctttgcgcgagactccggcacccctggccgtcacgtcctcagaaccgagtacgacaccaaacaactgggcggacttttcttcaacgtggccgacttctaccaatgaaaagcccgagaccgataactgggacgcatgggcagcacagccttctctgacggtacccagcgcaggccagcttcgccaacgctccgccttcactccagctacagcaacaggaagttcaccatcacctgtccttggccagggagagaaagttgaaggtctccaggcacaggcactatacccatggagagccaaaaaagataaccatttgaactttaacaaaaatgacgtgattactgtgctggaacagcaagatatgtggtggttcggggaggtccaagggcagaaaggatggttcccaaagagctatgttaaactaatatccggccctatcagaaagtctacctccatggactccgggagctccgagtcccccgcaagccttaagcgcgtggcctccccggccgccaagcccgtagtcagcggggaagagttcattgccatgtatacatatgaatcatctgaacagggcgatttgacattccagcagggcgatgtgattctggtaactaagaaagacggggactggtggactggcacagttggagacaaggccggcgttttccctagcaactatgtgagactcaaagactccgagggatcagggaccgctgggaaaaccggatcgcttggtaaaaagcccgagattgcccaggtgattgcatcctataccgcaaccgggccagaacagctcaccctggcgcccggacaactcattcttattaggaaaaagaaccctggcggctggtgggaaggtgagctccaagcgcgcggtaagaaacgtcagatcgggtggtttcctgctaactacgttaaactgttgtccccgggtacgtcaaagataaccccaactgagcccccaaagtctactgctttggccgcagtttgtcaggtgatcggtatgtacgattacactgcacaaaatgacgacgagctggctttcaacaaggggcagataattaatgtgctgaacaaagaggatcctgactggtggaagggggaggtaaatggccaggtggggctgtttccatctaattatgtgaagctcaccaccgacatggacccaagtcagcagtag

SEQ ID NO: 121107 - DNA, 3537 bp, Artificial Sequence
  Description of Artificial Sequence: Synthetic coding sequence
atggcccagtttccgactccctttggcggatcactcgacatatgggcaatcacagtggaagaaagggcaaaacatgaccagcagttccacagtctgaaacccatctccggattcattacaggagaccaggcgagaaactttttctttcagtccggcctaccacagccagtgttagctcagatatgggccctggcagacatgaacaacgatggccgtatggaccaggtcgaattcagcattgcgatgaaactgattaaactgaagttgcagggatatcagctgcctagtgccctgcctccagtcatgaagcagcagcccgttgccatctcgagtgcccctgcctttgcagccgtgccacccctcgctaacggcgctccccctgtgattcagccgctcccggcatttgcacacccggccgctacactgccaaagagttcctccttcagtcgctcaggccccgggtctcagctgaacacaaaattacagaaagcgcagtccttcgacgtggcatccgtgccacccgtggccgagtgggccgtgccccagtctagtcgtctcaagtacaggcaactctttaattctcacgataaaacgatgtccgggcatttaacagggccccaagcaagaactatactgatgcagtcttcactgccacaggcccagttggcctccatctggaacctgagcgatatcgatcaggatggtaagttaacagctgaagaattcattcttgccatgcacttgattgatgttgccatgtccggccagccgctacctcctgtgcttcccccagagtacattcctccatccttccgccgagtccggtcgggctctgggatctccgtcatctctagcaccagcgtcgaccaacgactgcctgaggagccagtgctcgaggatgagcaacaacagctggaaaaaaagctgcctgtgacattcgaggataaaaagcgggaaaactttgagagagggaatctggaactcgagaaaaggaggcaggcattactggaacagcagcgaaaggaacaagagcgtctggcgcagcttgagcgagccgagcaggagagaaaggagcgggagaggcaggagcaagagcgcaaaagacagctggagctggagaagcaactcgagaaacagcgagagctcgagaggcagcgcgaggaggaacggagaaaagaaattgagcgacgtgaggctgcgaaaagagagcttgagcgtcagcgccagctggagtgggagcgcaatagaagacaggagctgctgaaccagcggaataaggaacaggaggatatcgtcgtcttgaaagctaagaagaaaacactcgagtttgaactcgaggccctaaatgacaaaaaacaccagcttgagggaaagctccaggatatcaggtgtaggctcactacccagaggcaggaaattgaatctactaacaaatcccgcgaactgcgcattgctgaaatcacacatctacagcaacagttgcaggagtctcagcagatgttaggcaggcttattcctgagaagcagatcttgaacgatcaattaaaacaagtgcagcagaatagcctgcatcgggacagcctagtgacattgaaaagagccctggaagccaaggaactggcacgccagcacctcagggaccagctggatgaggtcgaaaaagagacccgctccaagctccaggagatcgatatttttaacaatcagctgaaagagttgcgtgaaatacacaacaagcaacagttacagaagcagaagtccatggaagcagaaaggcttaagcagaaggagcaggaacgcaagatcattgaactcgaaaaacaaaaggaggaagctcaaagacgggcccaagagagagataaacaatggttggagcacgtgcaacaggaagatgaacatcagagacctcgtaaacttcatgaggaggagaaactgaagagggaagaaagcgtgaaaaagaaggacggagaggaaaagggcaaacaggaagcacaggacaagcttgggcggctttttcaccaacaccaggaacccgccaagcctgccgtacaagccccctggagtactgcagaaaaagggccactgaccatttccgctcaggaaaatgttaaggtcgtgtactaccgcgccttgtacccttttgaatcccggagtcatgatgagataaccatacagccgggcgacatcgtgatggtcgatgagagccagaccggcgaacctggctggctgggcggtgagctgaaaggtaagaccggctggtttcccgcaaattacgctgagaaaataccggagaacgaagtgccagcgcctgtgaaaccagtgacagattccactagtgccccggcgcctaaacttgccttaagggagacccccgcaccactggccgttacctctagcgaacccagtaccacacccaataattgggctgacttcagctcgacatggcctacttctactaatgaaaaacccgaaaccgacaactgggacgcctgggccgctcagccgtcactaactgtgcctagcgctggtcagcttcggcaacggagcgcctttacacccgcaaccgcaaccggctcgtctcctagcccagtgctgggacagggcgaaaaagtggaaggcttacaagcccaagccctgtacccttggcgggccaaaaaggataatcacctgaattttaacaaaaacgatgttatcacagtactggagcagcaggacatgtggtggtttggagaagtccaggggcagaaaggatggtttcccaagtcatatgtgaaactgatcagtggaccaattcgaaagagcacaagtatggatagtgggagttcagaatcccctgcaagtctgaagagagtggcgtccccagcagccaaacccgtggtgagcggggaggaattcatcgctatgtatacctacgagtccagcgagcagggggacctgacttttcagcagggggacgtgattctcgtgacaaagaaggatggcgattggtggactggcactgtgggggacaaggccggcgtgtttccaagtaactatgtgcgcctaaaggactccgaaggaagcgggaccgcaggaaagactgggtcactggggaaaaagcctgagatagctcaagtgatagccagctatacggcaaccgggcccgaacagttgacactggctcccgggcagctgattctgatacggaaaaagaatccaggggggtggtgggaaggcgagctccaggcacgcggcaagaagaggcaaatcggttggtttcccgccaattacgtgaaacttctgagtcctggaacaagtaagattacacccaccgagcctccaaagtctactgctctggccgcagtctgccaagtgatcggtatgtatgactatacagcgcagaacgatgacgaattggcatttaataaaggccagattattaacgtccttaacaaggaagacccagactggtggaagggggaagtcaatgggcaggtgggcttgttcccttcgaattacgttaaactcacaacagatatggacccttcccagcagtag

SEQ ID NO: 121108 - DNA, 3450 bp, Artificial Sequence
  Description of Artificial Sequence: Synthetic coding sequence
atggcgcagtttcctaccccgttcggtgggtctctcgatatatgggccattactgttgaagaacgcgcaaaacacgaccagcagttccacagccttaaacccatcagcggctttataacaggtgatcaggctcggaacttcttcttccagagcggcttgccccagcctgtcctcgctcagatctgggctctcgcagacatgaataacgacggacggatggaccaggtcgagttctccattgccatgaagctcataaaattgaaactgcagggttaccaattgccttcagctctgccacccgttatgaagcagcaacctgttgctatttcaagcgcgcccgcattcgggatggggggtatagcatccatgccacccctcactgctgtagccccagtgcctatgggtagtattcctgtggtgggcatgtcaccaacactcgtgagctcggttcccaccgctgccgtcccccccctggcaaacggggccccacccgtcatacagcctctcccagcttttgctcaccctgcagccacgctaccaaagagttcctccttcagtcggtccgggccgggtagtcagctgaatactaagctccagaaggcacagagtttcgatgttgcctcggttccccctgtggccgagtgggccgtaccccagagctcccggctgaaatatcgccagcttttcaattcccacgacaagaccatgtccggtcatctgacaggccctcaagcacggactatccttatgcagtcctcgctgccacaggcacagttggcatctatctggaatctgtctgacatagaccaggacggcaagttaacggctgaggagttcattctggccatgcatctgatagatgtcgcgatgtctggacagccactcccccccgtgttaccaccggaatacatcccaccctccttcagaagggtaagaagcgggtccggaatctcagtcatctcatccacttctgttgaccaacgcctaccagaggagcctgttctggaggatgaacagcagcagctggaaaagaaactgcccgtgacttttgaggataaaaagagagaaaacttcgagcgagggaatctggagctcgaaaagagacgccaggcccttctggagcaacagcgtaaggaacaagagcgtctggcccaactggagcgggccgagcaagagcgaaaagaacgggagagacaggagcaggaaaggaagcggcagctggagttagaaaagcagttggaaaaacagagagagctggaaaggcaacgagaggaagaaaggaggaaagagatcgagaggcgcgaagctgctaaaagagagctggaaagacagagacagctggagtgggagcgcaataggagacaggagcttttgaaccagcggaacaaggagcaggaggacatagttgtgctcaaggccaagaagaagactctggagtttgagctcgaagcactaaatgataagaagcatcagttggagggaaagctacaggacattcgctgcaggttgactactcagaggcaggagatagagtccactaacaagagtagagagctaagaattgcggaaatcactcacctgcagcagcaactccaggagtcgcagcagatgctgggacgattaatcccggagaaacagattttgaacgatcaactcaagcaggttcaacagaatagtctacatagggattccttagtgacactgaagcgcgcactcgaagctaaggaactggcgcggcaacacctgagggaccagctggacgaggtcgagaaggaaacccgatcgaaactccaggagattgatattttcaacaatcaattgaaagaactgagagaaattcacaataagcagcagctccagaagcagaagtccatggaagcggaaaggctgaaacaaaaggagcaggagcgcaaaattatcgagctggagaagcagaaggaggaggcacagcggagagcacaggagcgagacaaacagtggctcgaacacgttcaacaggaggatgagcaccagcgccccagaaagctgcatgaagaagagaaactcaaacgagaggaaagtgtcaaaaaaaaggacggcgaagagaaaggtaaacaggaggcacaagacaaactggggaggttatttcatcagcaccaggaacctgccaagcccgcagttcaggccccttggtcaacagcggagaaaggccctttaaccataagcgcccaagaaaatgtcaaagtagtctattatagggcattgtacccattcgaaagccgtagtcatgacgaaatcacgattcaacccggcgacatcgtgatggtgaaaggggagtgggtggacgagtcgcagactggagaacccggctggctcgggggggaactcaagggcaagactggttggttccccgccaactatgctgaaaagatacccgagaacgaggtgccagcccctgtcaaacccgtgaccgactccacttcggctcctgccccaaagctcgcgcttcgggaaactcccgcccccttggccgttactagtagcgaaccaagcaccacaccaaataactgggctgatttcagctctacctggcccacatctacaaatgaaaagcctgaaaccgacaactgggacgcatgggctgctcagccatccctcaccgtgccctcagctggtcagctgaggcagaggtctgcatttaccccagccaccgccacgggctccagtccttcacccgtcctggggcagggggaaaaggtggaaggccttcaagctcaggccctctatccgtggagagccaagaaggacaaccacctcaactttaacaagaatgatgtgataaccgtcctggaacagcaggacatgtggtggtttggcgaggtacagggccagaaaggttggtttcccaaatcttacgttaaactgattagcggcccaatccgcaagtcgaccagcatggatagtgggagttctgaaagtccagcgtccctcaagagggtagcgagcccagcggccaagcctgtagtttccggagaggagatcgcacaagttatcgcatcttataccgcaaccggcccggaacagctcactctggccccaggtcagctgattctcattcgtaagaagaatccaggggggtggtgggagggcgaactccaagcaaggggcaagaagaggcagatcggatggttccccgccaactacgtgaagctccttagtcctggtacttccaagatcacacccacggagcccccaaagtctacggctctcgctgctgtttgtcaagtgataggaatgtatgattatacggcccagaacgacgacgagctggctttcaacaaagggcagataattaacgtacttaataaggaagatcccgactggtggaaaggagaagtgaatggacaggttggcctctttcctagtaattacgtgaagctcactactgacatggatccctcacagcagtag

SEQ ID NO: 121109 - DNA, 5151 bp, Artificial Sequence
  Description of Artificial Sequence: Synthetic coding sequence
atggctcagttcccgacccccttcggaggctcattggacatatgggctattactgtcgaagagcgtgctaagcatgaccagcagtttcacagtctgaaacctatctcgggttttatcacaggtgatcaggcacgaaacttcttctttcagtctggactccctcagcctgtgctggcccagatctgggctcttgccgatatgaacaacgatggaaggatggaccaagtggagttcagtatcgccatgaaactgattaaactcaagttgcaaggatatcagttgccaagtgctttgccccctgttatgaaacaacagcccgtagctattagttctgctcccgcgttcggtatgggcggcatcgcctccatgccaccactgaccgctgttgcaccagtccctatgggttctattcccgtggtcgggatgtctccaacattggtgtccagtgtgcccacagctgccgtacctccactggcaaacggcgccccaccagtgatacagccattgcctgcatttgcgcatcccgctgctaccttgccaaagagttctagttttagtcgttctggaccggggtcccagctgaacacgaaattgcagaaggcccagtcatttgatgtagccagcgttcctcccgttgcagaatgggcagtccctcagagctccaggctgaaataccgccagctgttcaattcccatgataaaacaatgagtggacatctgacagggcctcaggcgcggactatcctcatgcaaagcagcctgcctcaagctcaactcgcctcgatctggaatctgtctgatattgaccaggacggcaaactgactgccgaggaatttatcttggcgatgcatttgattgacgtggccatgagtggacagccacttccacctgtcctgccacccgaatatattcctccctcttttagacgcgtccgtagtggtagtggcatcagcgtgatctcctcaacatccgtggaccagcgtctgcctgaggagccagttctagaggacgaacaacagcaactcgagaagaagcttcccgtcacgtttgaagacaagaagcgggagaactttgagagggggaacctggagctcgagaagagaaggcaggctcttctggaacagcaaaggaaggagcaggaacgccttgcccagctggagcgagctgaacaagaacggaaggagcgtgagcggcaggagcaggaacgaaaaaggcaattggagcttgagaagcaactcgagaagcagagagaactggagcgacagcgcgaggaggaacgaaggaaggaaattgaaagaagagaggccgctaagcgggaattagagagacagagacagttagagtgggagcggaataggaggcaggaactgctaaaccaaagaaacaaggagcaggaggatattgttgttctgaaggccaaaaaaaagactctggaatttgaactggaggctcttaacgacaagaaacatcagctggaagggaaactccaagatatcagatgccgtcttacgacccaacgccaggagattgagtcaacaaataaaagtcgcgaactaagaattgctgaaatcacccacctgcagcagcagctgcaagagagccagcaaatgctcggacgactgattccggagaaacagattctgaatgatcagctgaagcaggtgcagcagaacagcctgcatagggatagccttgtcactctcaagagagcattggaagcgaaggagctcgctcgacagcatttgcgagaccagctggatgaagtcgaaaaggagacgcgctctaaattgcaggaaatcgacatatttaacaaccagttaaaggaactgcgagagatccataataagcagcaacttcagaaacagaaatccatggaggccgaacggctgaagcagaaggaacaggaaaggaagatcattgagctcgagaaacagaaagaggaggctcagagacgggcccaggaaagagataagcagtggcttgagcatgtgcaacaggaagatgagcaccagcggcccagaaagctgcacgaagaggagaagcttaagcgagaggagtctgtcaagaaaaaggacggcgaagaaaagggtaagcaagaggctcaagacaaactgggccgactgttccaccagcaccaggaacctgccaagcccgctgtgcaggctccctggtctactgctgagaaggggcctctgactataagtgcccaagagaatgtcaaggtcgtctactatcgtgcgctgtaccctttcgagtctaggagtcatgatgagatcactatacagccaggggacatcgtgatggttgacgaatctcaaaccggggaacctgggtggcttgggggagaacttaaaggtaagactggatggtttccagcaaattacgccgaaaagatacctgagaatgaagtgcccgccccagtgaagccagtgacagactccacctccgcgcccgcccccaagctagcactcagagagacaccagctcccctggcagtgacttcctcagaaccttccacaacacccaataattgggcagacttctccagcacctggcctactagcactaacgagaagcctgagaccgataactgggatgcctgggcggcccagccctccctaactgtgccgagcgccggacagctcagacaaagatccgcattcactcctgctacagccactggtagctcaccttctccagtgttgggtcagggtgaaaaagtggagggtctgcaggcccaggctttgtacccctggcgtgctaagaaagataaccatttgaactttaataaaaatgatgtaatcactgtcttagagcagcaagatatgtggtggtttggcgaagtgcaaggccaaaaaggatggtttccaaaatcttacgtaaagctcatatctggaccaatccgcaagtctacttcaatggacagcggttcctcggaatcacctgcctccttgaagagggtcgcaagcccagctgcaaagcctgtcgtttctggcgaggagtttattgccatgtatacctatgaatcctctgaacaaggcgatttgacattccagcagggcgatgtaatcctcgtaacgaagaaggatggagactggtggacagggacagtgggcgataaggcgggggtgttcccttccaattacgtgcgcctaaaggatagcgaggggtctggcactgctggcaagacgggaagcctaggtaagaagcccgaaatcgcacaggtgatagccagctataccgccacaggccctgagcaactgaccctggctccgggtcaactcatcctgatccggaaaaagaatcctggcggctggtgggagggggaactccaagccagagggaaaaagcgccagatcgggtggtttcccgctaattatgtgaaattgctgtcacctgggaccagcaagattacccctacagaaccccccaagtctaccgcactggccgctgtctgccaggtcattggcatgtacgattacactgctcagaatgacgatgaactcgcattcaataagggacagattattaacgtccttaacaaggaagatccagactggtggaagggcgaagtcaatggtcaggtgggtttgtttcctagcaattatgtgaaactcacaactgatatggatccgagccaacaatggtgctctgacctgcatctgctggacatgcttactcctactgagaggaagcgacagggatatatacacgagcttatagtaaccgaggaaaattacgtgaatgacctccaattagttactgagatcttccaaaaacccctcatggagtcggagctgcttactgagaaagaggtggctatgatattcgtgaattggaaggagctcattatgtgcaatatcaagttactcaaggcactgcgcgtgaggaaaaagatgtcgggtgaaaagatgccggtaaaaatgatcggcgatatcctgagcgctcagctccctcacatgcagccatatatacgattttgctctcggcagctcaatggtgccgccttgattcagcagaaaaccgacgaagctcctgactttaaagagttcgtaaagagactagctatggatccaagatgtaagggcatgcccctcagttccttcatactaaagcctatgcagcgagtgactagatacccgctgatcatcaagaacatcctcgaaaatacacctgaaaatcaccctgaccacagccatctcaaacacgcccttgaaaaagcagaggaactgtgctcacaagtgaatgaaggtgtgagagagaaggagaatagcgaccgattagaatggattcaagcccacgtccagtgtgaaggacttagcgagcaactagtctttaattctgtgaccaattgtctgggaccacggaaatttcttcattctgggaagttgtacaaggccaaatcgaacaaagaattatatggatttctcttcaatgactttctcctgcttacccaaattaccaagcctctgggctccagcggaacggataaggtatttagcccaaagtccaacctccagtacaagatgtataagacaccaatttttctgaacgaagtgttagtgaaactgcctactgatcctagcggggatgagcctatattccatatctcgcacatcgacagagtgtacacacttcgagcagagtcgattaatgagaggacggcctgggtgcagaaaatcaaggccgcttctgagctctatattgaaaccgagaaaaagaagcgtgaaaaggcttacctggttcgatctcagcgagctacaggcattggacgccttatggtgaatgtggtcgaaggaatcgagttgaaaccctgccggtcccacgggaagtcaaatccctactgcgaagtaacgatgggctcccagtgtcatatcacgaagaccatccaagacacgctcaatcctaaatggaattctaattgtcagttcttcatcagggatctcgaacaggaggtgctctgcatcactgtgtttgaaagggaccagttcagcccagatgatttcttgggcagaactgaaattagggtggctgatattaaaaaggaccagggctccaaaggccctgtgaccaaatgtctgctcctccacgaagtgccaactggcgaaattgtggtgcgcctggacctgcagctgttcgatgagccgtag

SEQ ID NO: 121110 - DNA, 4983 bp, Artificial Sequence
  Description of Artificial Sequence: Synthetic coding sequence
atggcgcagttcccgaccccattcgggggatctctggacatttgggctattaccgtggaagaaagggctaaacacgaccaacagtttcacagccttaagcctatttccgggttcattactggagaccaggctcgtaactttttcttccagtccggcttgccacagccggtgcttgctcagatttgggctttagctgatatgaacaatgatggccgcatggaccaggtggagtttagcatcgctatgaagcttatcaagcttaagctccaaggttatcagctgccctcagcactcccgcctgtgatgaagcagcagccggtggcaatcagttcagctccagcatttggaatgggaggaatcgcgtcaatgcctccattgactgcagtcgctcctgtacccatgggatctatccccgtagtcggcatgagtcccacgctcgtctcgagcgttccgacagctgctgtgccacccctggccaatggcgcaccccctgtgatccaacccctgccagcattcgcccacccggcggcaaccttgcccaaatcgtcctctttttccagatctggcccaggatctcaactgaatacaaagcttcaaaaggcccagtctttcgacgtggcctcggtcccgccggtggctgagtgggccgtgccgcagtcatcgcgtctgaagtatcgccaactgtttaactcacacgacaagactatgagcggtcatcttactggcccgcaagctcggactatactgatgcagagctctctccctcaggcacagctggctagtatatggaacctgagtgacattgatcaagacgggaaactcaccgctgaagaatttattctggccatgcatctaatcgacgtagccatgtccggccaacctctgcctcctgtgctgcctcctgaatatatccccccttcattccggcgcgtgcgatcaggaagtggcatcagcgtcatcagcagtacctctgtcgaccagaggttgcccgaagagccagttctggaggatgagcaacagcagttggagaaaaagctccccgtgacctttgaggacaagaaaagggagaattttgaacgcggaaatctcgagttagagaagcgccgccaagcactgttagaacagcagcggaaggagcaggaaagactcgctcagcttgagcgggctgaacaggagcgtaaagagagggagaggcaggagcaagagcgcaagaggcaactggagctcgaaaagcagcttgagaagcagcgcgaactcgaacgacaacgggaggaagaaagacgcaaggaaatagaaagacgggaagcagccaagcgcgagctcgaacgccagcggcagttagagtgggaacggaaccgtcgtcaagagctcctgaatcagcgcaacaaagaacaggaggatatagtagtcctgaaggcaaaaaagaaaaccctggagttcgagctcgaggccctcaatgacaaaaagcaccagcttgaaggcaagctgcaggatatcaggtgccgcctgaccacacagcggcaggagattgagagtactaataagtccagggagctgcggatagcggagattacccatctgcagcaacaactgcaggagagtcagcaaatgctcgggcggttgattcctgaaaagcagatcctgaacgaccagttgaaacaggtgcaacagaacagcctgcacagggactctctcgtcacactgaagcgagccctggaagctaaggagcttgctcggcagcaccttagggaccaactggatgaggtcgagaaagagacaagatctaagctccaggaaattgacatatttaacaatcagctaaaggagttgcgtgaaattcacaacaaacagcagcttcagaaacagaaatccatggaggctgagaggctcaagcagaaggagcaggagcggaagattattgagctggaaaaacagaaagaggaggcacagcgcagggcacaggagcgggacaagcaatggctcgagcacgtgcaacaggaagacgagcatcagagaccccggaaattgcatgaggaagagaagctgaaaagggaagaatccgtcaaaaagaaggacggagaagaaaagggtaagcaggaggcccaagataagctggggcgtctgttccaccagcaccaggaacccgccaagcccgcagtccaggccccatggagcactgccgagaaggggccgctgactatctccgcacaggaaaacgtgaaagtggtgtactatagagcactgtacccattcgagtcccgatctcacgacgagatcactatccagccaggggacattgtgatggtagacgagtcccagaccggagaacctggatggcttggtggagaactgaaggggaaaactgggtggttcccagccaattacgccgagaagatccccgagaatgaggtccccgccccagttaaacccgtcaccgactcgaccagcgctcccgcaccaaaactagcactacgcgagactcctgcgcctctggctgtcacatctagcgagccttcaaccacacccaataattgggcagatttctccagtacatggcccactagtactaatgagaaacccgagaccgacaactgggacgcctgggccgcccagccaagtctgactgtcccttctgctggccagctgaggcagaggagtgccttcacacctgctacggcaaccggaagctctcccagccccgtcctgggccagggcgaaaaagtagaaggccttcaggcccaagccctctatccatggcgggccaagaaggataatcacttgaatttcaataagaacgacgttatcacggtgcttgaacagcaggatatgtggtggtttggcgaggtccagggacagaagggctggtttcccaaaagctatgtcaagctaatatccgggcccatcagaaaaagtacttctatggactcagggtcatcagagagtcccgcctcacttaaacgagtggcttcccccgcagccaaacctgtcgtttctggggaggagtttattgcgatgtatacttacgagagtagtgaacagggagaccttacctttcagcagggagatgtcatcctggtcactaagaaggatggagactggtggactggcacagtgggagataaggcgggcgtattcccttccaactatgtgcggctgaaagatagcgagggttctggtacagccggaaagacaggtagtctgggaaagaaaccggagatcgcacaggtgatcgccagctatacagccaccggaccggaacaacttaccctggcacccggccagctgatacttattagaaaaaaaaatcccggtggctggtgggagggcgagctacaagctcgaggaaagaaacgacagatcggctggtttccagcgaactatgtcaagttattgtccccaggaacaagtaaaatcaccccaaccgagccaccgaagagcacggctctggcagccgtgtgccaagtaataggaatgtacgactatactgcgcagaatgatgacgaactggccttcaataaaggccagattatcaatgtgttgaataaagaggaccccgattggtggaagggagaggttaacggacaggtagggttgtttcccagcaattacgtaaaattaacaactgacatggatcctagccagcaatggtgcagcgaccttcatttgctcgacatgctcacccccacagaacggaagcggcagggatatattcacgaattaattgtcactgaagaaaattacgtgaatgatctccagctggtgaccgagatatttcaaaagcccctgatggagtccgagcttctgactgagaaggaggtggccatgatttttgtgaattggaaggagctcattatgtgtaacatcaagctgctaaaggccttgcgggtacgaaagaagatgagcggcgagaaaatgcccgtcaaaatgattggtgacatcctgtctgctcagctaccccacatgcagccttatatccgattctgctcacgccagctgaacggggctgctttgatccaacaaaagaccgatgaagctcccgattttaaagagttcgtaaagcgactggcaatggatcctcgatgtaaagggatgcctctgtcgtctttcatcctgaaacccatgcagcgcgtcacgcggtacccactgatcattaaaaaccagctcgtattcaattcagtaacaaactgcctcggcccccggaaatttctgcactccggtaaactttacaaggctaagtcaaataaggagctttacgggtttcttttcaacgactttctacttctgactcagatcacgaagcctctcggctcttctggcaccgacaaggtattctctccgaaatccaacctccagtataaaatgtataagacccccatcttcctgaatgaggtcttggtgaagctgccgaccgatcccagcggcgatgagcctatcttccatatttctcacatcgatagagtgtatactctaagggcggaatcaattaacgagcgcaccgcatgggtgcagaaaatcaaggctgcttcagaactctacatcgaaacagaaaagaagaaacgggaaaaggcatatctggttagaagccagcgggcaacggggatcggaaggttgatggttaacgtcgttgagggcatagaacttaagccatgccgatcgcacggtaagagcaatccatattgtgaggtgaccatgggctcacagtgccatattaccaaaactatccaggatacactgaatccgaagtggaatagcaattgtcagttctttatcagggacctggagcaagaggtgctctgcattaccgtgttcgaacgtgatcagtttagtcctgacgactttcttgggcgaacagaaatccgtgtggcagacataaaaaaggatcaaggaagcaaagggccggtgaccaaatgtcttctgctgcacgaagtgccaacaggcgagattgtcgtccgcttggacctacagctttttgacgagccctag

SEQ ID NO: 121111 - DNA, 348 bp, Artificial Sequence
  Description of Artificial Sequence: Synthetic coding sequence
atggcacagttcccaacgccctttggcgggagtctcgacatctgggccatcaccgtagaggaacgagccaagcacgaccagcaatttcactctcttaaacccatatccggcttcatcaccggtgaccaggctcggaattttttttttcagtccggactcccacaacccgtgctggcccagatttgggccctggcggacatgaacaacgatgggaggatggatcaggttgaatttagtatcgccatgaaattaattaaacttaagttgcagggttatcagctgccttccgctctgccgcccgtgatgaagcaacaacctgtcgctattagctctgcccctgccttttag

SEQ ID NO: 121112 - DNA, 237 bp, Artificial Sequence
  Description of Artificial Sequence: Synthetic coding sequence
atggcacagttccctacacctttcggggggagtctggatatctgggctattaccgtggaagaaagggccaagcacgatcagcagttccactctctgaagccaatctccggatttattaccggagaccaggcccggaattttttcttccaaagcggcctgccacagcctgtgttagctcagatctgggcacttgcagacatgaataatgacgggcggatggaccaggtagagttctag

SEQ ID NO: 121113 - DNA, 5094 bp, Artificial Sequence
  Description of Artificial Sequence: Synthetic coding sequence
atgatggcccaattccccaccgcaatgaatgggggacctaacatgtgggccattaccagcgaggagaggaccaagcacgacagacagtttgataacctgaagccatccggcgggtatatcacaggcgaccaagctagaaacttctttttgcagtccggcctgcccgccccagttctggccgagatctgggctctctccgaccttaacaaagacggtaaaatggatcaacaggaattcagcatcgccatgaaactgatcaagcttaagctgcaggggcaacagctcccagtagtgcttccgcctattatgaagcagcctcctatgttttctccactcatctcagcccgatttgggatgggctccatgcccaacctgtcgatcccacagccacttcctcctgctgcgcctattacttcactctccagcgccacaagcggaaccaatctgccgcccctaatgatgccgactcccttggtgccaagtgtctcaacctcctcccttccaaatgggactgccagtttaatccagccgctgcccataccatactcctccagcactctgccacacggatctagctactctctgatgatgggcggatttggaggcgcaagcatccaaaaggcccagtcactgatcgatttgggctcctcatctagtacaagctctaccgccagcctctctgggaattctcctaagaccggaaccagtgaatgggccgtgccccagccgactagactaaaatatcgtcagaagttcaacacccttgacaaaagcatgtccggatacttaagcggcttccaggcccggaatgccctccttcagtccaatctgagccagacgcagctcgcaactatatggacactggcagacgtcgatggagatgggcaactcaaagcagaggagtttattcttgcaatgcacctcaccgacatggcaaaggccggacagcccctacccctgacccttccacctgagctcgtgccgcctagttttaggggtggaaagcagatagattcaatcaatgggactctccccagctaccaaaagatgcaagaggaagagccccagaagaagctgccggttacatttgaagataaacggaaagctaattatgaaagagggaacatggagcttgaaaaacgtcggcaggcccttatggaacaacagcagagagaggcagaaaggaaggcacagaaggaaaaggaagaatgggaacggaagcaacgcgaactgcaagaacaggagtggaaaaaacagttggaactcgaaaagagactggagaaacagcgcgaacttgaacgtcagagagaagaggagaggcgcaaagacatcgaaagaagggaggcagcgaagcaggaacttgagaggcagagacgattagaatgggaacgaatccgcagacaggagctgctcaaccagaagaatcgagaacaggaggaaatagttcgtctgaactccaagaaaaaaaacctccacttggagctcgaagctttaaacggaaaacaccagcagatttcagggcgattgcaggatgtgcggctaaaaaagcaaacacaaaagaccgaactcgaggtactggataagcagtgcgacctagagatcatggaaattaagcagctgcaacaggaattgcaggaataccagaacaagttgatttatctcgtgcctgaaaaacaactcctgaatgagaggataaagaatatgcagtttagcaatacgccagactccggcgtgagtcttctgcacaagaagagtctagagaaagaggagttgtgccaaaggctgaaggagcagctggatgcactggagaaggagactgccagcaagctcagcgagatggactcattcaataaccaactgaagtgcgggaacatggatgactccgtcctgcagtgtctcctcagcctcctgagttgcctgaacaacctgttcctacttctgaaggagctgcgggaaacttacaatactcagcagttggccttggagcaactgtacaaaatcaaacgggataagctcaaagaaattgagcggaagcgcctggagctcatgcagaagaaaaagctggaggatgaagcagcccgtaaggccaagcagggcaaggagaatctctggaaggaaaacctgcgaaaggaggaagaggagaagcagaagcgcctacaagaggaaaagacccaggagaagatccaagaagaagaaaggaaggccgaagaaaagcagcgcaaagacaaggacacattaaaagctgaggagaagaaacgtgaaacagcaagcgtcctggtgaattacagggccttatacccattcgaggccaggaaccatgatgagatgtcatttaacagcggggatatcatacaggtggacgagaagaccgttggcgaacccggttggctgtacggaagctttcaggggaattttggttggtttccctgtaactacgtcgagaagatgccaagcagcgagaatgaaaaagcggtgtcccccaaaaaggccctactgccccccaccgtgtcgctgagcgccacctcgacgtcaagcgagcccctgtcttcaaatcagcccgccagtgtcaccgattatcagaacgtctcattctctaacctcaccgtgaacacttcttggcagaagaaatcggcgtttacccgcactgtcagccccggcagtgttagccctatccatggccaggggcaggttgtggagaacttgaaggcccaggccctttgctcttggaccgccaaaaaagataaccatctgaacttctcaaaacacgatattatcaccgtactcgagcagcaggagaattggtggttcggggaggttcatggcggtagggggtggttccccaaaagctacgtgaagattataccaggctccgaggttaagcgagaggaaccagaagccctctacgcagctgtcaacaagaagccgacaagcgccgcctattctgtcggagaggagtacattgccctctatccatactcatccgtagagccgggagatctgacttttaccgaaggtgaggaaattctcgtaacccagaaagatggagagtggtggacagggagcattggggatcgcagcgggatttttccctccaactatgtaaaacccaaggaccaggaaagcttcgggagcgcctccaagagcggggcttcaaacaagaaacctgagatagctcaggtaacctccgcctacgttgccagcggctcagaacaactgtcactcgcccccggccagcttatcctgatcctaaagaaaaatacttccgggtggtggcagggtgagttgcaggcccgggggaaaaaacgccagaagggctggttccctgcctcgcacgtgaagttattagggccatctagtgaaagagcaactccggccttccatccagtctgccaggttattgctatgtatgattacgctgccaataatgaggatgagctctcttttagcaagggccaattaattaacgttatgaacaaagacgaccccgattggtggcagggtgagataaacggtgtcacaggactattccctagcaattacgtcaagatgacaaccgattccgacccaagccagcaatggtgtgcagacttacaaactctagacactatgcagcccattgagcgaaagcggcagggttacattcacgagctgatacagaccgaggaacggtatatggccgatcttcagctggtcgtggaggtgtttcagaaaaggatggccgagagcgggtttctgaccgagggcgagatggcactaatatttgttaactggaaagaacttataatgtccaatacaaaactgctgaaggctctgagagtgaggaaaaaaactggaggcgagaagatgccagtgcagatgattggcgatatcttggctgctgagttgtcccatatgcaggcatatattaggttttgctcttgccagttaaatggagcggcattactccagcagaaaacggacgaggatacagatttcaaggaattcttgaaaaagctagcctctgaccctcgatgcaaaggaatgcctctgtcctcttttctgctcaaacccatgcaaaggattactcgctatcccctactgatacggtctatactggagaacaccccagagtctcatgctgatcattcttccctgaaactggcactagagagggctgaggagctctgttcgcaggtcaatgagggagttcgggagaaagagaacagcgaccgcctcgaatggatccaggctcatgtgcagtgcgaaggactagctgaacagttgattttcaattccctgactaactgtctggggccacggaaattgctgcactccggcaaactgtacaagacaaagagcaacaaagaattacatggattcttgtttaatgattttctgttactgacatatatggtgaaacaattcgccgtgtctagtgggagtgaaaagctgttctctagcaagagcaacgcccagttcaagatgtacaagactcccatattcctgaacgaggtgctcgtgaagctccccactgatcccagcagcgacgagcccgtctttcatatatcccatatcgatcgagtgtatacgttgcggacagacaatattaatgagcgaaccgcgtgggtgcagaagatcaaggcagctagcgaacagtacatcgatacagagaagaagaagagagagaaagcgtatcaggctagatcgcagaaaacctccggcattggacgcttgatggtgcacgttattgaggcaacagagctcaaagcttgtaagcccaacgggaaaagcaacccatactgtgagatcagtatgggtagtcagagttacaccacaagaactatccaggacactttgaacccaaaatggaacttcaactgccagttcttcattaaggatctgtaccaggatgtactgtgtctgacgttgttcgacagggaccagttcagcccagacgacttcctgggccggacggaaatcccggttgccaagattcggacggagcaggaaagcaaggggcctatgactcggagactcctgctgcatgaggtccctactggggaggtctgggtgagatttgacctgcagctgtttgagcagaaaacgcttttgtag

SEQ ID NO: 121114 - DNA, 5013 bp, Artificial Sequence
  Description of Artificial Sequence: Synthetic coding sequence
atgatggcccagtttcccaccgcgatgaatggaggtcctaatatgtgggccatcacgagcgaagaacggaccaaacacgatagacagttcgacaacctgaaacccagcggaggatatattaccggcgaccaggccagaaatttctttctgcaaagtggcctccccgcgcccgtgttggccgaaatttgggcattgtccgatctgaacaaagatggcaagatggaccagcaggaattttccattgctatgaaactcatcaagctgaaactgcaggggcagcaattgccggtggtccttccaccgatcatgaagcaacccccgatgttctccccattgatcagcgcgcgctttggaatgggcagcatgccgaatctatcaattccccagcccttgccacctgctgcccccatcacgtctttgagcagtgcaacgtccggaacaaacctgccaccactaatgatgcctaccccgcttgtgccctctgtgagcacatcgtccctgcctaatgggaccgcgagcctgattcagcctctcccaatcccgtatagttcatccacactgccacatggaagttcttacagcttgatgatgggcggattcgggggcgccagcatccagaaggcccagagcctgattgatctgggatcttcctcaagcacatctagtacagcaagcctgagcggtaattctccaaagaccggaacctctgagtgggccgtgccacagccaaccaggctcaaatacaggcagaaatttaacacgcttgataaatcaatgtcggggtatctctctggcttccaggccagaaatgcacttctacagtcaaatttgtcacagacacagttggcgactatttggaccctagctgacgtggatggtgatgggcagctgaaggccgaagagtttatcttggcgatgcaccttacggacatggccaaggcaggccagccactgccactaacactgcccccagagctcgtcccacctagtttcagaggaggcaaacagattgactctatcaatggtacgctgcctagttatcaaaagatgcaggaagaggaacctcagaagaagctacctgtcacctttgaagataagcggaaggctaactacgaacgtggtaatatggagctggagaagcgtaggcaggccctgatggagcagcagcagcgcgaggccgaaaggaaggcgcaaaaggagaaagaagaatgggaacggaaacagcgtgaactgcaagagcaggagtggaagaagcaactggaattggagaagagactagagaaacagcgggagctcgagagacagcgcgaagaagaacgccgcaaggatatcgagcgaagagaggcggccaagcaggagctagagcgccagcggcggctcgagtgggagagaattaggaggcaggaactcctcaaccagaagaatagagagcaggaggaaattgtccggctgaattccaaaaagaagaatctacatctggagctggaggccctgaatgggaaacatcagcagatttccggtcgcctgcaggatgtgaggctgaaaaagcagacccagaaaactgagctggaagtactcgataaacagtgtgatctggagattatggagatcaaacagttgcagcaggagcttcaagagtatcagaacaagctgatctacctcgtgcctgaaaaacagctgctgaatgagcgcatcaagaacatgcagtttagtaatacgcccgactccggcgtttctctgctgcacaaaaagtctctggagaaggaggagctgtgtcaacgccttaaagaacagctcgatgccctagagaaagagaccgcaagcaagctgagtgagatggattcttttaataaccagttgaaagagctgagggaaacctacaacacacaacagctggcactggagcagttatataagattaaaagagataaattaaaggaaatcgaaaggaagcgcctcgaattgatgcagaagaagaaattggaggatgaggccgcacgcaaagctaagcaaggcaaagagaatctgtggaaagaaaacctgcgcaaggaagaggaagaaaaacagaaaagactacaagaggaaaagactcaggaaaaaattcaggaagaggagcgcaaggcagaggaaaaacagcggaaggataaggacaccctgaaggccgaggagaagaaacgcgaaaccgctagtgttctagtgaattatagagccctgtaccctttcgaggcaaggaaccacgatgagatgagttttaactccggtgatatcatccaggtggatgaaaagaccgttggtgaaccgggctggctgtatggctcctttcagggcaactttggatggttcccatgtaactacgtggagaagatgcccagctccgagaacgagaaagccgtgtcccccaaaaaagccctgctgcccccgactgtttccctgtctgccacctcaacgagctctgagccgctttcttccaaccagcctgcaagcgtgacagactaccagaacgtctcttttagcaacctaacggtcaatacatcatggcaaaagaagagcgcatttaccagaaccgtgtctcctggttcagtctcacctatccacgggcagggacaggtagtggaaaatttgaaagcccaggctttatgctcttggacagcgaaaaaagacaaccacctgaacttctccaagcatgatatcatcactgttttggagcagcaggaaaactggtggttcggagaggttcatggcgggcgcggatggttcccaaaatcttacgttaaaattatacccgggtcagaggtcaaacgtgaagagcctgaagccctgtatgccgccgttaataagaagcctacatccgctgcctatagtgttggcgaggaatatattgccctctacccctattcttctgtggagccaggagacttaacttttacagagggggaagaaatactggtgacgcagaaagacggcgaatggtggactggcagtatcggggaccgttctggtatttttccatcgaattacgtcaagcctaaggaccaggagagcttcgggtctgcaagtaaaagcggagcatcgaacaagaagcccgaaatcgcacaggtgacgtctgcttatgttgccagcggaagcgaacagctgtccctggccccaggacaacttatcctgatccttaaaaaaaacactagcgggtggtggcagggggaactccaggctcgaggcaaaaaaaggcagaagggctggtttcctgcttcacacgtaaagctcctcggtccctcaagcgaacgcgcaacacctgcgttccaccccgtttgccaggtcatcgcgatgtacgattacgctgcaaataacgaagacgaactgtctttctccaaaggtcaactcataaacgtgatgaataaggacgatcccgattggtggcaaggtgagattaatggtgttacgggtcttttcccgagcaactacgtgaaaatgactaccgatagcgatccttcccagcaatggtgcgctgatctgcagaccctggatacgatgcagcctattgagaggaagaggcagggttatatacatgagctgatacaaaccgaggagcgctacatggctgatcttcagctcgtggttgaagtattccagaaaagaatggctgagtcaggctttttgactgaaggcgagatggccctcatttttgtgaattggaaggagcttataatgagcaacaccaagctgctcaaggctctgagagtacgtaagaagactggtggcgagaagatgcctgtgcaaatgatcggggatatccttgcggctgagctaagccatatgcaggcttatataagattctgttcctgccagcttaacggggctgccctgctccagcagaagacagatgaagacactgactttaaagagtttctgaaaaaacttgcgtccgacccacgctgtaaaggaatgccactttcttcattcctcctcaagccaatgcaaagaatcacccgctaccccctgctcatacgatcaatcctggagaacacaccagaatcccacgctgaccactccagccttaaactcgcccttgaaagggccgaggagctctgctcccaggtcaatgagggagtccgcgaaaaggagaattcagacagactggaatggattcaagcccatgtccaatgcgaaggcctggctgagcagcttatcttcaattcacttaccaattgcttgggccccagaaagctcctgcattcaggcaagctctacaaaaccaagagtaacaaggaactgcacggattcttgttcaacgactttttgcttctcacctacatggtcaagcagttcgctgtgagctccggcagcgagaaactcttctcgagcaagtctaacgcacagtttaaaatgtataaaaccccaatcttccttaacgaggtgctggttaaattgccgactgaccccagtagcgatgagccagtgtttcacataagccacatcgatcgagtttacaccctgcgcaccgacaatattaatgaaaggacagcctgggtgcagaagattaaggccgcctccgagcagtatattgatactgagaagaagaaacgcgaaaaagcctatcaggccagatcccagaaaacctcagggatcggtagacttatggtgcacgtgattgaagccaccgagctgaaagcgtgcaagccaaacggcaagagcaacccctattgcgagatctccatggggtctcaatcctatactaccagaactatccaggacaccctcaatcccaaatggaatttcaattgtcagttctttatcaaagacttataccaggatgtgctgtgtctcaccttattcgatagagaccagtttagccccgatgattttctgggcagaaccgagatacctgttgcaaaaattcggactgagcaggagtcaaagggacctatgacaaggaggctcttgttgcatgaggttcccaccggcgaagtgtgggtgagattcgaccttcagttgtttgagcagaaaacgttactttag

SEQ ID NO: 121115 - DNA, 5013 bp, Artificial Sequence
  Description of Artificial Sequence: Synthetic coding sequence
atgatggcgcaattccctactgcaatgaatggcggccccaacatgtgggccataacctctgaagaacgtacaaaacacgatcgccaatttgataacctcaagccctcaggaggttatataaccggtgatcaggcccggaactttttcctgcaatcaggcttgcctgcgcctgttctggcggaaatctgggctctgagcgaccttaataaagacggcaagatggaccagcaggagttctcgatcgcaatgaagttgataaagctgaagttgcagggacaacagcttcctgtcgtccttccgcctattatgaagcagccgccaatgttcagccccttaatcagtgccaggttcgggatgggatctatgcccaatttgtccataccacagcctctaccaccagccgcccccatcaccagtctgtccagcgcaacaagcggaaccaatctgcccccattgatgatgcccactcctctcgtccctagcgtgtccaccagcagcctgccaaatggcaccgcatctcttattcagcctctgccaatcccgtactcttcaagcacactgccacacggtagctcatatagcctgatgatgggcggctttggcggcgcatccattcagaaggcgcaatctctgatcgacctcggcagcagtagcagcacatccagtacggccagtttatcaggaaattctcccaaaactggcacttccgaatgggctgtgccccaacccacaagactgaagtacagacagaaatttaatactttggacaagtccatgtctggctacctgtccggcttccaggcaaggaacgcacttttgcagagtaacttaagccagacccagctcgccaccatatggactctggcagatgtcgatggggacggccagctcaaggccgaagagtttattcttgccatgcaccttacggatatggccaaggcagggcagcctctccctctcaccttaccacccgaattggtgccaccatcctttcgcggcgggaaacagatcgatagcatcaatggaacactcccatcatatcagaaaatgcaggaggaggaaccacagaagaagctgccagtaacatttgaggacaagaggaaggccaattacgaacggggcaacatggagttggaaaagaggagacaggccttgatggaacagcagcagcgggaggccgaaaggaaagctcagaaagagaaggaggagtgggagagaaagcagcgggaactgcaggaacaggagtggaaaaagcagcttgagctagaaaaacgactggagaagcagagggaactagagagacagcgggaagaagaacggcggaaagatattgaaagaagggaggccgcaaagcaggagctggagaggcagcgtcgactcgagtgggaacgcatccgaagacaggaactgctgaatcaaaaaaatcgggagcaagaggaaatcgtgcggttgaacagtaagaagaaaaatcttcatctggaactagaggcattgaacgggaagcatcagcagatttcgggccgactgcaggatgtccgactgaaaaagcagactcaaaagaccgaactggaagtactggataagcaatgcgatctggagataatggagatcaagcagctccagcaggagttgcaggagtatcaaaataaattaatctacctcgtgccagaaaagcagctgttaaatgaacgtataaagaacatgcagtttagcaacaccccagattcgggagtgtctcttctccacaaaaaatctctggagaaagaggagctgtgccaacggctgaaagaacagctcgacgccttagagaaggagacagcctcgaagctgagtgaaatggattcctttaataaccagctaaaggaattgcgcgagacttacaatacacagcaactggccctagaacagctgtacaagattaagcgcgataaacttaaagagattgaacggaagcgtttggaactaatgcagaaaaagaagttagaggacgaagctgctcggaaggccaagcagggtaaggaaaacttgtggaaagagaacctgcgcaaggaggaggaggagaagcaaaaaaggctgcaggaggagaagacacaggagaaaatccaagaagaggagcgtaaggctgaggaaaagcagcggaaagataaggacactttgaaagccgaggaaaaaaaaagggagacggcgtctgtcctcgtaaattatagagcattatatccattcgaggcgcgcaatcatgatgagatgtcatttaattcgggcgatatcattcaggtggatgagaaaaccgttggtgagccaggctggctgtatggtagctttcaaggaaactttgggtggtttccctgcaattacgttgaaaagatgccctcctccgagaatgagaaggctgtgagccctaaaaaggctttgctcccccctacggtgtctttatcagccacctcgacttcatcagagcccctgagttccaaccagcccgctagcgtcaccgactatcagaatgtgagcttcagcaatttaacagtgaacacttcttggcagaagaagtccgcattcacccgcacggtgtctcccggatccgtttccccaattcacggccaaggtcaggttgtagagaacctgaaggcgcaggccctttgctcctggactgcaaaaaaagataaccatttaaacttttcaaaacatgatataattaccgtgctcgagcaacaagaaaattggtggtttggtgaggtgcacggcggacggggctggttcccaaaatcttatgtgaagataatccccggatctgaggttaaaagggaggaaccagaagccttgtatgcggctgtgaataagaagccaactagcgctgcctatagtgtgggcgaggagtacatcgcactatatccctacagttctgtagagccgggcgatcttacatttaccgagggggaagagatactcgtcactcaaaaggatggtgaatggtggacaggaagtataggcgacaggtcaggaatttttccaagcaattacgtcaagcccaaagatcaggagtcattcggctccgcctctaagtctggggcatctaataagaagccagaaatagcccaggttacttcagcctacgtagctagcgggtcggagcagctctctctggcccctggccagttgattttaatcttgaagaaaaacaccagcgggtggtggcagggggagctccaggccagaggcaaaaagcggcaaaaggggtggttccccgcatcccacgttaagctcctgggcccatcttccgaaagagctacccccgcctttcacccagtgtgccaagttatagcgatgtacgactatgccgccaacaacgaggatgagctcagcttctccaaaggccagttaatcaatgtgatgaataaggacgatccagactggtggcagggggagattaatggcgtgacagggctctttccttcaaattatgtgaaaatgaccacagactcggaccctagtcagcaatggtgtgcagatttgcagactttggatacaatgcagccaatcgagaggaaacggcaggggtatatacacgaattgattcaaactgaggaaagatacatggccgacctacagctggtcgtcgaagtctttcaaaaacggatggcggaatcaggatttctgaccgagggcgagatggccctgatctttgtgaactggaaagaactcatcatgagcaacacaaagcttttgaaggcactacgggtgaggaagaaaaccggcggagaaaaaatgccagtgcagatgatcggagatattctggccgctgagctgtcccacatgcaggcctacatccggttctgctcttgtcaacttaatggagccgcactgttgcagcagaagacggacgaggatacggactttaaggagtttctcaaaaaactggcctccgacccccggtgcaaaggaatgcctctgagctccttcctgcttaagccgatgcaaaggatcacccggtatcccttactgatccggtctattctagaaaatacacctgagtcgcatgctgaccattcttccctgaagcttgcactggagcgagccgaggagctgtgtagccaggtcaatgaaggtgtgcgcgaaaaggagaactctgacagactcgaatggatccaggcccacgtgcagtgtgaggggctagcagaacaattgatatttaacagcctgaccaactgcctaggcccaaggaagctgttacacagcggaaagttatacaaaacgaagtctaataaagagcttcacgggtttcttttcaatgactttctactcctgacctacatggtaaaacaattcgctgtgtcctcagggagcgaaaagctgttctcatccaaatccaatgcccagtttaagatgtataagacacctattttcctgaatgaggtgctcgtgaagctgcccaccgacccctcgtcggatgaacctgtctttcatatttcacatatcgacagggtgtacacactgagaacggacaacatcaacgaaaggacagcttgggtccagaagatcaaggcagcctccgagcagtatattgacaccgagaaaaagaagagggagaaggcataccaggcacggtcccagaagacctccggcattggtcgactgatggtccatgtcattgaggccacagagttgaaagcatgtaagcctaacgggaagagcaatccttactgtgaaatttcaatggggtcccaatcatatacaacgcgcaccatccaggacacgcttaatcccaaatggaactttaattgtcaatttttcattaaggacctgtaccaggacgtcttatgtctcactttgtttgacagagaccagtttagtccagatgacttccttggaaggacagaaattccggtcgctaaaatccggaccgagcaagaatccaagggcccaatgactcgccggctgctcctccacgaggtccctacgggtgaagtgtgggtccgatttgacttgcagttatttgaacagaagaccctattgtag

SEQ ID NO: 121116 - DNA, 1836 bp, Artificial Sequence
  Description of Artificial Sequence: Synthetic coding sequence
atggcacagtttcctaccgccatgaatgggggacctaacatgtgggccattaccagcgaggagaggacaaaacacgaccggcagttcgataacctcaagccctcagggggatacataacgggggaccaggcccgaaatttcttcctgcaaagcggtttgccagcgccagttctcgctgagatatgggcactcagtgacttgaataaggatgggaagatggatcagcaggaattcagcatcgcaatgaagctgattaagctgaagctgcagggtcagcagctgcccgtggtacttccgcctatcatgaaacagccacccatgttttcccctctgattagtgccagattcggcatgggcagcatgccaaacctgtctattccccagccactgcctccagctgcaccgatcacaagcctgtccagcgcaacttctgggacgaatctgcccccattgatgatgcccacaccattagttcccagcgtcagcacttccagcctgcctaatggcacagcttctctaattcagcctcttcccatcccctactcttcatcaaccttgccccatggcagttcctacagtttaatgatgggagggttcggaggcgcaagcatccagaaggcacagagcctgatcgacctcggtagcagtagaagctggagctcaggctcttctgcccacagccccgccacccaccgcgcccccctgtccagcccagtgcctaactcctctacttccagtacagcgtccctaagtgggaactctccaaaaactgggacaagcgagtgggcagtaccccagcccacaaggctgaagtaccggcagaaatttaatactttggataaatccatgtccggttacctgtctggattccaggctagaaatgccctcttgcaatcgaatctgtcccagactcaactggcgactatttggacactcgcagatgtagacggggatggccagcttaaggcagaagagtttatcctggctatgcatctgactgatatggctaaagcggggcagccacttccgctgacactgcctccggagctggtgcctccctccttccgggggggaaagcagatcgactctattaatgggaccctcccctcatatcagaagatgcaagaagaagaaccccagaaaaaacttcccgtgaccttcgaagacaagagaaaagctaactatgaaagaggcaacatggaactcgagaaacggagacaggctctcatggaacagcagcagcgcgaggccgaaagaaaggctcagaaggagaaagaagagtgggaacgaaaacagcgagaactacaggagcaggaatggaagaagcagttggaactggagaaaaggcttgaaaagcagcgggaactggagagacagagggaggaagagcgccgtaaagacatcgagcggagggaagcagccaaacaagaactggaacggcagagaaggctcgagtgggaaaggatacgccggcaggagctgctcaatcagaagaatcgggagcaggaggaaattgtgcggcttaatagtaaaaaaaaaaatctccatctggagctcgaagctctaaacggcaagcaccagcagataagcggccgactgcaggacgtgcgactgaagaagcaaacgcaaaagactgaacttgaggtactagataagcaatgcgatttggaaatcatggagatcaagcaactgcagcaggagttgcaggagtatcagaacaaattgatctatttggttcctgaaaagcagctgcttaatgaaaggataaaaaatatgcaattcagcaatacccccgactctggagttagcttactgcacaagaagagcctcgaatag

SEQ ID NO: 121117 - DNA, 3750 bp, Artificial Sequence
  Description of Artificial Sequence: Synthetic coding sequence
atgatggctcagtttcctactgccatgaacggaggaccgaatatgtgggcaattacatcagaagagaggacaaagcacgaccgccagtttgataacttaaaaccaagtggcgggtatatcactggagaccaggcgcgcaatttctttcttcagagtgggcttcccgcccctgtgctggctgaaatttgggctctcagcgacctgaataaagacggtaaaatggaccagcaagagttcagcatcgcgatgaaactcatcaaattgaaactacagggacagcagttgccggtcgtgctgccacctattatgaagcaacctcccatgttttccccactgatcagcgcccgcttcggcatggggagcatgcccaatctctcaatcccgcagcctctgccccctgcagccccaatcacttccctctcatctgctacctccggcacaaacctgccacctttaatgatgcccactccactggtccctagtgtgtcaacgagcagcttacccaacgggacggcttcacttatacaacctctgcccatcccatatagtagttccacgcttcctcacggttcttcatatagcctcatgatgggcgggtttgggggcgcttccatccagaaagcccagtctctcatcgaccttggatcaagttccagcactagctcaacagctagcttaagtgggaatagcccaaaaactgggacatctgagtgggccgtgccacagcccacccgactgaaatacagacagaaatttaacactctggacaaaagcatgtccggctatctctctggcttccaagcccgcaacgcacttctccagagcaacctaagtcagacacagttggcaaccatctggaccctggccgatgtggacggggatgggcagttaaaagccgaggaatttatcctggccatgcatctgacggatatggccaaggctggacagccgctgccccttacactgccacctgaactcgtgcctccatcatttaggggaggcaagcaaatcgattccattaatggcactttaccaagttatcagaagatgcaggaagaggagccacaaaagaaactcccagtgacttttgaagataagagaaaggccaactatgagaggggcaatatggaacttgagaaacgccgccaggctctcatggagcaacaacagagagaggccgagcgcaaggctcagaaagaaaaagaggagtgggaacgcaagcagcgtgaactgcaggagcaggagtggaaaaagcagctggagttagagaaacgtttagaaaagcagagggaactggagaggcagcgtgaggaggagcgacggaaggacattgagaggcgggaggccgccaagcaggagctggaaaggcagagaaggctcgagtgggagaggatccggcgacaggagctgctcaaccagaaaaatcgggaacaagaagaaatcgtacggttgaactcaaagaaaaaaaacttgcatctggagttagaagccctgaacggtaaacaccagcaaatcagcggaagactccaggacgtcaggcttaagaagcaaacacagaaaactgaactagaagtgcttgataagcagtgcgatctggaaatcatggagataaagcagctgcagcaggaacttcaagaataccaaaataaactgatttatttagtgcctgaaaagcagctcctcaatgaaaggatcaagaacatgcaattttcaaatacccctgactctggcgtctccctccttcacaagaagtctcttgagaaagaggagctctgtcaacggctgaaagagcagctggatgctctcgagaaggagacggcatccaagctttccgagatggactccttcaataatcagctgaaatgcggcaatatggatgattctgtgttacaatgtctgttgagtctgctgagttgtctaaataatttattccttctgctgaaggagctgagggagacatataacacccaacagttggctctggagcaattgtataaaatcaagagagataagctgaaagagatcgagaggaaaaggctggaactcatgcaaaaaaaaaaactggaagatgaggccgcaaggaaggctaaacagggaaaggaaaatctctggaaggagaatctgagaaaagaagaagaagagaagcagaagcgcctccaggaggaaaaaactcaggagaagatccaggaggaagagaggaaagcagaagagaagcagagaaaggacaaagataccctgaaagcggaggagaaaaagcgcgagaccgcctccgtgctggttaactaccgggccctgtacccatttgaagctcgcaatcatgatgagatgagcttcaactcaggagacattatccaagtggacgagaaaacagtgggggaacctgggtggctctatggatccttccaaggcaatttcgggtggttcccatgcaattatgtggagaagatgcctagctctgagaatgagaaggccgtttcccccaaaaaggcgctgctgccgccaacagtgagtcttagcgcaacaagtaccagctcggaacccttgtcatccaaccagccggctagtgtgacggattatcagaatgtttccttctctaatctgacagtcaatacgagctggcagaagaaaagcgcctttacccgtacggtgtcgcctggaagcgtgagtcctatccacggacaggggcaggttgttgagaatctgaaagcccaggcactttgcagctggacagccaaaaaagacaaccacctgaacttctcgaaacacgatatcattaccgtgctggaacagcaagagaattggtggttcggcgaggttcatggtggacgcggatggttccccaagtcgtatgttaagattatccctgggagcgaggttaagcgggaggagccagaagctctatacgccgcagttaacaaaaagccaacatcagcggcctattcggtcggcgaggaatatatcgctctgtatccctactctagcgtggaaccgggagacctcacgttcaccgagggcgaggagatccttgttacccagaaagatggagaatggtggaccggatctatcggagatagaagcggaatctttcccagcaactatgtcaagcctaaagatcaagaatcgtttggcagcgcttctaagagcggggccagtaataagaaacccgaaattgcccaggtgacgagtgcctacgttgcaagcggatcagaacagctatctttagctccaggacaactgattctcattctgaaaaaaaacactagcggatggtggcagggagagctgcaagcccgggggaagaagaggcaaaagggctggttcccagcaagccatgtgaagctactgggaccttctagtgagcgggccacaccagcgtttcacccggtttgccaggttatcgctatgtatgattacgcagcaaacaacgaggacgagctcagcttttccaagggccagctgatcaatgtgatgaacaaggacgaccctgattggtggcagggagagatcaacggcgtgaccggcttgttcccctcaaattacgttaagatgacaaccgacagtgacccctcccagcagtggtgtgctgatctgcagacactggacaccatgcaacccatagaacggaagaggcaggggtatatacatgagttgatacaaacagaggagcgctacatggccgacttgcaactggtggtggaagtgcgccggttgcttcttgcatcctcccgaggcatttgttgtctcagctag

SEQ ID NO: 121118 - DNA, 1899 bp, Artificial Sequence
  Description of Artificial Sequence: Synthetic coding sequence
atgaacagatatacaactattcggcaattgggagatgggacctacggatctgtcctccttgggaggtctatcgagtctggtgagctgatcgcaatcaagaagatgaagcgaaaattttatagctgggaggagtgcatgaacctgagggaggtcaagtcactgaaaaagttgaaccatgcaaacgttgtgaagctgaaggaagtgatcagagagaacgaccatctttactttatttttgagtacatgaaagagaatctgtaccagctcataaaagagcggaataaactctttcctgagtcagcaattcgcaatataatgtatcagattttgcaagggttggccttcatccataagcacggcttctttcacagggatctcaaacctgagaacttgttgtgtatgggacctgagctcgttaaaattgccgatttcgggctggctcgcgagatcaggagcaaaccaccgtacactgactatgtctcaacaagatggtatcgggcaccggaggtactactgcgcagtacgaattattccagcccaattgatgtgtgggccgtgggttgtattatggctgaggtttatactctgcgcccactgttccctggggcctccgaaatcgataccatttttaagatctgtcaagtcctggggacccccaagaagacggactggcccgaggggtaccagctcagttctgctatgaattttcgctggcctcagtgcgtgccaaataacttaaaaactctcatacctaacgcctcatccgaggcagtgcagctcttacgggatatgctacagtgggatcccaagaagagaccaacagcctctcaagcgctgcgttacccatatttccaagttggccaccctctggggtccacgacacagaacctgcaggatagcgagaaaccccaaaaagggattctggaaaaggctgggcctcccccgtacataaagcctgtgcctccggcgcagccacccgcaaagcctcacacaagaatttctagccggcagcaccaagcaagtcagcctcccctccacctcacatacccctacaaagctgaggtcagtcgcacagatcacccttcacacctacaggaagacaagcctagccccttactttttccatctcttcacaacaaacacccgcagagcaagatcacagctgggctggaacacaaaaacggggaaatcaagccaaagagcaggagacgatggggcttgatatccagaagcaccaaggactctgatgattgggccgacttggacgacctggatttttcaccctcactctcccgcatagatcttaagaacaagaagcgccagtctgacgatacgctgtgtcgtttcgagagtgttctggacctgaaacccagcgagcctgtcggtactggaaacagcgctccaacccagacgtcctatcagcgccgcgacacaccaacccttaggagtgctgccaagcagcactacctaaaacactcccgctatctgcccggcatatccatacgtaatgggatactctccaaccctggcaaagagttcattcctcctaacccttggtcttcctctgggcttagcggcaagtcaagcgggaccatgagcgtcattagcaaggtcaactccgtcgggtcgtcatctacaagctcctcaggtctgaccggaaattacgtgcctagctttcttaaaaaggagatcgggagcgctatgcaacgcgtccacctggcaccgattcccgacccgtctcccggctactcatctttgaaggctatgcggccacatccgggaaggcccttttttcatacgcagccccggtctacgcctggtttgataccccgaccacctgctgcacagccagttcatggaagaaccgattgggcaagcaagtacgcttcccgacgctag

SEQ ID NO: 121119 - DNA, 1899 bp, Artificial Sequence
  Description of Artificial Sequence: Synthetic coding sequence
atgaacagatatactaccatccggcagttgggcgatggcacctatggctcggtgctgctgggccggagtatagaaagtggcgaacttattgccatcaaaaagatgaaacggaagttttacagctgggaagagtgtatgaacctgagagaagtgaaaagcctgaagaagttgaatcacgccaatgtggtcaaactcaaggaagtcatcagagaaaatgaccacctctattttatcttcgagtacatgaaagaaaatctgtaccagctgatcaaggagagaaataagctgtttcctgagtctgccatccgcaacatcatgtaccaaatcttacaagggctggccttcatccacaagcatggctttttccatcgcgacctgaagccagaaaatttattatgcatgggacctgaactcgtgaagattgcagattttggcctggcgcgtgaaatacgctcgaagcccccgtatactgactatgtatctacgcgctggtaccgggcccccgaggtactgctgcggagtactaattactcatcccccatcgatgtatgggctgtcggctgcataatggctgaagtatacaccttaaggcctctcttccctggagcttcggaaattgacaccatctttaagatttgtcaggtcctaggcacgcccaaaaagacagattggcccgaaggctatcaactgtccagcgctatgaactttagatggcctcagtgtgtccctaacaatcttaaaaccctcatccccaacgcaagcagcgaggccgttcagttactgagagatatgctacaatgggatccaaagaagagaccaactgcgtcacaggcactgagatacccatatttccaggttggccaccctctgggttccaccacacaaaaccttcaggacagtgagaaaccccaaaagggcatcctcgagaaagctggcccacccccttacattaagccagtgcctcctgcacagccgccagccaaacctcatacccgtataagttcccgccagcatcaggccagccagccacccttgcatctaacatacccctataaagcagaggtcagccgaaccgatcatcctagccacctgcaggaagataagccgagccccttgcttttccctagcctccacaacaaacaccctcagtctaagattactgccgggcttgagcacaaaaatggtgagatcaagcccaagtccaggcgccgttggggcctgatctctagaagcacgaaggacagcgatgactgggcagacctcgacgacttagacttctcccctagtctttctagaatcgacttaaagaacaagaagaggcagagcgacgacactctgtgtcggtttgagtctgtgctcgacctgaaaccatccgaacctgtcggaaccggcaatagtgcccccacccagacgtcatatcaaagaagggacacgcccaccttaagaagcgcagctaagcagcactacttaaagcacagcaggtatctgccaggcatttcgatacgaaacgggatactgtccaatcctggaaaagaattcatccctcctaatccctggtcaagctccggcctgtcaggaaagagcagcggcacgatgagcgtcataagcaaagtgaacagcgttggcagtagctcaaccagttcctcagggttaactggcaattacgtccctagtttcctcaaaaaagagataggaagtgctatgcagagggtgcacctcgctcctatccccgacccttccccaggctattcatcactgaaggcaatgaggcctcaccctggcaggccgttcttccacacccagcctagatctactcctggtctgattcccaggcctccagctgctcagccagtacacggtcgaaccgactgggcctcgaagtacgcctcccggcggtag

SEQ ID NO: 121120 - DNA, 738 bp, Artificial Sequence
  Description of Artificial Sequence: Synthetic coding sequence
atgtgtgccgaggtcggcccagccctgtgcagaggcatggaacgtaattctctgggctgctgtgaggccccaaaaaaactttctctgagtttttctatagaggccatcctgaaacggccagctcgaagaagcgatatggatcgacccgaaggccctggagaagaaggacctggtgaggcagcagcctctgggagcggcttagagaagccaccaaaggatcaaccacaggaagggcgcaaatcaaagaggcgcgtccgaaccacattcactactgagcagctccacgaactcgagaagatcttccatttcacccattacccagatgtacacatcagaagccagctggcagcccgcatcaatttgcctgaggcccgagtgcaaatttggttccagaaccagcgcgccaagtggcgaaagcaggagaagatcggcaatctaggcgccccgcaacagctgtctgaggcttcagtagcccttccaacaaacctagacgtcgccggacccacctggacctctactgctctgcgacgactcgctccccctacatcatgctgcccatccgcacaggaccagcttgcttcagcttggtttccggcatggataacactactgccagcacatccctgggagacccagcccgttcctgggctgcccattcatcagacctgcatccctgtcctttgtatcctgccacccccacacccaaagtgggggtctatctgcgctacatccacgtag

SEQ ID NO: 121121 - DNA, 738 bp, Artificial Sequence
  Description of Artificial Sequence: Synthetic coding sequence
atgtgtgccgaagtcggccccgcattgtgccgcgggatggagcgtaactcactggggtgctgcgaagcacccaaaaaactatccctgtctttcagcattgaagctattctcaagcgcccagccagacgatctgacatggataggccagaggggcccggagaggaaggccccggtgaggctgctgctagcggatctgggctagagaagcctcctaaggatcagccccaggagggacgtaaaagcaagcgccgagtcagaactacctttacaactgagcagcttcacgaactggaaaaaatattccactttacccactatcccgacgtgcacattaggagccagctcgctgcgcgaataaatctgcccgaggcgcgggtacagatctggttccagaatcagagggccaaatggcggaaacaggagaaaatcggcaatctgggggcgccccaacagctgtcagaggcaagtgtggctctccctaccaacctggacgtagccggccccacatggacctcgacggccctgcggagactggccccgcccacatcgtgctgcccctctgcccaggatcagttagcctccgcatggttcccggcttggatcactctgctacccgcccatccctgggaaacccaaccagttcctggcctgcctatccatcaaacttgcatccctgtgctgtgcatcttacctccaccacacccaaagtggggcagtatatgcgcaacttcaacctag

SEQ ID NO: 121122 - DNA, 1749 bp, Artificial Sequence
  Description of Artificial Sequence: Synthetic coding sequence
atggctaacgaggactgtcctaaggcagctgatagccctttttccagcgacaaacatgcccaactgattctggcacagattaacaagatgaggaatgggcagcacttctgcgacgtccagttacaggtggggcaagagtctttcaaagctcaccggctggtgctggcggcctcctccccgtatttcgccgccctgtttaccggaggtatgaaagagtccagcaaggatgtggtcccgatcctgggtatcgaggccgggattttccagatcttgctagattttatatacaccggcatagtcaatatcggagtgaataacgtgcaagagctaatcatagcggccgacatgttgcagctgacagaggtcgtgcatctgtgttgcgagttcctaaaggggcagatcgaccctcttaactgcattgggatctttcaattttccgagcagattgcatgccacgacttgctcgaatttagtgagaactatatccacgtccactttctcgaagtgcatagcggtgaagagttcctggccctgactaaagatcagctgataaaaattttgagatcagaggagctatctatcgaggacgagtaccaggtgtttctagcagccatgcagtggattctgaaagaccttggcaaaagaagaaagcatgtggtcgaggtacttgatccaattaggtttcccctgctgccgccgcaaaggctgctgaagtacattgagggcgtctctgacttcaatctgagagtagcccttcagacactccttaaggagtattgtgaggtttgtaagagtccaaaagagaataagttttgttccttcctacagacctccaaagtccgccctcgtaaaaaagccaggaaatacttatacgcggtcgggggctacacccggctccaggggggccgttggagcgactccagagctctgtcttgcgtcgagagattcgatacttttagccaatactggaccacagtcagttccctgcatcaggcccgatccggtctgggcgttactgtactcggaggtatggtgtacgccatcgggggggagaaagattcaatgatatttgactgtacagagtgttacgatccggtgaccaagcaatggactactgtggccagtatgaaccatccccggtgcggactcggcgtgtgcgtgtgttacggagccatctacgcccttggagggtgggtaggcgcagagattgggaacaccattgagagattcgatccggatgaaaataagtgggaagtcgtgggtaacatggctgtaagccgatattacttcggctgctgtgaaatgcaagggctgatttatgtaatcggcgggatcagcaatgaggggatcgagctgcgaagctttgaggtctatgatccactcagcaagcggtggtcccctctaccaccaatgggtacccgccgcgcatacctgggcgtagctgctctgaacgactgcatctactcagtagggggctggaatgagacacaagatgcactgcacacagtagagaagtactccttcgaggaggaaaagtgggtggaagttgccagcatgaaggtgccacgggccggaatgtgcgtggtagccgtgaacggactgctgtatgtcagcggcggcaggagttcgagccatgactttctggctcctgacactcaccggtacgaggtattcagacttaaatgggaaaacatgtgtatcctgtttaacgatcataagaccctcacaaaaggaatttttaacctctag

SEQ ID NO: 121123 - DNA, 1755 bp, Artificial Sequence
  Description of Artificial Sequence: Synthetic coding sequence
atggccaatgaggactgccctaaagccgctgattctcctttcagttccgacaagcacgcgcaactgattctagcccagatcaataagatgcgaaatggccagcacttctgcgacgtccagctccaagtcggccaggagtctttcaaggctcaccggctagtcttagcagcatcgtcaccttatttcgccgctctttttacaggcggtatgaaagagtccagcaaggatgtcgttcctatcctaggcatagaggctgggatctttcagatattgcttgatttcatttacactgggattgttaatattggcgtgaacaacgttcaggaactcatcattgcggcggatatgctgcagctcactgaggtggttcacctctgctgtgaatttttgaaaggccagattgaccctctgaattgtatagggattttccagttttctgaacaaattgcctgtcacgatctccttgaattctctgaaaactatatccacgtgcattttctggaggtccacagtggagaggagtttctggcccttacaaaagatcaattaattaaaatcctgcggtcagaggagctctcaattgaagacgagtaccaggtgttcttagcggccatgcagtggatcctgaaagacctcggcaaacggcgaaagcacgtcgtggaggtgctggacccaattcgattccccctattgcctcctcaacggctcctgaaatatatcgaaggggtttcagactttaacttaagagttgccctgcaaaccctactcaaggaatattgcgaagtttgtaagagtcctaaagaaaacaaattttgcagttttctgcaaacatccaaggtgagaccgcggaaaaaggctaggaagtacctttacgccgttggcggatataccaggctccagggggggcgttggagcgactcaagggccctgtcctgcgtcgaaagattcgataccttcagtcagtattggacgactgtgagttccctgcatcaggcacgttccggtctgggtgtcaccgtcctgggcggaatggtttatgccattgggggagaaaaagacagtatgatattcgattgtactgagtgctacgatcccgttactaaacagtggacaaccgtggcaagcatgaaccatcctaggtgtggcctgggtgtgtgcgtctgttacggtgccatttatgcattagggggctgggtgggcgccgagattggaaacactatcgagcgtttcgatcccgatgaaaataagtgggaggtggtcggaaatatggccgtttcgaggtactatttcggctgctgtgaaatgcagggcttgatctatgtgattggagggataagcaatgaagggattgaactaaggagctttgaagtgtacgaccctctgtccaagagatggagcccccttccaccgatgggaaccaggagagcttacttaggagtggccgctctcaatgactgtatctattccgtcggtgggtggaatgaaacacaagacgccttacacactgtggaaaagtatagcttcgaggaagagaaatgggtggaggttgccagcatgaaagtccctcgtgctggaatgtgcgtcgtcgcggtgaatggccttctgtacgtgtctggcggccgaagctccagccatgactttctggcaccagggaccctggacagcgtcgaggtgtacaatccccactccgatacatggactgagattggcaatatgattacttctaggtgtgaggggggcgtcgctgtactgtag

SEQ ID NO: 121124 - DNA, 3879 bp, Artificial Sequence
  Description of Artificial Sequence: Synthetic coding sequence
atgagggccgtgctcacttggagagacaaggccgaacattgcatcaatgatatcgcattcaaacctgacggcactcaactcatcttagccgccggatccagactgctagtatacgacacctcagacggaacattgctgcaaccacttaagggccataaggatacagtatattgtgtcgcatatgccaaagatggcaaacgcttcgcatccggcagcgcagacaagtccgttatcatctggacatcaaagcttgagggcatcctcaagtacacttcgtggtctgtgatgtcctcactgcaccttcatttaccatttttgggcctccacaaaactgttagagtgaccgccacggacaaagcccccaaaggacagggcggccgtatcgactgtctgaggcccagcgtgcagaaccagccaggtcagaagcataacgatgccattcagtgtgtatcctacaaccccattacgcaccaactggctagttgttctagcagcgacttcggactttggtcacccgagcaaaaatctgtgtctaagcataagtccagtagcaaaatcatttgctgtagttggacgaacgacgggcagtacctcgctctcggtatgtttaatggtataatatcaatccgtaacaaaaacggggaagagaaggtgaagatcgagcggcccggtggctcgctgtctcctatttggtctatatgttggaacccttctagtcgttgggagtccttttggatgaacagggaaaacgaggacgctgaagacgtgattgtgaatcgttacatccaggagattcctagtacgctcaagtcagctgtttactcgtcacaggggtccgaggctgaagaagaggaacctgaagaggaagatgactcccctcgcgacgacaacctggaagagcggaacgacatactggccgtggccgattgggggcagaaagtgtcattctatcagctgtcagggaaacagattggcaaagatagagccctgaattttgacccttgttgcattagctattttactaaaggggagtacatcctcctgggcggtagcgacaagcaggtgtccctgttcaccaaagacggcgttaggctcgggaccgtgggggagcaaaactcttgggtttggacctgtcaagctaaacccgattcaaactatgtcgtagtaggctgccaggacggtaccattagtttttatcagctgatcttcagtacggtgcatggtctgtataaggacagatatgcatatcgagattcaatgacggatgttatcgtccaacacctcataactgagcaaaaggtacgaataaagtgcaaagaactggtcaagaaaatcgcgatctaccgcaataggctggcaatacagctacccgagaaaattctaatctacgagctgtactccgaagacctgtccgacatgcattatcgcgtgaaagagaaaatcataaagaagtttgagtgtaacttgctcgtggtgtgtgccaatcacatcatcctctgtcaggaaaagaggctccaatgtctgagcttttcaggagtgaaggagcgcgagtggcaaatggaatcactcattagatacatcaaagtgattggtggaccccctggcagggagggtcttctggtaggtctgaaaaacgggcaaatcctgaagattttcgtggacaacctgttcgcaatcgtcttactgaagcaggctaccgccgtacgttgcctcgacatgtctgccagccggaagaagctggctgtggtcgacgagaacgacacttgcctggtgtacgacattgacaccaaagagctgctgttccaggagccgaacgccaactccgtcgcgtggaatacacagtgtgaggacatgttgtgtttctcaggcggcgggtacctgaacatcaaggcgagcactttccccgtccatcggcagaagttacagggcttcgtggtagggtataacggtagcaaaatcttctgtctccatgtcttctctatctcagccgtggaggtgcctcagagcgcacctatgtatcaatacctggatcgcaagctatttaaggaggcataccagattgcttgccttggagtcaccgacaccgactggagagagctggctatggaggcactagaagggttagactttgaaacagcgaaaaaggcctttattcgcgttcaggatctgcgatatctagaattgatcagctctattgaagaacgaaaaaagcgaggcgagactaacaatgacttgtttctggctgacgtgttcagttatcaggggaaatttcacgaggctgcaaagctttataagcggtcaggtcatgaaaacttggccctggagatgtacaccgacctgtgcatgtttgagtatgctaaagattttctagggagcggagatccaaaggaaacaaagatgctgattactaagcaggccgactgggccagaaacatcaaagaaccgaaagctgctgtcgagatgtacatctccgcaggcgagcatgtaaaggccatcgagatatgtggcgatcacggctgggtcgacatgttgatcgacatcgcccgtaaactggataaagctgaaagagaacctctgctgctctgcgcaacctatctgaagaagctcgactctcctggctacgctgctgagacctatctgaaaatgggtgatctgaaatccctggtccagctgcatgtagagacacaacgctgggacgaagcctttgcactgggcgagaagcacccggaatttaaggacgacatctacatgccctacgcccagtggctcgctgaaaatgaccgcttcgaagaagctcagaaagcttttcacaaagcgggacgccaaagagaggccgtgcaggtcctggagcaactgactaataacgccgtcgcagagtcccggttcaacgatgccgcctactattactggatgctgagcatgcagtgcctcgatatcgcacaggaccctgctcagaaagatactatgttaggtaaattttaccactttcagcggctagccgaactgtatcacggataccacgccattcatagacatactgaggatcccttcagtgtccatcgtccagaaacattgttcaatatcagtagattcctgttacactcccttcccaaagatactccatccggtatctcaaaggtgaaaatcctatttacgctcgcgaagcagagtaaagctctgggcgcctatcggctggccagacatgcttacgataaactaaggggcctgtacatacctgcccgcttccagaagtcaatagaacttggaacccttacaatcagggctaagcccttccatgatagcgaagagctcgttcctctctgctacaggtgcagtactaacaaccctttactcaacaacctgggtaatgtgtgtattaattgccggcaaccgttcatctttagtgcctcgagctacgacgttctgcatctggtcgagttttacctggaggagggaataaccgatgaagaagctatctcactgattgacctggaggtgctgcgtccgaagcgagatgatcggcagctggaaatcgcgaacaattcttctcagattcttcgattggttgagacaaaggattcaataggcgatgaggatcccttcactgcgaagctgagctttgaacagggcggctcagaattcgtcccagttgttgtgtcccgactggtacttcgctccatgtcccgcagagacgtcctgattaagagatggccacctccgttgcggtggcagtacttcaggagtctgcttcccgacgcctcaattacaatgtgtccatcatgcttccagatgtttcacagcgaggactacgagttgttggttcttcagcacggctgctgcccatattgcagacgctgcaaggacgatccagggccgtag

SEQ ID NO: 121125 - DNA, 3549 bp, Artificial Sequence
  Description of Artificial Sequence: Synthetic coding sequence
atgagagccgtgctgacatggagagacaaagctgaacattgcatcaatgatatcgcttttaaacccgatggaacacaattaattctcgcggcaggaagtcggttgctggtatatgatacttccgatggtaccctgctgcagccattgaaggggcacaaggacactgtctactgcgtcgcctacgcaaaggacggtaagcgtttcgcatccggctcggccgataagagtgtcattatctggacttctaagctggaaggtattctgaagtacacacataatgacgctatccagtgcgtctcatataaccccataacacaccagcttgcgtcttgctcctccagcgattttgggctctggagcccagagcagaagagcgtgtctaaacataagtcctcttccaaaatcatttgctgcagttggaccaacgacggacaatatctcgcgcttggcatgtttaacggaattatctctatccggaataagaatggagaagagaaggttaaaattgagagacccgggggatcccttagtcccatctggtcgatctgttggaatccttctcgcgaggaacgcaatgacattttagcagtcgcagattggggccagaaagtttctttttatcagctgtcaggaaaacaaattggcaaggatagagcccttaatttcgatccatgctgtatctcctactttaccaaaggagagtacatattattggggggctctgataaacaggttagtctcttcacgaaagacggtgtccgtctgggcaccgtgggtgagcagaattcctgggtgtggacgtgtcaggctaagcccgacagcaattacgtggtagtcggatgccaggatggaactatcagtttttaccagctcatattcagcaccgtgcatggattatacaaggatagatacgcttaccgagactccatgacagacgtcatcgtgcaacatctgatcactgaacaaaaggtacgtataaagtgtaaggaactggttaagaagatagcaatctaccgaaaccgcctggccatacagctgcctgagaagatattgatctacgagctatactctgaggacctctctgacatgcattacagagtgaaggagaaaatcatcaagaagttcgagtgtaacctactagtggtctgtgcaaatcatattattctgtgccaggagaaaaggttgcagtgcctgtctttctcaggagtgaaagagcgggagtggcagatggagtctttgataagatatattaaagtgattgggggcccgcccggtagagaaggtctcctggttggactaaaaaatggccagattttgaagatatttgtcgataatttatttgcaattgtcctccttaagcaggccaccgccgtgcgatgtcttgatatgtcagccagtagaaagaagttagcagtggtggatgaaaatgacacctgtctggtctacgacattgatacgaaagaactgctgtttcaagaaccgaatgccaatagtgtggcatggaacacacagtgcgaggatatgctgtgtttttcaggaggcgggtacctgaatattaaggccagcaccttcccagttcaccgccagaaactgcaaggattcgtagtcgggtataacgggagcaagattttctgcctgcatgtgttctctatcagtgccgtggaagtcccccagagtgcacctatgtatcagtacttggacaggaagctgtttaaagaggcataccagattgcatgcctgggcgtcaccgatacagactggcgtgaactggcgatggaggccctggaaggcctcgacttcgaaactgccaaaaaggcctttatacgagtgcaggacctgagatacctggaactgattagttcgattgaggaacgaaagaaacgaggcgagactaacaatgatcttttcctcgcggacgtttttagttaccaaggaaagttccatgaggcggctaagctctacaaacggtcaggccacgaaaacctcgccttagagatgtacactgacctgtgtatgtttgagtatgctaaagatttcctggggtctggcgaccctaaagagactaaaatgctgatcactaagcaggctgactgggcccggaacataaaggagcccaaagcagcggtcgaaatgtatatttccgccggggaacacgtgaaagcaatagagatttgcggggaccacggctgggtcgatatgctgatcgacatcgccagaaagctcgacaaagctgagcgtgaaccgctgctattatgtgccacctatcttaaaaaacttgactcccccgggtatgctgcagaaacgtatctgaagatgggggatctcaagtccctcgtccagctgcacgtagaaacacagcggtgggatgaagcctttgcactgggtgagaagcatcccgaattcaaagatgatatctatatgccgtatgcccagtggcttgccgaaaacgacaggtttgaggaggcacagaaagcctttcacaaagcagggaggcaacgcgaggccgtccaggtgctggagcaactcaccaacaacgcagtggcagaatctcggttcaatgacgcggcctactattactggatgttatctatgcagtgtttggacattgcccaggatcctgctcagaaggatactatgctaggcaaattctatcactttcagcgccttgccgaattataccatggctaccatgcaattcatagacacactgaggaccccttttcggtacaccgccccgagactctgtttaatattagcagattcttactgcattctctacccaaagacacacccagcggaattagcaaggttaagatcctcttcacacttgctaagcagagcaaggctctgggcgcctaccgtctggccaggcacgcttatgataagctaagggggctgtatattcctgcccgcttccagaagtccatcgaactgggtacattgaccatccgcgctaagcccttccacgattccgaggagctcgtaccactttgttaccgatgctcgactaataatcctctattgaacaatctcggcaatgtctgcattaattgtcgccaaccattcatcttttccgcctcctcttatgatgtactgcacctggttgaattttacctagaagaaggtattacggacgaggaggcgatcagcctgatcgacctggaagtgcttcgcccgaaacgggacgatagacaactggagatcgccaacaattcatcgcaaattcttcggttggttgagacgaaggactcgattggcgatgaggacccgtttaccgcaaaactcagcttcgaacagggcggatctgaattcgtcccagtggtggtgagcaggttggttctccgatcaatgtcacggagggacgtgctgatcaaaagatggcctcctcccctgaggtggcaatacttccgcagcctgctgcctgatgcaagcataactatgtgcccttcgtgttttcagatgtttcactctgaggattatgaacttctcgtgctgcaacacggatgctgtccttattgtaggcgctgcaaggacgacccagggccctag

SEQ ID NO: 121126 - DNA, 3726 bp, Artificial Sequence
  Description of Artificial Sequence: Synthetic coding sequence
atgagagccgtactgacctggagggacaaagctgagcattgtatcaacgatatcgcattcaagcctgatgggactcagctaattttggccgctgggtcccgtcttctggtatacgacacaagtgatggaactctgctccagcctctgaaaggacacaaagataccgtgtactgcgtggcgtacgcaaaggacggaaagcgcttcgcaagcggtagtgcagataagtcggtaattatctggacaagtaaacttgagggcattctcaaatatactcataacgatgcgattcagtgcgtgtcctacaatcctattacccaccagctggcaagctgttccagctcggatttcggcctttggagccccgaacaaaaatccgttagtaaacacaagtcctcttcaaagatcatatgttgctcttggactaatgatggccaatacctggccctgggcatgttcaatggcatcatcagtatccggaacaaaaatggcgaagaaaaagtgaagatcgaacgtccagggggctctcttagtcctatttggtcaatatgctggaatccttcaagccggtgggagtcattttggatgaaccgagaaaacgaagacgccgaggacgtcattgttaaccggtatatccaggagatcccatccaccctcaagtcggctgtgtattcatcccagggcagcgaagccgaggaagaggagccggaggaagaagacgacagcccaagagatgataacctggaagaaagaaacgatattcttgcagtcgccgactggggacaaaaagtgtctttctaccagctatccgggaagcaaattgggaaagaccgcgcactgaattttgacccatgctgcatatcatatttcacgaagggagaatatatattattgggcgggagcgataaacaggtcagtctattcacaaaggacggagtgaggcttggcaccgtcggggagcagaactcttgggtctggacatgccaagcgaaacccgattccaactatgtcgtggtgggctgccaggacggtacgatatctttctaccagctcattttcagcacggtgcacgggctgtacaaggaccggtatgcttaccgggattctatgaccgacgtgatcgtgcaacacttaattaccgagcagaaagtgcgaataaagtgtaaggagctggtgaaaaaaatagctatataccggaacaggcttgcaatccaactcccagagaagattttgatctatgaactttacagtgaggaccttagcgatatgcattatagagtgaaggaaaaaattattaaaaagttcgagtgcaacctcctcgttgtatgcgccaaccacattatcctgtgtcaggagaagagactgcaatgtttgtccttttctggagtaaaagaacgtgaatggcagatggagagcctgatcagatatatcaaagtgattggaggacctccgggccgggaaggcctcttggtcgggctgaaaaacggacagatcctgaagatatttgtagacaacttgtttgctattgtcctcctgaagcaggcaacagccgtgcgttgtcttgatatgagtgcctcccgcaaaaagttggcagtcgtcgacgaaaatgacacttgtcttgtgtacgatattgacactaaggagttattatttcaggagcccaatgccaactctgtcgcatggaacacacagtgcgaagatatgctgtgcttttctgggggcggttatctgaacattaaggcaagcacatttcccgttcacagacagaagctacagggctttgtggtgggctataacggaagcaaaatcttctgcctgcacgtgttcagcatcagcgccgtggaagtgccccagtcagctccgatgtatcagtacctagaccggaaactgtttaaggaggcataccagattgcctgcctgggcgtgacggacaccgattggagggaactcgccatggaggctctggagggacttgacttcgaaacggctaagaaggcttttattcgcgtgcaggacctgcgttacctcgagcttatctccagcatcgaggagaggaaaaaacgcggcgaaaccaacaatgatctgttcctcgctgacgtgttcagctaccagggcaagttccacgaagcggcaaagctctataagagatctggccatgagaaccttgctttggaaatgtacaccgatctctgtatgttcgaatatgcgaaagacttcctggggtccggtgaccccaaggagaccaaaatgttaatcacaaaacaagcagattgggctcgcaacataaaagagcccaaagctgcagtcgagatgtacatctccgccggcgaacacgttaaagctatcgagatctgtggtgaccatggctgggtagatatgttgatcgacattgccagaaaactggataaagcggagcgggagccactcttgctgtgtgccacctacctgaagaaattggattcccccggatacgcggccgaaacatacttaaaaatgggcgatctgaaatctctagtacaactgcatgtcgagactcaacgctgggacgaggctttcgcgctgggggagaagcatcctgagtttaaagacgacatttatatgccctatgctcagtggctggcggagaatgatcggtttgaggaagctcaaaaggcattccataaggctggtaggcagagagaggccgtgcaggtgctggagcagctgaccaataacgccgtcgctgaatcgcgattcaatgacgccgcatactactattggatgctgtccatgcagtgtcttgatatagctcaggatcctgcacagaaggacaccatgctgggcaaattttatcactttcaacgcctggcggaactgtatcacggatatcatgctatccacagacacaccgaagaccccttttccgtgcatagacccgagacgttattcaatattagtaggttcttactgcattccctgccaaaggatacccctagcgggatttcaaaagtgaagatcctattcactctggccaagcaatctaaagctctgggggcttataggcttgcccggcatgcgtacgataagctgcgggggctgtatattccagccagattccaaaaatccattgagttgggcaccttgacaatcagggctaagccgtttcatgactccgaggaactggtgccactgtgttatagatgttctaccaacaaccccttattgaacaacctgggtaacgtgtgcataaattgtaggcagccatttattttctctgcaagttcgtacgacgtgctacacctggttgagttctatctcgaggaaggtatcaccgatgaggaagccatcagcctcatcgacttggaagtcctcagacctaagcgagacgacaggcagctcgaaatcgccaacaactccagtcagatcctgaggctggtggagacgaaagattctatcggtgacgaagatccttttacagccaaacttagcttcgaacaaggtggctccgagtttgtgcccgtcgtggtcagccggctcgtgctaagatctatgtcccgcagggatgtgttaatcaaacgctggcctcctccacttagatggcagtactttcggtccttacttcccgatgcctccattaccatgtgcccgtcatgctttcagatgtttcattctgaagactacgagctccttgtactgcagcatgggtgctgtccgtactgtagacgttgtaaagacgaccctggaccgtag

SEQ ID NO: 121127 - DNA, 3396 bp, Artificial Sequence
  Description of Artificial Sequence: Synthetic coding sequence
atgcgagctgtattgacctggcgagataaggccgagcactgcatcaacgacatcgcatttaaacccgacgggacccaactgattctggccgctggatccagactgctcgtctatgatacatctgacgggaccctcttgcagccactgaaaggccacaaggacacggtgtattgcgtggcctatgctaaagacggactgtggtctcccgagcagaaatctgtttctaaacataagagcagctccaagatcatttgttgctcatggacgaacgatggacagtacttagccctcgggatgttcaacggaattatttccataagaaacaagaacggtgaagagaaggtcaagatcgaaaggccaggggggagcctgtccccgatatggtccatctgctggaacccctccagagaggagcggaatgatattcttgccgtggccgactggggccagaaggtgagcttttatcagcttagcgggaaacagatcggtaaggatcgcgccctgaacttcgatccctgttgtatcagctactttacaaaaggcgagtatatacttcttgggggctctgacaaacaggtatccctcttcacaaaagacggtgttcggctcggaaccgtcggagaacagaacagctgggtttggacctgccaggctaaaccagacagcaattacgttgttgtcggatgtcaggatggaaccatcagcttttaccagttgattttctctactgttcacggactttataaagaccgctacgcctacagggattctatgacggacgtcattgtgcagcacctgatcacagagcaaaaggtgcggattaagtgtaaggagctggttaagaagatcgcaatctacagaaacagattggctattcagctccccgagaagattctaatttatgagctatactctgaagatctgagtgatatgcactatcgcgttaaggagaaaatcataaaaaagtttgagtgcaatctgctcgtggtgtgtgccaatcacatcatcctgtgccaggagaagagactgcagtgcctgtctttctccggtgtcaaggaaagggagtggcaaatggagagcctcatccgctacatcaaggtcatcggcggtccaccagggagagagggtctgctcgtaggactcaagaatgggcagatactaaagattttcgtagacaacctttttgcaattgttctcctgaaacaggcaaccgcggtccgctgcctcgacatgagcgccagtaggaagaaactggctgtcgttgatgagaacgacacatgtttggtgtatgatatcgacacaaaggaactcttgtttcaggagcctaacgcgaattctgtggcgtggaatactcagtgtgaggatatgctgtgcttctctggtgggggctacctgaacattaaggcgagcacctttccggttcatagacagaaactgcaggggtttgtggttgggtacaatggatcaaaaatcttctgtctgcatgtcttttcgattagcgccgtggaggtgccccagtccgcccccatgtaccagtatctcgatagaaaactgtttaaggaagcctaccagattgcctgcctgggtgtgacagacacagactggagagaactggcaatggaagctctggagggcctggatttcgaaaccgcaaaaaaggcctttattcgcgtgcaggacctgagatatttagagcttatcagcagcattgaggagcgcaaaaaaaggggggagactaataacgacctgtttcttgccgatgtgttctcatatcagggaaaattccatgaggccgcaaagttgtacaagcggagtgggcacgagaacctggcccttgagatgtataccgatctgtgcatgttcgaatatgctaaggattttttagggtcgggcgatccaaaggagaccaagatgctcatcaccaagcaggcagactgggctcggaatatcaaggagccaaaagccgctgtagagatgtacatcagtgccggagaacatgtgaaggcaatcgagatttgtggagaccacgggtgggtcgacatgctaattgacatcgcacgcaagttggataaggcggaacgagaaccgctgctcctctgtgctacatatctcaagaagttggactccccaggctacgcagctgaaacgtatctgaagatgggcgatctgaaaagtctggtccagctccatgttgaaactcagcgttgggacgaagctttcgccttgggggagaagcacccagagtttaaggatgacatctacatgccatatgcccaatggctggccgagaacgatcgcttcgaagaagctcagaaagcttttcacaaggctggcagacagagggaagccgtgcaggtcttggaacagttgacaaataatgcagtggctgagagccgattcaatgatgcggcgtattactattggatgttgtccatgcagtgcctggacattgcgcaagccgatccagctcaaaaggacaccatgctcgggaagttttatcatttccagagactcgccgagttataccacgggtaccacgccattcaccggcacaccgaagacccattttcagtgcatcggcccgagaccctctttaatatctctaggttcctgcttcattctctgccaaaagacacacctagtgggatttccaaggtgaaaattctatttaccctggctaagcagtccaaagctcttggcgcctataggctcgcaagacacgcctacgataaactgcggggcctctatatcccagcccgcttccagaagtcaattgaactcggcacattaacaatccgcgccaagcccttccacgattcggaggaactcgtgccactgtgctatcgctgttcgactaataacccattgcttaataacctcggcaatgtgtgtataaactgccggcaacctttcatcttttctgcgagttcatatgatgtgttacacctggtggagttctacctggaggagggcattaccgacgaggaggcgatcagcctcatcgatctggaagtgctccgccccaaaagagacgataggcagctggaaattgcaaacaattcttctcaaatccttagactggtggagaccaaagatagcatcggtgacgaagaccctttcaccgctaaactaagtttcgaacagggtggctcagagttcgtccctgtcgtggtgagcaggctcgttctgcggtccatgtcacgtcgggatgtcctgatcaagaggtggcctccccctctgaggtggcagtatttccgttcacttctgccagacgcttctatcactatgtgcccatcctgttttcagatgtttcactccgaggactatgaactcctggtgctgcagcacggatgctgcccatactgtcgcagatgcaaggacgacccaggtccatag

SEQ ID NO: 121128 - DNA, 3276 bp, Artificial Sequence
  Description of Artificial Sequence: Synthetic coding sequence
atgttcaacgggataatatccatacgaaacaaaaatggagaagagaaggtcaaaattgaacgccctgggggcagcctgagccccatctggagtatctgttggaacccgtcttcccggtgggaatccttctggatgaatcgcgagaacgaggacgcagaggacgtgatcgtgaaccgatacattcaagaaattcccagcacgctgaaatctgccgtgtatagctctcagggctcagaagccgaggaagaggaacctgaagaggaagatgacagtcccagggacgataacctcgaagagcgcaacgatatcttggctgttgcagactggggacagaaggtgtctttctaccaactaagcgggaagcagatcggcaaggatcgggctctgaactttgatccctgttgcattagctattttaccaaaggagaatatattctgcttggaggcagtgataagcaggttagtctgttcaccaaggacggcgtgaggctcgggacagtgggcgagcaaaatagctgggtgtggacgtgtcaagcgaagcctgatagtaactacgtcgttgtgggctgccaggacggcaccatctccttctaccagctgatattcagcaccgtacacggcctctacaaagacagatacgcatatcgcgacagcatgaccgacgttattgtgcagcatctaattacggagcagaaggttagaattaagtgcaaggagctggttaaaaaaatcgcaatataccggaacagactagcaattcagcttccagagaaaatccttatctatgagctgtactcggaggacctatctgacatgcactatcgcgtgaaggaaaaaattatcaaaaaatttgaatgtaatctgttggtagtgtgcgcaaaccacatcattctttgtcaggagaagcgcttacagtgcctgtccttctccggcgtcaaggagcgcgaatggcagatggaatccctcatccggtatataaaggtcattgggggacctccaggacgggaagggctgctcgtaggccttaagaatggacagattcttaaaattttcgtagataacctttttgctatcgtcctgctcaaacaggctacagccgtgcgctgcctggacatgtctgctagccgaaaaaagctggccgttgtggacgaaaatgacacatgtctggtgtatgatatcgacaccaaagaactgctgttccaagaacccaacgcaaactctgtggcttggaatactcagtgtgaagatatgctgtgtttcagcggaggcggttacctgaacatcaaagcttccaccttcccagtgcatcgacagaaattgcagggcttcgtcgtgggatataatggctcaaagatcttctgtctgcacgtgttcagcatttccgcggtcgaagttcctcaatcggcccctatgtaccaatacctggatcgcaagctcttcaaagaggcgtaccagatagcttgtcttggggtgaccgacactgactggagggagctggcgatggaggccctcgagggcctggattttgagacggctaaaaaagcgtttattagggtccaggatctgcgctacctcgaattgattagctctatcgaggaaagaaaaaagagaggggagaccaataacgatctttttctggctgatgttttcagttatcaaggaaaatttcatgaggctgccaaactgtataaacgctccggccacgagaacctggccctggaaatgtacaccgatttgtgtatgttcgaatacgccaaggacttcctggggtcgggggatccgaaggagaccaaaatgctgatcacaaagcaggccgactgggccaggaacatcaaagaacctaaggcagccgtcgaaatgtatattagcgcaggggagcacgtcaaggcaatcgaaatttgcggggaccatggctgggtggacatgctgattgatattgctcgtaagctggacaaagctgagcgtgagccgctcctcctttgtgctacttacttaaagaaactggattccccaggctacgcagccgagacttatctcaagatgggagatttaaaaagtctggttcaactgcacgttgagacacagcgttgggatgaggctttcgctctgggcgaaaaacacccagagtttaaggatgacatttacatgccatatgcacagtggcttgctgagaacgaccgctttgaggaggcccagaaggctttccacaaggctggaaggcagagggaggctgtgcaagtgctggagcagctgactaataacgccgtcgctgagtcaagattcaacgacgccgcttactactattggatgctctccatgcagtgtcttgatatcgcgcaggatccggctcaaaaggacacaatgctgggtaagttctaccactttcagagactggccgaactataccatggctaccacgcgattcaccgacatacggaggatccattctcagtgcaccggccggaaactttgttcaacatcagcagatttttgcttcacagcttgccgaaggatacacctagcgggatctccaaagtcaagatcctctttactctggccaaacaatcaaaggctcttggggcatacagactggcccggcatgcatacgataagttaaggggactttatattccggccaggttccagaagtcaatcgagctcggcaccctgaccattcgggctaaaccttttcatgattctgaggagctcgtgcctctatgttaccgctgttctaccaacaatccgcttcttaataatctcggcaatgtgtgcattaactgtcgtcagccgttcatcttctctgcatcttcttacgatgtgctacacttggtggaattctatctagaggaaggtatcaccgacgaagaagcgatttctctcattgacttagaggtgctgaggccgaagcgtgacgaccgtcagctggaaatcgcgaataactcttcacagatcttgcggctggtggaaaccaaagatagtataggggacgaggatccttttactgcaaaattaagctttgagcaaggcgggagcgagttcgtcccggtggtcgtatctaggttggttctccgcagtatgagtagacgagatgttctgataaagcgctggccgccccctttaaggtggcagtactttcgtagtttgctgcccgacgcgagcataacaatgtgtccctcttgtttccagatgtttcattctgaagactatgagctgttggtgctccagcacggctgctgcccttactgccgccggtgcaaagacgacccaggaccttag

SEQ ID NO: 121129 - DNA, 3099 bp, Artificial Sequence
  Description of Artificial Sequence: Synthetic coding sequence
atgttcaatggcattattagcattcgaaataaaaatggggaggaaaaagttaaaatcgagaggcctggaggctcactgtcacctatttggagcatctgttggaaccctagtcgcgaggagcgcaacgatattctcgccgtggctgattggggccagaaagtttcattctatcagctctctggaaagcaaattggcaaggacagggctctcaattttgatccgtgctgcatcagttacttcactaaaggggagtatattttgctgggggggtccgacaaacaggtttcactcttcactaaggacggtgtgaggctggggacagtaggggagcaaaactcctgggtgtggacctgccaggccaagcctgattcaaactatgtcgtcgtcggctgccaggacggaaccatcagtttctatcagctcatcttctccacagtacatggtctctataaagaccgctacgcctaccgcgacagcatgactgatgtgatagtccagcatctcatcactgaacagaaggtgcgtataaagtgtaaagaactggttaaaaagatcgcgatctaccggaaccgattggctattcagttgcctgagaaaattctgatctacgagctttactcagaagacctttctgacatgcattatagggtaaaagaaaagatcatcaaaaagtttgaatgcaacctgctcgtggtgtgcgcgaaccacatcatcctatgtcaagaaaagcgactgcaatgtctgtcattctcaggtgttaaggaaagggaatggcagatggagagtcttatccgatacattaaggttattggcgggccccctggtagagagggactcctagttggcctcaagaacggccaaatattgaagatatttgtcgacaacttgttcgctatcgtactgctgaagcaggccaccgccgtacggtgcctggacatgagcgctagcagaaagaagctggccgtggtcgacgagaacgacacatgccttgtgtatgacatagacaccaaagaactcctgttccaggagcctaatgccaactctgtcgcttggaacacccagtgcgaggacatgctgtgcttctctggaggcggctacctgaacatcaaagcttctactttccccgtgcaccgccagaagctgcaaggctttgtcgtaggctataatggttccaagatcttttgcctgcacgtgttctctatttctgctgtggaggttccgcaatctgcccctatgtaccaatatcttgatcgcaagctcttcaaggaggcctatcaaatcgcttgcctcggggttacagatactgattggagagagctggccatggaagccctggaggggctcgactttgagacggccaagaaagcgttcataagggtgcaggacctccgctaccttgagctgatatcatcgatcgaagagaggaagaaacgcggagagaccaacaacgacctctttctagcagacgtgttctcataccagggaaagttccatgaagctgctaagctgtataaaaggtccggccatgagaacctggccctcgagatgtacacagatctgtgtatgtttgaatatgccaaagacttccttggatcaggtgacccaaaagagacaaagatgctaattactaagcaggccgattgggccaggaatatcaaagagcccaaggctgccgtggaaatgtacataagcgccggagaacatgttaaggctatagagatctgcggtgatcacggttgggtggacatgctgattgacatcgcacgtaagttagataaggcagaacgggagcctttgcttctttgtgctacctatttgaaaaagttggatagtccagggtatgcggccgagacatatctcaaaatgggcgaccttaagagcttggtgcagctgcatgttgaaacccaacggtgggacgaagccttcgccctgggggagaagcacccggaatttaaggacgacatttacatgccctacgcccaatggctggctgagaatgacaggttcgaggaagctcagaaagctttccataaggcagggaggcagagagaggccgtccaagtgctcgaacagttaaccaataatgctgtggcagagtctagatttaacgacgccgcttactactactggatgctttctatgcagtgcttggacatcgctcaagaccctgcccagaaggatactatgctaggtaagttctatcatttccagcgccttgcggaattatatcatggataccacgcaatccaccggcacactgaggatccattctcagttcatcgtccagagaccctgttcaatatttcgaggtttctactgcattctctcccaaaggatacacctagcggtatatcaaaggttaaaatcctgttcacgcttgcaaaacaatcgaaagccctcggtgcttaccggttggcccggcatgcctacgataagctgcggggcctttatatccctgcccgatttcaaaaatctatcgaactgggaaccctgaccattcgcgctaaaccattccacgattctgaggagctcgtgcccctctgctaccggtgctccaccaacaaccccctcctcaataacctggggaatgtgtgtataaattgcagacagccattcattttctccgcaagctcttatgacgtattacatcttgtggaattttacctcgaggaagggatcaccgacgaagaggctatcagtctgattgatcttgaggtcctgcgacccaagagagatgaccgccaattagagattgctaataacagttcccagattttgcgtctggtcgaaaccaaagacagcattggtgacgaggatcccttcaccgccaaattaagctttgaacagggcggatccgaatttgtacctgtggtcgtatcccgacttgttctgaggtctatgagtaggcgggatgtcctgataaaaagatggcctcctccccttcggtggcaatactttcgcagccttctgcctgatgccagtatcacaatgtgcccatcatgtttccagatgtttcactccgaagattatgagctgttggtgttgcaacacgggtgctgtccctattgccgtcgatgtaaggatgatccgggcccgtag

SEQ ID NO: 121130 - DNA, 3252 bp, Artificial Sequence
  Description of Artificial Sequence: Synthetic coding sequence
atgcgagctgtcttaacatggcgcgacaaagcagagcactgtatcaacgacatcgcttttaaaccagatggcacacagctgattttagccgccggatcccgtctgctggtctatgacacgagcgatgggacacttctgcagccattgaaaggacataaggacaccgtgtactgtgtcgcatacgcaaaggacggactctggagccccgagcagaagtcggtgagcaaacacaagtcttcatccaaaatcatctgctgccgggaggaacgaaacgatattctggctgtcgccgactgggggcagaaagtcagcttttaccagctgtcaggaaaacagattggcaaagatcgcgccttgaatttcgatccatgctgtattagttactttaccaagggcgagtatatcttgttgggaggatcagacaagcaggtgtctttattcaccaaggatggcgtcaggctgggcaccgttggcgaacagaatagctgggtctggacttgtcaggccaagcccgatagcaattatgtcgtcgtgggatgtcaggacggtactatctccttctatcaactgatcttttcaacagtgcacggactgtacaaagatagatatgcatacagagacagtatgacggatgtgatcgtacagcatctgatcactgaacagaaagtccgcattaagtgcaaagagcttgttaagaagattgcaatatataggaaccgcttagcaatccagctgcccgagaaaatcctcatatacgagctctacagcgaggacctgagtgacatgcactacagagtgaaggaaaaaattattaagaagttcgagtgtaatctcctggttgtttgcgctaaccacatcatcctgtgtcaagaaaagaggctgcagtgcctgtctttttctggcgttaaggagagggaatggcaaatggagtccctgattcggtatatcaaggttatcggaggaccgcccggcagagagggacttttggtgggtctgaagaacggccaaattctgaagatctttgtggacaaccttttcgcaattgtgctactgaagcaggcgaccgccgtgcggtgtctggatatgagtgcatctagaaagaaactggctgtggttgatgagaatgatacctgtctggtgtatgacattgataccaaggagttgttgttccaggaaccaaatgcaaactcagtggcttggaatacacagtgtgaggatatgctctgcttctcaggagggggatatctgaatattaaggcctctacttttcctgtccatcgtcaaaaactacagggctttgtggtcgggtacaatggctcgaagatattctgtctgcacgtgttcagtatttccgccgtcgaggtgccgcagagcgcccctatgtaccaatacctggacaggaaactgttcaaggaggcctaccaaatcgcctgtcttggagtcacggatactgattggcgggagttggcaatggaggcattggagggcttagactttgagaccgcgaaaaaggcattcatccgcgtgcaggacctgagatacctggagctgatttcctcaatcgaagagcgaaagaaaagaggggagactaacaacgacctgttcttggccgacgtcttttcttaccaaggcaaatttcatgaggctgccaagctctataagcggagtggtcacgaaaatttggcattggaaatgtataccgacctctgtatgttcgagtacgccaaggatttccttgggtcaggcgacccgaaagagaccaagatgttgatcaccaaacaggcggactgggccaggaatatcaaagaacctaaggccgccgtcgaaatgtatatctccgctggggagcacgtgaaggcaattgaaatctgcggcgatcacggctgggttgatatgctgatcgatatagccagaaaactcgacaaggcagaaagagagcccctcctcctgtgcgctacctatctgaagaagcttgatagcccaggatatgccgccgaaacctacttgaaaatgggtgacctcaaatcactggtccagctacacgttgagacacagaggtgggatgaggcttttgcactgggcgagaagcatccagagtttaaagacgatatttacatgccgtacgctcaatggcttgccgagaacgatagattcgaggaggcacaaaaagccttccacaaggccggccgacagcgcgaggcagtgcaagtcctagaacaactgactaacaatgcagtggccgaatctcggttcaatgacgccgcgtactactactggatgttgtccatgcagtgcctagatatcgctcaggctgatcctgcccagaaagacaccatgctcgggaaattttaccacttccagcggctcgccgaactgtatcacggttatcacgctatccataggcacacggaagatccattcagcgtgcacaggccagaaaccctgttcaatatttcccgtttcttgctgcactcgctcccaaaggatacgccctctggaatctctaaagtgaggaagattctgtttaccctagctaagcaatcgaaagctctcggagcataccggctggcgagacacgcctacgacaaactgaggggtctctatataccggcgagatttcagaagtccattgagttgggtacactgaccatacgcgcaaagcctttccatgactctgaagagttggtgcctctatgttaccgttgctcgacgaataacccgctgctcaataatctgggtaatgtgtgcattaattgccggcagccctttattttttccgcctccagttatgatgtgcttcatctcgtggagttctacctggaggaaggcatcacagatgaagaagcaattagtctcatcgacctggaggttctgcgacccaaaagggatgacagacaattggaaatcgccaacaattcctctcaaatactgaggctggtggaaaccaaggactcaatcggggatgaggacccctttactgccaagttgagctttgagcagggggggtccgaatttgtccctgttgtggtgagcaggctggtgctgaggtccatgtcacggcgcgatgtcctgatcaaaagatggcctcccccactccgatggcagtactttaggagtttgctccctgacgcttccattactatgtgccccagctgtttccagatgtttcacagcgaagattatgagttgcttgtcttgcagcacggctgttgcccctattgcaggaggtgcaaggacgaccccggaccctag

SEQ ID NO: 121131 - DNA, 2886 bp, Artificial Sequence
  Description of Artificial Sequence: Synthetic coding sequence
atgagggcagttctaacctggcgggataaagctgagcactgcatcaacgatatcgcatttaaacccgacggcacccaattgatactggccgctggctcacggctcctagtgtacgacacctctgacggtactctactgcagccactaaagggacacaaagatactgtctattgtgtcgcatatgcaaaggatggcaagaggttcgcgtctgggagcgcagataaatctgtgattatctggactagcaagctggaaggcatcctgaagtacacccacaatgatgcaattcagtgcgtctcttacaaccctatcactcatcagttggcttcatgtagttctagtgacttcgggctttggtctccagagcagaaatcagtctctaagcataagtctagctctaaaatcatttgctgcagttggaccaacgatggccagtacctggccctggggatgtttaatggaatcatctctataagaaacaaaaacggagaggaaaaggtcaaaatcgagagaccaggtggtagcctgtctccaatttggagcatttgctggaatccatcccgagaagagcgcaacgacatattggcggttgcggactggggtcagaaggtgtccttctatcagctgtctgggaagcagattggaaaggatagggcgcttaattttgatccctgctgcatctcctactttactaagggggagtacattctcctcggcgggtccgacaagcaggtgtctctcttcacgaaagacggggtgaggctcgggaccgtcggtgagcagaatagctgggtctggacttgccaagccaaacccgattccaattacgtcgtggttggatgccaggacggcaccatttcattttaccaactgatcttctccacggtgcatgggctttataaggatcggtatgcatatcgcgattctatgaccgatgtcattgtccagcacctgatcacagagcaaaaggtccggattaaatgcaaggaactggtaaagaaaatcgctatatatcgtaatcggctcgcaatccagttgcctgagaagattctgatctacgagttatattctgaagacctcagtgacatgcactaccgtgtgaaggagaaaatcataaagaagttcgaatgtaatttgcttgttgtgtgtgcaaatcacattattctttgtcaggagaagaggctgcagtgtctgtcattcagcggcgtcaaagaacgcgagtggcagatggaatccctgatccgctacattaaagtgatcggtgggcctccagggagagagggcctactggttggactcaaaaatggccagattctcaaaattttcgtagataatcttttcgctatcgtgttgctgaaacaagcaaccgctgtcaggtgcctggatatgtcagcatctcgtaagaaactggcagtcgtcgatgagaatgacacatgtctcgtttatgacatcgacactaaggaactcttgttccaggagcccaacgctaattccgtggcatggaatacacagtgtgaggatatgctgtgcttctccggcggcggatatctgaacattaaggcgtcaacattccccgtccacaggcagaaactccagggatttgtggtaggatataacggcagtaagattttttgtctgcacgtcttcagcataagcgccgtggaagtacctcagagtgcaccaatgtatcagtacctggaccgcaaactgttcaaagaagcctatcaaatcgcatgcctcggagtgacagacaccgactggcgcgagctcgcaatggaagcccttgagggcctcgactttgagactgccaaaaaggccttcattcgggtgcaagacctgcggtacttagagctcatctctagcatcgaggagcgcaaaaagaggggcgaaacaaataacgatctgttcctggccgatgtcttctcatatcagggtaaattccatgaggcggctaagctctacaaacgatcaggccatgaaaatttagccttagaaatgtataccgacctgtgcatgtttgaatatgccaaagactttttgggcagtggggaccccaaggaaacaaagatgctcattaccaaacaggctgattgggcacggaacatcaaggagcctaaagccgcagttgaaatgtacatctccgccggggaacacgtgaaagccattgaaatctgcggcgaccacggttgggtggatatgctgatagatatagcaaggaagctcgataaagccgagagggagccactgctgctctgcgccacctatctgaaaaagctggattctcccggatatgctgctgagacctatcttaaaatgggggacctgaaatctctggttcagctccacgtggaaacccagcggtgggacgaagcattcgctctgggggagaagcatccagagttcaaagatgatatatatatgccctacgcgcagtggctggccgagaatgataggtttgaagaagcccagaaggcattccacaaagccggaaggcagcgagaagcagtgcaggtgctagaacagctgacgaacaacgccgtagcagagagccgtttcaacgatgctgcttactactattggatgctgagtatgcaatgcctggacattgcccaggaccccgcccaaaaagatactatgctgggcaaattttaccacttccaacggctggcagagctctaccatggctaccacgctatacaccgccacaccgaagatccattttctgtacacagaccagagaccctgttcaatatttcccgatttctgcttcattcgctacctaaggacactccctcaggtatcagcaaggtttgcgaaaatacactgcacttaggtcaggccgaacagggcccaagatgcctgcaggctggaccagcccgactctag

SEQ ID NO: 121132 - DNA, 3357 bp, Artificial Sequence
  Description of Artificial Sequence: Synthetic coding sequence
atgcgcgctgtgctgacttggcgtgataaagctgaacactgcatcaacgatatcgccttcaagcccgatggaacccaactgattctggccgctggctctagactgctggtttatgacacctcggacggaacactcctgcagcctctgaagggacacaaagacactgtttactgtgttgcctatgcaaaggacgtgctttgcattgagggcctgtggtccccagagcaaaagtctgttagtaagcataaatcgtcatctaaaatcatatgctgcagctggactaatgatgggcaatacctggccctgggtatgttcaatggcatcatttctatccggaacaaaaacggagaagagaaggtcaagattgagcggcctggcgggtccctctcacccatttggtcgatatgttggaatccttcccgagaagagcgcaatgatatattagccgttgcagattggggccagaaggttagcttctaccagctgtcaggaaaacagataggtaaggacagggccctgaatttcgatccttgctgcataagttactttaccaaaggagagtacatcttgctgggcgggtcagataagcaggtcagcctgttcacaaaggatggagtgcgtctggggacagtgggggagcagaattcatgggtgtggacctgccaggccaaacccgactcaaattatgtggtagtgggttgtcaggatggcaccatatccttctaccaactcatctttagtaccgttcacggtctgtacaaagatagatacgcctacagggattccatgactgatgtgattgttcaacacttgatcacagagcaaaaggtccggattaaatgcaaagaactagtgaagaagattgccatttatcggaacagactagcgatccaattgcctgagaagatactcatatacgaactgtattccgaagatctgtccgacatgcactatcgagtgaaggaaaagattatcaagaagtttgagtgcaaccttctggttgtctgtgccaaccacattatcctttgtcaggaaaagcgactccagtgtctgtctttctcgggagtcaaagagagggaatggcagatggagtctctgattcgatacattaaggtcattggggggcccccggggcgggaagggctcctggtgggattaaaaaacgggcagatactaaagatattcgtggacaatctttttgcaatcgtgttactgaaacaggcaaccgcagtgcggtgtctggatatgtccgcctctagaaagaaacttgcggtggtggatgagaatgacacatgcttggtgtacgacattgataccaaagagctgctgtttcaggaaccaaacgctaatagtgtagcatggaatactcaatgtgaagacatgctctgctttagcggagggggatatctcaatatcaaggcttctaccttccctgtccaccgtcagaagctgcagggatttgttgtcgggtacaacgggtccaaaatcttttgtttacacgttttctctatatctgctgttgaggtgccacaaagtgctcccatgtatcagtatctggatcggaaactgtttaaagaggcctatcaaattgcttgtctcggtgtgacagacaccgactggcgggagttggcaatggaagcgctggagggcctcgatttcgagactgccaagaaggaacgaaagaaaaggggcgagactaataatgacctgtttcttgccgacgtgttttcctaccaaggcaagttccatgaagccgccaagctgtataagaggagcggacatgagaatcttgcgctggagatgtacaccgacctctgtatgtttgaatacgcaaaggattttttgggatcaggagatcctaaggaaactaaaatgctcataaccaagcaggccgattgggcacggaatattaaagaacccaaagccgctgttgagatgtacatttcggccggagagcacgtgaaagctattgaaatttgtggcgatcatggctgggtagatatgttaatcgatatcgccaggaaacttgacaaggcagagcgggagcctttgttgttatgtgccacatatttgaagaaactggatagtccgggctatgctgcggaaacatacctgaagatgggcgatctcaaatcgctcgtgcagttgcacgtggaaacccagagatgggacgaggcgtttgccctgggcgaaaagcaccccgaattcaaggacgacatctatatgccttacgctcagtggctggccgagaatgataggtttgaggaggcgcaaaaggcatttcacaaagccggcaggcagcgcgaggcagtgcaggtgctagagcagctgacaaacaatgccgtggctgagagccgttttaacgatgcggcctactactactggatgctctccatgcagtgcctggacatcgcccaggcggatcccgcccaaaaagatactatgctcggaaaattctaccatttccagcgactggccgagctgtaccatggataccacgcaattcatcgccacactgaggacccgttttccgttcacagaccagaaaccctcttcaatatctctagattcctgctgcactcactcccgaaagatacacctagcggcatatcaaaggttaaaatcctgtttacgctcgcgaagcagtctaaagctcttggcgcatatcggcttgcccgtcatgcttacgataaactgagagggctctatatccccgctagatttcaaaagagcatcgaactcggtacactgactatcagagccaaaccttttcacgactcggaagagctagtgccactctgttataggtgcagcaccaataaccccctgcttaacaacctaggtaacgtgtgtataaattgtcgtcagccttttatcttttctgcaagcagctacgatgtccttcacctggtggaattctacctagaggagggaataacggatgaggaggccatttcactaattgatcttgaggttctgcgccccaaacgggacgaccgtcagctggagattgcaaataactcgtcacagatactgcgtctagtggagactaaagactcgatcggggacgaagatccatttacagctaagctctctttcgaacaagggggttcggagtttgtccccgtggtggtgtctcgcctagtactgaggtcgatgtcacgacgagatgtacttattaagcgctggccacccccactgcgttggcagtacttccggagtctccttccagatgcttccattactatgtgtccgtcgtgcttccaaatgttccactctgaagattatgaactcctcgtcctccagcacggttgttgtccttactgccgccgttgtaaggacgatcccggtccttag

SEQ ID NO: 121133 - DNA, 5250 bp, Artificial Sequence
  Description of Artificial Sequence: Synthetic coding sequence
atgcatctgaaacacctgagaactttgctgagcccccaagatggcgctgccaaagtgacctgtatggcctggagccaaaacaacgctaagtttgctgtttgtactgtggatagggtggtgctgctgtacgatgaacacggtgaaagacgcgacaagttcagcacaaaacccgcggacatgaagtacggaagaaaatcatatatggtcaaaggcatggctttttcacctgacagcactaagattgctataggacaaactgataatataatctacgtttacaaaataggcgaagattggggcgataagaaggtcatatgtaacaagtttatacagacatccgcagtgacatgtctgcagtggcctgccgaatacatcatagtgtttgggttggctgaggggaaagttcgcctcgccaacaccaaaacaaacaagtcctcaacgatatacggcacagagtcatatgtcgtctccctgacaaccaattgcagtggtaaaggtattcttagtgggcacgcggacggtacaatcgtgcggtacttttttgacgatgagggatctggggaatcacagggaaagttggtgaaccacccctgccccccctacgccctggcttgggcaactaactctatcgtagcagccggttgtgatcggaaaatcgtggcctatggcaaggagggacacatgctacagacctttgactattccagggaccctcaggagagagagttcactaccgccgtgagcagccccggcggacagtccgtagtgctgggtagttacgacaggttgcgtgtgttcaactggattccccgcagatcaatctgggaggaggccaagcccaaagagatcacgaacctttacacgatcacagccttggcttggaagcgcgacggatccaggttatgcgttgggacgctgtgcggtggggtggagcagtttgattgttgcctccggaggtctatttataaaaacaaatttgaactaacatacgtgggaccctcccaggtgatcgtgaaaaacttgagctctgggacgagggtggtcctcaagagtcattacggatatgaagtggaagaggtgaagatcctcggaaaagagagatacctcgtcgcacatacttctgaaacactgttgctgggcgatctcaatacaaatcgcctcagtgagattgcatggcagggcagtggtggcaacgaaaaatattttttcgaaaacgaaaatgtgtgtatgatatttaacgctggcgaattgacactggtggagtatggtaataatgacacactgggatcagtgcggactgaatttatgaacccccaccttatctccgtcaggattaatgaacggtgccagcggggcacagaagataacaagaagctggcctaccttatcgatatcaaaactatcgctatcgtagatctgattgggggctacaatatcggaaccgtgtcacacgaatccagagtagattggctggagctcaacgagaccgggcataaactactattcagagataggaagttacgactgcatctctacgacatagaatcttgttccaaaacgatgattttgaacttttgctcttatatgcagtgggtgcccggcagtgatgtgctggtcgcccagaaccgcaatagtctctgcgtgtggtacaatattgaggcccctgagcgtgtgaccatgtttactattaggggggacgtcatcgggctcgagcgtggaggaggcaaaaccgaggtgatggtcatggagggtgtcacaactgtggcttacacattggatgaggggctcatcgaattcgggactgctatcgatgatggaaactatattagggctaccgcttttcttgagacactcgagatgacccccgagaccgaggccatgtggaaaaccttgagcaagctggctctggaggctaggcagctccatatcgctgagaggtgtttcagtgcccttggccaggtggccaaagctagatttctgcacgagaccaacgagatagccgaccaggtgtcacgagagtatggtggggaagggaccgatttttaccaggttcgtgcccggctagccatgctggagaagaactacaagcttgccgagatgatttttttagagcagaatgcggtcgaagaggctatgggcatgtatcaagaactgcacaggtgggacgagtgcattgctgtggccgaggctaaaggtcatcctgccctggaaaaactccggcggtcttattatcagtggttaatggacacgcaacaggaggaaagagcgggcgaactccaggagagccaaggcgatggactggccgcaatcagcttatacctgaaggccggattgcctgctaaggctgcaagactggtcctaactagggaagaattgctcgccaataccgaactcgtagagcacataaccgcggccctgatcaagggcgagctgtatgaacgggcaggggacttgtttgaaaagatacataacccccaaaaggccctggaatgctacaggaaggggaacgccttcatgaaggccgtagaactggccagactggcatttcctgtcgaggtggttaagctcgaagaagcctggggggaccatctggttcagcagaaacaattagacgccgcaatcaatcattacatcgaagcacgctgttcaattaaagctattgaggcggcccttggggctagacagtggaagaaagctatctatattctggacttgcaggaccgcaacaccgccagtaaatattaccccctcgtggcacagcactacgcctccctccaggagtacgagattgccgaagaactgtatacaaagggagatcgtacgaaggacgcaatcgatatgtacacgcaagcgggcagatgggagcaggcgcacaaactcgcaatgaagtgtatgcggccggaagatgtatcagtattgtatatcacccaggcgcaggagatggagaaacaggggaagtaccgagaggcggagaggctttacgtgacagtccaggagcccgatctagccattaccatgtacaaaaaacacaaattgtatgacgatatgataaggctcgtgggcaagcatcacccagacttgttgagtgatactcatctgcatctcggcaaagaactcgaagcagaggggaggttacaggaggccgaatatcattaccttgaagcccaggagtggaaagctaccgttaacatgtatagagcatctggattgtgggaggaagcatacagggtggcaagaacccagggcggagctaacgcacacaaacacgtcgcatacctctgggcaaaaagcctgggcggcgaagcagcagtgcggctgctgaataaattgggcctcttggaggctgctgtggatcacgccgctgataattgcagtttcgagtttgcgttcgagctgtccaggctggcactgaagcataagacgcctgaggtacatttgaaatatgccatgtttctcgaggacgaaggaaagttcgaggaggctgaggctgaattcatcagagctggaaagcccaaagaagccgttttgatgtttgtacacaatcaggattgggaggctgctcaaagggtggcagaggcgcatgatccagattccgttgctgaggtccttgttggtcaggctcggggcgccctggaggaaaaagactttcagaaagccgagggtctgcttctgagggcgcagcgcccaggcttagcactcaattattacaaagaggccggtctgtggagcgacgcactcaggatctgtaaggattacgtcccctcacagctggaggctctacaggaggagtacgaacgtgaggcgacaaagaaaggggcccgcggagtggaaggctttgtggagcaagcgcggcattgggagcaagccggcgaatattcacgggccgtggattgctacttgaaggtgagagattccggaaattcagggctggccgagaagtgctggatgaaggccgcagagctctctatcaagttcctgccaccccagaggaacatggaagtcgttttggccgtcggaccccagctgataggtatcggtaagcattctgccgccgctgagctgtacctgaatctcgacctcgtgaaggaggccatagacgcctttatcgaaggcgaggagtggaataaggcaaagcgtgtagcaaaagaactggatcccagatatgaggactacgtcgaccagcactacaaggaattcctgaagaaccaaggcaaagtagatagtcttgtgggagttgatgtcattgccgcgcttgatctctacgtcgaacagggccaatgggataagtgtatcgaaacagctaccaagcaaaattataaaatcctgcataagtatgtggccctgtatgcaacacatctgattagggagggaagttcagcacaggcacttgctttgtacgtgcagcatggagctcccgctaacccacagaactttaatatctataagcgcattttcacagatatggtatcttctcccggtacaaactgcgcagaagcatatcacagctgggccgacttgcgggacgtgctgttcaacctgtgtgagaatttggttaaatcatctgaagccaatagccccgcccacgaggaattcaaaaccatgctgctgattgcacattattatgctacacgctctgctgcgcagtccgtgaagcagttagagacggtggcagccaggttaagcgtgtcactgctccggcatacacaactgttacctgtagataaggcattttatgaggccggtatcgccgccaaggccgtgggatgggacaatatggcattcatctttctgaataggttcctggacctgaccgacgcgatcgaagaaggaacactggacggccttgaccacagcgacttccaggacaccgacattcctttcgaggtccctctcccagctaagcagcacgtgccggaggcagaaagggaagaggtcagagattgggtgctgaccgtgagtatggatcaacggctggaacaagttctgcccagggacgagcgtggcgcctacgaggcttccctcgtggcagcaagcacaggagtgcgtgccctgccttgcttgattaccgggtaccctatcctccggaataagatagaatttaaacgacccgggaaggccgctaataaagacaactggaataagtttctgatggctataaagacgtctcattctcccgtatgccaggacgtcctgaagtttatctcacaatggtgcggcggattgccaagcacctcgttctctttccagtag

SEQ ID NO: 121134 - DNA, 1536 bp, Artificial Sequence
  Description of Artificial Sequence: Synthetic coding sequence
atggcctggagtcagaataacgctaagttcgcagtttgtacagtggatagggtagtgctcctctatgatgagcatggcgagcgaagagataagttttctaccaagcccgcagacatgaaatacggcaggaagagttacatggtgaagggcatggccttttcccccgactctaccaagattgcaataggccaaactgacaatattatttacgtgtataagattggagaagactggggagataaaaaagtgatttgcaataagttcattcagacttcggccgtaacatgcctgcagtggccggctgagtatatcatcgtctttggattggcagagggcaaagtaaggttagcaaacacaaagacaaacaagagtagcaccatctacgggacagaaagctacgtggtttccttaacaaccaactgtagtggcaaaggaattctctccggccacgccgacgggacaattgtccgatacttcttcgatgacgaggggtccggtgaaagccagggaaaactggtgaatcacccatgtccaccatacgcgctggcctgggccacaaattctattgtcgccgccggatgtgacaggaagatcgtcgcatacggaaaagagggccatatgctgcaaacattcgattatagcagggatccacaggaacgtgagttcaccacggccgtgtcttccccgggcggccagtccgtggtcctgggctcctatgaccgtctcagagtctttaactggattccccgcaggtccatctgggaggaggccaagcccaaagagattaccaacctctacaccatcactgctttggcgtggaagagggatggatccaggctctgcgttggcaccctgtgcgggggggtggagcagttcgactgctgtcttcggagaagcatatacaagaataagtttgaactgacctacgttggaccttctcaggttattgtcaagaacctgtcttccggcactcgcgtggtgctgaaatcacactacggttacgaggttgaggaggtgaaaatcctcggcaaggaaagatacctagtcgcacacacatctgaaacccttttactgggcgatttgaacacgaatcggcttagcgaaatcgcatggcagggtagcggcggtaatgaaaagtattttttcgaaaacgaaaatgtatgtatgattttcaacgccggcgaactgactctggttgagtacgggaacaacgatactttgggatcagtcaggacagaatttatgaacccccacctcatttccgtgcgcattaacgagaggtgccagcgtggtacagaagataataaaaaattggcctatctgattgatatcaaaaccattgcaatcgtggacctgatcggggggtacaacattggcacagtcagccatgagagtagggtcgactggctggagctgaatgaaacggggcataaactcctgttccgagatagaaaactgagggtgcggcgggctacaaaggcccttggtattgggtggcccaccgagggggtacgccaagctgcaaccagagactag

SEQ ID NO: 121135 - DNA, 369 bp, Artificial Sequence
  Description of Artificial Sequence: Synthetic coding sequence
atgacccatctactattaacagctaccgtcacacccagcgagcagaatagctcacgtgagcctggttgggaaacggctatggcaaaggacatactgggagaggccggtctgcactttgatgagctcaataaattgagagtgctggaccctgaggtaacccagcagaccatcgaattgaaagaagagtgcaaggacttcgtagacaagattggccagttccagaaaatcgtgggcggcctcattgaattggtggaccagctagcaaaagaggccgagaatgagaagatgaaagtccgaagcgcctgtttaccaccaacaagttggccaggaacactggtgcattacccgctcattcccctaccttcgtag

SEQ ID NO: 121136 - DNA, 447 bp, Artificial Sequence
  Description of Artificial Sequence: Synthetic coding sequence
atggctaaggatatattaggagaggctgggctgcacttcgatgagctcaacaagctgcgggtcttggaccccgaagtgactcagcagacaatcgaattgaaggaagaatgtaaggattttgtcgataagattggtcagttccagaaaattgttggcggcctgattgagctcgtggaccaactggctaaggaagccgagaatgaaaagatgaaatccttggccgtgagtcctcggctggaatgtactggcgcgattagtgcccactgcaagttatgcctgagcgatagcagtgactcgcctacatcccccagtcgagtcgggggcacgacaggccacaggtgttccgaactggctcagatctatagtaaggcagaacgctctagtactgccgccactagttcgcctaactcacgcaaagaaaatgctgcccgcaaggtttccgggtag

SEQ ID NO: 121137 - DNA, 399 bp, Artificial Sequence
  Description of Artificial Sequence: Synthetic coding sequence
atggcgaaggacattttgggggaggccgggttacattttgatgagctcaataagctcagggtgcttgacccggaggtaacccagcagacaattgagctaaaagaagaatgtaaagactttgtcgataagatcggccagttccagaaaatcgttggaggccttattgagctggtggaccagctcgccaaggaggctgagaatgaaaaaatgaaagcaattggtgcgcgcaatctgttaaaaagtatcgctaagcagcgtgaggctcaacagcagcagctgcaggccctcatcgctgaaaaaaaaatgcaactggagcgatatagggttgagtacgaggcattatgtaaagtggaagcagagcagaacgagttcattgaccagttcatttttcagaaatag

SEQ ID NO: 121138 - DNA, 216 bp, Artificial Sequence
  Description of Artificial Sequence: Synthetic coding sequence
gatattcttggagaggcgggcctgcacttcgacgagttgaacaagctccgtgtgctggatcctgaagtgacccagcagaccatcgagctcaaggaggaatgtaaggatttcgtggataaaatcggtcagttccagaaaatcgtcggcggacttatcgaacttgtggaccagctagctaaagaagcagaaaacgagaagatgaaggtgagtggctag

SEQ ID NO: 121139 - DNA, 345 bp, Artificial Sequence
  Description of Artificial Sequence: Synthetic coding sequence
atggccaaggacatactcggcgaagcgggtttacactttgatgaactgaataaactgagggtactggatcccgaagtgactcagcaaactattgagctcaaagaagaatgtaaggattttgttgacaaaattggtcagtttcagaaaatagtaggcgggctgatcgagctagtggatcagctggccaaagaagctgaaaatgagaagatgaaagccataggtgcgagaaatttattgaaatcaatcgccaagcagcgggaagcccaacagcagcaactgcaggcgttgatcgcagagaaaaagatgcaactcgaaagaaatgagctgaagatttctctgctgtag

SEQ ID NO: 121140 - DNA, 477 bp, Artificial Sequence
  Description of Artificial Sequence: Synthetic coding sequence
atgacccatctcttactgacagctacagttacaccatccgaacagaatagctcccgggagccaggttgggagaccgctatggccaaagacattctaggagaggcaggcctgcactttgatgaactgaataaactgagagtgctagatcctgaggtcactcagcagacaatcgaactgaaggaggaatgcaaggacttcgtggacaagattggccagtttcagaagatcgtcggaggtttgatcgaacttgtggaccagctagctaaggaggcggaaaatgagaaaatgaaggctattggagcccgcaatcttctgaagagtatcgccaagcaacgcgaagcccagcagcaacagctacaggccctcatcgccgaaaagaaaatgcagcttgaacggtacagggtcgagtacgaggccctctgcaaggtcgaagccgaacaaaacgagttcatcgaccaatttatttttcagaaatag

SEQ ID NO: 121141 - DNA, 399 bp, Artificial Sequence
  Description of Artificial Sequence: Synthetic coding sequence
atggccaaggacatacttggtgaggccggattgcactttgatgagttgaacaagcttcgggtgcttgaccctgaggtcacacagcagaccattgaacttaaggaggaatgtaaggactttgtcgataaaataggtcaatttcagaagatcgtaggaggactgatcgagctggttgaccaactcgccaaggaagctgaaaatgagaaaatgaaagccatcggggcgcggaatttgcttaaaagcatcgccaaacaaagagaggctcagcagcaacagctgcaggcacttattgccgagaagaagatgcagctagaacgctatcgagttgaatacgaggcgctctgtaaggttgaggcagaacaaaatgaattcatcgatcagtttattttccaaaagtag

SEQ ID NO: 121142 - DNA, 642 bp, Artificial Sequence
  Description of Artificial Sequence: Synthetic coding sequence
atggaagacctcttagaccttgatgaagagctgaggtatagcctcgccacaagcagggcaaagatgggcagacgtgcccaacaggaatctgcgcaggccgaaaatcaccttaacggaaagaattcctccctgaccctgactggtgaaacgtcttctgccaaactgccccgttgcagacagggagggtgggccggggattcggtaaaggcctccaatggaactcagacaggcaagcagcaactcgacctgaatgcatgctaccacaagacacatcacagggatttggggctcgcgagcctggaggaggctgacattccaataattcccgatctagaggaagtgcaggaagaggactttgtgttgcaggtcgcggcccctccttcgatccagatcaaacgcgttatgacatatcgcgatctggacaatgatcttatgaagtactctgccattcagacgctcgacggtgagattgacttaaaattgcttaccaaagtgctggctcctgaacacgaagtaagagaggacgacgtaggttgggactgggaccatctgttcacagaggtgtcgagtgaagttttgacagaatgggacccgctccagactgagaaggaagatccagcgggacaggcaagacacacttag

SEQ ID NO: 121143 - DNA, 627 bp, Artificial Sequence
  Description of Artificial Sequence: Synthetic coding sequence
atggaagacttactcgacttagatgaggaactccgctattcgctggctacatcacgagcaaaaatggggcgccgagcacaacaggagtccgcccaagccgagaaccacttaaacggcaagaatagctcccttacattaacaggagagactagcagtgcaaagctgccgcgatgtcgccagggcggttgggccggcgattctgtaaaagcctcaaagttcagaagaaaggcatcggaagagatcgaggactttcgcttgaggccccagagcctgaacggcagtgactacgggggcgatattccaattatccctgatctggaagaagtgcaggaagaggacttcgtgctacaggtggccgcaccaccttctattcagatcaaacgagtgatgacctaccgtgatttggacaatgacctcatgaagtactcagctatccagactctcgatggggaaatcgacttaaagctccttaccaaagtactggcccctgaacatgaggtgagggaggacgatgtaggatgggactgggaccacctgtttactgaggtatcctccgaggtattgaccgagtgggaccctctgcagaccgaaaaagaggatcccgctggccaggcccggcacacatag

SEQ ID NO: 121144 - DNA, 342 bp, Artificial Sequence
  Description of Artificial Sequence: Synthetic coding sequence
atggaggatctgctggacctggatgaggagctgcgctactcattggcaacttcacgggcaaaaatggggcgccgagcccagcaggaatctgctcaggcagaaaaccatctcaatggaaaaaactcatcactgacattgacaggagaaactagctctgctaagctgccacgctgccgtcaggggggctgggccggcgattccgtgaaagcttctaagtttcggagaaaggcgtctgaggagatagaagaatacgtgagttcaatcctgatcttaatggtgtcctatgtcgatctcggccagcagtgtagcctgggcggtcatgacctcttccacctgtgctag

SEQ ID NO: 121145 - DNA, 1290 bp, Artificial Sequence
  Description of Artificial Sequence: Synthetic coding sequence
atgacagccgcccttgctgtcgtcactaccagtggactggaggatggtgtgccgcgttctcgcggggagggcactggggaggtcgttctagaacgaggccctggtgcggcatatcacatgttcgtggtgatggaggacttagtcgagaagctgaagcttttgcggtatgaggaagaattcctaagaaagtcgaaccttaaggcaccttctcgccactacttcgccttgccgaccaaccccggagagcagttctacatgttttgtacacttgcagcgtggctgattaataaagctgggcgtccctttgaacagcctcaggaatatgacgatcctaatgccaccatttcgaacatcctatccgaactccgaagttttgggcgcacagccgatttcccaccaagcaagctgaagagtggttacggggagcacgtgtgctatgttctcgactgtttcgcagaagaggctctcaagtacattggtttcacctggaagaggcctatttatccagttgaggagctggaagaagaaagtgtcgctgaggacgatgccgaactgactctcaataaggtggatgaggaatttgtcgaggaagagacagataatgaagaaaatttcattgacttaaatgtcctgaaagctcaaacttatcacctggatatgaatgagactgcaaagcaagaggatatactggagtccactacggatgcagctgagtggagtctcgaggtggagcgtgtgctgccgcagcttaaggtgaccatccgcacagacaataaggactggcggatccatgtcgatcaaatgcatcagcatcggtctggcattgaaagtgcactcaaagaaaccaaggggttcttagataaattgcataatgagattacgaggaccctagagaaaatatcatctagggagaaatacataaataatcaactggagaacctggtccaggagtatagagcagcacaagcccagcttagcgaggctaaggagcgctatcagcagggcaacgggggtgtgaccgagcgtaccagactcctttctgaagtgatggaagaactcgaaaaagtcaagcaagagatggaggagaagggctcatcaatgactgacggggcccccctggtgaagataaaacagagcctcacaaaactgaaacaggagaccgtggagatggacatacggattgggatagtggaacataccctcctgcagtctaaactgaaggaaaagtccaatatgacacggaatatgcatgctacggtgattcctgagcctgccacgggcttttattag

SEQ ID NO: 121146 - DNA, 2334 bp, Artificial Sequence
  Description of Artificial Sequence: Synthetic coding sequence
atgcgtctgaagatctcactgttaaaggaaccgaagcaccaggagctggttagttgtgtcgggtggacaaccgccgaagagctgtactcttgcagtgacgatcatcagatagtgaagtggaatttgcttacttctgagaccacacagatcgtcaaactgcctgatgatatttaccccatcgacttccactggttcccaaagagtctgggcgtcaagaaacagactcaagccgaatccttcgtgctgaccagttcagacggcaaatttcacttgatcagcaaactgggtagagtcgagaagagtgttgaagcccattgcggagccgtgctagctggaaggtggaactacgaaggaactgcccttgtgactgtgggcgaagacgggcaaatcaagatatggtccaagaccggcatgctgaggtctacattagcgcaacaggggaccccagtgtatagcgtggcttggggccctgactcagagaaagttctgtataccgctggtaagcagctgatcatcaaaccactccagcccaatgccaaagtgctgcagtggaaagcgcatgacgggattatactgaaggttgactggaactccgtgaacgatctgatcctgtccgccggcgaggactgtaagtacaaggtgtgggactcttatggccggcctctgtacaactcccagcctcatgagcacccgataactagcgtggcctgggcccccgacggggagcttttcgcagtgggctccttccacacactgagattgtgcgataagaccggctggtcctacgcactggagaagccaaatactggctcgatctttaatatcgcctggagtatcgacggaacccaaatagctggagcttgcgggaatggacatgtggtgttcgctcacgtcgtagaacaacattgggaatggaagaactttcaggtgacgctgacaaagcggagggccatgcaggttcgcaacgtgctgaatgacgccgtggacctgctggagttccgcgacagggtcatcaaggccagtctgaattatgcacatttagttgtgtcaacctcactgcagtgttatgtcttctctaccaagaactggaacactccaatcatcttcgacctgaaagaagggactgtctccctgatcctgcaggccgagagacattttctgcttgttgacggcagttctatttacctatatagttatgaaggcagatttatcagctcccccaaattcccgggaatgagaacggacattctgaacgcccagactgtgtcattgtctaacgacaccatcgcaattcgggataaggctgatgagaaaattattttcctgtttgaggcttccacaggcaaaccactgggcgacggcaagtttctgtcacacaagaatgaaatcctggagatcgctttagatcagaaaggtctcacaaacgatcgaaagattgcgtttatcgacaaaaatagagacctttgcatcactagcgtgaagaggtttggaaaagaagaacaaatcattaagctcggaacaatggtgcacactctggcgtggaatgacacttgtaatatcctttgtgggctgcaggataccaggttcatcgtctggtattaccctaacactgtctacgtggaccgggatattctccccaaaaccctctatgaaagagacgcttctgaattttcaaagaacccccacatcgtgtcgttcgtgggcaatcaggttactatccgtagggctgacggtagccttgtccatatatccattacaccgtatcctgccattctccacgaatatgtctcctcatctaagtgggaagatgctgtgagattatgcagattcgtcaaagagcaaactatgtgggcatgccttgctgccatggccgtcgcaaacagggatatgacaactgctgaaatcgcttacgcggccattggtgagatagacaaagttcaatacattaactctattaaaaacctgcccagtaaagagtccaaaatggctcacatcctactctttagtggcaacatccaggaagccgagatcgttttgctccaggccggactcgtctaccaggccattcagattaacattaacctctataactgggaaagggcgttagaacttgctgtcaaatataaaacccatgtggacacagtgctggcctatcggcaaaagttcctcgaaactttcggaaagcaggagacgaataagagatatctccactacgcagaagggctgcaaattgattgggaaaaaatcaaggctaaaatcgagatggaaatcactaaggaacgtgaacagagttctagttcacagtccagcaagtcaatcggtttaaaaccatag

SEQ ID NO: 121147 - DNA, 195 bp, Artificial Sequence
  Description of Artificial Sequence: Synthetic coding sequence
atgcgcctcaaaatctcacttctgaaagagcctaaacaccaggagctggtgtcatgtgtcggatggaccactgccgaggagctgtatagctgtagtgacgatcaccagattgtgaagtggaatctcctgacctcagaaacgacccaaattgtgaagcttccagatgatatttatcccatagactttcattggtag

SEQ ID NO: 121148 - DNA, 1923 bp, Artificial Sequence
  Description of Artificial Sequence: Synthetic coding sequence
atgctgcgttccacgctcgcacagcaaggtacacccgtgtatagtgtggcctggggccccgattcagaaaaggtgttatacaccgcggggaagcagctcatcattaaaccattgcagcctaatgctaaggtcctgcaatggaaagcacatgacgggatcatcctaaaggttgactggaacagtgtcaatgacctgattctgagtgccggtgaggactgtaagtacaaggtgtgggatagttatggtaggccattatataacagccaaccgcatgagcacccaattacctctgtggcttgggctccagacggagaattattcgccgtgggcagcttccacaccctaagactgtgtgataagacgggctggtcttacgcgctcgagaagcctaacaccggttccatttttaacatcgcatggtctatagacggtacacagatcgcaggtgcctgtggaaatggtcacgtcgtttttgcccatgtggtggagcaacattgggagtggaagaatttccaggtcacccttacaaagagaagggccatgcaggtgaggaacgtgctgaatgatgcggtagatctgctcgagtttcgagatcgagtgattaaagcctccctgaattatgctcatcttgtcgtgtccacttcactccaatgctacgtgttcagtactaaaaattggaacacccccataattttcgatctgaaagaaggtacagtgtccctgatactccaggccgagaggcacttcctcctcgttgacggcagctctatctacttatactcttatgaggggcgcttcatttcctctcctaagttccctggtatgagaacagatatcctgaatgcgcaaaccgtctcacttagcaatgatactattgccatccgcgataaagctgatgaaaagatcattttcctgtttgaggcgagcacaggaaagccgttaggcgatgggaagtttcttagccacaagaacgagatcctggagattgcgctggatcagaagggcttgacgaacgaccgcaaaattgcgttcatcgacaagaacagagacctgtgtatcacgagcgtgaagaggttcggaaaggaagagcagattatcaaactaggaacaatggttcatacactcgcctggaatgacacatgcaacatcttatgtggactccaggacacaaggttcatagtttggtattacccaaacacagtttacgtggacagggacatacttcccaaaaccctgtatgaaagagacgcatctgagttttccaaaaaccctcatattgtgagttttgtcggtaaccaagtgactatcaggagggcagatggatcattagtacatatcagtattacaccttatcccgccatactccacgaatacgtctctagctccaagtgggaagatgctgtgcggctgtgcaggttcgtgaaggagcagactatgtgggcgtgtttagctgctatggctgtggccaaccgcgacatgacaacggcagagatcgcctatgcagctattggggagattgataaagtgcagtatataaattctataaagaacttgccttcaaaagagagtaagatggcccacatcctgctgttctccggaaacattcaggaagcggagatagtcttactacaagccggcctagtatatcaggctatccagatcaacattaatctatataattgggagcgagccctggaactggcggtgaagtataaaacacatgtggacacggtgctggcttaccggcagaaattccttgagacgttcgggaaacaggagacaaataaacggtatctgcattatgccgaaggccttcagatcgactgggagaagattaaagctaaaatcgaaatggagattactaaggaaagagaacagagttcatcttcgcaatcatccaagtccatcggcctgaagccctag

SEQ ID NO: 121149 - DNA, 366 bp, Artificial Sequence
  Description of Artificial Sequence: Synthetic coding sequence
atgcggttgaaaatctctctgctgaaggagcccaagcaccaggagctggtgtcatgtgtcggctggactaccgccgaagaactatattcatgctcagatgaccaccaaatcgtcaagtggaacttgcttacttccgaaaccacacagatcgtcaagcttcctgatgatatttacccaatcgatttccattggttcccaaagagcctgggagtcaaaaaacaaacgcaggccgagtcgttcgtgctgacgtcgtcagacggcaagttccatctgatatcaaaactcggtagggtggagaagtccgtagaggcacactgcggggcagtactggctgggaggtggaactacgagggtacagccctgtag

SEQ ID NO: 121150 - DNA, 1923 bp, Artificial Sequence
  Description of Artificial Sequence: Synthetic coding sequence
atgctgagatccaccctagcacagcagggaactccggtctacagcgtggcttggggcccagattccgaaaaggtactatacacggctggaaagcagctgattattaagccgctgcaacccaacgccaaagttctacaatggaaagcgcacgacggaattatcctgaaggtggattggaatagcgtaaacgatctgatcctttcagctggggaggactgcaagtataaagtgtgggactcttacggccgcccactgtataattctcaaccacacgaacacccaattacttctgtggcgtgggctcccgatggagaattattcgccgtcggcagcttccacacgctgcgactctgcgataaaaccggatggtcctacgccttggaaaaacctaacaccggtagcatctttaacattgcatggagtatcgatggaacccagattgctggggcatgcggaaacggccatgtggtctttgcccacgtggtcgaacaacactgggaatggaagaatttccaggtcaccttgaccaagaggcgggcaatgcaggtccgtaatgtgctcaacgacgcagtcgatctgctggaattccgggatcgagtgattaaggcgagcctgaactatgctcaccttgtggtatcaacttcccttcagtgctatgtcttcagcacaaaaaactggaataccccgatcatcttcgatttgaaggagggaactgtttcccttatactgcaagctgaacgccatttcctgctagtggatgggtcatctatttacttatactcatacgagggcaggttcatctccagtcccaagtttccgggaatgcgcacagacatattaaatgcacagacagtatccctgtctaacgatactatcgcaattcgcgataaggctgatgagaaaatcatattcctgtttgaagcgtcaaccggaaagcccctcggtgatggtaagttcctgagccacaagaatgagatcctggagatcgcgctggaccagaaaggcctgaccaatgaccgcaagatcgcttttattgacaagaaccgggacctgtgcatcaccagcgtgaaacgattcggcaaagaagagcagatcattaaattaggcaccatggttcatactctggcatggaatgacacctgtaacatcctgtgcggactacaggatacgcggtttatcgtatggtactacccgaacactgtgtatgtagaccgagatatcctgcccaaaactctgtacgaacgggatgcctctgaattttcgaagaatcctcacatcgtgtcttttgtcggtaatcaggtgactatccggcgcgctgatggcagtcttgtccacataagcataaccccgtaccccgccattctgcacgagtacgtgtctagttcaaagtgggaggacgcggtccggctctgtaggtttgttaaagagcagacaatgtgggcttgccttgccgcgatggcagtcgccaaccgtgacatgacgacagccgagatcgcctacgctgctattggcgaaatcgacaaagtccaatacatcaactcgatcaaaaatcttccatcaaaagagtccaagatggcgcacattcttttgttctctggcaacatccaagaggcagaaattgtactcttgcaggctggactcgtgtatcaagccatccagataaacatcaatctgtataattgggaaagagctttggagctagccgttaagtataagacacatgtggacacagttttagcctatcggcaaaaattcctcgagacttttggaaagcaggaaactaacaaaaggtatcttcactacgctgagggactgcagattgactgggagaagataaaggctaaaatcgagatggaaataacaaaagagcgagaacagtctagctcgagccagtcctccaagagcattggactgaaaccgtag

SEQ ID NO: 121151 - DNA, 540 bp, Artificial Sequence
  Description of Artificial Sequence: Synthetic coding sequence
atgcgcctcaagatcagcctgctgaaggagccaaagcatcaggagcttgtctcatgtgttggctggacaactgctgaagagctgtattcttgcagcgacgatcaccagatagtgaaatggaatctgctcaccagtgaaactacacagattgtgaagctgcccgatgacatatatcctatagatttccactggtttcccaagtcactcggcgtcaagaagcagacacaggccgagtctttcgtgctaacgagttcagatggcaaattccacctgatatccaaactaggtcgggtcgagaagtcggttgaagcccattgcggagctgtgctcgcaggccggtggaattatgagggaacagctctggtgacagtcggtgaagacggtcagattaagatctggtctaagaccggtatgctccggtctacattggctcaacaagggaccccggtttatagtgtcgcctgggggccggattccgaaaaggttctgtatacagccggtaaacagttgattattaagcctctacagcccaacgcttag

SEQ ID NO: 121152 - DNA, 1227 bp, Artificial Sequence
  Description of Artificial Sequence: Synthetic coding sequence
atggcctccgtggctagttgcgactcccggccttcaagcgacgagctccccggggacccctcatcccaggaggaggatgaagattacgacttcgaagatcgtgtttcagactccggatcttactcctccgctagctccgattacgacgatttagaaccggaatggctggacagcgtccaaaaaaacggtgaactgttttacctcgaactgtctgaggatgaggaggagagtctactgcctgagactccgaccgtgaatcacgtccgctttagcgagaacgaaatcatcatagaagacgactacaaagaacgaaagaagtacgaacctaaactaaaacagttcacaaagatactacggagaaaaaggttattaccgaaacgctgcaataaaaagaatagtaacgataatggccccgtgtcgatcctgaagcatcagtcgaaccaaaaaacaggcgtgatagtgcagcagcgctataaggacgtaaacgtgtatgtgaaccccaagaagctgacagtcattaaggctaaggagcagttgaaactgctggaggtgttggtaggcattatccaccagaccaagtggtcctggagacgaaccgggaagcagggggacggagagcggctcgtggttcacggtctgctcccaggtgggagcgcgatgaaatcaggtcaggtgctcatcggagatgtgctggtcgcagttaacgatgtggatgtgactaccgaaaatattgaaagagttttgagttgtattcccggcccaatgcaagtgaaactcacttttgaaaacgcctacgatgtaaagcgggagacaagtcatccacgccaaaagaagacgcaatccaatacatccgacctagtcaaactgttatggggcgaggaagtggagggcatacagcaatctggcctgaacaccccacacattattatgtacctgactctccagttggactctgagacttctaaggaggaacaggagattctgtatcactaccccatgtccgaggcttcccagaagttaaagagcgttcgggggattttccttacactctgcgacatgttggaaaacgttactggcacacaggtaacttctagttcattgctccttaatggcaaacagattcatgttgcatattggaaggaatctgataagcttctgttgattgggttacccgccgaggagatagagctgccatcaagcgcccacacgcatggcgaaagaaactag

SEQ ID NO: 121153 - DNA, 2829 bp, Artificial Sequence
  Description of Artificial Sequence: Synthetic coding sequence
atggcaagtgtagcttcttgcgactcccgcccctccagcgacgagttgcccggcgatccaagcagtcaagaggaggacgaagactacgactttgaggacagggtgtctgacagcggcagctattcatccgcctcctctgactacgacgatctcgagccagagtggctcgattctgttcagaaaaatggcgaactgttctatctcgaactgtctgaggatgaggaagaatccttgcttcccgagacacctaccgtgaaccatgtgaggttctccgagaatgagataattatcgaggatgactacaaggaacggaagaagtacgagccaaagttgaagcagttcaccaaaatcctgagaaggaagcggttgctgcctaaaagatgcaataagaagaactccaatgacaacgggcccgttagcatcctcaaacatcaatccaaccagaagacaggagtgatagtgcagcagcggtataaggatgtaaacgtgtatgtcaatcctaagaagctgacagttattaaagccaaggagcagcttaaacttttagaggtcctagtgggcatcatccaccagacgaaatggagttggagaagaacgggtaagcaaggcgatggagagcgtttagtcgtacatggcttgctaccaggaggaagcgccatgaagagcggccaggttctgatcggcgatgtgctggttgccgtgaatgacgtcgatgtgaccacagagaatattgagcgggtcctgtcttgcatcccagggcccatgcaggtgaagctcacctttgaaaacgcctatgacgtgaagcgggagacatcccatccaaggcagaagaaaacacagagtaatacttccgatctggtcaaattactttggggtgaagaggtggaagggattcaacagagcgggttgaataccccgcacattatcatgtatctcacgctccagctggactcggagacttcgaaagaggagcaagagatactctaccactatcccatgtccgaggcatcacagaaactaaaatcagtgcgcgggatcttcctgaccctgtgcgacatgctcgagaacgtcaccggcacccaagttacttctagcagtctcctcttaaatgggaagcagattcacgtcgcatattggaaagaaagtgataagctattgcttattgggcttcctgctgaggaagttccgctgccgaggctacgaaacatgatagagaacgtaatccagactctgaaattcatgtatggaagtctcgactctgccttctgtcaaatcgaaaatgttccaagacttgaccatttctttaacctcttttttcaaagagctctccagcctgcaaaactgcactccagcgcttcacccagcgcccaacagtacgacgcttcttctgctgtactgctggataaccttcctggcgtccgatggctgactcttcccctcgagatcaaaatggagctagatatggcactgtccgaccttgaagccgctgatttcgcagagctgtcagaagactactacgacatgcgcagattgtatacaatcctcggatctagtctcttttataagggatatctcatttgtagccatctccctaaagatgatctcatagacatcgctgtgtattgtaggcattactgtcttctgccactggctgccaagcagcgcatcggccagttgataatctggcgcgaggtgtttccacaacatcatttgcgccccctagctgactcatcgacagaagtttttcccgagccggaaggcaggtattttctgctggtcgtgggactgaagcactacatgctgtgtgtactcttagaggccggaggatgtgcgtctaaggccattggctcccccggccccgactgcgtctacgtagatcaggtgaaaactacgcttcaccaactggacggggtggatagcagaattgatgagcgcctagccagctcacccgtaccatgcctctcgtgcgccgactggtttctgactggatctagagagaaaacagatagcctaactaccagcccaatcctctcccggctccagggcacctcaaaggtcgcaacatcccccacgtgcagacgcacactcttcggcgactacagtctgaaaacacgtaaaccctctccctcctgttcttcaggtgggtccgataatggatgcgaaggcggtgaggacgacgggttctccccacatactactcccgatgcggttaggaaacagcgcgagagtcagggcagtgacggcctggaggaatcaggcactctgctcaaggtcacaaagaaaaagagcactctgcctaatcctttccacctgggcaatctaaagaaggatctgcccgagaaagaactagagatctacaatacagttaagttaactagcggacccgagaacacgctgtttcattatgtcgcactggaaacggtacaggggatcttcatcacccccactctcgaggaagtcgcccagctgtccggctcaattcacccgcaactcataaaaaactttcatcagtgttgtctgagcattcgggccgttttccagcagaccctggtcgaggagaaaaagaaaggcctgaacagcggggatcactcagattccgccaaaagcgtgagctccctgaatcccgtgaaagagcacggcgtgttgttcgaatgtagtccgggcaactggactgaccagaagaaagcacctcccgtgatggcctactgggtggttggcaggctgttcctgcacccaaagcctcaggaactatacgtctgcttccacgacagcgtgaccgagatcgctattgagattgcgtttaaacttttttttggactcactctgtag

SEQ ID NO: 121154 - DNA, 2688 bp, Artificial Sequence
  Description of Artificial Sequence: Synthetic coding sequence
atgaacaagtccgaaaaccttttgttcgccggctcttctctagcaagccaagtgcatgccgccgctgttaacggcgacaaaggggcacttcaaagactgatcgtgggaaatagcgcgctgaaggacaaagaggatcaattcgggagaacacctctgatgtactgtgtcctcgctgaccgacttgactgcgccgacgccctgctcaaggccggagccgacgtcaataagaccgatcatagccagcggaccgcactgcacttggccgcccagaagggaaactaccgtttcatgaaattgctgttgactcggcgcgcaaactggatgcagaaggacctcgaggaaatgaccccacttcatctgacaaccagacaccgttcacccaagtgtctggcgctgctgttgaagtttatggcccctggcgaggtcgatacgcaggacaaaaacaagcagactgccttgcactggtcagcatactacaataatccagaacacgttaagctccttatcaaacatgacagtaatattggaatccccgatgtagagggaaagattccattgcactgggccgcaaatcacaaggaccctagcgccgtgcatacggtgcgttgtattcttgatgctgcacccacagaatcactcctgaactggcaagattatgaaggccgaacgccactccactttgccgtggcggacggaaatgtgaccgtagtcgatgttctgaccagctacgaatcctgcaacatcacatcctacgataatctcttccgcacgcctctgcactgggctgctctcttgggacacgctcaaattgttcatctgcttctcgaacgaaacaagagcgggacgattccctcggattcccagggtgcgactcccttacactacgcagctcaaagtaactttgcagagactgtcaaagtcttccttaagcaccctagcgttaaggatgattccgaccttgagggccgcaccagtttcatgtgggccgctggcaagggttccgacgatgtcctcaggaccatgcttagcctgaagagcgacatcgatatcaatatggctgataaatatggagggaccgccctgcacgcggcagctctttccggccatgttagcaccgtaaaacttctactggagaacaatgctcaggtggatgccacagacgtgatgaagcacacacctctgttccgcgcatgcgaaatgggccacaaggatgtaatccagaccttgattaagggcggcgcaagagtcgacctggtggaccaggatggacactccctactccattgggctgcactggggggcaacgctgatgtatgccagattctcatcgagaataagattaatcccaacgtccaggattatgccggacggactcctctgcagtgcgcggcttacgggggctatattaactgtatggccgttctgatggagaataatgccgatcccaatatccaggataaggaaggccgaaccgccctgcactggagttgcaacaatggctatctggatgccattaaactgctgctggatttcgcggctttcccaaatcaaatggaaaataacgaagagagatatactcctctggattacgcccttttgggagaacgccatgaggtcatccagtttatgcttgaacacggcgcattgtccatcgccgccattcaggatattgcggcttttaagatacaggcggtctataaaggatataaggtgcgcaaggccttcagggaccgcaagaacttgctgatgaaacatgagcagctgaggaaggatgcagctgccaaaaagagggaggaggagaacaaacggaaagaagccgaacagcaaaagggccgccgtagcccagatagctgccgaccccaggccctgccatgtctaccatctacacaagatgttccatcacgacagtcccgggccccatcgaagcaacccccggcaggaaacgttgctcagggaccagagcctagagattcacgcggaagtcctgggggcagtctggggggggctctccaaaaggagcagcacgtatctagtgatttgcagggcaccaatagccgacggccgaatgaaaccgctcgcgagcacagcaaaggacagtcggcgtgtgtgcacttccgtcccaatgagggctcagatggaagccggcacccaggtgtgcccagcgtcgaaaaatctcgggagctgcgtctccagattatccagcgggagagacgtaggaaggagctattccggaagaagaataaagccgccgccgtcattcagcgggcctggcggtcatatcagctccggaagcatctgtcccatttgcggcacatgaagcagcttggggcaggagacgtagacaggtggaggcaagaatcaacagccttgctcctgcaggtctggcgtaaggagctggaactcaagtttcctcagaccaccgctgtttcgaaggctccaaagtctccttcgaagggaacgtctggcactaagtcaacaaagcacagtgtcctgaagcagatttacgggtgctcacatgagggaaagatccaccaccctacccggagtgtcaaggcaagctccgtgctgaggctgaatagcgtcagcaatctgcagtgtatacacctgctggagaacagcggaaggtccaagaatttctcttataatctccagagtgccacacagcccaaaaataaaaccaaaccctag

SEQ ID NO: 121155 - DNA, 3198 bp, Artificial Sequence
  Description of Artificial Sequence: Synthetic coding sequence
atgaataaatctgaaaatctcctgttcgccggatcctccctcgcttcacaggtgcacgccgctgctgttaacggggataagggtgcactccaaaggctcatcgttggtaattctgctctgaaggataaggaggaccagtttggtagaacccccctgatgtattgtgtgttagctgatagactggattgtgccgatgcactgctgaaagccggagcagatgtcaacaagacagaccactcacaaagaaccgctctacacctggccgctcagaaaggaaactatagattcatgaagcttctattgacgaggcgtgctaattggatgcagaaggatctagaggagatgaccccacttcacctcactacgagacacaggtctcctaaatgtcttgcactcctgctgaagtttatggccccaggggaggtcgacactcaggacaagaataaacagacagctctgcattggtctgcttactataacaacccagagcacgtgaagttactgattaaacacgactctaacattggcattcctgacgtggaggggaagatccccctgcattgggccgctaaccacaaggatccatcagccgtccacactgtacggtgtattctcgacgcggccccgacagagagtctgctgaattggcaggattatgaggggcgcacccctctgcacttcgccgttgctgacggtaacgttacagtcgtggacgttctgaccagctatgaatcctgtaacatcacgtcatacgataatttattcagaactcccctgcattgggccgcacttctggggcacgcacagatcgtacacttgctgctggaaaggaataagtctggaacaattccgagcgatagccagggagccacacccctgcattacgctgcccagtcaaatttcgccgaaactgttaaagtgttcctcaagcacccctccgttaaggacgattctgatttggagggtaggacctcctttatgtgggccgcaggaaagggtagtgacgacgtgctgcggacaatgttatctctgaaaagcgacatcgatatcaatatggctgataaatacggaggcaccgcactgcacgctgccgccctgagcggccatgtgtctaccgtgaagctgctgttggaaaataacgcacaggtcgatgccactgatgtgatgaaacacacgccactcttccgcgcctgcgagatgggtcataaggatgtgatccaaacccttattaaaggcggggccagggtcgatttggtcgaccaggatgggcactccctcctgcattgggcagctctcggcgggaatgcagatgtttgccaaattctaatcgagaataagataaaccccaatgttcaggactatgcaggaaggacccctttacaatgcgcggcctacggcggatatatcaactgtatggccgttcttatggaaaataacgctgaccctaatatccaggacaaggaagggcgaactgcgctgcattggagctgtaataacggctatttggatgctattaaactcttactggacttcgccgctttccctaaccagatggaaaataatgaggaaagatacacgccgcttgattacgccttactgggcgaaagacacgaggtgatccagttcatgctggaacacggtgccctgagcatcgccgctatacaggatatcgccgcctttaaaatccaggcagtgtacaaaggatataaggtgcggaaggcatttcgggaccgcaaaaatttactgatgaagcacgagcagctgcggaaggacgcggccgcgaaaaagagggaagaggagaataaacggaaagaggcggaacagcaaaaggggcggcgaagccctgattcttgtagaccccaagcactcccctgtctgccctcaacacaggatgtcccctctcgccaaagcagggctccatccaagcagccccccgccggaaatgttgcccagggacccgaaccacgggattcgcggggcagcccgggtggctcattggggggtgctcttcagaaagagcaacacgtgagttcggatctgcagggaacaaattcgaggcgtcctaacgagactgcccgagagcatagcaagggccagtctgcctgcgtacactttaggcctaacgaaggtagtgatggctcccggcaccccggagtgcccagcgtcgaaaaaagccgcggggagacagctggcgatgaaagatgcgccaaaggaaaaggattcgttaaacagcctagttgtatccgggtcgcaggccccgacgagaagggcgaggatagtcgtcgagctgccgctagcctgcccccgcacgattcgcactggaaaccgagccgcaggcacgataccgagccaaaggcgaaatgcgccccccaaaagagacgtacccaggagctgagagggggacgctgcagccctgcaggaagctccagacctggctccgcccgcggcgaagccgtacacgctggtcagaaccccccgcaccataggacaccccggaataaagtcacccaggccaaactcactggtggcctgtatagccacctgccgcaatctacagaggagctgagatctggtgctcggagactggagacctccaccttgtccgaagattttcaggtgtcgaaagagacagacccagctcctggtcccctgtccgggcaatcagtgaacattgatctgctacccgtggaacttagactccaaattatccagcgagaaagaagacggaaggaactctttcgcaaaaaaaataaagctgctgccgtgatccagagggcctggcgctcctatcaactgcgaaagcacctttcacacctccggcacatgaagcagttgggtgcaggagacgttgatcgttggagacaggaatccaccgctttgttacttcaggtgtggcggaaagagttggaacttaagtttcctcagactacagcagtctctaaggctccaaagtccccttctaaggggacctccgggaccaaatccaccaagcattcggtgctgaaacagatatacggatgttcgcatgaaggcaagatccatcatccaactagatcagtgaaggcaagcagcgtgctacgtctgaattccgtgtccaatctccaatgtattcacctgctcgagaacagcggcagatcgaaaaacttctcttacaaccttcaatccgccacccaacctaagaacaaaacgaagccatag

SEQ ID NO: 121156 - DNA, 306 bp, Artificial Sequence
  Description of Artificial Sequence: Synthetic coding sequence
atgaacaaatccgagaatttgctttttgccggctcctccttggcttcccaagtgcatgccgcagccgttaatggagacaagggggccctgcaaaggctgattgttggtaattctgcactgaaagataaagaagatcagttcggaaggaccccattgatgtactgcgtgcttgccgatcgcctcgactgtgccgatgcattactaaaagctggagctgacgtgaacaaaaccgatcactctcaacggacagccctgcatctcgccgcccagaaggcacttaggacgatctccactggccgtatttag

SEQ ID NO: 121157 - DNA, 2967 bp, Artificial Sequence
  Description of Artificial Sequence: Synthetic coding sequence
atgaagctgctattaacgcgccgcgcgaactggatgcaaaaggatctggaggagatgaccccccttcacttgactacccggcacagaagtcccaaatgccttgccctcctgctaaaatttatggcgcccggagaggtcgacactcaggacaagaataagcagactgccctgcactggagcgcatactacaacaatcccgagcatgtcaaactcctaataaagcatgacagcaatatcgggatccccgatgtggaaggaaagatcccattgcattgggccgcaaatcacaaggatccgtccgcagtgcacacagtgcgttgcatactggacgcagcccctaccgaaagtttgctcaactggcaggactacgagggcagaacaccgcttcacttcgccgtggctgatggcaacgtgacagtggtcgatgttcttacatcatatgagtcctgtaacattacgagttacgacaacctcttcagaacaccattgcactgggccgctcttctaggccacgcacagatcgtgcatcttctcctcgaacggaataagtcggggaccattccatcagacagccagggggccacacctttgcattacgctgcccagtcgaatttcgcagagaccgtgaaggtgttcctgaagcacccttccgtgaaagacgactctgacttggaggggcgaacctcttttatgtgggccgccggcaagggttcagacgatgtcctcaggactatgctgagcctgaagagcgatattgacattaacatggcggacaaatacgggggcaccgctcttcatgctgcagccttgtccggacacgtaagcactgtgaaattactcctggaaaataacgcacaagtggatgctactgatgtgatgaagcacactccactgttccgggcatgcgaaatgggacacaaggacgtgattcagaccctgatcaagggaggggcccgcgtggacctcgtggatcaggatggacattctctcctccattgggctgctctgggaggtaatgccgacgtgtgtcagatcttgatcgagaataagataaacccaaacgtgcaggactatgccggtcgtacacctctacagtgtgctgcctatggcggatatatcaactgcatggcagttctcatggagaacaacgctgatccgaacatccaggataaggaaggacgcaccgcactgcattggagctgtaacaacggatatcttgatgctattaaactcttgctcgacttcgccgccttcccaaaccaaatggagaacaacgaggaaaggtacacacctctagactatgcgctcttaggtgaaagacacgaggtcatacagtttatgctggagcatggcgccttgagtatagcagcgatccaagacattgcagcctttaagattcaggctgtgtacaagggttacaaggtgcggaaagcctttcgtgataggaaaaacctcctgatgaaacacgagcagctccgtaaagatgccgcagccaaaaaacgggaagaagagaacaaacgtaaagaggctgaacagcagaaaggcaggcgaagtcctgacagctgtcgcccgcaggctctcccttgtctcccgagcacacaagatgtaccatctcgtcagagtagagcccccagtaaacagccccccgcaggcaacgttgctcaaggcccagaaccgagggatagcagaggatcgcccggtgggtctttaggcggagccctacagaaggagcagcatgtgtcctcagatctgcaaggaacgaactctcgacggcccaatgagacagccagagagcactcaaaggggcagtcagcctgtgtgcacttcagacccaacgaagggtccgacggcagtcggcaccccggggtgccttcagtagaaaaatccagaggcgagacagctggggacgagcggtgtgctaagggaaaaggctttgtgaagcagcccagttgtattcgggtcgccggaccagacgagaaaggtgaagattcaaggcgcgcggccgcttctctcccacctcatgatagtcactggaaacccagcaggaggcatgatacagagcccaaggccaagtgcgctccccagaaacgccgaactcaggagctacgggggggaagatgttcacccgcaggctcatcccgtccagggagtgcccgcggagaagcagttcatgctgggcaaaatccgcctcatcatcgcacaccacggaataaagtgacccaggcaaagttaacgggggggctgtactcacatctgccccagtctaccgaagaacttcggagtggggccaggcgcctggagacaagcacccttagcgaagactttcaggtttcaaaggagacagacccggctccggggcctcttagtggacagtctgtgaacatcgacctgctgcctgtcgaattgcgacttcagatcatacagagggaaaggcggcggaaggagctgtttcgcaaaaagaataaggccgcggctgtcattcaacgggcctggagaagttatcagttacgtaaacaccttagccatctgaggcacatgaagcagctgggagcgggtgacgtcgatagatggaggcaggagtcaaccgccttgctcctgcaggtctggcgcaaagaactagagctaaagttcccacaaacaacagcagtgagtaaagctcccaaatctccaagcaagggcacaagcgggactaaatccacaaaacacagcgtgttgaagcagatttacgggtgttctcacgaaggaaaaatccaccacccgacaaggagtgtaaaggcctcatctgtcctcagactcaatagcgggaaagctgccactgctaaacagatggtgggtaaaaatatgggtaaacacttccccctcttccatcctcaaagacagaagaccttggaacagatttggcccggtttctcgaacggccaccttattagctgggattattattgttcccaacacttgagcccgtag

SEQ ID NO: 121158 - DNA, 3723 bp, Artificial Sequence
  Description of Artificial Sequence: Synthetic coding sequence
atgtccgtgaaagaaggggctcagaggaaatgggctgccttaaaagagaaactgggtccccaagattccgatccaaccgaagccaacctcgaatcagctgatcccgaactctgcatacgactgctgcagatgccctctgtagtcaactactctggcctgcgaaagcgcttagaaggatccgacgggggatggatggtgcaattcctcgaacagagcggcctcgatcttctgttagaggctcttgcgaggctgtctggcagaggcgtggccagaatcagcgacgcactcctccagctcacctgcgtctcgtgtgttagagctgtgatgaactcaagacagggcatcgaatacatactgtctaaccagggctatgtgagacaacttagtcaggcactggacacctctaatgtgatggtaaagaagcaagtgttcgaactccttgcagcactgtgtatctattcccccgagggccatgtcctgacacttgacgctctggaccattacaaaacggtgtgttcccagcagtatcggttctctatagtgatgaacgagctgagcggctcagacaatgtcccctacgtggttacactactatccgtgataaacgccgtgatcctaggcccggaagacctgcgagctcgaacgcagctcaggaacgagtttatcgggttgcagctgttagatgtcttggcacgcctgcgggacctggaagacgcagacctgctcatacagttggaggcatttgaggaagccaaggctgaggatgaagaggagctccttcgcgtaagcgggggcgttgatatgagttcccaccaggaggtgttcgccagcttgtttcataaagtatcctgcagccccgtgtctgctcaactgctctctgtgttgcaaggattgctccacctagagccaacattacgcagttcccaattgctctgggaagccctggaatccttagtaaatcgggcagtactactggccagcgatgcacaggagtgtactctagaggaagtggttgagcgattgttgagtgtgaaaggtcggccacggccctcacccctagtaaaggcgcacaagtccgtgcaagcgaatctggaccagtctcagcggggttcttcccctcagaacactaccacccccaaacctagtgttgagggccagcagcctgccgctgccgccgcatgtgagcccgtggaccatgcacaatctgaatcgatccttaaggtaagtcaaccccgcgcactcgaacagcaggcaagtacacctccaccaccccccccacctcctctgctccccggtagctctgccgaacccccccccccccccccccctcctcctctgcccagcgtgggagcaaaggcacttcctaccgcgccacccccgccacccctgccaggcctaggtgctatggcacccccggctcctcctctgcctccacctcttcccggcagttgcgagtttctgccaccgccccctccccccctccccggcctgggctgtccccccccccctcccccgcttctccccggaatgggctggggccctccacccccccctccccctctgctgccctgcacttgctcaccacctgtggcaggcggaatggaagaagtgattgtggcccaagtagatcacgggcttggttccgcctgggtgcctagccatagaagggtgaatcctcccaccctccggatgaaaaagctgaattggcagaaactgccgtcgaacgtcgcacgtgagcataattctatgtgggcatccctgtcttctccagacgctgaagcagtggagccagacttctcctctatcgagcggctttttagcttccctgctgccaaacctaaggagccaaccatggtagccccccgagctcgaaaggagcctaaagaaatcacctttcttgacgctaaaaagtcgctgaacctcaacatttttctaaagcagttcaaatgctctaatgaagaggtcgcagccatgattagagccggcgacacgactaagttcgacgtcgaagtcctgaagcagttgcttaagctgctccctgaaaaacatgagatagaaaaccttcgcgcatttaccgaagagcgcgccaaacttgcctcagctgatcatttctacctgcttcttctcgcaatcccctgctaccagttgagaatcgagtgtatgctgctatgcgagggcgctgctgccgtactggatatggtgcgacctaaggcacaactggtgttggccgcttgcgagagtttactcacttcgcggcagctgcccattttctgccagctcatcctgcggatcggcaattttttaaactacggatcccataccggggacgcagacggcttcaaaatcagcaccctcttaaagttgacagagactaagtctcaacagaaccgcgtgaccctactacatcacgtgttagaggaggctgagaagagccaccctgacctccttcaacttccccgcgacctcgaacagcccagtcaggctgccggcatcaacttagagattatccgctccgaggcctcatctaatttaaagaaactgttagagaccgagcgcaaggtgtctgcttccgtggcagaagtgcaagaacaatacacagaacggctgcaggcctctatttctgccttccgcgccctggatgagctgttcgaagcaatagagcagaaacagcgtgaattagcggactacttatgcgaggatgcacagcagttgagcttggaagacactttctcaacaatgaaggccttcagagatctctttctgcgggcactgaaggagaacaaggaccgcaaagaacaggccgcgaaggccgagcgcaggaagcagcaactcgctgaggaagaggccaggagaccacgcggtgaagacggaaagcccgttcgtaaggggccaggaaagcaagaggaagtctgcgttattgacgccttgctggctgacatacggaaaggatttcagttgaggaaaaccgctagaggccgtggggatactgatgggggatccaaagcggcatctatggatccacccagagccactgagcctgtggccactagcaatccagcaggtgaccccgtcggcagcacacgctgtcctgcatctgaacccggcttggacgcaacaacagccagcgaatcaagaggctgggacctcgtggacgccgtgacaccggggccacagccaaccctggagcagctggaagagggaggtccccgaccgctcgaacggcgctctagttggtatgttgacgcctctgacgtgctaacgaccgaggatccgcagtgcccccagcctctagagggggcatggcccgtcacgctgggcgacgcgcaggcgctcaagccacttaagttttcaagcaaccagccaccagcagcaggatcaagccgtcaggacgctaaagacccaacctctttgctgggtgttcttcaggcagaggccgatagcacaagcgaaggccttgaggatgcagtccactccagaggggcccgcccaccagccgctggcccgggcggcgatgaggatgaggacgaagaagacaccgctcctgagtctgctcttgataccagtctcgacaaaagcttctctgaagacgctgtgactgacagttcaggttctggaaccctgccaagagccaggggtcgggccagcaaaggaactgggaaaaggaggaaaaaacgaccttcaagatctcaggagggcctcaggccccgcccgaaggcgaaatag

SEQ ID NO: 121159 - DNA, 3750 bp, Artificial Sequence
  Description of Artificial Sequence: Synthetic coding sequence
atgtctgtgaaggagggcgcccaaaggaagtgggctgcgctgaaagaaaagcttggccctcaggactcggaccccaccgaggcgaatctcgaaagcgctgatccggaactttgcattcgtttactgcagatgccatccgttgtcaactattctgggctaaggaagcgccttgaggggtctgacgggggctggatggtgcaatttcttgaacagtctggcttagaccttctgctcgaggcactggcccgtctctccgggcggggtgtggccaggatcagtgatgccttattacagctcacttgtgtgtcttgtgttagagcagtgatgaactctaggcagggaatcgagtatatactgagcaaccagggctatgttagacagctgagtcaagcgctcgataccagcaacgtgatggttaaaaaacaggttttcgagctactggctgcgctctgtatctattctcctgagggacacgtgctgactctggacgctttggatcattacaagaccgtgtgcagccagcagtatcgtttctccattgtaatgaacgagctaagcggttctgacaacgtgccatatgtggtgactctactgagtgttatcaatgcagtaattcttggtcctgaggatctccgggcacggacccagctacgcaacgagtttatcggacttcagctccttgacgttttggcaaggttgcgtgatcttgaagatgcagatctgcttatacagctggaagccttcgaggaggcaaaggccgaggacgaggaggagctgctgagggtgtccgggggagttgatatgtctagtcatcaggaggtattcgcatcgttgtttcacaaagtaagctgctcccctgtttcggcccaacttctgtccgtgctgcagggcctgctgcacctggagcctacgcttagaagtagtcaacttttgtgggaggcactcgagagcctcgttaatagggcggtgcttctggcctccgacgctcaggaatgtaccctcgaggaggttgtggagaggctcctgtccgtcaaggggaggccacgtccctcgcctttagtcaaggcccacaagtctgtgcaagccaatttggatcagtcacaacgaggcagctctcctcagaataccactaccccgaaaccctctgtagagggccaacagcccgccgccgctgcagcctgcgagcctgtcgaccacgctcagagcgaaagcatccttaaggtttctcagccaagagctctcgaacagcaggcctctaccccaccaccaccccctccgcccccactgctccccggaagtagcgcagaaccgccgcctccaccccctccaccgccactgcccagtgtgggtgccaaggcacttccgactgctccgccccccccacctctccccggtctcggcgccatggcacccccagccccccctctcccccctccacttccagggtcctgtgaattcctcccacccccccctcccccactaccagggctgggatgtccaccacctcccccccctctgctgcccggtatgggctgggggcctccaccacctccaccaccattactgccctgtacctgttctcccccagttgccggtggcatggaagaggtaatagttgcccaagtggatcatggtctgggctctgcttgggtgccctctcaccgcagggtgaatcctccaacactgcgcatgaagaaacttaattggcagaaactgccatccaacgtcgcgagagaacacaatagcatgtgggcttctttgtcgtcccccgacgcggaagctgtggaaccggattttagtagtatcgagagactgttttcctttcctgcggctaagcctaaagagcccaccatggtggcaccccgagcacggaaggaaccgaaggaaatcacattcctggatgcgaaaaagagccttaatttgaacatttttctaaaacagttcaagtgctccaatgaagaagttgcagccatgatcagggctggtgatacgaccaagtttgatgttgaggtgctgaaacagctgctgaagctccttcccgaaaagcatgaaatcgagaacctgcgtgcttttacagaagagagagcgaagctagccagcgccgaccacttctacctgctgcttttagctattccatgttaccagctacgaattgagtgcatgctcctttgcgagggggcggctgccgtgcttgatatggtgcgacccaaagcccagttggtgctggctgcttgtgaatcactgttgactagcaggcaactgcctatattttgccagttaattctccggattggtaacttcttaaactacgggtcccacacaggggacgcagatgggtttaaaatcagcaccctgttgaagctgacagaaaccaaatcccagcaaaaccgagtcaccctgctccaccatgtactagaggaggccgagaagagccatccagaccttttacagttacccagagatctggaacagccttcacaagctgccggaataaatctggaaattattaggtcagaggcctccagcaatttaaaaaagctcctggagacagagagaaaagttagtgctagcgtcgccgaagtgcaagagcagtatacagaacgccttcaagcgtccatcagcgcattccgcgccttggacgaactgtttgaggcgatcgaacaaaagcagcgggaactggcagactacctgtgcgaggacgcgcagcagctgagcctggaggataccttctccactatgaaagcgtttcgggatctgtttcttcgagccctgaaggagaataaggaccgtaaagagcaagctgccaaagcagaacggagaaaacagcagctggccgaggaggaggcaagaaggcctcgcggcgaagatggaaaaccagtgcgaaaggggccaggcaagcaggaggaagtgtgtgtgattgatgctctcctggccgacatacggaaaggtttccaattgaggaagacagctagaggccggggggatactgacggcggaagtaaggctgcgtcaatggacccaccgcgtgccaccgagccagtcgctacatccaatcccgcaggtgaccccgtcggctctacacgctgtccagccagcgagcccggcctcgacgctacaaccgcctctgagtctaggggttgggatctcgttgacgcagtaacaccgggtcctcagccaaccttagagcaattggaggaaggcggaccaagacccttggaacgcagaagcagctggtatgtggatgcatccgacgttcttactacagaggaccctcagtgtcctcaacctctggagggtgcgtggccagtcacactgggggacgcccaagctttgaaaccactcaagttctcttcaaaccagccccccgcagctgggtcctctcgccaggatgccaaggaccccacttcgctgcttggggtccttcaggcggaagctgattcgacttctgagggtttagaggacgctgtccacagtagaggagcacgaccaccagcagccggtcccgggggggacgaggacgaagatgaagaggacaccgctccagagagcgccctggacaccagtctagataagtcattctctgaagatgccgtgaccgactcatcagggtctggaaccttgccaagagctagggggcgcgctagtaaagggaccggcaaacggcgaaaaaagcgcccttcacgctctcaggaggaagtgccccccgacagcgacgacaataaaacgaaaaagctttgcgtgatccagtag

SEQ ID NO: 121160 - DNA, 705 bp, Artificial Sequence
  Description of Artificial Sequence: Synthetic coding sequence
atgtcagtgaaagagggtgcccagagaaagtgggctgctctgaaagagaaactcggcccacaggattccgacccaacagaggccaatctggaaagcgccgatccagaactttgcattagactgctccagatgcccagtgtagttaactattctggattgcgcaagagacttgaaggttcagatggcgggtggatggtacagttcctggaacagagcggtctggatctgctgttggaggccctggcacgactgtctggccgaggggttgctcgcatttctgacgcactcctccagctgacttgcgtgagttgtgttcgcgcagtaatgaatagccgacaaggtatagagtatatccttagtaaccaaggatacgtgcgccagttgtcccaagctcttgatacatccaatgtgatggtcaaaaagcaagtattcgagctgctggccgcactctgcatctatagtccagaggggcatgtcctcacccttgacgccctggatcactacaagaccgtctgctctcagcagtacagattcagcattgtgatgaatgaactctctggatccgacaacgttccatacgtggtaactttgctgagtgttataaatgccgttatcttgggccccgaggatctccgggccaggacacagctgcggaacgagttcatcggtctgcaacttctcgatgtgctcgcgaggctgaggtag

SEQ ID NO: 121161 - DNA, 1758 bp, Artificial Sequence
  Description of Artificial Sequence: Synthetic coding sequence
atgtctcagcagcacaccctacctgtaaccttgagtcctgctctctcgcaggaactgttaaagaccgtaccgccacccgtgaacactcatcaggagcagatgaagcagccaactccacttccaccaccctgccagaaagttcccgtggagctgcccgtcgaggtcccttcaaagcaagaagaaaaacacatgacagcggttaaggggctaccggaacaagagtgcgaacagcaacagaaggagccccaggaacaggagttacaacagcagcactgggagcagcacgaggagtaccagaaggccgagaaccctgagcagcaactgaaacaggaaaagacgcaacgagaccagcagctgaacaagcaactcgaagaggaaaaaaaactgctagatcagcagcttgaccaggagttggtgaaacgcgacgagcagttgggtatgaaaaaggagcaactactcgagcttccagagcagcaggagggtcatttgaaacatttggaacagcaggaaggacaactgaaacatcccgaacaacaggaaggtcagctggagctcccagagcagcaagaggggcagctcgagctcccagaacagcaggaagggcagctcgaacttcctgagcagcaggagggccagctcgagctgcccgaacaacaggaagggcaactggagctgcctgaacaacaggagggccagcttgagctgccccaacagcaggaaggccagctcgagctctccgagcagcaggaagggcaactcgaactgagtgaacaacaggagggtcaactgaagcacctggagcaccaggaggggcagcttgaggtcccggaggagcaaatggggcagctgaaatatcttgaacagcaggaaggacagctcaaacatctggaccaacaggaaaaacagccggagctcccggaacaacagatggggcagctcaaacacctggagcagcaggaaggacagccgaagcatctggagcaacaagagggtcaactggaacaactcgaggagcaggaggggcagctgaaacacctcgaacagcaggaaggacagttggaacacctggaacatcaggaggggcagctggggcttccggagcagcaggtcctccagcttaagcagttggagaagcagcagggacagccaaaacacctggaagaagaggagggtcagttgaaacacctggttcagcaggaagggcaacttaagcacctggtgcaacaggaagggcagttggagcaacaggaacgccaggtggagcatctggagcagcaggtgggtcagttaaaacacttagaggagcaggaagggcagctaaagcacctcgagcaacagcagggccagttggaggtgcctgaacagcaggtcgggcagcctaaaaatctcgaacaggaggaaaaacagctggaactaccggaacagcaagaaggccaagtcaagcacctggagaagcaagaggcacagctggagctgccggagcagcaagttggtcagcctaaacacctcgagcagcaggagaaacatctggagcatcccgaacagcaagacggacagttgaagcatctagaacagcaggagggccagctgaaggacttggagcaacagaaaggacagctagagcaacccgttttcgcaccagctccaggccaggttcaggatattcaaccggccctccccaccaagggggaagtcctcctgcccgtggaacatcagcaacaaaaacaggaggtgcagtggccacccaagcacaagtag

SEQ ID NO: 121162 - DNA, 1320 bp, Artificial Sequence
  Description of Artificial Sequence: Synthetic coding sequence
atgaaaaaagaacagcttctggagctgcctgaacagcaggagggccacctgaaacacctggaacaacaggaaggacagctgaaacaccccgaacagcaagaaggacaactcgagctgcctgaacagcaggaggggcaactcgaattgcctgaacagcaggaaggacaactcgagcttcccgaacagcaggaggggcagctggaactgcctgaacagcaagaaggccagctggaactacccgaacagcaggagggacagttggagctgccccagcaacaggaggggcagctggagctctccgagcagcaggagggtcagctcgagctttcagagcagcaagagggacagctgaagcatctggaacaccaggagggtcagctagaagttccggaggaacaaatgggtcagctcaagtacttggagcagcaggaaggacagctcaaacacctcgaccagcaagagaaacaaccagaattaccagagcagcaaatgggtcagctcaaacatctggaacagcaagagggacagccaaaacacctcgagcaacaggagggccagctggaacagctggaggagcaagagggccagctgaagcatttggagcagcaggagggccagctcgaacaccttgagcaccaagagggccagctggggttgcctgaacagcaggtcctgcagctgaagcaactggagaagcagcaaggacagccaaagcatctggaggaggaggagggtcagctcaagcatctcgtgcagcaagaaggtcagctgaaacacctggttcagcaggaaggccagttggagcagcaggaacggcaagtggagcacctcgaacagcaggtgggccagctcaaacatcttgaggaacaggaaggacagctgaaacatttagagcagcagcaggggcagctggaggtgcctgaacagcaggtcggccagcctaagaatctggagcaggaggagaagcagctggagttgcctgaacagcaggaagggcaggtcaagcacctcgagaagcaggaggctcaactggaattgcctgagcagcaggtcgggcagcctaaacacctagagcagcaagaaaaacacttagaacacccggaacagcaggacgggcagctgaaacacctggaacaacaggagggacagcttaaagacctcgagcagcaaaaggggcaactcgaacagcctgttttcgccccagcccccggacaggtacaggacatccagcccgcactccctacgaagggcgaggtcctgctccccgtggagcatcagcaacagaagcaggaagtccagtggccgccgaaacacaaatag

SEQ ID NO: 121163 - DNA, 1914 bp, Artificial Sequence
  Description of Artificial Sequence: Synthetic coding sequence
atgggcttactctcccaggggagccccctctcatgggaagaaaccaaaaggcatgcggaccatgtgcggagacatgggatcctacaatttcttcacatttaccacgccgtgaaggaccggcacaaagacgtcctcaaatggggtgacgaggtggagtatatgttagtgtcctttgaccatgagaataagaaggtacgactcgtgctgtctggcgaaaaggttttagagaccctgcaagagaaaggagaaaggaccaatcctaatcatcccactttgtggaggccagaatatggcagctacatgatcgagggcactcctgggcaaccgtatggaggaactatgagtgaattcaatacagtggaggccaacatgcgaaaacgaaggaaggaagccacttcgatcctcgaagagaaccaggccctctgcaccattacttcctttccaagactaggatgcccaggtttcaccctgccggaggtgaagccaaatccagtggaagggggcgcaagcaagtccctgttctttccggacgaggccattaacaaacatccgcggttctctaccctgaccaggaacattcggcatagacgcggagagaaggtcgtcatcaacgtccctatttttaaggacaagaacactccttcccctttcattgaaactttcaccgaggacgacgaagcctcccgggccagcaagcctgatcacatttacatggatgcaatgggcttcggaatggggaattgttgtctacaggttacatttcaggcctgctctatttccgaagccagatacctatatgatcagctggccactatttgtcctattgtcatggcgctttctgcggcttctcctttttatcgaggatacgtgtccgatatcgattgcaggtggggggtgatttcagcatcagttgacgaccgaacaagagaggagagaggtttggagccgctgaagaacaacaattaccgcattagcaaaagtcgatacgactccattgattcttatctgtccaaatgcggagagaagtacaacgatattgaccttacgatagataaggagatctacgaacagttacttcaagaggggattgaccatctgctcgcccaacatgtagcccatctgtttattagagaccccctaacattgtttgaagagaagatccatctcgacgacgccaacgagtccgatcatttcgaaaacatccaaagcaccaattggcagacaatgagatttaagccccccccacccaacagcgatattggttggcgtgtggaatttcgcccaatggaggtgcaacttacagattttgaaaacagcgcatacgtcgtctttgtggtgttgctcacccgcgtgatcctgtcctataaacttgactttttaatcccattatcgaaggtggatgagaatatgaaggtggcccagaagcgggacgccgttctacagggtatgttttatttcaggaaagatatctgtaagggcggtaacgccgttgtcgacgggtgcggtaaggctcagaacagtacagaactggccgccgaggagtacactctaatgagcatcgataccatcatcaacggaaaggaaggggtgttcccaggcctgattccaatactcaactcctatctcgagaatatggaagtggatgtggacactagatgttcaatcctgaactatctgaagctaatcaaaaagcgcgcttcaggagaactgatgacagttgcccggtggatgagggagtttattgccaatcacccagactacaaacaagactccgtcattactgacgagatgaactatagcttgatcctgaaatgcaaccagatcgcaaacgaactttgtgagtgcccagaactacttggttccgcttttcgaaaagtgaagtactcgggttctaaaactgatagtagcaactag

SEQ ID NO: 121164 - DNA, 870 bp, Artificial Sequence
  Description of Artificial Sequence: Synthetic coding sequence
atgtattttctgacaccgatcctggtggctatcctctgtattctcgtggtctggatctttaaaaacgccgatagatccatggagaagaagaaaggagaacctaggaccagggccgaagcccggccatgggtggacgaagatctgaaagatagctccgatctgcaccaggccgaggaggatgcggacgaatggcaggagtctgaggagaacgtggaacacatcccgttttcgcacaatcattaccctgagaaagagatggtaaagcgctcccaagagttttacgaattgctcaacaagagacgatccgtccgattcatttcaaacgagcaggtcccaatggaagttatcgacaacgttatccgtacagctggaacagcccccagcggcgcgcataccgagccatggaccttcgtcgtagtcaaagaccctgacgtgaaacataagattaggaaaattattgaggaggaagaggagatcaattacatgaagcgcatgggccatagatgggtaaccgatttgaaaaaattgcgtaccaattggattaaggagtatttagataccgcgccaattctgatactcatcttcaagcaagtgcacggcttcgctgcgaatgggaagaagaaggttcattattataatgagatctcagtgtctatcgcctgtggtattctgttggccgcactgcagaatgccgggttagtcactgttaccacaactccacttaactgtgggccccggctgagggtgctgttggggagaccagcacacgaaaaattgctcatgctcctccccgtgggttatccgtccaaggaggccacggtgccagatcttaaaagaaagcccttggaccagatcatggtgactgtgtag

SEQ ID NO: 121165 - DNA, 813 bp, Artificial Sequence
  Description of Artificial Sequence: Synthetic coding sequence
atgtactttctgacacctattctcgtggccatcttgtgcattcttgtcgtttggatcttcaagaatgcagaccgaagtatggagaagaaaaaaggagagccaagaactagggcggaggcccgcccttgggtggacgaagacttgaaggactcctctgacctccatcaggccgaggaggatgcagacgagtggcaggagtcagaagagaacgtcgaacatattcccttcagccataaccactacccagagaaggagatggtgaaacgatctcaggaattttatgaactgctgaacaaaaggaggtccgtgcgatttatttctaacgagcaggtccctatggaagtaatcgataatgtgattaggactgccgggaccgccccctctggcgcgcacactgagccctggacgtttgtcgtggtgaaggatcctgacgtgaagcacaagatccgcaagatcattgaggaggaggaggagatcaactacatgaagcggatgggccaccggtgggtgaccgatctgaaaaagctgcgtaccaactggattaaagagtatctggacaccgcacctatactgatcttgatcttcaaacaggtccacggcttcgcggcaaacggaaagaaaaaagtccactattataacgagatcagcgtgtccatcgcttgtgggatcttactggcagccctacaagttaacaatgggatcactatgagacaccagactgcccgacataggcaccttatagaagggcccggcagatcatctgaagcctgttcaaagctgagctcgcagggttgccccgggttttattgttag

SEQ ID NO: 121166 - DNA, 744 bp, Artificial Sequence
  Description of Artificial Sequence: Synthetic coding sequence
atgtattttcttactcctatcctggtggctatcttatgcatattagtggtgtggatctttaagaatgcagaccggtctatggaaaaaaagaagggggaaccacgtaccagggcggaggcccgcccttgggtagacgaagatcttaaggatagctctgacctgcaccaagcggaagaggatgctgatgagtggcaggagagcgaagaaaatgtggagcacattcctttcagtcataatcactaccccgagaaggaaatggtgaagcggtcacaggaattctatgaactcctgaacaaacgccggagcgttcgtttcattagtaacgagcaggttcctatggaagtcatcgacaatgtgataagaacagccgggaccgccccctccggcgctcacaccgagccatggacattcgtggtcgttaaggaccctgatgtgaaacacaaaattcgtaaaatcatagaggaagaggaggagatcaattatatgaagaggatgggtcacagatgggtgacagacttaaagaagcttcgaacgaattggatcaaagaatacctcgacaccgcccccattctaatcctaatcttcaagcaggtgcacggcttcgcagccaatggcaagaagaaggtccactactataacgagataagcgtgagcattgcttgtgggattctgctggctgccttgcaggtgtttgggaaaatcatcctcaaggagctggcactgattagctttctgaacctgtag

SEQ ID NO: 121167 - DNA, 855 bp, Artificial Sequence
  Description of Artificial Sequence: Synthetic coding sequence
atgtactttctaactcctatccttgtggcgatactgtgcatactcgttgtgtggatatttaagaacgcggatagaagtatggagaaaaaaaaaggagagccccgtacccgtgccgaggcccggccatgggttgacgaagatttgaaagacagtagcgacctgcaccaagctgaggaggacgccgatgaatggcaggaatctgaggaaaacgttgagcatatccccttttcacacaatcactacccagaaaaggagatggtgaaaaggagccaagaattctatgagctgctaaacaagcggcgctcggtcagatttataagtaacgagcaggtgccaatggaggtgattgacaacgttatcaggacagctgggaccgctccatcaggggcccatacggaaccttggacattcgtggtcgtcaaggatcccgatgtgaagcataagattcggaagattatagaggaggaagaggagatcaactacatgaaacgcatgggccaccgctgggtgacagacctgaagaaactccggaccaactggatcaaagaatacctcgacacagcccccatccttatcctgatctttaagcaggtgcacgggttcgcagctaacggaaaaaaaaaagttcattactacaacgaaatcagcgtctctatcgcttgcggcatcctgctggccgccttgcaagtgaacaacgggatcacgatgcgccatcagaccgccaggcaccgacatctcattgagggcccgggacggagctccgaggcttgctccaagctgtcatcacagggatgtcctggggcaagcgctgctgggagtctgttccattttgcaatcgaatttgctgccccttag

SEQ ID NO: 121168 - DNA, 2850 bp, Artificial Sequence
  Description of Artificial Sequence: Synthetic coding sequence
atggaacccccgggccgcagctcaaggtcaaccgcaagccacacgctgcaccaatattgttgtccaacccaggtgctcgactctatgaaattaaccccttcagggcgactcgctgagtcttctgtggagggcgatgcgcccggttccgacttaagcaccgcggtcgactcaccaggtagccaaccaccgtaccggctgtctcaactcccgccaagcagctctcacatgggagggcctcctgccggagtcggactgccttgggctcagagagcccgcctccagccggcatcagtggcattaagaaagcaggaggaagaggagattaagagatcaaaggcactgtcagactcttatgagctttcaaccgacctgcaggataaaaaggttgaaatgctggagcggaaatacggtggaagcttcttaagcaggcgagcagcacgaacaatccagacagcatttcggcagtataggatgaataaaaactttgagagattacgatcctctgctagtgagtccagaatgtctcgccgcattattctgtcaaacatgagaatgcaattttcgttcgaagagtacgaaaaagcacagaatccggcttattttgagggaaaaccagctagcctggacgagggcgccatggccggggcacgctctcaccggctagagcgcgggctcccatatggtgggtcttgtggcgggggaattgacggtggtggttcttctgtgactaccagcggagagttttctaatgatattaccgagctggaagacagtttctctaagcaagttaagtcactcgctgaatcaatcgatgaagccctcaactgtcacccttcaggtccaatgtccgaggagccagggagcgctcagctggaaaagagggagtcaaaggaacagcaggaggactcgtcagctacttcattttccgatctgcccctgtatctcgacgatacggtgcctcaacagagccccgaacgcctgccgagcacggagcctcctccacaggggaggcccgagttttgggccccggccccattgcctcccgtgccaccacctgtaccatccggcacacgagaggatgggagccgcgaagaaggcaccagacgaggacccggttgtctggagtgtcgtgatttcagactccgcgcagcacacctaccattgttaaccatagagcccccatcagacagttctgtagatctgagcgaccgatctgatcgcggtagcgtgcatcgccagctggtgtatgaagccgacggttgctcaccacatggcaccctgaaacacaaagggccccctgggagggcgccaatcccacatcgtcattatcccgcgccagagggtcctgcaccagcccccccaggtcccctaccaccagcccctaacagcggaaccggcccgagcggggttgccggtggtagacgccttggaaaatgtgaagccgcaggagagaacagcgatgggggagacaacgaatctctggagtcgtcctccaactctaacgagactatcaattgtagttctggcagtagtagtagagactctctacgagagcctcccgccactggcctgtgcaagcaaacttaccagagggagactcgacactcctgggacagccctgctttcaacaatgatgtggtccaaaggagacattaccggattgggttaaacctgttcaataagaaacccgagaagggcattcagtacctgattgaacgcggctttttaagcgacacgcccgtgggggtggcacactttatcctcgagaggaagggactttccaggcagatgattggcgagtttctggggaataggcagaagcagttcaatcgcgatgtattggattgtgtcgtcgacgagatggatttctcctctatggatttggacgatgctctcagaaaatttcagtcacatatacgagtgcagggggaggcacaaaaggtggagcgcttaatcgaggcctttagccaaaggtattgcgtctgtaatcccgcacttgtaaggcagtttcgcaatccagatacaatttttattttggccttcgctatcatcctactgaacacagacatgtactcgccgagtgtaaaagctgaaaggaagatgaagcttgatgattttattaagaacttgcggggtgtggacaatggggaggatatacctcgggacctgctcgtgggaatttatcaaagaattcaaggacgagagctgagaacgaacgacgaccacgtctctcaggtccaggctgtggaaagaatgatcgtcggtaaaaaacccgttctgtccctgcctcatcgacgtctggtatgttgctgtcagctgtacgaggtgcctgacccgaaccgaccacaacggctggggctccaccaaagggaggtttttctgtttaacgacttactggttgtcactaaaatcttccaaaaaaaaaaaatccttgttacatactcgtttaggcaaagttttcctctggttgaaatgcacatgcagctgtttcagaactcctattaccagttcgggatcaaactgctgtcggccgttccagggggagagcggaaagtcctcattatctttaatgcgccttcactccaggataggctgaggttcacttccgacctgcgcgagtcaatcgcagaggtacaagagatggagaagtaccgagtcgaatctgaactagagaagcagaaggggatgatgaggcctaacgcgtcccagccaggtggggccaaggactctgtgaacgggaccatggccagatcatccctagaagatacctatggagccggtgacggccttaaacggggggcactgtcttctagcctgcgggacttatcggatgcaggcgtatgctactag

SEQ ID NO: 121169 - DNA, 4437 bp, Artificial Sequence
  Description of Artificial Sequence: Synthetic coding sequence
atggaagcggggtcagggccaccaggcggtcccggctccgaatcccccaatcgggcagttgagtacttactggagctgaacaacattattgagtctcagcagcagctcctagaaacccaaaggcggcgcattgaagagctggaaggccagctggaccagttgacacaggagaatagggacctgcgcgaagagtctcaactccatcggggggaacttcaccgtgatccccacggagcccgagactcccctggaagagaatctcaataccaaaacctgcgcgagacacaattccatcatcgcgagttgcgggaatcccagttccaccaggccgcccgagacgttggttaccctaatagggagggagcctatcaaaatcgtgaagcagtgtatcgcgataaggaacgggacgcatcctacccgcttcaggacacaacaggttacacagctagggagagggacgtcgcccagtgccacctgcaccacgagaatcctgctctagggcgggaacgcggcgggagagaagccggcccagcccacccagggcgggaaaaggaagctggatattcggcggcagtaggtgtaggacctcgccctccgcgagaaaggggacagttgagccgcggagcttcccgtagttcttctccgggagcaggtggcggccattcaacctccacctccacatccccagctactactctgcagcgtaacgtagagggtgacgcacccggctcagacttatctaccgcagtggactcccctggctctcagccaccgtaccgactttcgcagctgcccccgtcttcttcacatatgggcggcccgcccgctggggtgggactcccttgggcccagagagccagactgcagccggcatccgtcgcactgcgaaagcaggaggaggaagaaataaagcgcagtaaggcattgtccgacagttacgagttatccacggaccttcaggacaaaaaagtcgaaatgttggagaggaagtacggaggaagctttctgagtaggcgggctgctaggacaattcagaccgcttttcggcaatatagaatgaataagaacttcgaacgtctcaggagcagtgcgtccgaaagtaggatgtcgcgcagaatcatattgagcaacatgagaatgcaattttcctttgaggaatacgagaaagcccagaaccctgcatattttgaaggcaagccagcctccctggacgaaggggcaatggctggggcacgcagccaccgactcgagcgtggactcccttatggcggctcttgtggcggcgggattgatggcggcggtagctctgttactacttccggagaattcagtaacgacataaccgagctggaagactcctttagtaagcaggtgaagtcactggctgaaagcatagatgaggcactgaattgccacccgagcggaccgatgtctgaggagcctggctccgctcagcttgaaaaaagagagtcaaaagagcaacaagaggatagttccgccacaagcttttccgatctgccgttgtacctcgatgatacagtgccgcagcagagcccggagagacttccctctactgaaccgccgccccagggacgcccagaattctgggcccctgcccctctcccacctgttcctccacctgtgccttctggcactagggaggatgggtctcgggaggagggaacccgccgcggacccggctgtctagagtgccgggactttaggttgcgagccgcccacttgcccctattgacaatcgagcctccaagtgattcatccgtggatttgtccgatcgtagtgatagaggcagcgtacatcgacagcttgtctatgaggccgatggttgtagtcctcacggcactcttaagcacaaagggccacctgggcgggccccgatacctcaccgtcactaccctgcccctgaaggccccgctcccgctccaccgggaccactgccaccagcaccaaatagcgggactggcccctcgggggttgcgggaggaaggcggctgggaaagtgcgaggcagccggtgaaaatagtgatggcggggataatgagtcactggagtcctcttctaacagcaatgaaaccattaattgtagcagtggctcctcctccagagattctctgcgggagcctcccgcaacaggcctctgcaagcagacataccagagagagacgcgacactcctgggattctccggcctttaacaacgacgtcgtacagagaaggcactatcgcattggccttaacctgttcaataagaaacctgagaaaggtatacaatatctgattgagcggggcttcctgagtgatacaccggtgggtgtggcacacttcatcctagaaagaaagggcctatctcgacagatgatcggagaatttcttggcaaccggcagaagcagttcaaccgggacgtgctagattgcgtggtggatgagatggacttcagtagcatggacttggacgatgctctgaggaaattccagagccatattagggttcagggcgaggcccagaaggttgaacgactcatagaggcctttagtcagcgatactgcgtttgcaacccagctctagtgagacagtttagaaaccccgatacaatctttatccttgcttttgccattatcctccttaacacggatatgtattcacccagcgtaaaggcagagagaaaaatgaagctggacgattttatcaagaatctgcgcggagtggacaacggggaggatataccgagggaccttctcgtggggatttaccagcgaatccaagggagagagttgaggaccaatgacgatcacgtaagccaggtgcaagctgtagagagaatgattgtgggcaagaagccagtcctgagcctgccacatcgaaggctggtatgctgctgccagctgtatgaggtcccagatccaaatcggccacaaaggcttgggcttcaccagcgtgaggtttttctgtttaatgatttgctggtggtcaccaagatctttcaaaaaaagaaaattcttgttacttactccttccggcagagttttcccctggtggaaatgcacatgcaactctttcagaattcctattaccaattcggaattaaactgttatctgccgtgcccggcggagagcgaaaggtattgattatttttaacgctccttccctccaggacaggttacggtttactagcgatttgcgagagtcaatcgcagaggtacaggaaatggagaaatatagggtcgaaagtgagctggaaaagcagaaggggatgatgcgcccaaacgcatcccagccagggggcgctaaggactctgtgaatggaactatggcgaggtcttctttagaagacacgtatggagcgggggacggactcaaacggggagctcttagttctagtctcagggatctctcagatgcagggaagaggggtcgccgtaactccgtggggtctttggattccactatagagggcagcgtaatcagcagcccacgaccacaccaaagaatgccaccccctcctccaccaccccctccggaagaatataagagtcaacgccctgtaagcaatagctcttcattccttggttccctgttcggatcaaaacgagggaagggccccttccaaatgccccctcccccgacaggtcaggccagtgcaagctcgtcttccgcgtcctcaacccaccaccaccaccatcatcaccatcatggacattctcacggcggactgggggtgctgcccgacggacagagcaaactgcaagcactacacgcccaatactgtcagggccccggtcctgccccgcccccttacttgcctccacaacagcctagcctgcctcctccaccacagcaaccaccgcccttgccgcaacttggaagtatccccccaccacctgcctcagcacctcccgtcgggccacatcgacactttcacgcccatgggcccgttcctgggccacaacactacacccttggaaggccaggccgagctcctcggaggggggctggaggccacccccagttcgcaccccatggtcgccaccccctccaccagccaacgtccccacttcctctctacagtcctgctccacaacatcccccggcccacaagcagggacctaagcactttattttttcgcatcacccccagatgatgcccgccgccggggcggcgggaggcccgggatctcgacccccaggagggagctattcccaccctcaccacccccagagcccgctcagtccacattctccaatcccgccccatccctcctaccccccgctgcctcctcctagccctcatacgccccactcgcctctgcctcctacaagtcctcacgggccattgcacgcttcaggtcctccaggcaccgcgaatcccccgtctgccaaccccaaggcaaagccatcaaggatctccaccgttgtgtag

SEQ ID NO: 121170 - DNA, 4467 bp, Artificial Sequence
  Description of Artificial Sequence: Synthetic coding sequence
atggaggctggcagcgggcctcccggcggccccggtagcgagtctcctaatcgcgccgttgagtacttgctcgagcttaataacattatagagtcccaacagcagctgttagaaacgcagcggcgaagaatcgaagagttggaaggacagcttgatcagctaactcaggagaaccgggacctgcgcgaagagtcacaacttcaccgcggcgagctgcatagggaccctcacggagcccgagacagtcctggaagagaaagtcagtaccagaatttgagagagacgcagtttcaccaccgggaacttcgggaaagtcagttccaccaggcagccagggacgtgggttacccaaatagggaaggcgcatatcaaaaccgggaggcagtctacagggacaaagagagagatgcaagttaccctctgcaggacactacaggctacacagcccgggaacgggacgtggcccagtgtcatctgcatcacgagaatccagctctggggcgcgagagaggcgggcgtgaagctggaccagcacaccctggccgggagaaggaggcagggtacagcgcggccgtgggagtgggcccgagaccgccccgagagcgcggtcagttgtcaaggggggcatcgcgcagctctagcccaggggctgggggtggtcactctacctcgacctccactagcccagctacaactctacagcggaaaagcgatggcgagaattcaaggaccgtcagcgtcgagggtgatgcgcctgggtcagatttgagtacagctgtcgactcgccggggtcccaacctccctatcgtctgtcccaactcccaccatcttccagtcacatgggcggacctccagccggtgtaggcctcccctgggctcagagagcccggctgcagccggctagcgtagctctgaggaagcaagaggaagaggaaattaaaagatccaaggctctcagcgatagctatgaactgagtaccgatctccaggacaaaaaagttgaaatgctggaaagaaagtatggagggagttttctgagcaggagagccgcaagaactatccaaacggcattccggcagtatcggatgaataagaattttgagagattgagaagtagcgcatctgaaagtaggatgtcaaggagaattatcctctctaacatgcgtatgcagttctcttttgaggagtacgagaaagcgcaaaatccggcatacttcgaaggaaagcctgccagcctagacgagggtgccatggcaggggcacgttcccacaggttggaacggggactcccgtatggcggcagctgtggaggcgggatcgatggtggcggctctagcgtcaccaccagtggagaatttagtaacgatattaccgaattggaagatagcttctctaagcaggtcaagtccctggccgagtcaattgacgaggctcttaactgtcaccccagcggacctatgagcgaagagcccggttcagcgcaactagaaaagagagaatccaaagagcagcaagaagactcttctgctacctctttctcagatttacccctatatcttgatgataccgtccctcaacagagcccagagcgcttgccttctaccgagcctccacctcagggaagaccagagttttgggcccccgcaccattaccacctgtgcctccacccgtgccgtctggcacccgagaagacggcagccgggaggagggcacccgcaggggacccgggtgcttagagtgcagagacttcagactgcgagctgctcacctgcctcttctgactattgagcctccaagcgacagttccgtcgacctgtccgatcgatccgatagaggcagtgtgcacaggcagctagtttacgaggcagacgggtgcagccctcacggcaccttaaaacacaaggggcccccggggagagctcctatcccacacagacactaccccgccccagaaggacctgctcccgctcctcctggcccactcccacccgccccaaactcaggcaccggcccatccggagtcgccgggggcaggcggttagggaagtgcgaggcagccggcgagaacagcgacggtggggataacgaatccctggagagctcctcaaattctaacgaaaccattaattgttccagtggctctagctcccgtgattccttgagggagccacctgcaaccgggctatgtaaacagacttatcagagagagacgcgtcacagctgggattcccccgcattcaataatgacgtggtgcaaagaagacactatcgtatcgggctgaacctgttcaacaaaaagccagagaagggaatccaatacctgatagagaggggctttttatcggatacccctgtcggtgtggcacatttcatccttgagagaaaaggcctgtcacggcaaatgattggcgaattcctcggtaacagacagaagcagttcaacagagacgtgctggattgcgtcgtggatgagatggacttttcaagcatggacttagacgacgctcttagaaaattccagtcccacatccgcgttcagggggaagctcagaaagtggagagactgatcgaggctttttcccaacgatattgcgtttgcaaccccgctctggtgaggcagttccggaatcccgataccatttttatccttgcatttgccattattttactgaacactgatatgtatagcccctcagttaaggcagagcggaagatgaagctggacgactttatcaagaacctgaggggtgtcgataacggcgaggatatcccacgggatctactcgtgggcatctatcaacggatacagggccgggagctgagaactaatgacgaccatgtgagccaagtgcaggccgtagagcgaatgatcgtcggaaagaagcctgtcctgagcttgccgcatcggcggctggtttgctgctgtcagctctacgaagtgccagatcccaataggccacagaggctgggactgcaccagcgtgaggtcttcttgttcaacgaccttctggtggtcacgaagattttccagaagaagaagatcctggtaacctattctttcaggcagtcattccccctggttgagatgcacatgcagctctttcaaaactcctactaccagtttggaatcaagctcctgagtgccgtgcctggaggtgagcggaaggttttgataatcttcaatgctcctagcctccaggaccggctgcgattcacaagtgatctccgggagagtatcgccgaagtccaggagatggaaaagtacagggtcgaatcagaactagaaaaacagaaagggatgatgcggccaaatgctagtcaaccgggaggcgctaaggatagtgtgaatggaactatggccagatcgtctctggaggatacctatggtgcaggtgatggtctgaagcggggcgctctcagctcttcactcagggatttgagcgacgccggtaaacgaggcagacggaactctgtggggtctctagatagcactatcgaaggctctgtcatcagctcgccccggcctcaccaaagaatgccgcctcccccacctcctccacctccagaagagtacaagagtcagagacctgtgtccaactccagctcttttctgggcagcctctttggctctaagaggggtaagggacccttccagatgccacctccacccaccggtcaggcatcagcatcttcaagtagcgccagttccactcaccatcatcatcaccatcatcatcacgggcattctcatggcggcctaggcgtgctgccggatgggcagagcaagctccaagcattgcatgcccagtactgtcagggacctggacccgccccacccccgtacctgcccccacaacaacccagtctgccccctccccctcaacagccacccccgctgccacagctgggctcaatccctccaccacccgccagtgctcctccggtcggtccccaccggcattttcatgcacacggtccagtgccggggccacagcactacaccctcgggaggccagggagggcacctcgccggggggcaggcgggcacccccagtttgctccccatggccgacatccactgcaccagccaactagtccactgcccctatactctcctgcgccacaacaccccccggctcacaagcagggacctaagcactttatctttagtcatcaccctcagatgatgccagccgcaggtgcagctggggggcccggtagcagaccacccggaggcagctattcccaccctcaccaccctcagtccccactaagtccccattcgcctatccctccacatcccagctatcctcccttgccccccccttccccccacacgccccactcccctctgcctcctacatcaccacacggacctctccatgcctccggaccgccggggacagcaaatcctccaagtgccaatcccaaagcaaagccttctcgaatttcaactgtcgtttag

SEQ ID NO: 121171 - DNA, 3549 bp, Artificial Sequence
  Description of Artificial Sequence: Synthetic coding sequence
atggaaagtctgcttgaaaatccagttagggctgtgctgtacttgaaggaactgaccgcaattgtccagaatcaacagtccctcatccacacacagcgggagcgcatagacgaactagaacggagactggacgagttgagcgcagaaaacagatctctctgggagcaccaacaactgctgcaagcgcagccaccgcccggacttgtcccgccttcttcggccccactgcccgcggctccggccacagcccccgctgcagcggcacgcgcccaggaaccgctgcaggatcaagggcagagatccgcagccgccccccaccccgctcccgatcgaccacccaggcagcatcacggacagctgcttgagcagccacagagaggcccagggagccgggcccatactccacaatcccctcacaaacatttgggcacacagggggccgtgaccgataaggagaaggagagaccccccagctgctgtgctgcagcgggagcacttctccaacataaaagcccatccgccttgggaaagggagtgttgtctagaagaccagagaacgagacagtgttacatcagttctgttgtccagccgccgatgcttgcagcgacctggcatcacagtcggacgggtcgtgtacccaagcgggggggggtatggaggattcggtggttgctgcagctgcggtggccgccggaagaccttccgctcacgctcctaaagcccaggcccaagaactgcaagaagaagaagaaaggcctggcgccggggctgccagtccacgggccggcccacagcataaggccagccctggacgccagcaacctgccttggctaccgcgctgtgcccacacgccccagccgcttctgactacgaattgtcactggatcttaaaaataagcaaatagagatgctggaacataagtatggagggcacctggtcagccgcagagctgcgtgcactatccaaacagcattccgccaatatcagctgagcaagaacttcgagaagatccgcaacagcttattggagagtcggttacccagacgcatctctctgagaaaggtgaggagccccaccgctgaatctctggcagccgagaaagcattaatggagggctatggactcgtgggacttccccttgtgcggtccccatccctcccaccaaccttcgccgggaccctcacagagttggaggattctttcacggaacaggtccaatcactggccaagtcaattgacgacgccctctctacttggtctctcaagacaatgtgctccctccgtgaatctggggcctaccagctccatcaggctctgcaggcagcagcaggacctcctggactggaagccgagggacgcgcgcccgagtccgcgggtcccggccctggcgacgatgccgccgagactcccggtttgccgccagctcactccggcacgcttatgatggcatttcgggacgtgacagtccagattgccaatcaaaacatttctgtgtccagctccactgcccttagtgtggctaactgcctaggagctcagactgtgcaggcccctgctgaaccggctgcagggaaagcagaacagggagagacttccggccgtgaggccccggaggcccccgccgtgggcagggaggatgcgagcgctgaggactcctgcgccgaggctgcagcctctggagcggccgacggtgcaacggcacccaaaaccgaggaggaagaggaagaggaagagaccgctgaggtcggccgtggggccgaggcggaggctggtgatttagagcagctgagttcctcgagtacttctaccaaatccgctaagtccgggtccgaagcttctgcctccgcatctaaggacgctctacaggcaatgattctgtcccttccaagatatcactgtgagaaccctgcatcatgtaagtctcctacactgagtacagacactctgcggaaacgcctctacagaataggcctaaatctcttcaacattaaccctgataaaggaattcagtttttgatttctcgcggcttcattccagatacgcccatcggagtagcacactttctgctgcagaggaagggcctgtcaaggcagatgataggcgaatttctgggcaactcaaagaaacagttcaaccgcgacgtcctagactgtgtggtggatgagatggacttttcctctatggaactggacgaggccctgagaaagtttcaagcgcacatccgcgtgcagggggaagcgcagaaggtggagcgactgattgaagccttttcccagcgttattgtatgtgtaatccggaggttgtccaacagtttcacaacccggacaccatatttatattggccttcgccatcattttgctgaacacagacatgtactctcctaatatcaagccggaccgcaagatgatgctcgaggactttattagaaatctcaggggcgtcgacgatggtgctgacatccccagggagttagtggtggggatatacgagagaatccaacagaaagagcttaagagtaatgaggaccatgtgacgtatgttacaaaggtagagaaaagcattgtcggaatgaagacggtgttatctgtgccacaccggagattggtgtgttgctcccgcctcttcgaggttacagatgtgaataagctgcaaaagcaggccgcccatcagagagaggtgtttttgtttaatgacttactggtgatccttaaactgtgtccaaagaaaaaatccagttcaacgtacaccttttgcaaaagtgtgggcctgctgggcatgcaatttcagcttttcgagaatgagtactattcccatggaatcaccctcgtcacacccctcagcggcagcgagaagaaacaggtcttgcatttttgcgccctcggctccgacgaaatgcagaagttcgtagaggacctgaaggagtccattgcggaagttactgaacttgaacagatcagaatagagtgggagttagaaaaacagcagggtactaaaactctgtcttttaagccttgtggagctcagggggatccacagtccaaacagggtagcccaacggccaagcgcgaggccgcactgcgggaacgcccagcagagagcactgtggaagttagcatccataatagactccagacttcccagcacaactcaggcctaggtgctgaacgcggcgcacctgtgccgccccctgacctacagcctagtccaccccgccagcagactcctcctttaccccctccgccgccaacgcctcccgggacactagtgcagtgccagcagatagtgaaagttatcgtccttgacaagccctgccttgcacgaatggaaccgctgttatctcaggccttgtcctgttacacttcatcatcttccgatagttgtgggagcacccctctcggcggacctggtagccccgtgaaggttacccaccagccccctctgcctccaccacccccaccatataatcacccgcaccaattttgtcctcctggaagtttgcttcacgggcaccggtatagtagcgggagcaggtccctcgtgtag

SEQ ID NO: 121172 - DNA, 2280 bp, Artificial Sequence
  Description of Artificial Sequence: Synthetic coding sequence
atgcttgagcacaagtatggtggtcacctcgtctctaggagagccgcctgtacaattcaaactgctttccgacagtaccagttgtccaagaatttcgaaaagatcaggaacagcctgttagaaagccgcctccctagacggatctccctgcgcaaggtacggtcaccgaccgcggaatcccttgcggcagagaaagctctgatggaggggtacgggttggtcggcctgcctctggtccgaagcccgtcactgcccccgaccttcgctggcacactgacagaactcgaggattccttcacggaacaggttcagagcctggctaagtccatcgatgacgccctctcaacctggtcacttaaaactatgtgttcattgagagaaagtggggcttaccagttgcatcaagctctgcaggctgcagccggccccccaggactggaggctgaaggaagagcccccgaatctgccgggccgggtcccggtgatgacgcagcagaaacgcccgggctcccccccgcccattcaggaaccctaatgatggccttccgagatgtgactgtacaaatcgccaaccagaatatatctgttagtagtagcacagctctctcagtggctaattgtctcggagcacagaccgtgcaggctcccgcagagccggccgcggggaaggccgagcagggcgaaacaagcggccgggaggcccccgaggccccagccgtggggagagaagacgcatctgctgaggattcctgtgccgaggcggcagcctccggggccgccgatggtgcgactgcaccaaaaaccgaagaggaggaggaagaggaggaaacggccgaggtgggaagaggcgcagaggcggaggcaggggacttggagcagctgagttcttcgagcacgtccaccaagagcgctaagagtgggagcgaagcatccgcttccgcgagcaaggacgccttgcaggccatgattctatctctgccccgctaccattgcgagaacccggcttcgtgcaaatcacccacactgtcaaccgataccctgagaaagaggctgtatcgcatcgggctcaatctgttcaatattaatcccgataagggcatccaattcttaatatcccgtgggtttattcccgacacccctatcggagtggctcacttcctcctgcagcgtaaaggactctcaaggcagatgataggagagttccttggtaattctaaaaagcagtttaatcgagatgtcctggattgtgttgttgacgagatggatttttcatccatggagttggatgaagccttgcgtaagttccaggcacacattcgtgtccagggcgaagctcagaaagttgagcgcctgatagaggcatttagccagagatactgcatgtgtaaccccgaagtggtgcagcagttccacaaccccgacacaatcttcatacttgcatttgctataatattgctgaataccgatatgtactcaccaaacattaaaccggatcgaaagatgatgctcgaggactttatacggaacttacgtggagtagatgacggggcggacatcccaagggagctcgttgtggggatatatgagcggattcagcagaaggagcttaaatctaatgaggaccacgtaacctatgtcaccaaggtggagaagtctattgtcggtatgaagacggtattaagcgtaccccaccggcgcctggtgtgttgtagccggctgttcgaagttacggatgtcaataagttacaaaagcaggcagctcaccagcgggaggtcttcctcttcaatgatctcctggtgattctcaaattgtgccctaagaaaaagagttcttcgacctacacattctgtaagtcggtggggttactcggaatgcagttccagctgtttgagaatgagtattattcccacgggattacactagtgactccactctccgggagtgagaaaaaacaggtccttcacttttgtgctctggggagcgacgaaatgcagaagttcgtggaagatttgaaagagtctattgcagaggtgaccgaattggagcagattcggatcgagtgggagctggaaaagcaacaggggaccaaaaccctttcttttaaaccctgtggtgcccagggcgatccacagtccaagcaagggagcccaacggccaagcgagaggccgctctacgggaaagaccggcagaatctacagtcgaggttctcataaacgccagtccagccaggcttactattctccccattagcagagacacaattaaaagctactgctag

SEQ ID NO: 121173 - DNA, 3549 bp, Artificial Sequence
  Description of Artificial Sequence: Synthetic coding sequence
atggagagcttgttggaaaatcctgttcgggctgtcttgtacctaaaggaactgacagctatagtgcagaatcaacagtcccttattcacacgcagcgcgagcgcatagacgaacttgaaaggcggctggacgaactgtcggcagagaacaggtcactctgggagcatcagcagctgctgcaggcccaacctcctcccggattggtcccgccatccagcgccccactgcccgccgctccggcaactgcccctgctgccgctgcccgggctcaggagccacttcaggaccaggggcagcgatcagcagctgccccgcaccccgctccggaccggccaccaaggcagcaccatggtcagctgctcgagcaaccccagcggggccccggctcgcgagcccataccccacagtctccccataagcacctgggcacgcaaggggctgtcacggataaagaaaaggagcgacccccttcttgctgtgccgctgccggagctctcttgcaacacaaaagtccttcagctctggggaaaggggtcctcagtaggcggcccgaaaatgagacggttctccatcaattttgttgtcccgctgctgacgcgtgttcagatcttgccagccaatctgacggaagctgtacccaggccggcgggggaatggaggattcagtggtagccgctgccgccgtggcagccggtagaccatccgcgcacgcacccaaagcccaagctcaagaactccaggaggaggaagagaggcctggcgctggcgccgctagccccagagctgggccgcagcacaaggcctcccctggtaggcaacagcccgctcttgcaaccgccctttgtccccacgcccccgccgcatcggactatgagctttcactcgacttgaagaacaaacagatcgagatgctggagcataagtacgggggccacctggtatcacggcgcgccgcatgtactattcagacagcctttagacagtatcagctgagcaagaatttcgaaaagatccgaaattcactgttggaatcccgactacctagacgcatttctctgcggaaggtcaggtccccaactgccgagtccctggcagccgagaaagctctcatggaggggtatggactggtgggcctcccccttgtgcggtctcccagcctgccccctacgtttgcagggacgctgaccgagctagaggattcttttaccgagcaggtgcagtcactggcaaaaagtatcgatgatgccttgtcaacttggagcctgaagacaatgtgttctttgagggagtcaggcgcatatcagctgcaccaggcactgcaagcagccgcagggccacccggtctggaggcagaaggccgagcaccagaatctgctgggccaggccctggagacgacgctgctgagacccccgggctaccccccgcacatagtggaactctgatgatggcatttcgagatgtgacggtgcagatagctaaccagaacatatccgtctcaagcagcactgccttatcggtggctaactgtttaggcgcgcagacggtgcaggctcccgcggaaccagctgcagggaaggccgagcaaggggagacctctgggcgagaagcccccgaggcgcctgcggtggggcgcgaggacgcctctgccgaggactcttgtgctgaagctgcagcttcgggggcagctgatggagctaccgccccaaagaccgaagaggaagaggaggaggaggaaactgccgaggtaggtcgaggagctgaagcagaggccggagatttggaacagctaagctcttcgtccacatccacgaaatctgctaaatccggcagcgaggcaagtgcctccgcctcgaaagacgcgctgcaggctatgatcctcagcctcccccggtatcattgcgagaatcccgcatcatgtaagagccctactttgagtaccgacactctgcgtaagcgtctgtaccgcatcggcctgaacctgttcaatataaaccctgataaagggattcagttcctcataagtaggggttttattcccgatacacccattggcgtggcacattttcttctgcagcgaaaagggctatcacgacagatgataggtgaattcctcgggaatagcaaaaagcagttcaacagggacgtcttagattgtgtcgtggatgagatggactttagtagtatggagctcgacgaggcactgcggaagtttcaagcccatatcagggtgcagggcgaggcacagaaagtggagcgactgattgaagcattcagccagaggtactgtatgtgcaatcccgaggtggttcaacagtttcataaccccgacacaattttcatccttgcctttgccattatactgctaaatacagacatgtacagcccgaacatcaaacctgataggaagatgatgctggaagattttattaggaacttgaggggagttgatgacggagctgatattcccagagagctggtggttggaatctatgagaggattcagcagaaagaactaaagagcaacgaggatcatgtcacttacgtgaccaaggtggaaaagtccatcgtcgggatgaaaacggtgctttctgtcccccaccgccgcctggtgtgctgtagtcggttgttcgaggttacagacgttaacaaactgcagaagcaagcagcccatcagagggaagtcttcctcttcaatgacttgttggtaatccttaaactgtgtcctaaaaagaaatcctcttccacttatacgttttgtaagtccgttggtctcctgggtatgcagtttcaattgtttgagaatgaatattacagccacggcatcactctggtgactcccttgagcggtagcgaaaagaaacaggtcctccacttctgcgcattgggaagcgacgagatgcagaagtttgtggaagatctcaaagagtctattgctgaggttaccgagctggagcagattcgcatcgagtgggagctggaaaagcaacaggggaccaagactctgtcctttaagccctgtggggcccagggagaccctcagtccaagcagggaagtcccactgccaagcgtgaggcagccctgcgagaaagacctgccgagtcgacagtcgaagtcagtatacacaatcgcctgcagactagccagcacaacagcggcctgggcgccgaacggggggcccccgtgcctccgccggatctgcagccttccccaccgagacagcagaccccgcctctgccccctccgccccctacaccgcctggaaccctcgtgcagtgccagcagatcgtgaaggtcattgtccttgataaaccctgcctggctcgcatggaaccattgctgagccaggccctgtcctgctacacatcttcaagttccgattcttgcggcagtacgccactggggggtccaggtagcccggtgaaagtcactcaccaacctccactcccgccaccacctcctccttacaaccaccctcaccagttctgcccacctgggagtcttctgcatggtcacagatactccagtggctctcgaagcctggtctag

SEQ ID NO: 121174 - DNA, 1797 bp, Artificial Sequence
  Description of Artificial Sequence: Synthetic coding sequence
atgaagccgacaggcaccgatccaagaatcctcagcatcgccgccgaagtggcgaagtcacctgaacagaacgttcccgtcattctgctgaaactcaaagagattatcaacattacccccctcggatcctccgagttgaaaaagatcaagcaagatatctactgctacgaccttatccagtactgcttgctggtgctaagccaggactatagcagaattcagggaggctggactacaatctcccagttaacacagatcctcagtcactgctgtgtgggtctggagcctggcgaggacgcggaggaattttacaacgaattgctcccttcagccgctgagaattttctcgttctgggccgtcaactccagacatgctttattaatgccgcaaaagctgaagagaaagatgaactgttgcattttttccagatcgtgaccgatagtctgttctggctgttgggtgggcacgttgaattgatccagaacgtgctgcagagtgaccattttctgcatcttttacaggccgacaatgtacagattggttctgcggtcatgatgatgttacagaatatcctgcaaatcaattccggtgacttactgagaattggaaggaaggccctttactctatcctggatgaggtcatattcaagctcttctctacacctagcccggtaatcaggtcaacagctaccaaactgctgcttctgatggcggaatcacaccaggagattctcattttgctcagacagtcaacctgctacaaaggactgcgccgcctgctgtctaagcaggagactgggaccgaattctctcaagagttgaggcagcttgtcggcttgctcagccccatggtgtaccaggaggtggaagagcagaagctgcaccaggcggcttgcctcatccaagcatattggaagggattccagaccaggaagcggttaaaaaaactccccagcgcagtgatagctctgcaaaggtcgttcaggtctaagagatctaaaatgctgctggagataaacaggcaaaaggaggaagaggatttgaaactgcagcttcagctacaaaggcagagagccatgagattgagccgtgaacttcagctaagcatgctcgaaatcgtgcaccccggtcaggtggagaaacattaccgggagatggaggagaaatctgccctcatcattcaaaaacattggagaggctaccgggaacgcaagaactttcaccagcaacgccagtccctcattgagtacaaggcagccgtgactctccagcgagcagccctgaaatttctggccaaatgccggaaaaaaaagaagctcttcgccccttggagagggttgcaggaactgactgatgccaggagggtggagttgaagaaacgcgttgacgattatgtgcgacgtcacctgggttctccaatgtccgacgtggtgtctcgggagctgcatgcccaggcacaggaacgcctacaacattatttcatgggtcgcgccttagaggagcgagcgcaacagcatcgggaggcattgatcgctcagatatccaccaatgtcgagcagctgatgaaggctccctctcttaaggaagctgagggcaaggaacctgagttgtttttgtctagaagccggcccgtagcagcgaaagccaagcaagcccacctcaccactctaaaacacatacaggctccttggtggaagaaacttggggaagaaagtggagacgaaattgacgtccccaaggatgagctctccattgagcttgagaacctgttcatcggcggaacaaaacctccatag

SEQ ID NO: 121175 - DNA, 1398 bp, Artificial Sequence
  Description of Artificial Sequence: Synthetic coding sequence
atgaaaccgacaggaacagacccgagaatactcagcattgccgctgaagtggccaaatcacccgagcagaacgtccctgttatcttgttgaaactgaaagaaattatcaacatcacccctctcggtagttctgaactcaaaaagatcaaacaggacatatattgctatgacctgatacagtactgtctcctggtgctaagccaggattactccaggatccagggagggtggacaactatctctcagctcacacagatactgagtcattgctgtgtcgggctggagcctggggaagacgctgaggagttttacaacgaactcctgccctccgcggctgagaacttcctggtgctgggtcgccaactgcagacttgttttattaatgccgccaaagcagaagaaaaggacgagctcttgcacttttttcagatcgttaccgattcccttttttggcttctgggcggccatgtagaacttatccagaacgtgttacagtctgaccacttcctgcaccttctccaagccgacaacgttcagatagggagtgctgtcatgatgatgttgcagaatatcctgcaaattaaccgaagcaagaggagcaaaatgcttctggagatcaataggcaaaaggaggaagaagatctgaaactgcagctgcagctgcagagacaaagggcgatgaggttgagtcgggagttgcagctgtcaatgctggaaatcgtgcaccctggccaggtggaaaagcattatcgcgaaatggaagagaagagcgccttgatcatccagaaacactggcgcggatatcgagaacgaaaaaactttcaccaacagcggcagtcactcatcgaatataaggcggcggtgaccctgcagagagccgccctgaaatttctcgccaagtgccggaagaaaaaaaagcttttcgccccctggaggggacttcaggagttgaccgacgctagaagggtggagttgaagaaaagggtcgacgattacgtgcgccgccatctcgggtcgcctatgtctgacgtcgtatcccgagagttacacgcccaggcccaagagcgtcttcagcactattttatgggccgggccctcgaagaacgcgctcaacaacacagggaggccctcattgcccagatcagcacaaacgtggaacagctaatgaaagctccaagtctgaaggaagctgaggggaaagaacctgagctgtttctgtctaggtcccgacctgttgctgccaaagccaagcaggcgcacttgaccacgcttaaacatatccaggcgccttggtggaagaagctgggggaggagagtggcgacgaaatcgatgtccctaaggatgagctgtctatcgaactggagaatttatttatcggaggcacgaagccaccttag

SEQ ID NO: 121176 - DNA, 264 bp, Artificial Sequence
  Description of Artificial Sequence: Synthetic coding sequence
atgaaacccaccggaactgaccctaggattttgtcaatcgccgcagaagttgccaagtctcctgagcagaacgtgcctgtcatattattaaagctgaaggaaatcataaatatcactcctctgggaagcagcgagcttaaaaaaataaagcaagacatctattgctacgacttaatccagtattgcctgctcgtgttgtcccaggactactcgcgcattcagggagggtggacaacaatctcacagctgactcaaatcctgtag

SEQ ID NO: 121177 - DNA, 1332 bp, Artificial Sequence
  Description of Artificial Sequence: Synthetic coding sequence
atggaggaagactcacttgaagatagcaacctgccaccgaaggtctggcattcagagatgaccgtgtcagttaccggcgagcccccaagcaccgtggaagaagaaggcatcccaaaagaaaccgacatcgaaattatcccggaaattccagaaaccctagaaccgctgtccttgccagacgtcctccgcatttccgctgttctggaggacaccactgatcagctgtcaatactgaattacatcatgccagtgcagtatgaggggagacaatccatctgtgtaaagtcgcgtgagatgaatctggaaggcaccaatctcgataaactgccaatggcttccaccatcactaagatacccagcccactcatcacagaggaagggcctaacttacccgagatcaggcacaggggcagattcgccgtcgaattcaataagatgcaggatctcgtcttcaagaagccaaccagacagaccattatgacaactgagacgcttaagaaaatccaaattgatcgccagttcttcagcgacgttatcgccgataccataaaggagctgcaggattcggcgacatacaattcactgctccaggcactgagtaaggaacgagaaaacaaaatgcacttctacgatattattgctagagaggagaagggacggaagcaaatcatcagcctccaaaaacaacttatcaacgtgaaaaaggagtggcaattcgaagtccagagccagaacgagtacattgcgaacctgaaggaccagttgcaggaaatgaaggcaaagtccaacctggaaaaccggtacatgaagactaataccgaactacagattgcccaaactcagaaaaagtgtaatcgcaccgaagagctcttggttgaagaaatcgagaagctgcgaatgaagaccgaagaagaggctaggacccataccgaaattgaaatgttcctgcgtaaggagcagcagaaactcgaagaaaggctggaattttggatggaaaagtatgataaagacactgagatgaaacaaaacgagctgaatgccttgaaggctaccaaggcaagcgatttggcccacctgcaggatctggccaaaatgattagggagtatgagcaggtcattatcgaggacaggatcgagaaggaacggagtaaaaagaaagtcaaacaggacctcctggagctgaaatccgtcataaaactccaggcctggtggaggggcacgatgatacgacgggaaatcggaggatttaaaatgcccaaagacaaagttgatagcaaagacagcaaaggcaagggcaaaggtaaggacaaaaggcgcgggaagaagaaatag

SEQ ID NO: 121178 - DNA, 165 bp, Artificial Sequence
  Description of Artificial Sequence: Synthetic coding sequence
atggaagaggacagccttgaagatagcaatctccctcctaaggtgtggcattcagaaatgaccgtgtccgtaactggggagcctccctcaactgtagaggaagaaggcattccaaaagagaccgatatagaaattatccccgagatccctgagacacttgagtag

SEQ ID NO: 121179 - DNA, 1332 bp, Artificial Sequence
  Description of Artificial Sequence: Synthetic coding sequence
atggaagaggattccctggaagactctaatctgccccctaaggtatggcactcggaaatgaccgtgtcagtcacaggcgagcctcccagcactgtggaagaggaaggcatccccaaagagaccgatatcgaaataatcccagagatacctgagactttggaaccactaagcttacctgacgtgctgagaatttccgctgtgcttgaggatacgacagatcagctcagtattctgaactacatcatgcccgtacaatacgaaggcaggcagtccatttgtgtgaagtcacgggagatgaatttggaaggaactaacttggacaaattgccaatggcaagcaccattactaaaattccttctccattgatcacagaggaaggacccaatctgccagagattcggcaccggggcagatttgccgtcgagttcaacaagatgcaggatctggtattcaagaaaccaacgcgacagacgatcatgactactgagaccctcaaaaagatccaaatcgatcgccagttttttagcgacgttatcgccgataccatcaaggagcttcaggactccgccacgtataatagtctgttgcaagcactgtctaaagaacgggagaataagatgcatttttacgatattatcgcccgtgaggaaaagggacggaagcagatcatctcactacaaaaacagcttatcaacgtcaagaaagaatggcagtttgaagtccaatcgcagaacgaatacatcgcaaatctaaaggaccagctgcaggagatgaaggccaagtctaacttggaaaaccggtatatgaagaccaacactgagttgcagatagctcagacgcagaagaaatgcaaccggacagaggaactccttgtggaggaaattgagaagctaagaatgaaaaccgaagaagaagcgcggacacacacagagatcgaaatgttcttaagaaaagaacagcagaaactggaagagaggttggagttttggatggagaaatacgataaggacacggagatgaagcagaatgagctaaacgctcttaaggcaacaaaggcttccgatctggctcatttacaggatcttgctaagatgataagggagtatgagcaggtgattatcgaagatcgtattgagaaagaacggtctaagaaaaaggtcaagcaggacctcctcgagctgaagagcgttatcaaactgcaggcctggtggcgcggaacgatgatcaggagggagatcggggggttcaagatgcccaaagataaagtcgacagcaaggacagtaagggaaaaggcaaaggcaaggacaaacgcaggggtaaaaaaaaatag

SEQ ID NO: 121180 - DNA, 4974 bp, Artificial Sequence
  Description of Artificial Sequence: Synthetic coding sequence
atgtcggctgccgacgaggttgacgggctgggagtggcaaggccacactacgggtccgtactggataatgaaaggttaaccgccgaggagatggatgaaagacgccgtcagaacgttgcctatgaatacctgtgccatttagaggaggccaaacgctggatggaagcctgcctgggcgaagaccttcctccgaccactgagctggaagagggattgcggaacggggtctacctggccaaacttggaaacttcttttctccaaaagtcgtgtccctgaagaagatctacgaccgcgaacaaacccgatacaaagccaccgggctccatttccgacataccgacaatgtgatccaatggctgaacgcaatggatgagatagggctgcctaagatattttacccagagacaaccgatatctatgacagaaaaaatatgccgcggtgtatatactgtattcacgcgctttcgctttacctttttaagttaggtctcgctccccaaatccaggacttgtacgggaaggtggactttaccgaggaagaaatcaataatatgaagacagagcttgaaaaatacggaatccagatgccagcgttctctaaaataggcggaatcctggcaaacgaactctctgttgatgaggctgctctgcatgccgcagtgatagccattaatgaggccattgatcgcagaatccctgccgacacatttgccgccctcaagaatcctaacgccatgttggttaatctggaagaaccattggccagcacttaccaggatatcctctatcaggccaagcaggataagatgaccaatgccaagaaccgcaccgagaactccgagagagagcgagatgtatacgaggagctgctgacccaggccgagattcaggggaacatcaacaaagtgaacacgttcagtgcactggcgaatatcgatctcgccctggaacagggtgacgccttggccttattccgcgccttgcagtcccccgcgctaggacttcggggcttacagcagcaaaatagtgattggtacctcaaacagctgctgtcagacaagcagcagaaacgccaaagcggacagacagaccccctgcagaaagaagagctgcagtccggagttgatgctgccaatagtgcggctcagcaatatcagcggcgactcgcggctgtggccctgattaatgcagcaatacagaagggcgtggctgaaaagaccgtactggagttaatgaaccctgaagcccaattgccgcaggtatacccttttgcagcggatctgtaccagaaggagctggccacccttcagagacagagtcccgaacacaatcttacacatcccgagttaagcgttgccgtcgagatgcttagttctgtggccctaatcaaccgtgccctggaatccggagatgtgaatactgtgtggaagcagctaagttccagcgtgaccggactaacgaatatcgaggaagaaaactgtcagagatacttggacgagctcatgaaactcaaggctcaggcccacgccgaaaacaatgaattcattacatggaacgacattcaggcgtgtgtcgatcacgtcaatttggtcgtccaggaggagcacgaaaggatcctcgctataggcttaataaatgaagcactggatgagggggatgcgcaaaagacactccaggccctccaaatacccgcagccaagttggaaggcgtcctggctgaagtggcgcagcattaccaggacacactgatcagagcaaagcgggagaaagcccaggagatccaagacgaaagcgcagtattgtggctggatgaaatacagggcgggatttggcagagcaacaaggatactcaggaggcccagaagttcgccttggggattttcgccatcaacgaagctgttgagtctggcgatgtgggcaagactttaagcgctctgcgctcgccggatgtaggcctgtacggtgtgatccccgagtgtggggaaacatatcacagtgatctagccgaggctaagaaaaaaaaattagcagtgggcgataacaacagcaaatgggtgaaacattgggtcaaagggggctactactattaccacaatttggagacccaagaaggcgggtgggatgagccccctaacttcgtgcaaaatagtatgcaattgtctagggaagaaatccagagcagtatctcaggggtgactgccgcttacaatcgcgaacagttgtggcttgcaaacgagggcctgatcacccgactgcaggcccggtgccgcggctaccttgtgagacaggaattccgctcccggatgaacttcctcaagaaacaaatccctgcaatcacgtgcatacagagccaatggagagggtacaaacagaaaaaggcatatcaagaccggctggcctatctgcgctcccacaaagatgaagtagtcaaaattcaatccctagctagaatgcatcaggcaagaaaaagatatagagatcgcctgcagtacttcagggatcacattaacgacattataaagattcaggcgttcatccgggcaaacaaagctagggatgattacaaaaccctcattaatgctgaggatccgccgatggtggttgtccgaaagtttgttcacctgctggatcagtcagatcaggactttcaggaagagcttgatctgatgaagatgagagaggaagtcataaccctgatcaggagcaaccaacagttggaaaatgatctgaatctcatggacattaagatcggcctgctagtgaagaacaaaatcaccctgcaggacgtcgtgtcacactccaaaaagctgaccaagaagaataaagagcagctgtccgacatgatgatgatcaacaaacaaaaaggtggcctgaaggccctgtcgaaagagaagcgggagaaactagaggcttaccagcatctcttctatctcctgcaaacaaacccaacgtacctcgccaagctgattttccaaatgcctcaaaataagagcacgaagtttatggatagcgtgatttttactctttacaattacgcttcaaaccagagagaggaatatctgctcctccgcctgttcaaaacagcgcttcaggaagaaatcaaatcgaaagtggatcagatacaggaaattgtgacaggtaaccctactgtgattaagatggtcgtgagttttaacagaggcgcccgcgggcagaacgctttacgccagatcttggcccctgtggtgaaggaaatcatggatgacaaaagtcttaatataaagaccgatccggttgacatctataagtcttgggtgaaccaaatggaatcacagacaggagaagcttcgaagttgccctatgacgtgacacccgagcaagccctggcccatgaagaggtgaagaccaggttagattctagcattcgaaacatgagagctgtcactgataagttcctctctgccatcgtgtcctcagtcgacaagatcccatacggcatgagatttatagctaaagtgctcaaagattccctgcacgaaaaattcccggacgccggcgaagacgaacttttgaaaatcatcggaaacttgctttactatcgctacatgaaccctgccattgtagctccagacgccttcgacattattgacctatctgcaggcggccagttgactacggatcagcgtaggaacctgggttccatcgccaaaatgctccagcatgctgctagcaataagatgtttctgggcgataacgcccaccttagcattatcaacgaatacctctctcaatcttatcagaaattcaggcgattcttccagacagcctgcgatgtaccggagctccaggataagttcaatgttgacgaatactctgatttggtgacactgaccaagcccgtgatttatatttctataggggaaattattaacacccatactctcctgctggaccatcaagacgccatagctccggaacacaacgacccgatccacgagctcctcgacgatttaggggaggtccccaccattgagagtttaatcggcgagtcctcgggtaacttgaatgaccctaataaggaggccctggcaaaaaccgaagtgagcctcactcttacaaacaaatttgacgtccctggggacgagaatgcagagatggatgcacgaacaattctactcaacactaaacgactgatcgtagatgttatcagattccaacccggtgaaactttgaccgaaatcttggagacacccgctacgtccgagcaggaggctgaacatcagcgggccatgcagaggcgcgctatccgggatgccaagacgccagataagatgaaaaaatcaaagtcagtgaaagaagactctaatctcacactccaagagaagaaagagaagattcaaacgggtttaaagaagctgaccgaacttggcaccgtggatcctaaaaataaatatcaggagctcatcaacgacatcgctagagatattagaaatcagagaagataccgtcaacgccggaaagctgagctggtgaagctgcaacaaacttatgctgcgctcaacagcaaagccaccttctacggcgagcaggtagactactacaaatcttatatcaagacatgtcttgacaatctggcctctaaggggaaggtgagcaagaagcctcgggagatgaaaggcaaaaagtcgaaaaaaatatccctgaaatacaccgcagctagactccacgagaagggagtcctcctcgagatagaagatttgcaggtaaaccaatttaagaatgttatctttgaaataagccccaccgaggaggtgggcgactttgaggtcaaagcaaaattcatgggcgttcagatggagaccttcatgcttcattatcaggaccttcttcaactgcagtacgagggcgtagccgttatgaaacttttcgatcgcgctaaagtcaatgtgaatctcctgatttttcttcttaacaagaagttttacgggaaatag

SEQ ID NO: 121181 - DNA, 4728 bp, Artificial Sequence
  Description of Artificial Sequence: Synthetic coding sequence
atgccccacgaggagctcccgagccttcagcgcccgcgctatggttccatcgtggacgacgagagattgagcgcagaagagatggacgagcgtcgtagacaaaatatcgcatacgagtacctctgtcacctggaggaggccaaacggtggatggaagtatgcttggtagaagaactgccccccacaacagaactggaggagggacttaggaacggcgtctatttagctaaactcgccaagtttttcgcaccaaaaatggtgtccgagaagaagatctatgacgtcgagcagacacgctacaagaagtcgggtctgcactttcggcatactgacaacaccgttcaatggctccgagccatggaaagcatcgggcttcccaagatattttatccagaaacgacagacgtctatgatagaaaaaatatccctcgtatgatatattgtatccacgccctgtcgctctatttatttaagctcggtatcgctccccaaatccaagatctgctcggcaaggtggattttaccgaagaggaaatcagcaatatgcgcaaggaattggaaaagtatggaattcagatgccctcattctccaaaatcggcggcattctcgccaacgaacttagcgtcgatgaagccgcacttcacgccgcagttattgctatcaacgaggccgtagagaaaggtattgccgagcagactgtggttactctcagaaacccaaatgccgtcttgaccctggtggatgataacctggcaccagagtatcagaaggaactatgggacgccaagaaaaagaaagaggaaaacgcacgacttaagaactcctgcatttccgaggaggaaagagatgcttacgaagaactgctgacccaggccgagatccagggaaatattaataaggtgaatagacaagccgccgttgatcatataaatgctgtgattcctgaaggcgaccccgaaaacaccctccttgcactgaagaagccggaggcccagttgcccgcagtctatcccttcgcggccgcaatgtaccagaacgaactgtttaatctccagaagcagaacaccatgaattacctcgcacacgaggaactgctcatcgcagtcgagatgctatctgcagtagcacttcttaaccaagcattagaatctaatgacttggtaagtgtgcagaaccaactgagatctcccgcaataggcctgaacaacctggataaagcgtacgtggaaagatatgccaatacgctgctttcagtgaagctcgaggtgctgagccagggacaggataacctgagttggaatgaaatacaaaattgtattgacatggtcaatgcgcagatacaagaagaaaatgatagggtggtggccgttgggtacatcaatgaggcaatcgatgaagggaaccccctgaggacactcgagacactgctgttgccgaccgccaacatcagcgatgtcgatcctgcccatgcacagcattaccaggacgtgctctatcatgccaagtctcagaaacttggcgattccgaatctgtgagcaaggttctgtggttggacgaaattcaacaagcagtagacgacgcgaacgtagacaaggaccgtgctaaacagtgggtcaccttagtggtcgacgtcaatcagtgtctggagggcaagaagtcatcggacattctgagtgtgctgaagtccagtaccagcaatgcaaatgacatcatccccgagtgcgcagacaaatactacgatgcccttgttaaggccaaggaattgaagtctgagagagtgtcctctgacgggtcctggctgaagcttaatctgcacaaaaaatacgattattactataatacagattctaaggagtcatcctgggtgacccctgagagctgcctttacaaagagagctggctgactgggaaagagatcgaggacatcatagaggaagttacagtcggctatattcgggagaacatctggtcagcttcagaggaacttttgctgcgttttcaggctacaagctccgggcccattctgcgggaggagtttgaagcaagaaaatccttcttgcatgaacaagaggaaaacgtggtcaaaatccaggccttttggaaaggatataagcagagaaaggagtatatgcacagaagacagaccttcatcgataacacggactcaatcgtgaaaattcagtcttggttccgaatggctaccgccaggaagtcctacctctccagacttcagtactttcgagatcacaataacgaaattgtgaagatccagtctcttctccgtgcgaacaaagccagagacgactataagaccttggtggggagtgagaaccccccacttaccgtgattcgcaagttcgtttacctgctggatcagagtgacctggactttcaggaagagctggaagtcgcccgcctgagggaggaagtggtgacaaagatccgcgccaatcagcagctggaaaaggacttgaacctgatggacataaagatagggctgctggtaaaaaacagaatcacactcgaagatgttatcagccacagtaaaaaactgaataagaaaaaaggaggcgaaatggagatccttaataacaccgacaaccaaggcatcaagtcgctgtctaaggagcgtcgcaagacgttggagacataccagcagctattttacttgttgcagaccaatcccttatatctcgctaaactcatcttccagatgcctcagaataagagcacgaagtttatggatactgtgatatttacactgtacaactatgcgtccaaccaaagagaggagtatctcttgctcaagctgttcaagacagctttggaagaggagatcaaatcaaaagtggatcaagttcaggacatcgttactgggaacccaacagtcatcaagatggtggtctcattcaatcgcggagctcggggacagaacactttaagacagcttcttgcccctgtagtgaaagagatcatcgatgataagtctctgattattaacaccaatcctgtggaggtgtacaaggcatgggtgaaccagctggaaacgcagaccggagaggcaagcaaattaccatatgacgttacaactgaacaggcactgacgtaccctgaggttaaaaacaaactcgaagccagtattgaaaaccttcgaagagtcactgacaaagtcctaaacagtatcatctcatctcttgatctgctcccttatggactgagatatatagctaaagttcttaagaatagtattcacgaaaagtttcccgatgcgaccgaagatgagctcctgaaaattgtggggaacctcctctattatcggtacatgaaccctgccatcgttgccccggatgggtttgacattatagacatgaccgctggcggtcaaatcaactccgaccagcggcgaaatctgggatccgtggctaaggttctacaacatgccgcctccaataagttgtttgagggcgaaaatgaacacctgtctagtatgaacaattatctaagcgagacttatcaagaatttcggaaatatttcaaagaagcctgtaatgtgcccgagcctgaggagaaatttaatatggataagtataccgatttggtaaccgttagtaaaccagtgatctatatctcaatagaggagatcatcagcacccacagcttgcttttggaacaccaggacgcaatagctcccgaaaagaatgacttgctgtctgagctactcgggtcacttggggaagtccccacagttgagagtttcctaggggagggtgccgtggacccgaatgatccaaataaggccaataccctgagccaactcagtaagaccgagatatctctcgttctaacctctaagtacgacatcgaggatggcgaagccatcgactcacgaagtctcatgataaagacaaaaaagctgatcatagacgtgatccgcaatcagccaggaaatacactcacagaaatcctggagactccggccaccgcgcaacaggaggtggatcatgccactgacatggtgtcccgcgcaatgatcgactcccgcacaccggaagaaatgaaacactcccagtcgatgatcgaggatgcacaacttcctctggagcagaagaaaagaaaaatacaaaggaacctgcggactttggaacagaccggccacgtttcttcagagaataaataccaggatattctgaacgagattgcgaaagacatccggaatcagcgcatttacagaaaactccgcaaggccgaactagcaaaattacagcagacgcttaacgcccttaataagaaagctgcattctatgaagaacagatcaattactatgacacctatataaaaacctgcttggacaatttgaaacgcaagaacacaagacggtcaattaaactggatggcaaaggcgagccaaagggagctaaacgggctaagcccgtgaagtatactgcggctaaattgcatgaaaagggggtcttgttggacatcgacgacctgcaaactaatcagttcaagaatgttacgtttgacattattgctaccgaggatgtaggaatcttcgatgtcagatctaaattcctaggcgtggaaatggaaaaagtgcagcttaatattcaggacctcctccagatgcaatacgaaggcgttgctgtgatgaagatgtttgataaggtaaaggtgaacgttaatctgctaatctatctgcttaataaaaagttttatgggaagtag

SEQ ID NO: 121182 - DNA, 3234 bp, Artificial Sequence
  Description of Artificial Sequence: Synthetic coding sequence
atggtgaacgcccagatccaggaagaaaacgacagagttgtggcagtcggatacattaatgaagctatcgatgaggggaaccctctgaggacacttgagaccctgctgctgcccactgctaatatttctgacgttgatccggctcacgcgcagcattaccaggacgtactttaccacgccaagtcccagaaactgggcgactccgagtcggtgtccaaagtgctgtggctagacgaaatccagcaggcagtggatgacgctaacgtggacaaggacagggccaagcagtgggtgacattggtggttgacgttaaccaatgcctggaggggaaaaagtcaagtgatattctgtccgtgctaaagagctctacttctaatgcaaacgatattatccctgagtgtgccgacaaatactatgacgctctggtcaaagccaaagagctcaaaagtgagagagtgtccagcgacggctcatggctcaagctgaacttgcacaagaagtatgactattactacaacacagactctaaggaatctagctgggtaacacctgaatcatgtttatacaaggagtcgtggcttacaggcaaagagattgaagcattttggaagggttacaaacagcgtaaggagtacatgcacagaaggcagacctttatcgataatacagattctattgtcaagattcagtcttggtttaggatggcaacagcacggaagtcatatctctccaggttacagtatttccgggaccacaacaacgagatcgtgaagatccagtcattactgagggctaacaaggcaagggatgactataaaacactggtcggaagtgagaatccccctctcacggtgatccggaagttcgtttatttactggaccagagcgacctggatttccaggaggagctcgaggtggcccggctccgggaagaagtggtgactaagattcgggccaaccagcagctggagaaagacctgaacctcatggacatcaagatcggtttattagtgaagaaccggattacactcgaagacgttattagccactccaagaaactcaacaagaagaagggaggcgaaatggagatactcaataacacagataaccaaggtattaagtctctttctaaggagcggcgcaaaactctggagacataccaacagctgttttatctgctgcagacgaaccccctttatctggcaaagctaattttccaaatgccacagaacaagagtacgaagttcatggacaccgttatcttcaccctctacaattatgctagcaaccagagagaagaatatctcctcctgaagttatttaaaaccgcactggaagaagagatcaagagcaaggtcgaccaagttcaggatatagtgacaggcaacccaactgtgattaaaatggtggtgtcattcaacagaggggcaagaggacagaacacgcttagacaattgctagcacccgttgtcaaggaaattattgacgataagtcgctcatcattaacacaaatcccgtggaggtgtataaggcgtgggttaatcagcttgaaacacagacgggtgaggcaagcaagctcccttacgatgtgacaaccgagcaagcactcacgtatccagaggttaaaaacaaacttgaggcttccatagaaaatctgagacgcgtgaccgacaaagtactgaatagcattatttctagcctggaccttctcccctacggcctgagatacattgccaaggtgctcaagaactcaatccatgagaagttccctgatgcaaccgaagacgaattgcttaagattgtcggcaatcttctgtactatagatatatgaacccagctatcgttgcgcccgacggatttgacattatagatatgacagccggaggtcagatcaactccgaccaaagacggaatctcggctctgttgcaaaggttctacaacacgcagcaagtaacaagctctttgagggcgagaatgaacacctctcatctatgaataattacctgtccgaaacttaccaagagttccgcaagtattttaaagaggcatgcaacgttccagaacccgaggaaaagttcaacatggacaaatacacagatctggtgacggtcagtaagcctgtcatttatatcagtattgaggaaattatttcaacacatagcttgcttctagagcatcaggatgctatagccccagaaaaaaacgatttactgtcagagctactgggatcactgggggaggtcccgacagtagagtcttttttaggagaaggggcagtagaccctaatgatccaaacaaagcaaacaccctgtcacagttgtctaaaaccgaaatctctcttgtcttaacaagtaaatatgacattgaagatggagaggcgatcgatagtcgcagtctgatgattaagactaaaaaactgatcatcgatgttatccgcaaccagcccggcaatactttaacagagatcttggaaactcccgcgaccgcccagcaagaagtggaccacgcgacagatatggtgtccagagccatgatcgattcccggacccccgaagaaatgaagcattcccagagcatgattgaagatgcacagcttccgctggaacagaagaagagaaagattcagaggaacctccggacactcgaacaaactggccacgtcagttctgagaataagtatcaggatatcctaaatgaaatcgccaaagacattagaaaccagcgcatttaccgaaagctcaggaaggctgaactggccaaactgcagcagactcttaacgcattaaacaagaaggctgccttctacgaggagcaaattaattactacgacacttatataaagacctgcctcgacaacctcaaacgcaagaacacccgacgctccattaaactagacggcaaaggtgagccaaagggtgccaaaagagctaaaccggtgaagtatactgccgccaagctgcatgaaaagggcgtcctgttggacatcgacgatcttcagacgaaccagtttaagaatgtgacatttgatattattgccactgaggacgtgggaatctttgatgtgcgaagtaagtttctcggcgtcgaaatggagaaggtccagctgaatattcaagacctcctgcagatgcaatacgagggggtggccgtgatgaagatgttcgataaggtgaaggtcaatgttaatctccttatctacctattgaataaaaagttttatggcaagtag

SEQ ID NO: 121183 - DNA, 3216 bp, Artificial Sequence
  Description of Artificial Sequence: Synthetic coding sequence
atgcacagcctaccaggagtcgttgcagtgggatacatcaatgaagccattgatgaaggaaaccctcttcggactctggagactcttttacttccaaccgcgaatatcagtgacgtagacccagcccacgcccagcactaccaagacgtgctctatcacgccaagtcacagaaactgggggactcggagagcgtttctaaggtgttgtggttggatgagattcagcaagctgtggacgatgcaaacgtggacaaggaccgtgccaaacagtgggtcacgctggtggtggatgtgaaccaatgtttagagggcaagaagtccagcgatatcttaagcgttctaaagtcaagtacaagcaatgctaatgacataattccagagtgcgctgacaagtactatgacgctctcgttaaggccaaagagctcaaaagtgaacgagtgagctcagatggtagttggctgaaactcaatctgcacaagaaatatgactactattacaacaccgactccaaagagtccagttgggtgaccccggaatcatgcctgtacaaggagtcttggctaactgggaaagaaattgaggccttctggaaagggtacaagcaacgcaaggagtatatgcacaggcgccagacattcattgataacacggactccattgtcaagatccagtcgtggttcagaatggctacagccaggaagtcatatctctcgcggctacaatatttccgcgatcataataatgaaattgtcaagatccagagcctcctgcgcgctaataaggcacgagatgattataagaccctcgtcggcagcgaaaacccaccgctgacggtaatccgaaagtttgtgtatctcttagaccagtctgatctggactttcaagaggagctggaagtcgctaggcttcgggaggaggtcgtgactaagataagggcaaatcagcagctcgaaaaagacctcaacctaatggacattaagataggcctgctggttaaaaatcgaatcaccctcgaggacgttatctctcacagcaagaaattgaacaagaagaaaggtggagagatggaaatcctcaacaatacggataatcaggggattaaaagtttgagcaaggaacggagaaaaacactggaaacctatcagcaactcttctacctgctccagacaaatcccctgtaccttgcaaaactcattttccagatgccacaaaataagtcaacgaaattcatggacacagtcatctttaccctgtataattacgcctcaaaccagcgcgaggaatatctgctattaaaactctttaagacggctcttgaagaggagatcaaatccaaggtcgaccaggttcaggacatcgtgaccggtaacccaaccgttatcaagatggtggtgtcattcaatcggggcgcccgtgggcaaaatactctgcgccaattactggcacctgtggtcaaggaaattatcgatgataaatctctgattatcaataccaatcctgtcgaggtttacaaggcctgggtgaaccagctcgagacccagactggggaagcctcaaaactgccgtacgatgtgaccactgagcaggccctgacctatccagaggtgaagaacaaacttgaggcatcgattgaaaacctgcgaagagtcacggacaaggtcctgaactcaatcatctcgtcacttgacctcctaccgtacggcctccggtacattgctaaagtcctgaagaatagcatacacgagaagtttccagacgccaccgaggatgagctgttgaagattgtgggaaacctgctgtattatcggtacatgaaccctgccattgtggccccggacggtttcgatattatcgacatgactgcggggggccaaatcaactccgaccagcggaggaacttggggtcagtggctaaagtgctgcagcatgcggcgtctaataagttgttcgagggtgaaaacgaacacctgtcaagcatgaacaactacctttcagagacttatcaggagttccgaaaatatttcaaggaggcttgcaatgtgcctgagccagaggagaagttcaacatggataagtacactgatctggtaaccgtatctaagcccgtcatatacatttccattgaagagattatttcaacgcacagcttgctgcttgagcatcaggatgccattgcccccgagaagaacgacctgctttccgaacttctcggctcgctgggcgaagttccaacagtggaaagtttcctgggggagggagccgtagaccctaacgatcccaataaagccaatacacttagccagctgtccaagaccgaaatttcccttgttttgactagcaagtacgacattgaggacggggaagcaatcgactcaagatccctcatgatcaaaacgaagaagctgattatcgacgtgatccgcaaccaacccggtaataccctcaccgaaatcctggaaaccccggcaaccgcacagcaggaagtcgatcacgccactgacatggtgagtagggctatgatcgatagccggacccctgaggaaatgaaacactcccagagcatgattgaagatgcacagttgcccctcgagcagaagaaaaggaagatccagcgaaatctgcggaccttggagcaaacaggccatgtctccagtgaaaacaagtaccaggacatcctgaatgagatcgcaaaggatattagaaatcagcgcatctaccggaaattacggaaagcggaactggcaaagttgcagcagacactcaacgccctgaataaaaaggcggctttctacgaagagcagataaactactatgacacttacataaaaacctgtctcgacaacctgaagcgcaagaatacccgccgctctatcaaacttgacggaaaaggcgaaccgaaaggtgcaaagcgggccaaaccggtaaagtacaccgccgccaaattacacgagaagggtgtgctgttagatattgacgacctgcagactaaccagttcaagaatgtgaccttcgatattattgctacagaagatgtcggaatcttcgatgttaggagcaagtttctcggtgttgagatggagaaagtgcaactgaacattcaggatttgctgcagatgcagtacgaaggggtagcagttatgaaaatgttcgataaagtcaaggtgaacgtcaatctgctcatttatttgcttaacaaaaagttttatggcaagtag

SEQ ID NO: 121184 - DNA, 1134 bp, Artificial Sequence
  Description of Artificial Sequence: Synthetic coding sequence
atggggtgtttcaaaggcgtcgttgccgtggggtatattaatgaggcaattgatgagggcaatccactccgcaccctggaaaccctgctcttaccaaccgctaatatttctgacgtcgatcctgcacacgcacagcactaccaggatgtgttgtatcacgctaagagccagaaactgggggatagcgagagcgtcagcaaggtactgtggctggacgagatacaacaggccgtcgacgatgcaaacgtcgacaaggacagagcaaaacaatgggtgactctcgtggtagatgtgaaccagtgcctggagggaaagaaaagctccgatatcctctctgtgctcaaatcaagtacctccaatgctaatgacattattccagagtgcgccgataaatactatgatgccttggtcaaggcgaaggagctaaaatcggagagagtgtcttccgatgggtcatggctgaagctgaacctgcataaaaaatacgattattattataacacagacagcaaggaaagctcctgggtgactcctgagagctgtttgtacaaggagtcatggttgaccgggaaagaaatcgaggatattatagaggaggtcacagtgggatatattcgggagaacatctggagtgcatcagaagagcttctattgcgtttccaggccaccagcagtggacccattctgcgggaggagtttgaggctcgcaaaagcttccttcatgagcaagaggagaacgtggtaaaaattcaggccttctggaaagggtataaacagaggaaggagtacatgcacaggagacaaactttcatcgataacacagactctatcgtgaagatccagtcgtggttccggatggccaccgcccggaagagctacctcagtcggcttcaatatttccgcgaccacaataatgagattgtcaagatacagtctctgttaagagccaacaaggcaagggatgattacaagaccctggtcggctccgagaacccacccctcactgtaataagaaaatttgtctatctacttgaccaatccgaccttgatttccaagaagagcttgaggtggccagacttcgagaggaagtagtgaccaagattagggcaaaccagcaacttgagaagacgtag

SEQ ID NO: 121185 - DNA, 3084 bp, Artificial Sequence
  Description of Artificial Sequence: Synthetic coding sequence
atggcccagaacactgagaaccacgacccggtcggttcaatattgattcagatccacgaggatttatatcagttaaaggaaaagctcacaaagttctcacctgaggaaaaaggggaaacccttgacatacaaagtcttgagacagctattaagcgtaccgaagtaggccttcgcattcatatcgaaaagtacctcaacgttgtaaaccagaatgtcctgaccacatcagtcaacgatgaatctctgtacacacctcaggcgagcaaatggctgttaccgactgtgatcgatcagaagagctttatatttccccaggagtctgagggcaccttctggcagccccagaggcagcactcgagcagcctgcctgtcttccccagggccaaaattaaggtgagcaagctgattaaggggagtaatatctctagtctgacagtgctgcctagttctcactgtactgatccatacttcaccccaatccctgttctccaggccgatgcccataagggcatcctgtccatgattgaaagggggctgattccacccactgctcgcataaccttccagaacccacccatcactccaagagctgcaccactccactcattcgacgaggcccgcaagatacctactgtggcaacattcaccatccccagagagccgccaccttcaccagctgaggtgaagttctttcccaagaagcagaggagcaaggggaagtcaaggagatctcgaggacatcacgatagaaaagcgatgaaggtgaagacacccttacgggccctgaagtccctttgggattatgatttcctgatctacgatggggtgatcgataacaccgctcctgacttcctggccttcaaggagcatttcagcctggcgtggggcggcatcttctctttacttgaacacgtcgaaaaatttctccggaattatgctattcccgaggtaaagattaagggcaacaacctggtcgctctgctgccagaattcgaacttacaaataagctcacacgctacgacctgctgtctgtgctggaggaccccgcgcatgtgcagatgctgatcaatttgcctggacagcgatacaagggacaggatggcaactcggaagccgcaatgaaaatccaagcaacttggaagtgttacaaggcacgtaagtttttccttttttacaggcagcagaaatgggccagtggggtgatcgccatcgcctggctgttatattgccacaagacccgtctcaaaaagattttaaaagagtcacgccagcgccacttagaaaactttcgtatcagagctaagcatctggccgccaattggaacaggatcagaacctctcggcgcaccattatccatattccttcactggggtattcacagccagtgagggagcacatagctgatttcaacacccagcagaatatgcagctaggtcgactctgtgatattctagacgctaatgtgaacgtaatctacatttgttcccaccacatgaacgacgagttagtgctctactacaaaaaaatcctgtctttgcacgctgcagtaaagtcaggtaacctcgaggacagatctgatctgcaggatcgctttaagattataactccggaagccgtaaatatatttcctaaacaccatatgtgtttggccactcacctgatgtactctccaaaggcaatcaaacgaataaagaatctcattcgggggaccgaggcatatattgtgtcagggttattgcaccgcgacgatctggccgtggccgacatgttagacattcccatccttggttctgaacccgaacttgctcacctatacagtactaaaagtgggggcaaaagggtgttcgactccgcaaacgtggcagtacccccaggaatttatgatatctactcacagcagcaaatgattgagcagctttcgcaactgataactgaccatctccaaatccagcgatggctctttaaaatggacagcgagtttcgtggaaacggcactgcattttgcgacatacctagctatctgaaatgctacaaatgggttttgaaagagagcagccgctacgggctggaggattggcgcaaaaagtgggctcaggaacctgccctcgtcaaaatctctgaagagcttgccggcatcctcgcccagcacgcccagcccgtgaacgaaaagcggtttcctacctggagaaagtttctgcagacttttctcagccagggcggggtgatcgaagccttccccccggccgacaacgtaactaacctgaccgtggacatgctgattgagccaaatggaaaaatctcagtgcttagtactggcgaccagctgcatgcagagagcccatttatttcctccggcaccacagtgccccagacttctgtggacccccaggtcctgacctatctttgtctgcagatcggcaaagcctgccgtatgagagacgttgtcggctacttcagcatcgacctcgttacttttatagaccctagcactctcgaacagcaggtttgggccacaggactgaatctggcatatagtgatcagttggccctcacccagctgactctttacttaacaaatgggcatctggactgctcacttagcacattggaggtgcctaggtttgtccccaaggagcgaaagaagacaaagtgcatgagcgccttgtccatgccaatgttggctactagtcgctacgccgttatgacaacacagcttaggcactctaatctcagtctggtctttcattacgtattcttgcagatttgtcgcgctcatggaattgggtacgacgtcgaagaacgccagggcactgtttttatactgtacgagcacttaaagcgccacaagctaggcatgttaactattggagaggacctgcagggcgtgctgatgacattcgcccgccacctgtttatcatccaccaggagatttctgcccccaacatgcagggagaaacgaatttcaagaccacaattgcggacattgaaactatcctgagggtaaccaaggagaacaagatgcggtttgaggaggagcaacagtcgaaggacgacaagaacctttcaaaacctaagaaatag

SEQ ID NO: 121186 - DNA, 2091 bp, Artificial Sequence
  Description of Artificial Sequence: Synthetic coding sequence
atgatcgagcggggcctgatccctcctacagcaaggataacctttcagaacccacccatcactcctcgtgccgcaccgttgcacagcttcgacgaggcccggaagatccccacagttgctacttttacaattcccagggagcctcctcctagccctgctgaggtaaaattctttcctaagaagcagcggtcgaaagggaaatccaggagatcgagaggacatcacgacaggaaggccatgaaggtaaaaactccacttagggcacttaaaagcctttgggattacgactttctgatttacgatggggtgatcgataataccgcccccgattttctggcattcaaggagcacttctctctagcctgggggggcatttttagtcttctggaacatgtggagaagtttctgcggaactatgcaattccagaggtaaaaattaaaggaaataacttagtggcgcttttgcccgaatttgagttaacgaataagctgaccaggtacgatctgctgagcgtgttggaggacccagcccacgtgcagatgctaattaaccttccggggcagcgatataagggacaggatgggaacagcgaggccgccatgaagattcaggcaacttggaagtgctataaagccagaaaattctttctgttttatcgccaacagaaatgggcgagtggagttatcgccatcgcttggctactgtactgtcacaagacgagactgaaaaaaatcctgaaggaatccagacagcgccacctcgaaaatttccgcatacgggccaagcacctggccgccaactggaatcgcattaggacatcaagacgaacaattatccacattcccagccttggctattctcagccagtgcgggaacacattgctgacttcaatacacagcagaatatgcagcttggcagactctgcgacattctggatgctaacgtgaatgtgatatatatatgttctcatcatatgaacgatgagttagtgttgtattataaaaagattctgagcttacacgcagctgtaaaatccggtaacttggaggacagaagcgatctccaggatcggttcaaaataattacaccagaggcagtcaatattttcccgatgatcgagcagttatcccagcttattaccgatcaccttcaaatccagagatggctgttcaagatggacagcgagtttaggggaaacgggactgccttctgcgatataccctcttacttgaaatgttacaaatgggtcttaaaggaaagttctagatacggcttagaagattggcggaagaagtgggcgcaggaacccgccttagttaagatttctgaagaactggccgggattcttgcacagcatgcccagccagtcaatgagaaacgattccccacttggcgtaaatttctgcagacattcctctcccagggtggcgtgattgaggccttccccccagcggataacgttacaaatttgactgtcgatatgctgattgagccaaacggcaaaatctcggtactgagcaccggcgaccaactgcatgccgaaagcccgtttatatcttctgggacgaccgttcctcagacaagcgtggatccacaagttctgacctatttgtgccttcaaattggcaaagcttgtcggatgagagatgtggtgggatacttttcaattgacttggtcactttcattgatccatctacactagaacagcaggtgtgggccaccggactcaacctggcttactcagaccagttagctctgacacaattaactctctacctgaccaatggtcacctcgactgctcgttgagcacccttgaagtgccccgtttcgtgcccaaagaaagaaaaaagactaagtgcatgtctgccttgtctatgccaatgctcgccacttcccggtatgccgtcatgactacccagctccgccattctaacctatctctggtatttcactacgtgtttctccagatttgtagagcacatggtatcggctatgacgtcgaaaacaacagaagaggatcccccggaggaccccatgatctctgttccccaagcttgcaccacccatccaggaatatctccacttag

SEQ ID NO: 121187 - DNA, 1866 bp, Artificial Sequence
  Description of Artificial Sequence: Synthetic coding sequence
atgactaaggccatgaaggttaagactcctctgagggcccttaaaagcctgtgggactacgactttctcatttacgacggagtgatcgataatactgcacctgattttttagccttcaaagaacacttctctctggcttgggggggtatattcagtttgctcgagcatgttgagaaattcctgaggaactacgctatccccgaggtgaagataaagggaaacaatctggtagcactcctgccagagttcgagctcactaacaagctcactcggtatgacctgctctccgtgttggaggacccagctcacgttcagatgctaattaaccttcccggccagagatataagggccaagatggcaactcagaagccgccatgaagatccaggctacttggaagtgctacaaggcccgaaagtttttcttattctacaggcagcaaaagtgggctagtggtgttatagctatcgcatggttgttgtattgccataagacccggcttaagaagatcctaaaggagtcacgccagagacatttagagaacttcaggatcagagcgaagcacttggcggccaactggaaccgaattcgcacaagccgccgcactatcatccacatacccagcctggggtactcccaacccgtgagggagcacattgccgactttaatacccagcagaacatgcagctcggaaggctatgcgacatactggatgctaatgtgaacgtcatctacatttgttcccatcacatgaacgatgaactggtgctgtattacaaaaagattctgtcattgcacgctgcggtgaagagtggaaaccttgaggatagatccgacctgcaggataggtttaagataatcaccccagaagcagtgaacattttccctatgatcgagcagctgagccaactgatcaccgaccacctccagatacagcggtggttgttcaagatggactccgaattcagaggtaacggcacagccttttgcgacattccctcctacctcaagtgctataaatgggtgctgaaggaaagcagccggtacggactcgaagactggcggaaaaaatgggcacaggaacccgccctggtgaaaattagcgaggagttagcagggattcttgcccaacacgctcagcctgtcaacgagaagcgcttccctacatggaggaagtttttgcagaccttccttagtcagggcggtgtgattgaggccttcccaccagccgataacgtgacgaatctgacggttgacatgttgattgagccgaacggcaagatctccgttctctctacaggcgaccagttacatgcagaaagtccattcatcagtagcgggacaacagtgcctcaaacttccgtagatccacaggtgctgacttacctgtgcctgcaaatcggtaaggcatgtcgcatgcgggacgtcgtcggctatttcagtatcgacttagtgacctttatagacccttccactctcgagcagcaggtttgggcaacaggactcaatcttgcctactctgatcaattggctcttactcagctaacactttatcttactaacggccacctagactgcagcctttctacactggaagtcccgagattcgtgcccaaggaaaggaagaagactaagtgtatgtccgctctgtcaatgccaatgcttgccacttctcggtacgctgtgatgacaacccagctgaggcactcaaacctgtcactggtatttcactacgtctttctgcagatatgccgggcacacggcatcggctacgacgttgagaataacagacgtggatcgccaggcggcccccacgatctgtgttctccctccctccaccacccctccagaaacatctccacatag

SEQ ID NO: 121188 - DNA, 2055 bp, Artificial Sequence
  Description of Artificial Sequence: Synthetic coding sequence
atgaaggtaaagaccccactgagggcactcaagagcctgtgggattacgattttctcatttacgatggagtgatagataacaccgccccagatttcctagccttcaaggagcatttcagtctggcctggggaggaatcttcagccttttagaacatgtggaaaagttcctgcgaaattacgcaatccctgaagtgaaaatcaagggtaacaatctcgttgcgctgctccccgagttcgagctgaccaataagctgacgcggtatgatcttttgtctgttctagaggatcctgctcatgtccagatgttgattaatctgcccgggcaacgctacaaaggtcaggacggcaacagcgaggccgccatgaagattcaggctacttggaagtgctacaaagcaagaaagttctttctcttttaccgccagcagaaatgggcaagtggtgtgatagcaatcgcatggctgctttactgtcacaagaccaggctgaaaaagatcctgaaggaatcaaggcaacgccacctcgagaactttaggatcagggctaagcacttagcagctaattggaacagaatcagaacttcgcgtagaacaatcattcacataccgtccctggggtactcacagcccgtacgtgaacatatcgctgactttaatactcagcagaacatgcagctagggcggctgtgcgacatcctggatgccaatgtaaatgttatatacatctgcagtcaccatatgaacgacgaactggtcttgtattacaagaaaattctaagcctgcacgccgccgtgaagtcaggaaatctggaggatcgaagcgacctccaggacaggtttaaaataatcacccccgaggctgtaaacatatttcctatgatagaacagctcagtcagcttatcacggatcacttacagatccaacggtggctgtttaaaatggattccgaattcagaggcaatggtactgcattttgtgacatcccatcatacctgaagtgctacaaatgggttctgaaggagtcgtcccgctacggcctcgaagactggaggaagaagtgggcacaagaacccgccctggtgaagattagcgaggaacttgccggaattctggcccagcacgctcagcccgtgaatgaaaagaggttcccaacctggcggaaattcctacagacattcctaagtcagggtggggttattgaggcatttcccccagccgataatgttaccaaccttactgttgatatgcttattgaaccaaatgggaaaattagcgttttatccacaggcgatcagttgcacgccgaatctccattcatctcaagcggaaccacagtaccacagaccagtgtggatccacaggtgctgacctacctctgcctgcagattggtaaggcttgtaggatgcgggacgtcgtgggctacttctctatcgatctggtcaccttcattgacccctccactttggagcagcaagtgtgggccaccgggctgaatctggcatatagcgaccagctggctcttacccagctgactctatacctcactaatggacacctagattgcagcttatccacgcttgaggtgcccagatttgtcccgaaagaaagaaagaaaactaaatgcatgagcgccctgtccatgcctatgttggctacttcacggtatgcggttatgaccacacagcttaggcactcgaatctgtccctggtctttcattacgtctttcttcagatctgccgggcccacggcatcggctacgatgtcgaagaacgccagggcacagtcttcattttatatgaacatctgaagaggcacaagctcgggatgcttacgatcggcgaagatctgcagggtgttttgatgacgttcgcacggcatctatttattatccaccaggaaatttcagcccccaacatgcaaggcgaaactaatttcaagacaaccatcgcagacattgagaccatcctgcgggtgaccaaggagaataaaatgaggttcgaggaagagcagcagtctaaagatgacaagaacctgagcaagcccaagaagtag

SEQ ID NO: 121189 - DNA, 507 bp, Artificial Sequence
  Description of Artificial Sequence: Synthetic coding sequence
atggcccagaatacagaaaatcacgaccctgtgggttccattctcattcagatccacgaggatttatatcagctgaaggaaaaactgaccaaattctcaccggaggaaaaaggcgagactttggacattcagagtctcgagactgcaataaagagaactgaggtgggacttcggattcatatcgagaagtacctgaacgtcgtcaaccagaacgttcttacaaccagcgtgaatgatgagtcactgtataccccgcaggcatccaagtggctgcttcccaccgtgattgaccagaagagtttcatattccctcaggagagcgaaggcactttctggcagcctcagagacaacatagtagctcccttcccgttttcccgagagccaaaagaaaaatcggactgaacgtcaaaattcttcaggatcccgaaaatatccaccatagagccgcagtgaacgctaattacggtatcagtctcccttatattaatcagcgcaaggcctgctag

SEQ ID NO: 121190 - DNA, 339 bp, Artificial Sequence
  Description of Artificial Sequence: Synthetic coding sequence
atgaggctggaagaattaaagcggttgcaaaatccactagaacaggtgaacgatgggaaatactcattcgaaaatcatcagctggccatggatgccgagaataacatcgagaaatacccattgaatctgcagcccttagagtccaaagttaagattatccaacgcgcttggcgagaatatctgcagcgtcaggagcccctggggaagaggagtccaagccctcccagtgtctcatctgaaaaactctctagttcagttagcatgaacacgttctcggacagctctacacctgtctctgtgatgtttctgttcctgtgtcctgatctgacattcaactag

SEQ ID NO: 121191 - DNA, 480 bp, Artificial Sequence
  Description of Artificial Sequence: Synthetic coding sequence
atgagactggaggagctgaagcggctgcagaatccacttgagcaagtaaacgacggaaagtactcctttgaaaatcaccagctagccatggacgctgaaaacaatatcgagaaatacccactgaatctgcaaccgcttgaaagcaaggtgaaaattatacagcgtgcctggcgtgaatatctgcagcgccaagagcctctgggaaagaggagcccttctcctccttcggtaagtagcgagaagctgtcttcatccgtatcaatgaacactttctctgattcaagcaccccttttgccagagcgccggtggggaagattcatccatacatctcctggcgattgcagagccccggggataagttaccaggcgggagaaaggtgattcttttgtacctcgatcagttggctcgccctacagggtttatccatacactgaaggagccccagatcgaacgcttgggcttccttactctgcagtag

SEQ ID NO: 121192 - DNA, 399 bp, Artificial Sequence
  Description of Artificial Sequence: Synthetic coding sequence
atgcgacttgaggagctcaaacggcttcagaatcctctagaacaagtaaatgacggcaagtattcattcgagaacattcagcgcgcttggagagagtatctccagaggcaggagccactgggcaaacgcagtccaagtcccccctcggtctcatccgaaaaactgtcttcaagcgtatcgatgaacaccttttctgattcttccaccccttttgcccgggcccccgtcggaaagattcacccatacatttcatggaggcttcaatccccaggagacaagttgcctggcggtcgcaaggtgatactgctttatttggatcaactggctagacccaccgggtttatccacaccctgaaagagcctcaaatcgagcgcctgggctttctgaccctccagtag

SEQ ID NO: 121193 - DNA, 2892 bp, Artificial Sequence
  Description of Artificial Sequence: Synthetic coding sequence
atggatgccccgaaggccggttatgcattcgagtatctgatcgaaacgttaaatgactccagtcacaagaagttttttgacgtgtcaaagcttggaacaaagtacgacgtcttgccctatagcatacgcgtcctgcttgaggccgccgtgaggaattgcgatgggtttttgatgaagaaagaggacgtgatgaatatcctggattggaagacaaaacagtccaatgtggaagtgccctttttcccggccagagtccttttacaagatttcaccggtatccctgcaatggtagacttcgcagctatgcgggaggcagtgaagactctggggggtgatccagaaaaagtgcacccagcgtgccccactgatctaacagtggatcactccctccagattgatttctccaagtgtgccattcagaacgctccaaatcccggcggcggggacctccagaaagctggcaagctctcccctgtgaaggtgcagcctaagaaattgccatgccggggacagactacatgcaggggaagctgtgattcaggggagctcgggcgtaactcaggaactttctcctctcaaattgaaaacaccccaatcttatgtccattccacctccagcctgtaccagagccagaaaccgttctgaagaaccaggaagttgaatttggaaggaatcgtgagaggctgcagttcttcaaatggtcatcccgggtgttcaaaaacgtggccgtgattccacccggcacgggcatggcacaccagatcaatctcgagtatctgtcgcgggtggtattcgaggagaaggatctcctgttccccgactctgtggtggggacagactctcacattacaatggtgaatggattaggtatcctgggttggggcgtgggtggcatcgagactgaggcggtgatgctgggcctccccgtctccctcacccttcccgaagttgttggctgtgagctgactggctcatccaacccatttgtgacaagcattgatgtggtgctggggatcactaagcacttaagacaggtgggtgtagcaggtaaatttgtcgaattttttggaagtggtgtgtcccaactgagtatagtggataggaccacgatagccaatatgtgccctgaatacggcgcaatactcagttttttccccgttgataacgtgacgctgaaacacctagaacataccggtttttctaaagccaaactcgaatccatggaaacatacctgaaggctgtaaaactgtttaggaatgatcagaatagtagcggagagccagagtatagccaggtcatccagataaaccttaacagtattgtaccatcagttagcggacccaaaaggcctcaggatagggttgcagtcaccgacatgaagtccgacttccaggcctgcctaaacgaaaaagtcggttttaaaggatttcagattgcagccgaaaagcaaaaagatatcgtgagcatacattatgagggatctgagtacaagctcagtcatggctctgtcgtgatcgccgctgttatttcttgcaccaacaattgtaacccaagcgtgatgcttgccgccggcttacttgctaaaaaggcggtcgaggcagggttacgggtcaaaccctatatccgcactagcctgtctcctggaagtggcatggtgacccactacctttctagcagcggcgtcctcccttatctgtccaagttgggtttcgagattgtgggctatggctgcagtatctgcgtgggaaacaccgccccactttcggatgccgtgctcaacgccgtcaaacagggcgatttggtgacttgcggtatcctatccggtaataaaaattttgaaggccgtttgtgcgactgcgtacgcgctaactacttagcgagtcctccactcgtggtggcttacgcgatcgccggaacggtaaatattgactttcaaactgaacctctggggacggatccaacggggaagaatatctatctgcacgacatctggccttcccgagaggaagtgcatcgtgtcgaggaggagcacgtgattttgagcatgttcaaggctctcaaagataagattgagatgggcaacaaacgatggaattccttagaggccccagactccgttctgtttccttgggatctaaaatccacctatatcaggtgtccaagcttctttgataagctgaccaaggagcctatcgcacttcaagcaattgagaacgcccacgtgctattgtacctcggagattctgtgacgaccgaccatatttcccccgccgggagcattgctcgcaatagtgctgcagcgaaatatctgaccaatagaggactcactccgcgtgagttcaacagttatggcgcacggagggggaatgacgcagtgatgactcgaggtaccttcgccaacataaaattatttaacaaattcatcgggaaaccggcccctaaaaccatccattttccatccggccagacactggatgtttttgaagcagccgaactgtatcagaaagaagggatcccgttaattatcctcgccggcaagaagtacggctctgggaatagcagggattgggcagctaagggcccgtatctgctgggcgtaaaggccgttctagcggagtcttacgagaagatccacaaagaccacctcattggaatcgggattgctccactgcagtttttgcccggcgaaaatgcagattctttggggctcagcggccgggagacttttagcttgacgtttcccgaagaactcagtcctggcatcaccctcaacatccagacttccactggtaaggtctttagcgtgatcgcaagtttcgaggacgatgtggagattaccctgtacaagcacgggggcctcctgaattttgtggcccgcaaatttagttag

SEQ ID NO: 121194 - DNA, 96 bp, Artificial Sequence
  Description of Artificial Sequence: Synthetic coding sequence
atggattacgttgaggataagcttagttcagagttcgtatttaataatccaaatatcaaggggacatgtggttgtggtgagtccttcaatatttag

SEQ ID NO: 121195 - DNA, 261 bp, Artificial Sequence
  Description of Artificial Sequence: Synthetic coding sequence
atgtcggcctcccttgtgcgggctaccgttagggccgtgtcaaaaaggaagttgcagcctacaagggcagcgctgaccctgaccccatcggctgtcaataagataaagcaactgctaaaagataaacccgagcatgtgggcgttaaagttggcgtccgtactcgggggtgtaacggtctatcatacaccctggagtatactaaaaccaaaggcgacagcgacgaagaggtgatccaggatgggtggagcgctgtcgtctag

SEQ ID NO: 121196 - DNA, 390 bp, Artificial Sequence
  Description of Artificial Sequence: Synthetic coding sequence
atgtctgcctcgctcgttcgtgccacagtgcgcgcagtgagcaaaagaaagttgcagccaacacgagccgctctaactctgaccccgagtgctgtgaacaagattaagcagctcttgaaggataagcctgagcatgtcggcgtgaaggtgggcgtgagaacacgaggttgtaacggcttatcttatacactggagtacactaaaaccaagggagattccgatgaggaagtgatccaggatggcgtccgagtgttcatcgagaagaaggcccagctcactctattggggactgagatggattacgtcgaggataagctgtctagcgagtttgtgttcaataatccaaacataaaaggaacctgcggatgcggtgaaagcttcaatatctag

SEQ ID NO: 121197 - DNA, 531 bp, Artificial Sequence
  Description of Artificial Sequence: Synthetic coding sequence
atggttgccgccgggggcggagctagaacagaaggcgcagtgagaaggagcttgtggcggcaatgcgcccggcgtgttcatggagagaaactaaggaggcctacttttggcccccggcaccggggggcggggacggccaaaatgtccgcctctttagtgcgggcaactgttagagcagtctctaaacggaagctgcagccgacgagggccgccctgaccctcactccatcagcagtcaataagatcaagcagctgctgaaggacaagcccgaacatgtcggggtcaaagtgggagtgagaacacgcggctgcaacggcctgtcgtataccttggagtatacgaagaccaagggcgactcagacgaagaagtcattcaggatggagtgagagtgtttatagaaaagaaagcacaattgacactgctgggaaccgaaatggactacgtggaggacaagctgtctagcgagtttgtgttcaacaatccgaatatcaagggaacttgtggttgcggggagtcttttaatatctag

SEQ ID NO: 121198 - DNA, 504 bp, Artificial Sequence
  Description of Artificial Sequence: Synthetic coding sequence
atggccgcagcaggagcgtttcggctcagacgggcagcgagcgcactgctgttgagaagccccagattgccagctcgcgagctatctgcaccggcacgtctttatcacaagaaggttgtcgaccactatgaaaacccaagaaatgtggggagcctggataagactagcaaaaacgtgggcacaggactagtaggagcacctgcgtgtggggatgtaatgaagctgcagatccaggtggatgagaagggcaaaattgtggatgcccgattcaaaacgttcggatgcggctcagcaattgcctcatcctccctagcaactgagtgggtaaaaggcaagacggtggaagaagccctgaccataaaaaacaccgatatcgctaaagagctctgcctgccccctgtcaagctccattgcagcatgctggcagaagacgcgataaaagcagcattagcagattataaactcaaacaggaacctaagaaaggagaagctgaaaaaaagtag

SEQ ID NO: 121199 - DNA, 390 bp, Artificial Sequence
  Description of Artificial Sequence: Synthetic coding sequence
atggtacttatcgacatgagcgtggatctgagcacgcaggtggtagaccattacgaaaatccgcgaaacgtgggctcactggacaagacctccaaaaatgtgggcaccggactggttggggcccccgcctgcggcgatgtcatgaaacttcaaatccaggtggacgaaaagggaaaaatcgttgacgctagatttaagacctttgggtgtggcagcgccatcgcatcttcctctcttgctacagagtgggtgaaaggcaagaccgtggaggaagccttaaccatcaaaaatacagatatcgcaaaggagctatgtctgccgcctgtgaagctccattgtagcaagtcggtcctgttccctgcagaggagaagacacagttaagcccctag

SEQ ID NO: 121200 - DNA, 429 bp, Artificial Sequence
  Description of Artificial Sequence: Synthetic coding sequence
atggtcctaatagatatgagtgttgacttgagcacccaggtggttgaccattacgagaaccccaggaatgtgggaagcctcgacaaaacatccaagaatgtgggcaccggcctggtcggagcacctgcctgtggcgacgtgatgaagctccagattcaggtggatgaaaagggaaaaattgtcgatgcccgatttaagacttttggttgcggaagcgctatcgcatcctcatcacttgctaccgagtgggtgaagggcaagaccgtggaggaggctttgacaataaagaacacggatatcgccaaagaactttgcctccctccggtgaagctgcactgctcaatgctggccgaggacgccattaaggctgcgctggctgactacaagctgaaacaggaacctaaaaagggcgaagcagagaagaaatag

SEQ ID NO: 121201 - DNA, 1443 bp, Artificial Sequence
  Description of Artificial Sequence: Synthetic coding sequence
atgtccttcccacaattgggataccctcagtacctgtccgccgccggccccggcgcctacgggggggagaggccaggtgtgctagccgctgcggccgcagccgctgccgccgctagcagtggccgcccaggcgccgctgagctcggcggcggcgctggcgccgccgccgttacatcagttctcggtatgtatgccgcggcagggccttacgccggggctccgaactactctgcctttttaccttatgccgcagatctgtctctgttctcacagatgggttcgcaatacgaactcaaggacaatcccggcgtgcatcctgccacattcgcggcccacacagcaccggcttattatccctatggacagtttcagtacggcgacccgggcaggcccaagaacgctactagggaatccacctctactttaaaggcttggctcaatgagcacagaaaaaatccgtatcctacgaagggagaaaaaataatgctggcgattatcacaaaaatgacacttacacaagtgtccacgtggttcgcaaatgccagaagacgcctgaaaaaagagaacaaagtgacctggggcgctaggtcaaaggatcaggaagacggggccctgtttggaagtgataccgaaggagaccccgaaaaggccgaagacgatgaagaaatcgacttggaaagtattgatatagacaagatagacgaacatgatggggatcaaagcaacgaagacgatgaggataaagcagaggctccccacgcaccagctgctccctccgccctggcccgcgatcaaggctcccccctggcagccgctgatgtcctcaaaccacaggattctccacttggcttagccaaagaggctcccgaaccggggagcaccagactgcttagtccgggagcagctgccggggggctacagggggcacctcacggcaaacccaagatctggtcgctggctgagaccgcaaccagtcctgacggcgctccaaaggcttcaccaccaccgcctgctggccacccgggtgcccacggaccatccgctggtgccccattgcaacatccagcattcctccccagccacggactgtatacctgtcacatcggaaaattttctaattggacaaatagcgcattcctggcacagggttccctgttaaacatgaggagctttcttggcgtaggcgccccacacgcagccccccatggcccacatcttccagcccccccccccccccagccgccagtggcaattgcacctggggccctgaacggggacaaggcgagtgtgaggagttcccctaccttacccgagagagacttggtgcctcggcccgattcccctgcgcagcaattaaaaagtccgtttcaacctgttagggacaacagtcttgccccgcaagaagggacacccaggatcctcgccgccctccccagtgcttag

SEQ ID NO: 121202 - DNA, 1416 bp, Artificial Sequence
  Description of Artificial Sequence: Synthetic coding sequence
atgtcatacccgcagggatacctttaccaggcaccaggctctctggccctgtactcctgccccgcgtacggggcatcggcactcgctgctccccgctccgaggagctagctaggagtgcatcaggtagcgcattctccccatatcctggcagcgcagctttcaccgcgcaagctgccaccggattcgggtctcccctccagtactccgccgatgcggctgccgccgctgccgggttccccagttacatgggcgccccttacgatgctcataccacaggtatgactggggcaatctcttaccacccatacggctcggcggcctacccataccaattgaacgaccccgcctataggaagaacgccactcgggatgccacggccacactcaaggcctggttaaacgaacatcgcaaaaacccctatccgactaaaggcgaaaagataatgctggcaatcatcacaaagatgacactaacccaggtcagcacatggttcgcgaacgctaggaggagacttaagaaagagaacaagatgacctgggcaccacgcaacaaatccgaagacgaggacgaagacgaaggcgatgcaactcgttctaaagatgagtctccagacaaagcacaggaaggaacagagaccagtgcagaagatgagggtatctcgttgcacgtggacagtctgaccgaccatagctgctccgccgaatccgacggggaaaagctgccctgtagggcaggcgatccactgtgtgagtccggttccgagtgtaaagataaatacgacgacctggaggacgacgaggatgatgatgaagaaggcgagagagggttggctcctccaaagccagtcacttcgagccctctgaccggactggaggccccactgctgtcgcctcccccagaggcagccccaaggggaggtcggaagacacctcaggggtcacggaccagccctggagctccacctccggcctcaaaacccaaactctggtccttggccgagatcgcaactagcgacctgaaacagccaagcctgggcccgggctgcggaccccccgggttgccagccgcggcagcccccgcttcgaccggcgctccccccggaggaagcccctaccccgccagcccgctgctgggtcgcccattatactatacatccccgttctatggtaactatacaaattatgggaacctgaacgctgcacttcagggccaaggtttgctgcggtacaattccgcggctgctgctccaggcgaggcccttcacaccgcacccaaggcagcgtccgatgctggaaaagcaggagctcatccactggaaagtcattacaggtcaccaggggggggctatgaaccaaagaaagacgcctcagagggatgtaccgttgtgggcggaggggtgcagccatacctgtag

SEQ ID NO: 121203 - DNA, 1416 bp, Artificial Sequence
  Description of Artificial Sequence: Synthetic coding sequence
atgagttacccacaggggtacctgtaccaggcacctggttccctagccctatactcatgcccggcctatggagcctctgcacttgcagctcctagatcagaggagcttgccagaagcgccagcggttccgccttctccccctacccaggatccgccgctttcaccgcacaggctgcaaccgggtttggcagccccctccagtatagcgccgatgccgcagcagcagccgctggctttccatcttatatgggcgctccctacgatgcccatacgaccggcatgacaggggcgatttcttaccacccctacggctcggctgcttatccttatcagctgaatgacccggcatacaggaaaaatgccacacgggatgccaccgccactttaaaggcatggttgaatgaacacagaaaaaacccataccctaccaagggggagaagatcatgctggccatcattactaagatgaccctgactcaggtctctacctggtttgctaacgctagacgacgcttgaaaaaggagaataagatgacttgggccccaaggaacaaaagcgaggatgaggacgaggatgagggggacgctacacggtctaaggatgaatcgccagacaaagctcaagaaggcacagaaaccagcgccgaggatgaagggatcagcctgcacgtggactccttgacggatcactcatgctctgccgagagcgacggagagaaactgccatgcagggcaggggatcccctgtgcgagtcaggaagcgagtgtaaggacaaatacgacgatctcgaagacgacgaggacgacgatgaggaaggagagcggggattagcccctcccaagcccgtgacctcttcaccacttacaggactcgaggcccctcttctttctccccctccagaggccgcccctaggggaggcaggaagaccccgcagggatctcgcacgagccccggggctccgcctcctgcatccaaaccaaaactgtggagcctggctgagattgcaacatctgatttgaagcaaccttcacttggaccaggctgcggccctcctggattacccgccgccgcggccccagcttccactggagccccccccgggggctctccttatcctgcaagtccattgcttggtcggcccctgtactatacatcacctttttatgggaactataccaattatggaaacttgaatgccgccctgcagggccagggcctgcttcgatataattcggcggcagctgccccaggagaggccctgcatacagcaccaaaggccgcctccgacgccggaaaggcaggtgcccatccccttgagtcacattaccgttctcctgggggagggtacgaacctaagaaagacgcctctgagggctgcaccgtcgtgggaggaggagtgcaaccatacctgtag

SEQ ID NO: 121204 - DNA, 1506 bp, Artificial Sequence
  Description of Artificial Sequence: Synthetic coding sequence
atgtcgtttccccaactgggatatcagtatatccggcccctctatccatctgagaggcccggagctgcgggggggtccggcggttctgccggggccaggggagggctcggggccggagcaagcgagcttaacgcctccggcagcttaagcaatgtactgtctagcgtgtacggcgcaccttatgcagctgcggccgccgccgccgccgctcagggctatggtgcgtttttgccttatgccgctgaactacctatcttcccccaactgggcgctcagtacgaactgaaagatagccctggtgtccagcatccagcagcggctgccgcttttcctcacccccatcctgcattctatccctatgggcagtaccagttcggcgacccttctaggccaaagaatgcgacacgcgagtcaaccagcaccctgaaggcctggttaaacgaacacaggaaaaatccatacccaactaagggcgagaagattatgttggctataattacaaaaatgacactgacgcaggtatctacctggttcgccaacgctaggaggaggctgaagaaagagaacaagatgacttgggcccctcgaagtcgaacagacgaggaggggaacgcttatggttctgaacgggaggaagaagacgaagaggaggatgaggaagacggaaagcgagagctggagctggaagaggaggaactcggcggggaggaggaggacaccggcggcgagggactggccgacgacgacgaagacgaagagatcgatctggagaatttagatggagccgccacagagcccgagctatccctggctggagcagctaggagagatggcgatctgggtcttggtccaattagtgactctaaaaatagcgactcagaagactcaagcgaagggttggaggataggcctcttcctgtcctaagcctggccccagctcctccacccgttgcagtcgcctcaccttcccttccttctccgcccgtgtccctcgatccatgtgcccccgcacctgctccggcctctgccctgcaaaagccaaagatatggagtctcgcagagactgctactagccccgacaatcccaggagatctcccccaggcgcaggtggttcaccacctggcgccgccgtagcgccatctgcgctccaactgtccccggcagccgccgctgctgccgcacaccgccttgttagcgcccctctcggcaagtttccagcctggacaaataggccttttccaggccccccacccggcccacgcctgcatccgctttcactcctagggtctgcccctccccaccttcttgggctgccgggggcagccgggcaccccgccgcagctgctgctttcgctcgacccgctgaaccagagggaggcactgaccgatgctccgctctggaggtggaaaaaaaacttctgaaaactgctttccagccagtgcctcgaaggccacagaatcacctagacgcagccctggttctctcagctctttcaagtagctag

SEQ ID NO: 121205 - DNA, 741 bp, Artificial Sequence
  Description of Artificial Sequence: Synthetic coding sequence
atgctgtggaggcagctgatctactggcaactgcttgcactcttttttctgccattttgtttgtgtcaggacgagtatatggagtcccctcagacaggaggtctgccacctgactgctccaagtgctgccacggcgactattctttccggggctaccagggtcctcccgggccaccagggccccccggtatccctgggaaccacggcaataacggcaacaacggcgcaaccggccacgaaggcgcaaaaggggagaaaggcgataagggggatctggggccaagaggagaaagggggcaacacggcccaaagggggagaaaggctatccagggatcccaccagagcttcagatcgctttcatggcaagtctggctactcacttttcgaatcagaactccggaattatatttagcagcgtggagacaaacatcgggaatttcttcgacgtcatgacaggacggttcggggcaccggtgtcgggagtgtacttctttacctttagcatgatgaagcacgaagacgtagaggaagtctatgtgtatctcatgcataacggcaataccgtgttctcaatgtattcttacgagatgaagggcaagtcagatacctcctctaatcatgctgttcttaaactcgctaagggggatgaggtgtggcttaggatggggaacggcgctctgcacggtgaccatcagcgattctccaccttcgcaggcttcctgctgtttgaaacgaaatag

SEQ ID NO: 121206 - DNA, 1560 bp, Artificial Sequence
  Description of Artificial Sequence: Synthetic coding sequence
atgtcctaccctcagttcgggtatccctacagctccgcaccgcagttcttgatggccacgaacagcctgtccacctgctgcgaatctggtggccggaccctggccgatagcggcccagccgcttctgctcaggctccggtctattgccccgtgtatgaatcgcggttgttggccaccgccagacacgagttgaatagcgccgccgcgcttggagtgtatggaggaccttatggtgggtcccagggatacggcaactacgttacatacggatccgaggcgagtgctttctactctctgaattccttcgacagtaaggacgggtccgggagtgcccacggggggctcgcgcccgcagctgccgcctactacccttatgagcctgctctagggcagtatccatatgatcgctacggcacaatggactctgggacgcggaggaaaaacgctaccagagaaacgacatctactcttaaggcttggctgcaggagcatagaaaaaatccctacccgaccaagggggaaaaaatcatgctggccataataactaaaatgaccctaacgcaagtgagtacttggttcgcaaacgcacggagaagattgaagaaggagaacaaaatgacatggcctcctagaaacaagtgcgccgatgagaagaggccctacgcagagggtgaggaggaggagggaggcgaagaagaagcccgtgaggagccattaaaaagtagcaagaatgcagaaccggtcgggaaagaagaaaaagaacttgagctttccgacctggacgattttgaccccctggaagcagagccaccagcctgtgaattgaagcctcccttccacagcctggacggtgggcttgagagggtgcccgctgcaccggacggacctgtgaaagaggccagcggtgctttgcgtatgtcactggccgccggcggtggcgccgccctggatgaagacttggagagggcccggtcttgtctgcgcagcgccgccgctggacccgagccactgcctggggctgaagggggtccccaggtgtgcgaggccaagttgggttttgtgcctgctggagcctctgccggtctcgaagccaagccacgtatatggtcattagcgcataccgcgactgccgcagctgccgccgcaacatctttatctcagacagagttccctagttgtatgctgaagaggcagggacctgccgcgcctgcagcggttagctccgcaccagcaacatccccctctgtggctctccctcatagcggtgcacttgacaggcaccaggactccccagtcacatctctgagaaactgggtcgacggtgtgtttcacgacccgatcttgagacattccacattgaaccaggcctgggctacagctaaaggcgcgctgttggaccctggacccctgggacgttctctgggagctggagccaacgtgctgaccgcgccactagccagggcattcccaccagccgtgccccaagatgctccagccgccggcgctgcccgagaattgttggctcttcccaaggctgggggtaaacccttttgtgcctag

SEQ ID NO: 121207 - DNA, 1560 bp, Artificial Sequence
  Description of Artificial Sequence: Synthetic coding sequence
atgtcatacccacaatttggctacccctattcctccgcaccgcagttcttgatggcaaccaacagcttgtcgacgtgctgcgagtcagggggcaggacactcgccgacagcggaccagcggcctcagcccaagctccagtgtactgtcccgtgtacgagagtagactcttggccacagcacgacatgagttaaatagtgcagcggcactgggtgtctatggaggtccatatggaggcagtcagggctatggaaactacgtgacatacgggagtgaagcctccgcgttttattccctgaactcttttgattcaaaagacggttcaggtagcgctcatggtggccttgccccagccgcagcagcttattacccttacgaacccgccttaggccaatatccatacgaccgttacggcactatggatagcggcactaggagaaagaacgctaccagagaaacgacgagtacattgaaagcctggctacaggagcaccgcaaaaacccgtatcccactaaaggcgagaagataatgcttgccatcattaccaagatgaccctgacccaagtgtcgacgtggttcgccaatgcaaggaggcgtctaaaaaaagagaacaaaatgacttggccgccacgcaacaagtgtgcagatgaaaaaagaccttacgccgaaggggaagaggaagagggcggagaagaagaggcacgggaggaacccttgaagagtagtaaaaacgcagaaccagtaggaaaagaggaaaaagagctcgagttgagcgacctggatgatttcgatccactggaggcagaacctccagcctgtgaactcaagcccccttttcacagtctggacggaggactggagagggtgcccgccgcgccagacgggccagtgaaggaagcctcaggtgccctgagaatgtcccttgccgccgggggcggcgctgctttagacgaggatctggaaagagcacggagctgcctgaggtcggcagctgccgggccagagcctctaccaggcgctgaaggtggtcctcaggtttgtgaggcaaaactcgggtttgtgcccgccggagcttcagctggattagaggcaaaacccagaatttggtcacttgctcacactgctacagctgcagcagcggccgcaacatctctctcccagacagagtttccgtcttgcatgttaaagcggcaggggccggctgcccctgccgccgtttcctctgcacccgccacatcaccatccgtggccctgccccacagtggagcactggatcggcatcaggattcgccggtcacctccttaaggaattgggtggacggagtgtttcacgaccccatccttagacattcaacactgaatcaggcctgggccacagcgaaaggtgctctgctcgaccccgggcctctgggacgatctctgggggcgggtgccaacgtgttgaccgcacccttggctagagcctttcccccagcggtgcctcaggacgcgccggctgccggagctgctagggagctgcttgcccttccaaaagcaggcgggaagccgttttgtgcttag

SEQ ID NO: 121208 - DNA, 1452 bp, Artificial Sequence
  Description of Artificial Sequence: Synthetic coding sequence
atgagctatccccaagggtatctatatcagcccagcgcatcactggccctatacagctgtcccgcttattctacgtcagtcatcagcggaccaaggactgatgagctcggaagaagctcaagtggtagtgcgttttctccctatgccggatcaacggcatttaccgctccatccccaggatataattcccatttgcagtatggagctgaccctgcagccgccgcggcagccgcgttttcctcctacgttgggtctccatacgatcacacccccggaatggctgggagcttgggataccatccttatgccgcgccgctggggtcttatccctacggagaccctgcctatcgaaagaacgccacacgggacgcaacagcgaccttgaaggcctggcttaatgaacatcgaaagaatccctacccgactaagggggaaaaaatcatgttggcaatcattacaaagatgacactgacccaggtgtcaacttggttcgccaatgcacggcggcgcctcaagaaagagaataaaatgacatggaccccgagaaaccgtagtgaagatgaagaagaggaggaaaatattgacctcgagaagaacgatgaagatgaacctcagaagcctgaagataaaggggatccagaaggcccggaggccgggggcgctgaacagaaggccgccagcggatgtgagaggctgcagggaccccctactccagcaggaaaggaaaccgagggctcattaagcgattcagacttcaaggaaccaccgtcggaagggagactggacgcccttcaaggacctccaaggacaggaggcccctctccggccggtccggccgcagccaggctagctgaggatcctgctccccactatcctgcaggcgccccggctccggggccgcatccagctgctggtgaggtccccccaggtcccggggggccttctgttatacactcccccccacccccgcctcctccagcagtcttggctaagcctaagctgtggagtttggccgagattgccacaagcagcgataaggtcaaggatgggggtggggggaatgaagggagtccttgccccccttgtcctggtcctattgctgggcaggccctgggcgggagccgggcgagtcctgccccagcaccgtctcgaagcccctctgcccagtgcccttttcctgggggcaccgtgctatctagacccctgtactacaccgcccccttttatcctggctatactaactacggaagcttcgggcaccttcatgggcatccaggtcctggcccagggccgaccaccggtcccggcagccattttaacgggctgaaccagactgtgctcaacagggctgacgctctcgcaaaggaccccaagatgctcaggtcccagtctcagttagatctgtgtaaagacagcccatacgaattgaagaaggggatgagcgacatttag

SEQ ID NO: 121209 - DNA, 441 bp, Artificial Sequence
  Description of Artificial Sequence: Synthetic coding sequence
atgtcctacccgcaggggtacctgtaccagccgtctgcttcccttgcactttatagctgtcctgcttacagcacttccgtgatctctggccctagaaccgatgagcttggtcggtcctcaagtggcagtgcatttagcccatatgcgggcagtactgcatttacagcaccaagccctggctacaacagtcaccttcagtacggcgctgatcccgccgcagctgctgcagcagcattctcatcatacgtcctgctgaaaaaggagaagaagtctctcgactttccatgtttccccccacttcgcccaacatgtgtgagatctcccgccgaaaggggcgtcgcaagtgtcgcccaggccagcatctgcatggagggtagggccgcagtggcccgttctgcccatgggggaagtccttacgcccacagagttcccggcccatag

SEQ ID NO: 121210 - DNA, 498 bp, Artificial Sequence
  Description of Artificial Sequence: Synthetic coding sequence
atgggctgggatctaactgttaagatgctcgcagggaacgaattccaagtgtccctgtccagctcgatgagtgtgagcgagctgaaagctcaaataactcagaagataggagtccatgcatttcagcagcgcttggcagtccacccgtcgggagtagcacttcaagaccgcgttccactcgcgtcccaggggcttggtcctggatctactgtgttgctggtggtggataagtgcgatgagcctctcagcattctggtgagaaataacaaagggcggtctagcacttatgaagtgcgcctgacccagaccgtggcccacctgaaacagcaggtgtctgggctggagggggttcaggacgacctcttctggctgacttttgaaggtaaacccctggaagaccagcttcctctaggggagtatggcctgaaacctctctccacagtcttcatgaacctacggttgaggggcggagggaccgaacccggaggcagatcatag

SEQ ID NO: 121211 - DNA, 3129 bp, Artificial Sequence
  Description of Artificial Sequence: Synthetic coding sequence
atggcagacgcattcggggatgagctgttcagtgtgtttgagggagactccaccaccgcggccggaacgaagaaggacaaggagaaggacaaagggaagtggaaaggacctcctggtagtgccgataaggccggcaaacgattcgatggcaaactgcagagtgagagtaccaataatggaaaaaataagcgcgatgttgatttcgaaggtactgacgagcccatctttgggaagaaacccagaattgaggagtcaatcaccgaggatttgtccctcgctgatctgatgccaagggttaaggtgcagagtgtggagactgttgaaggttgtacacatgaggtggccctgcccgctgaggaagactatcttccacttaaacctcgcgtaggcaaagccgctaaggagtatccctttatcttggacgcattccagagggaagctatccagtgtgtggacaacaaccaatccgtgctcgttagcgcccacacttctgccgggaaaactgtctgcgccgagtacgctattgcactcgccctgcgggaaaagcagcgagtgatcttcaccagtccaattaaagccctgtccaaccagaaatatagggagatgtacgaggaattccaggacgtggggttaatgaccggggacgtgactatcaaccccactgctagttgtctggtcatgacaactgaaatcctgagaagtatgctgtacaggggttctgaagtcatgagagaggtagcgtgggttatcttcgacgagattcactatatgcgtgattctgagcgtggggtggtgtgggaggaaaccatcatcctgttgccagacaacgtacactacgtcttcctgtctgctactattcctaatgccaggcagtttgcagagtggatctgtcatcttcacaagcagccttgccatgtgatttacaccgactatcgtcctacgcccctgcaacactacatctttcctgcgggaggcgacgggcttcaccttgtggtggacgagaacggagacttccgggaagataattttaacactgccatgcaggttctaagagacgcaggcgatcttgccaagggggatcagaaaggacgcaagggcggcaccaagggaccctctaacgtattcaagatcgtgaaaatgataatggagcggaatttccaaccagtgatcatttttagtttctcaaaaaaagactgtgaagcatacgcactacagatgactaaactggatttcaataccgacgaggagaaaaagatggtggaagaggtgtttagtaacgctatagattgtctgtctgatgaggacaaaaaactcccacaggttgagcatgtgctgcctctcctaaagaggggcatcgggatccaccatggcggtctgctgccaatcctgaaagagaccatagagatactcttcagcgagggcctcatcaaagccctattcgcaacagaaacgttcgcgatggggattaacatgcctgctcgcacggtcctgttcaccaacgcccggaaattcgacgggaaagactttaggtggatttctagcggggagtatatccagatgagcggcagggcgggccgccgcgggatggatgatcgcggtattgtgatactcatggtcgacgaaaagatgtcacccaccattggaaagcaactgcttaagggaagtgctgatcctctgaattctgccttccacctgacatataacatggtgctgaatctcttgagagtcgaagaaatcaaccccgagtacatgctggaaaaatccttttaccaattccagcactatagggccatacccggggtggttgagaaagtaaagaatagcgaagagcagtacaataagatagtgattcctaatgaggaatccgttgtcatctactacaagattagacagcagcttgccaagcttggtaaggagatcgaagagtacattcacaagcctaagtactgcctgccttttctccagccagggaggcttgtgaaagtgaaaaatgagggagacgatttcggatggggcgtcgtagtgaatttctctaagaagagcaacgtgaagcctaactcaggggagctcgacccattgtatgtagtagaagttctgctccgttgctcaaaagaatccttaaaaaacagcgctaccgaagccgctaagcccgccaaaccagatgagaagggggaaatgcaggtcgtcccagtgctggtgcatctgctcagcgcaatctctagtgtgcggctgtacatccctaaggatcttcgtcctgtggataacaggcagagcgtcttaaagtccatccaggaggtgcaaaaaagatttcccgatgggatccctttgctggatcccatagatgacatggggattcaggaccagggtctgaagaaagtgattcagaaggtagaagcttttgagcaccgcatgtactcccatccattgcacaatgacccaaacctggagacagtttacactttgtgcgaaaagaaagcccagatcgcaatagacataaagtccgcgaagagggagctcaagaaagcaagaaccgtcctccaaatggacgaacttaagtgccgaaagagagtcctaagacgtctgggcttcgccacctcctcagacgtcattgaaatgaaaggtagagtcgcttgtgagattagttctgctgacgagctgttactcaccgaaatgatgtttaacggcctgttcaatgacttgagcgcagaacaggccactgcactcctcagctgcttcgttttccaggagaacagctcagagatgcccaaattgactgagcaactggcgggcccactcagacagatgcaggaatgtgcaaaacgtatagccaaagtaagcgcggaggcaaagttggaaatcgatgaagaaacctacttgtcctccttcaagccacacctaatggacgtcgtctacacatgggccacaggagcgactttcgcccatatctgcaaaatgacggacgtgtttgagggctccatcataaggtgtatgaggagactggaggagttgcttcgccagatgtgccaggcagccaaggcaatcgggaataccgaactggagaataagtttgccgaaggaatcacaaagattaaaagagacatagtgttcgccgccagcctgtatctctag

SEQ ID NO: 121212 - DNA, 981 bp, Artificial Sequence
  Description of Artificial Sequence: Synthetic coding sequence
atgggcgatatgggcgaccctccgaaaaaaaaacggctcataagtctttgcgtgggctgcggtaaccagatccatgatcagtatatcctgcgtgtctccccagacctggagtggcacgcagcttgtctcaagtgcgcggaatgtaaccagtatctagatgagagctgcacctgttttgtgcgcgatggaaaaacctactgcaagcgcgactacataaggctgtatggtatcaaatgtgctaagtgctcaatcggcttttcaaagaatgactttgtgatgcgcgccaggagcaaagtttatcacattgagtgttttcgctgtgtcgcctgtagtagacagcttatacccggcgacgagttcgccttgcgagaggacggactgttctgcagggcggaccatgacgtcgtcgagcgggccagcctgggcgccggagacccactgtccccgctgcatccggctcgaccgctgcagatggcggctgaaccgataagcgctagacagcccgcattgaggccgcacgtccataagcagcctgagaaaaccaccagggtgcggacggttctgaacgaaaagcagttacataccctgaggacttgttatgccgctaacccaaggcccgacgccctgatgaaggaacagctggtggagatgaccggtctgagccccagagtaatccgcgtgtggtttcaaaacaagcggtgcaaagacaagaaacgctcaatcatgatgaagcagctacagcagcagcaaccaaacgataagaccgcgaatcctgtagaagtgcagagttatcaacctccctggaaagtgctaagtgactttgctcttcagtccgatatcgaccaaccagcctttcagcagttggtgaatttttccgagggcgggcctgggtccaactctactgggtctgaagtggccagcatgagtagccaactccccgacactcctaattctatggtggccagccctattgaggcatag

SEQ ID NO: 121213 - DNA, 270 bp, Artificial Sequence
  Description of Artificial Sequence: Synthetic coding sequence
atgggtatcctgaagctacaagtatttctgattgtcttgtctgtagccctgaatcacctgaaagccactcctattgagtcgcatcaagtggagaaacggaaatgtaatacagcgacatgcgccacacagcgcctggcaaactttctggttcatagcagcaacaattttggcgctatcctatccagcacaaacgtaggctctaacacatatggcaagagaaacgctgtggaagtgctaaaacgagagcccctgaactacctacctttgtag

SEQ ID NO: 121214 - DNA, 240 bp, Artificial Sequence
  Description of Artificial Sequence: Synthetic coding sequence
atggggatattaaagctgcaagtcttcctcatcgtgctgtcagtggccttgaaccatttgaaagccacacctatcgaatctcatcaagtcgagaaaagaaagtgtaataccgcaacatgcgcaacccaaagactggcaaactttcttgtgcattcatcaaacaatttcggagcgatactgtcttctacgaatgttggttcaaacacttatggtaaacgtaatgccgtagaagtgttgtag

SEQ ID NO: 121215 - DNA, 270 bp, Artificial Sequence
  Description of Artificial Sequence: Synthetic coding sequence
atgggaattctcaaactgcaggtgtttcttattgtgctctcagttgctctcaatcatttgaaagcaaccccgatagagagccatcaggtcgagaagaggaagtgtaatacagcgacttgcgctacccaaaggctcgccaacttcctcgtgcatagttcaaataattttggagctatcctatcttcaacaaatgtgggcagtaacacttatgggaagagaaatgctgttgaagtgctgaagagagagcccctaaattacttacctctgtag

SEQ ID NO: 121216 - DNA, 1449 bp, Artificial Sequence
  Description of Artificial Sequence: Synthetic coding sequence
atgtcaggccacaaatgctatccttgggatttgcaggaccggtacgctcaagataagagtgtcgtcaacaaaatgcaacagaaatattgggagaccaaacaggccttcatcaaagctactggaaagaaggaggacgagcacgtcgtggctagcgacgctgatcttgatgcaaagctcgagctgttccactctatccagcggacgtgcctggatctttccaaagctattgtgctgtaccaaaagcgtatctgctttctttctcaagaggagaatgaacttggtaaattccttaggtcacagggctttcaggataagacaagagcgggcaagatgatgcaggcgaccgggaaggcactgtgcttctcttctcagcagcgcctggcccttcgcaaccccctgtgccggtttcaccaggaggtagaaactttccgtcaccgcgccatctctgacacttggctgacagtgaacaggatggagcagtgccgcaccgaatacagaggcgcgttactgtggatgaaggacgtgtcgcaagagcttgatcctgacctgtataaacaaatggaaaagttcaggaaagtccagacccaggtgcggcttgccaagaagaactttgacaaactgaaaatggatgtctgccagaaagtcgatctcctgggcgcctctcgctgcaatctcctgtcacacatgctcgccacctaccagactaccctcctgcacttttgggagaagacgtcacatactatggcagccatacatgagtcattcaaaggctatcaaccctacgagttcaccacgctcaaatctctccaggatcccatgaaaaagctggtcgagaaagaagaaaaaaagaagatcaaccagcaggagtctactgatgcagcggtccaggagccttctcagttgatctctctcgaggaggagaatcagcggaaggagagtagttcgtttaaaactgaggatgggaagtcaatcctgtccgcacttgacaaagggagtactcacacagcatgttcggggcctatcgacgaattactcgacatgaagagtgaggagggggcatgcttgggaccggtggcgggtacccccgaacctgagggcgccgacaaagatgacctgttattgctctctgaaatattcaatgctagctccttagaggaaggtgaattcagcaaagaatgggctgccgtgttcggagatggacaggtgaaggagcctgtcccaacaatggccctgggcgaacccgaccctaaggctcagacaggtagcggttttctgccctcgcagctgttggaccaaaatatgaaggacctccaggcgagcctccaggagccggcaaaggccgcatctgatctgactgcctggtttagcctctttgctgacttagatccattgagcaatcctgatgccgtaggaaaaacggataaagaacacgagctgttgaatgcgtag

SEQ ID NO: 121217 - DNA, 774 bp, Artificial Sequence
  Description of Artificial Sequence: Synthetic coding sequence
atgagtgggcataaatgtagctacccatgggatttgcaggaccgttacgctcaggataagagcgtggtgaacaagatgcaacagaaatattgggaaaccaagcaggcctttattaaagctacgggaaaaaaggaggatgaacacgttgtagcttccgatgccgacctggacgccaagcttgaactcttccattccatacagcggacatgcctggatctctccaaggcaatcgttctctatcagaaaaggatctgttttcttagccaggaggagaacgaactgggaaaatttttacgctctcagggatttcaggacaagacccgcgcaggaaaaatgatgcaagccacgggtaaggccctgtgttttagcagtcagcagcgactggccttaagaaaccccctgtgccgctttcaccaagaggtagagaccttccgccatcgagccatatccgatacttggctcacagttaaccgcatggagcagtgccgtaccgagtaccgcggggctttgttatggatgaaggatgtgtctcaggagctcgatccagatctgtataagcagatggagaagttccggaaggtgcaaactcaagtgagactggccaagaagaattttgacaagctaaagatggacgtgtgtcaaaaggtcgatctcctaggcgccagtcgttgcaacctgctcagccacatgctggctacctaccagcttgcatgggatcagtggcagggcccacgaaacctcaaagttctgacaaaaatgacgtgctgctgttag

SEQ ID NO: 121218 - DNA, 1452 bp, Artificial Sequence
  Description of Artificial Sequence: Synthetic coding sequence
atgtccggccacaagtgtagctacccttgggacctccaggatcggtatgcgcaagacaaaagcgtggttaacaaaatgcaacagaagtattgggagactaaacaggctttcattaaagcaaccggcaaaaaggaggatgagcatgttgtggccagcgacgctgatttggacgctaaactggagcttttccacagtattcagagaacttgcctggacctgagcaaggccatcgtgctgtatcagaagcggatatgcttcctttcacaggaggaaaatgaacttggaaaatttctgcgatctcaaggattccaagacaaaactcgcgccggaaaaatgatgcaggctaccgggaaggccttgtgcttttcaagtcagcagagattagcactcaggaaccctctgtgtcggttccatcaagaggttgagaccttcagacatcgggcaatcagcgacacctggttgaccgtgaaccgtatggaacaatgcagaaccgagtaccgcggcgcacttctgtggatgaaggacgttagccaagagttggacccggatctctataaacaaatggagaagtttcgtaaggtccagacccaggttcgcctggcgaagaaaaacttcgataagctcaagatggacgtgtgccaaaaggtcgacctgctgggtgcctctcgttgtaatctgctcagtcacatgcttgcaacgtatcagactaccttgctgcacttctgggaaaagacctcacatacaatggcagctatccacgaatcttttaagggttaccagccctatgagttcactactctaaagtctcttcaggaccctatgaagaagctggtcgaaaaagaggaaaaaaagaagatcaaccagcaggagagtactgatgctgcagtgcaggagccctcccagctgatctcactggaggaagagaatcagcgcaaggagtcttcttcatttaaaacagaagacggtaaatccattttaagcgcgctggataaaggatctacccatacggcatgttcgggaccgatcgacgaactgttagatatgaaaagcgaagagggcgcttgcctgggacccgtcgctggcaccccggagccggagggtgctgacaaggatgatctccttttgctctctgaaatcttcaacgctagctcattggaagaaggagagttcagtaaggaatgggctgcagttttcggcgatggacaggtaaaagagcccgttccaactatggcactaggggagccagatcctaaagcacagacaggtagtggatttttgcccagtcagttgttggaccagaacatgaaggacctccaggccagtcttcaggagcctgcgaaggcagctagcgacctcaccgcgtggttcagccttttcgcagacctcgacccgctgagcaaccctgacgcagtcgggaagaccgataaagagcatgagctactgaatgcctag

SEQ ID NO: 121219 - DNA, 1452 bp, Artificial Sequence
  Description of Artificial Sequence: Synthetic coding sequence
atgtcagggcataagtgttcgtacccatgggacctgcaggaccgctacgcgcaggataagagcgtggtgaacaagatgcagcaaaaatactgggaaacaaaacaggcattcatcaaagcgacggggaagaaagaagatgagcatgtagttgcatccgacgccgaccttgatgcaaagcttgaattatttcatagcatccagaggacatgtctagatctgtcaaaggccattgtcctgtaccagaaacgaatctgtttcctgagccaggaggaaaacgaactggggaaattcctcaggagccaggggttccaggacaaaacccgagccggaaaaatgatgcaggcaaccggcaaagctctgtgtttttccagccagcaacgactggctctgcgaaaccccctctgccgatttcatcaggaggtcgaaacttttcggcaccgtgcgatttcggacacctggctcacggtgaaccggatggagcaatgtagaaccgagtatcgcggagccttactgtggatgaaggacgtttctcaggaactagatcctgacttgtacaagcagatggagaaatttaggaaagtacagactcaagtgcgcctcgcgaagaaaaactttgacaaattgaagatggacgtgtgccagaaggtggatcttcttggagccagtaggtgcaacctcctatctcacatgctggctacataccaaacaacgcttctccatttttgggagaaaacttcacataccatggctgccatccatgaatccttcaagggctatcaaccctacgagttcaccaccttaaagagtctgcaggaccctatgaagaagctagtagagaaggaggagaagaaaaaaataaatcagcaggagtctaccgacgctgccgtacaggaaccatcccagcttatttctctggaggaagaaaaccagaggaaggagagcagcagcttcaagactgaagacgggaagagcatacttagcgccctggacaagggctctacccatacagcctgctcgggcccgatcgacgagctcctagatatgaaaagcgaggagggtgcctgcttagggccagttgccgggacccctgagccggagggggccgataaggacgatttgctcttgctatctgagattttcaacgctagctccttggaggaaggcgaatttagcaaggagtgggcggcggtgtttggtgatggacaggtgaaggagccggtgcccacgatggccctgggtgagccagatcccaaagctcagaccggtagtggatttctgcctagtcagctgcttgatcagaatatgaaggacctccaggcaagcctgcaggaacccgccaaggcagcatccgatcttaccgcatggttctccctgtttgcagacttggaccccctgtctaatcctgacgccgtgggaaagacggataaggagcatgaactgctcaatgcttag

SEQ ID NO: 121220 - DNA, 1452 bp, Artificial Sequence
  Description of Artificial Sequence: Synthetic coding sequence
atgtccggacataaatgtagttacccttgggatttgcaagaccgatacgctcaggataagtcagtggtgaacaaaatgcagcagaaatattgggaaactaaacaggccttcataaaggcaacaggaaaaaaggaggatgagcacgtggttgcttccgacgctgatctagatgctaagctggagctttttcactccatccaacgcacctgcctggatctctcaaaggccatcgtgctttaccaaaaaagaatctgcttccttagccaggaggaaaacgaactcgggaagtttctccggtctcagggcttccaggacaagaccagagccggcaaaatgatgcaagctaccggcaaggctctgtgcttcagtagtcagcagcggctcgcccttagaaaccctctgtgtcgctttcaccaggaggtagagacttttaggcatagggcgatcagtgatacatggctgacagtcaatcggatggaacagtgccgtactgaataccgtggagcattactatggatgaaagatgtatctcaagaactcgaccccgatttgtacaagcagatggagaaattccggaaggtgcagacacaggtgcgccttgccaagaagaacttcgacaagctcaagatggatgtttgtcagaaagtagatctgctaggggcatcgcggtgtaacctgctgagccacatgctggcaacttatcagactaccctcctacatttttgggagaagaccagccacacgatggcggctatccacgaatcatttaagggatatcagccctacgagtttacaacactgaagtccctgcaagaccctatgaagaaactcgtggagaaggaagagaagaaaaagataaatcagcaagaaagcaccgatgccgctgtgcaggagccatcccagctgatttccctcgaagaggagaatcagaggaaagagagttcttcctttaaaacagaagacggtaagagcatcttatccgccctggacaaagggtctactcacacagcatgctcaggtcccattgacgagctgcttgacatgaagagtgaggagggtgcttgcctagggcctgtggccggaacccccgagccagagggagccgataaggacgacctgttactcttgtccgaaattttcaacgcctcaagtctggaggagggggagttctctaaagagtgggcagccgtgttcggagacgggcaggttaaggaacctgtgcctacgatggctcttggcgagccagaccctaaggcacagacgggatcggggttcttgccttctcagctgctggaccagaatatgaaagatctgcaggcaagcctgcaggagcccgccaaagctgcgtctgatctaaccgcctggtttagtctgttcgccgatttagatcctctgtccaacccggacgctgtgggtaagacagataaagagcatgaactgttaaacgcttag

SEQ ID NO: 121221 - DNA, 1539 bp, Artificial Sequence
  Description of Artificial Sequence: Synthetic coding sequence
atgagcggccacaagtgctcgtacccctgggacctgcaggaccgctatgcccaagacaagagcgtagttaacaaaatgcagcaaaagtattgggaaacaaagcaggcttttatcaaagctactgggaaaaaggaagacgaacatgtcgtggcgtctgacgccgatctggatgcaaagctcgagcttttccacagcatccagcggacatgtctggatctgtctaaagctatagtactctaccaaaaacggatctgcttcttgagtcaggaggaaaacgagcttggcaagttccttcgcagccaggggttccaagataaaacaagggccgggaagatgatgcaggcaaccgggaaagccttgtgcttcagttcccagcagcgcctggctctgagaaatccactgtgccgcttccaccaggaggtggagactttccgacaccgtgctatctccgacacgtggctgacagtgaacagaatggagcagtgccgcacggaatatcgcggagccctgctttggatgaaggacgtgtcacaagaactggacccagacttgtataaacagatggagaagttcaggaaggtccagacccaggtgaggcttgcaaaaaagaacttcgataaattgaaaatggatgtgtgccagaaggtggacctattaggagcgtctcgctgcaaccttctcagccacatgcttgccacgtaccaaactactctgctgcatttttgggagaagacatcccacacaatggcagccattcacgaatccttcaagggctaccagccatatgaattcaccaccctgaaaagcctgcaagaccccatgaagaagctggtggagaaagaagaaaagaagaagattaatcagcaggagtcaactgacgcagctgtccaagaaccctctcagtatctacagaatatttgtctggaaatgaaggcaaactccgatatcaagatgttgcagaagggcaaagagggacagcaaatagggattctgatcagcttggaggaggagaaccagcgcaaggagtcctcttcttttaaaactgaggacgggaaaagcatcctgtccgcactcgacaaggggtccacccatacagcctgctccggccctatcgacgagctgctcgacatgaagagtgaggagggtgcatgcctgggccctgtggcaggcacaccagagcctgaaggggcagataaggatgaccttctgctgctctctgaaattttcaacgcctcaagtttggaggagggcgaatttagcaaagaatgggctgctgttttcggagatgggcaggtaaaagaacctgtcccgacaatggcccttggagaaccagacccaaaagcacagacagggagcggcttcctgccatcacagctcttggatcagaatatgaaggatctccaagccagtcttcaggagcccgccaaagccgcatctgatcttacggcttggtttagtctgtttgctgatctggatcccctctcaaatccagatgctgttggaaagacggataaggagcatgaactgctaaatgcttag

SEQ ID NO: 121222 - DNA, 405 bp, Artificial Sequence
  Description of Artificial Sequence: Synthetic coding sequence
atgtcgggccataagtgttacccctgggatcttcaggaccgttacgcacaagacaaatctgttgtcaacaagatgcagcaaaagtactgggaaactaaacaggcatttattaaggccaccggaaagaaagaagacgagcacgtggtcgcctcggacgccgatctggacgcaaagctggagttgtttcattccattcagcggacttgcctggatctatctaaggcaatcgtcctgtaccagaaaagaatctgcttcttgagccaggaagagaatgagcttggcaagttcctgaggtcccagggcttccaggacaaaacgcgagccggtaaaatgatgcaggctacgggcaaagcactgtgtttctcctcccagcagagactggcgctgaggaaccccctttgctag

SEQ ID NO: 121223 - DNA, 489 bp, Artificial Sequence
  Description of Artificial Sequence: Synthetic coding sequence
atgagcgggcacaagtgctcatatccatgggacctgcaggatcggtacgcccaggataagagtgtcgtgaacaagatgcaacagaagtattgggagaccaagcaggccttcatcaaggcaaccgggaaaaaagaagatgagcacgttgtcgccagtgacgcagacttagacgccaaactggagcttttccactccattcagcggacctgcctcgatctttccaaagctattgtcctttaccaaaagaggatctgtttcctgagccaggaagaaaacgaactgggaaagttcctacgcagtcagggattccaggacaaaacacgcgccgggaaaatgatgcaggcaacaggaaaggcactgtgtttctcttcccagcagaggctggccctccggaatcccttatgcagattccaccaggaggtggaaacgttccgacacagagctatatctgatacatggctcaccgtaaacaggatggagcagtgctag

SEQ ID NO: 121224 - DNA, 666 bp, Artificial Sequence
  Description of Artificial Sequence: Synthetic coding sequence
atggctgcggcgagaccctccctcgggagggtcctccctggaagctccgtgctgtttctctgtgatatgcaggagaaatttcgccacaatattgcttactttcctcagatcgtaagcgtggccgcccgcatgttgaaagtagcacgcctgcttgaggtccctgtcatgcttacagaacagtacccccagggcctgggtccaaccgtgcccgaactgggcaccgaggggttgcgacctctggctaaaacttgcttttccatggtacctgctctgcaacaggaacttgattcaagaccccagctgaggtcagtgctgctgtgcggaatcgaggctcaggcatgcatactcgacccaaggtcatacccaggcctggcgctgactagcctatacccacagaacaccactctggacctgctagataggggacttcaggtacacgtggtcgtcgacgcctgcagctcacgatcccaggtcgaccggctggttgccctggcacgcatgagacaatcaggcgcattcttgtccaccagtgagggccttatcctgcaactggtgggagatgccgtacacccccagtttaaggagatccagaagctcatcaaggaacctgctcctgatagtggccttttgggtctgtttcaggggcagaattcgctgttacactag

SEQ ID NO: 121225 - DNA, 618 bp, Artificial Sequence
  Description of Artificial Sequence: Synthetic coding sequence
atggccgctgcacggccttctctgggaagggtcttacccggcagctccgtgttgtttttatgcgatatgcaggaaaagtttcggcacaacatcgcctatttcccacagatagtgtctgtggccgccagaatgctaaaggttgcgaggttgctagaggtgccggtcatgctgacagagcagtatcctcagggactggggccaaccgtgcccgagctgggaacggagggcctgagacccttggctaaaacatgctttagtatggtgcctgccctccagcaagagctcgacagccgcccgcaattgcggtctgtgctgttatgtggcattgaagcacaagcgtgcattctgaacacgactctggatttactggaccgcggtcttcaggtacatgtggtggtggacgcttgttcgtcaagatctcaggtggataggctcgtcgctttggccagaatgagacagtctggtgcattcctctctacatcggagggcttgattctgcaactagtgggcgacgcagtgcacccacagtttaaagagatacaaaagttgatcaaggagccagcacccgatagcggattgttaggcctgttccagggtcagaactcacttctccactag

SEQ ID NO: 121226 - DNA, 408 bp, Artificial Sequence
  Description of Artificial Sequence: Synthetic coding sequence
atggccgccgctcggccaagcctggggagggtcctcccgggtagcagcgtcctttttctgtgcgacatgcaagaaaagttccggcataacattgcctattttcctcaaatagtcagtgtggccgcgagaatgcttaagaatactacgctggatttattggatagaggtctccaagtccacgtggtggtagacgcttgttccagcagaagccaagtggatcgccttgtagcactggctcggatgcgccagtcgggggctttcctctcaactagtgagggtctgattttgcaactcgtgggtgacgctgtccatccacagttcaaggagatccagaagctcataaaagagccagcccccgacagcgggctcctcggactgttccagggtcaaaactcccttctgcactag

SEQ ID NO: 121227 - DNA, 1101 bp, Artificial Sequence
  Description of Artificial Sequence: Synthetic coding sequence
atggctggccccgcctggattagtaaagtcagccgcctgttaggcgcttttcacaaccctaagcaggtgactagaggcttcactggcggcgtgcaaactgtgaccctaattcctggagatggtatcggcccagaaatctcggctgccgtcatgaaaatttttgacgcggccaaggcacccattcaatgggaagagcgtaatgtgacggctattcagggtcctggcggaaaatggatgatcccttcagaggccaaagagtccatggacaagaataagatggggttgaaaggacccctgaagacaccaatagccgctggccacccaagcatgaacctattgctgcggaagaccttcgacctatacgcgaatgtaaggccctgcgtgtcaattgagggctacaaaactccgtacactgacgtaaatattgttaccatcagagaaaatacggaaggagaatactctggaatcgagcacgttatcgtggacggagtagtccagagtatcaaactgattacagaaggagcatccaagcggatcgccgagttcgcgtttgagtatgcacggaataaccatcgttcaaatgtcaccgccgttcacaaggcaaatatcatgagaatgtcagacgggctctttctgcagaagtgccgggaggtggccgaatcttgcaaggatatcaaattcaacgagatgtatcttgacaccgtgtgcctgaatatggtccaggaccctagccagttcgatgtgttggttatgcctaacctgtatggggacattctgagcgacctgtgcgccggactgataggtggacttggggtgacaccaagcggcaacataggggccaacggggtggcaatcttcgagtctgtgcatggcacagctcctgacatcgccggaaaagatatggctaaccctaccgctctgctgcttagtgcagtgatgatgttgcgccatatggggctgttcgaccatgctgcgagaattgaggccgcctgttttgcgaccatcaaagatggtaaatcacttacaaaggacttgggagggaacgctaaatgtagtgacttcacagaagagatctgcaggagggtaaaggacctggattag

SEQ ID NO: 121228 - DNA, 774 bp, Artificial Sequence
  Description of Artificial Sequence: Synthetic coding sequence
atgaacttgttactgcggaagacgttcgacctgtacgcgaacgtaagaccctgtgtctccattgaaggctacaaaacaccatataccgacgtgaacatagtaacgattcgtgaaaacacagaaggggagtatagcggcattgaacacgtgatcgtagacggggttgttcagagcatcaagcttatcacagaaggcgctagcaaacgaatcgcggagtttgctttcgagtacgctcgtaataaccacaggtctaatgtaactgccgtgcacaaggccaatatcatgaggatgtcagatggacttttcctccagaaatgccgcgaagtagccgaaagctgcaaagatattaagttcaatgaaatgtacctggatactgtatgcctgaatatggttcaggatcctagtcagtttgatgtgctcgttatgcccaatttatacggagatatcctcagtgacctctgcgcaggactcatagggggtctcggggtcacccctagcggcaatatcggggccaacggagtcgccatttttgagtctgtccatgggaccgctccagacatagccggcaaagatatggccaaccctaccgctctcctcttgtccgcagtgatgatgctgaggcatatgggattgttcgaccatgcggcccgcattgaggcagcatgttttgcaaccatcaaggatgggaaatcccttactaaagacttaggaggcaacgctaaatgcagtgattttaccgaagagatttgccgcagagtgaaagacctcgattag

SEQ ID NO: 121229 - DNA, 495 bp, Artificial Sequence
  Description of Artificial Sequence: Synthetic coding sequence
atggctgcgttgtcgggagtccgctggttgacccgggctctggtttccgcggggaaccctggggcttggagaggacttagcactagtgcggcggcccatgccgcttcccgttcacaagctgaggacgtccgggtcgagggatcattcccagtgaccatgctgcctggcgacggtgtcggccccgagctgatgcacgccgtgaaagaagtctttaaagcagccgccgtccccgtcgagtttcaggagcaccatctttcggaagtccagaacatggcttcagaagaaaagttagaacaagtccttagctctatgaaagaaaataaggtggccataatcggcaaaatccacaccccgatggagtacaagggcgagctcgcatcttacgatatgagacttaggcgcaagttagatctcttcgcaaatgttgtccacgtaaagagtctccccggatatgatagcgcccagcagagtcggcctggagatcatagtaggtag

SEQ ID NO: 121230 - DNA, 1158 bp, Artificial Sequence
  Description of Artificial Sequence: Synthetic coding sequence
atggccgcgctatcaggtgttcgatggctcaccagagcgctggtgtccgccggaaatccaggagcatggaggggtcttagcacatcagctgctgcacacgcagcgtcacgttcacaggcagaggatgtgcgtgtggaaggctcctttcccgtgactatgttacctggtgatggggtaggcccagaacttatgcacgcagtcaaggaagtgttcaaagcagcagcagttccggtcgaatttcaggaacatcatctctctgaggtgcagaacatggcatctgaagagaagctcgagcaggtgctatccagcatgaaggaaaataaggtggccatcattggcaaaattcacacgccaatggaatataaaggggagctggctagttacgacatgaggttgaggcgaaagctggacctttttgcaaacgtggtccacgtcaagagtttgcctggttacatgacacgacacaataatctggacttggtgataattcgggagcagaccgagggagaatattcctcgttggaacacgaaagtgcacgcggcgtgatcgagtgcttaaaaatagtgaccagagccaaatcccagcggatcgctaaatttgcctttgattatgccaccaagaagggaagagggaaagttaccgccgtacacaaggccaatatcatgaagctgggggacggtctgtttctgcagtgctgcgaagaagtggcagaactctaccccaagataaagttcgagacgatgatcatcgacaactgctgcatgcaactggtgcagaacccataccagttcgacgtgttggtaatgccgaacctatacggaaacataatcgacaacctcgcagccggcctcgtgggcggcgctggcgtcgtgccaggggaatcgtactctgcagaatatgccgtgttcgagaccggcgctaggcaccccttcgcccaggcagtcggacgcaatattgcgaaccccacagctatgttgttaagcgcttcaaacatgctccgacacctcaacctggaatatcactcatcaatgatcgctgacgccgtgaagaaggtgatcaaagtcggcaaggtccgaaccagagacatgggcgggtacagcaccactaccgactttatcaaatcagtaataggccacctccagactaaaggatcatag

SEQ ID NO: 121231 - DNA, 1152 bp, Artificial Sequence
  Description of Artificial Sequence: Synthetic coding sequence
atggccgctctgagcggcgtgcgctggctgacccgggcactcgtgagtgccggcaacccgggcgcgtggcgtggactgtccacgtctgcggcagctcacgccgcaagtagaagtcaggcagaagacgtgcgtgtcgagggaagtttcccagtgacaatgctgcccggcgacggagtgggaccggaactgatgcacgccgttaaagaggtttttaaagcggccgccgtccccgtggaattccaggaacaccatctttctgaggtgcagaatatggcctcagaggaaaaactcgaacaggtgctatcctctatgaaagagaataaggtggcaatcatcggaaagattcatacccctatggaatataagggcgagctggcttcctatgacatgagactgaggcggaagttggatttgtttgccaacgtggtgcatgtgaaatccctgcccgggtacatgacccgccacaataatctggatctagtcataattagggagcagaccgagggcgaatacagttccctcgagcacgaaagcgctaggggggtaatcgaatgtcttaagattgtcactcgtgccaaaagtcagaggattgccaaatttgctttcgactatgccacaaaaaaaggtaggggtaaggtcaccgcggtgcataaggccaacattatgaagctgggggatggactctttctgcagtgttgcgaagaggtggctgaactctatcccaagattaagtttgagaccatgatcattgacaactgttgcatgcaattagtgcagaacccctatcagtttgacgtcttagtgatgccaaatctctacggaaacatcattgataatctggccgcaggcctcgttggaggcgccggagtcgtgccgggagagagctactctgccgagtatgccgtttttgaaacaggagcaagacaccctttcgcgcaggctgttggtagaaacatcgctaatccaactgcaatgctgctctctgcgtccaacatgctgcgtcatctaaatctggaatatcactcttccatgatagctgacgcagtgaaaaaagtgatcaaggtgggaaaggtaaggacttctgacatgggtgggtacgccacctgtcacgattttacagaggccgtaatcgctgctctgccacatccatag

SEQ ID NO: 121232 - DNA, 702 bp, Artificial Sequence
  Description of Artificial Sequence: Synthetic coding sequence
atgaagatgggcgagagatggagtagtctgtttccattcccagtgtctccaagctgctgctttctcttgacccagtccgctcgcggagtgatcgaatgcctgaagattgttactagggctaaatctcagcgcatcgccaaatttgcctttgactacgcgacaaaaaagggcagggggaaagtgactgcagtgcacaaggccaacattatgaaacttggcgacggcctcttcctccagtgttgcgaggaagtcgcagaactctacccaaagatcaagtttgaaacaatgatcatagacaattgttgtatgcagctcgtacaaaacccgtaccagtttgatgtgctggtaatgccaaacctctacggtaacatcatcgacaatctggcggcaggccttgtcgggggcgcaggagtggtacctggggagagttactcagccgagtacgctgtctttgagacgggagctagacatccattcgcccaggcggttggaaggaatatcgccaaccctaccgctatgttactgagcgctagtaacatgttacgtcatctgaatctcgaataccattcatcaatgatcgccgatgccgtaaagaaagtgattaaggtgggaaaggtgcgaacaagagacatggggggctactccaccaccaccgatttcatcaagagcgtgataggacacttgcaaactaaagggtcctag

SEQ ID NO: 121233 - DNA, 795 bp, Artificial Sequence
  Description of Artificial Sequence: Synthetic coding sequence
atggagagtggcaagaccgcgtcacctaaaagcatgcctaaggacgctcaaatgatggcccagattcttaaggatatgggcatcaccgagtatgagccacgagtcatcaatcagatgttggaatttgcgttcaggtacgtgacaaccatcctggatgacgccaaaatctatagttctcatgccaagaaagccaccgtggatgcagatgatgtgcgtctcgctattcagtgtcgggccgaccagagcttcacctctccccctccacgggatttcctgctcgatattgcccggcagcgaaatcagacccccctccctttaattaagccctatagtggacccaggctgcctcctgataggtactgtttgactgccccgaactataggctgaagagtctgcaaaagaaggccagcactagcgcggggcgaatcactgttccacggctgagtgttggatctgtgacgagccgaccgtcgacaccaactctaggcaccccaactccgcagaccatgagcgtgagcactaaggtaggaactccaatgagcctgactggtcaaagattcactgtccagatgcctacgagtcagagccccgcagtgaaagcttcgattcctgcaactagcgcagtgcagaatgtgcttataaatccttcgctgatcggcagcaaaaacattcttatcacgacaaatatgatgagcagtcagaacactgccaatgagtcttcaaacgccctgaaaaggaaaagagaggacgatgacgatgacgacgatgacgatgacgattacgataatttgtag

SEQ ID NO: 121234 - DNA, 906 bp, Artificial Sequence
  Description of Artificial Sequence: Synthetic coding sequence
atggccattcgacggaatcgggttgcgctgaagggtaatatcgaaaccaaccacaatttaccaccttcgcacaagtcacggaataatatccttagaacctccctggacttatatgctaatgtgatccactgcaagagtctacctggcgttgttacaagacataaagatatagacattcttatcgtgcgcgagaatacagaaggagaatattcatctctcgagcacgagagcgtcgctggagtagtagagtccttaaaaatcattaccaaagcgaagtccctccggattgctgaatacgcatttaagctcgctcaggaaagtgggcggaaaaaggtcaccgcggtccacaaggcgaatattatgaagctcggcgacggcctgtttctccagtgttgcagagaggtcgcggcccgttatccacaaataactttcgaaaacatgattgtggataacactaccatgcaacttgtgagccggcctcagcaattcgacgtcatggtcatgcctaatctgtatgggaacattgttaacaacgtctgcgctggcctggtaggagggccagggctggtcgcgggtgctaattacgggcacgtgtatgccgtgtttgagaccgcaaccaggaacacagggaagtctatcgccaacaaaaatatcgccaatccaacagcaacactcctagcctcctgcatgatgctagatcacctgaagctgcactcgtacgctacctcgatccggaaagctgtacttgctagcatggataacgaaaacggcctggtctgcgctgagcctgcttgcgtcctgcagatgcacactccagatattggtgggcaaggcaccacgtcagaggcgattcaggacgttataaggcatatccgtgtcataaatgggcgtgccgtagaagcttag

SEQ ID NO: 121235 - DNA, 1143 bp, Artificial Sequence
  Description of Artificial Sequence: Synthetic coding sequence
atggctttgaaggttgccacggtggccggaagcgctgcaaaagcagtgcttgggcccgccttgttatgcagaccgtgggaggtgctgggcgcgcatgaagtgccttcacgtaacatctttagcgagcagaccatccccccatccgctaaatatgggggccgccacaccgtcactatgattcccggggacggcatcgggcctgagcttatgcttcatgtaaaatcagtcttcagacatgcgtgcgtgcccgtggatttcgaggaagtgcacgtgagcagtaatgctgacgaagaagatattagaaatgctatcatggcaattcggaggaatcgcgtggcacttaagggaaatatcgagactaaccacaacttaccaccttcacacaagtctcggaataatattctgaggacctccttggacctctacgctaacgtgattcattgcaagtccttgcccggcgtggtgacccgtcacaaggacattgatatactaatcgtgcgcgaaaacactgagggagaatacagtagtctggagcacgagtccgtcgctggggtggttgaatccctcaaaattataacaaaggccaagtctctgagaattgccgaatacgctttcaaactcgctcaggagtccgggcgcaagaaggtgaccgctgtacacaaggctaatatcatgaaattgggcgacggcctttttctgcagtgttgtagggaggtcgcagcaaggtacccccaaattacattcgaaaacatgatcgtggacaacactacgatgcagctggtcagtcggccgcagcagtttgatgtcatggtgatgccaaacctgtatggaaacattgttaacaacgtctgcgcagggctggtgggtggaccaggactggtggcgggagccaactacggacacgtgtacgccgtattcgagacggcgacgcgcaataccggcaaaagcatagccaataaaaacatcgcgaacccgacggcaacccttctcgcatcttgcatgatgttggaccatttaaaacttcacagctacgctaccagcatacgcaaggccgtgctcgccagcatggacaacgagaacgtgcggttcccttcacaccctactctcctcccccgccccgtgagcccatgttctctgctttag

SEQ ID NO: 121236 - DNA, 525 bp, Artificial Sequence
  Description of Artificial Sequence: Synthetic coding sequence
atgtatacgttcgatcaggccactggcggcaccgcccaatttgaggctcattccgacgctcaggccctcgttctactggatgtgacccccgaccaatccatggtcgatgagggtatggctcgcgaggtgattaatcgcatccaaaaactgcgcaaaaaatgtaatctggtccctacggatgagattaccgtgtactataaggcgaaatctgaaggaacatacttaaacagcgtgatcgagtcacacacagaatttatctttaccactattaaggcaccattgaagccataccctgtctctccatcagacaaggtgctcatacaggagaaaacacagctcaaagggagcgaactcgagatcacactcactagggggtcaagcctgcccggaccagcttgcgcatacgtgaatctgaatatctgcgcgaatggctctgaacaaggcgaaatgcagtggatcatccccgaaatctatcatttctggaagcctaggtggagcatcgccccagggaagagtaagaggtag

SEQ ID NO: 121237 - DNA, 525 bp, Artificial Sequence
  Description of Artificial Sequence: Synthetic coding sequence
atgtatacctttgaccaagcgaccggcggaactgcccagttcgaagcgcactccgacgcccaagccctggttcttctagacgtgacgcctgaccagtcaatggtggacgaagggatggcgagagaagtaataaatagaatacagaagttacgtaagaaatgtaatttagtgcctacagatgaaatcactgtctattacaaagctaagagtgaggggacgtatctcaactcagtcattgagtcccatactgagttcatcttcactacaataaaagctccactgaaaccataccccgtttctccgagcgacaaagtgcttatccaagagaagacccagctgaagggatcagagctagagattactcttacgcggggctccagcctgcccggccccgcctgtgcatacgtgaacttaaatatctgtgccaatggaagcgagcagggcgaaatgcagtggatcatccccgagatttatcacttttggaaaccccgctggtcgatcgccccaggcaagtcaaaacggtag

SEQ ID NO: 121238 - DNA, 3789 bp, Artificial Sequence
  Description of Artificial Sequence: Synthetic coding sequence
atgctgcagcaggtccctgaaaacattaattttcccgccgaggaggagaaaattctggaattctggacagaatttaattgcttccaggagtgcctgaaacaatccaaacacaagccaaagttcacattctacgacggtcctccgttcgctacaggactgccccattatggacacatattggccggtacaatcaaggacatagtcacgcgctatgcccaccaatcagggtttcacgtcgataggcgcttcgggtgggactgtcacggactgcctgtcgaatatgaaattgacaagacgctgggaatccgcggacccgaagacgtggccaagatgggaatcaccgagtataataatcagtgcagagcaatcgtcatgcgatactccgctgagtggaagtccactgtgtccaggctgggaagatggattgactttgacaatgactataaaacactgtacccccagtttatggagtcagtgtggtgggtattcaaacaactatacgataagggccttgtgtatagaggtgtgaaggtcatgccattcagcaccgcctgcaacacacccttgagtaactttgagagtcatcagaactataaggatgtgcaagatccgagcgtgtttgtgaccttccctcttgaagaggatgaaaccgtgagtttagttgcttggaccactaccccttggactctgcccagcaatcttgccgtctgcgtgaaccccgagatgcagtatgtaaagataaaggatgtggccagagggagattactgatcctgatggaggctcgattatccgccctgtacaaattggaaagcgactacgagatcttggagaggtttcctggtgcatatcttaaaggtaagaaatatcgcccactattcgattattttctcaaatgtaaagaaaatggggccttcactgtcctggtggacaattacgtaaaagaagaagagggtaccggggtagtgcaccaggccccatattttggggctgaggattacagggtgtgtatggattttaacattattagaaaggacagtcttcctgtctgtcctgtggacgcgtcaggttgtttcacgactgaggtcactgactttgctggccagtacgtgaaggatgccgacaagagcatcatcagaaccctcaaagagcagggaaggctgctggtggccacaacctttacgcactcatatccattctgctggagatccgacacccccttgatctacaaggccgtcccctcgtggtttgtgagggtcgaaaacatggtggaccagctcctgagaaacaatgacctctgctattgggtccccgagctggtgagggagaagagattcgggaactggttgaaggatgccagagattggaccatcagtcgcaatagatactgggggacaccaatcccactgtgggtttcagatgactttgaagaagtcgtctgtattggatctgtcgctgagctcgaggaactgtcgggcgccaagatctctgacctgcaccgtgaaagcgtcgatcatcttaccattcccagccggtgtgggaaaggtagcctgcatcggataagtgaagtgttcgactgttggttcgagagtggaagcatgccatacgcccaggtgcactacccttttgaaaacaaaagagaatttgaggacgcatttcctgccgactttatcgcggaaggaattgaccagactcgggggtggttttacacccttctggttctggcaaccgccctgtttgggcaaccaccattcaagaatgtcatcgtcaatggactggtgcttgcctcagatggccagaagatgagcaagaggaaaaagaattatcccgatcctgtttcaattatccagaaatacggggctgatgcccttcgtctgtatctcatcaactctccagtggtgcgagccgaaaatttgcgttttaaagaggagggcgttagagatgtactcaaagatgtgcttctgccgtggtacaatgcttaccgcttcttaattcagaacgtgcttaggctgcagaaagaggaggagatcgaatttctctataatgaaaacactgtgcgcgagagccccaatatcacagaccgctggattctgtcatttatgcagtctctgattggcttcttcgagacagagatggcagcctacaggctgtacaccgtggtccctcggctggtgaagtttgtcgatatacttactaactggtatgtgcgcatgaatcgccgccggctgaagggcgagaatggaatggaagactgcgttatggccctagagactctctttagtgtgctgctgtccctgtgtcgactcatggccccctatacaccctttctgacagaactgatgtaccaaaatctgaaggtgctgatagaccccgtgagcgttcaggacaaagatactctgagtatacactatctgatgctgccacgggtgcgcgaggagctaatcgacaaaaagaccgaaagtgccgtgtctcaaatgcagtcagtcatcgaactggggcgagtgattagagacaggaagacaattccaattaagtaccctttgaaggaaattgtggttatacaccaggacccagaagccctgaaggacattaaatcactggagaaatatataattgaggaactgaatgtgcgcaaagtcactctgtcaacagacaagaacaaatatggtatccgtctcagagccgagcccgaccacatggtgctaggcaaacgcctcaagggggctttcaaggccgtgatgacttccattaagcagctgtctagtgaagagctggagcaatttcagaaaacaggtactatcgtagtggaaggacatgaattacacgacgaggacatccgactaatgtacacattcgatcaggccacaggtgggactgctcagttcgaggcacacagtgacgcccaggccctggtcctgcttgacgtaaccccagaccaatccatggtcgacgaggggatggccagagaggtcatcaaccgcattcaaaaactcaggaagaaatgtaatttggtccctaccgacgaaatcaccgtgtattataaggctaagtctgagggcacttaccttaatagcgttatcgagagccacactgagtttatcttcaccacaattaaggccccccttaagccctaccccgtgtcaccatcggataaggtgctcattcaagaaaagactcaattgaagggcagcgaacttgagataacactgacgcgaggctcaagcctgcctggcccagcatgtgcctatgtgaatctgaacatatgcgctaatgggtccgaacagggcggcgtactgctgttagaaaacccaaaaggcgacaatagattagacctgctcaaacttaaatcagtggtgaccagcattttcggagtgaagaacactgagttagctgtgtttcacgacgagacagagattcagaatcaaactgatctgcttagcctgtctggcaagactctctgtgtgacagccggttccgcacccagtctgatcaactcctctagcacgctcctgtgtcagtacatcaatttacagcttttgaatgcaaagccccaggaatgtctcatgggtacagtggggacgctgctattggaaaacccccttggccagaatggtttgacccatcaaggtctcttgtatgaagctgctaaggtgttcggcctcaggagcagaaagctgaaactgtttttgaacgagacacagacccaagaaataacagaagacatccctgttaaaaccctgaacatgaaaacagtgtatgtgtctgtactccctaccaccgccgatttctag

SEQ ID NO: 121239 - DNA, 3729 bp, Artificial Sequence
  Description of Artificial Sequence: Synthetic coding sequence
atgctacagcaggtccctgagaatatcaacttccccgctgaggaagagaagattctggagttttggacagagtttaattgtttccaggaatgtttaaagcagtctaagcacaagcccaagttcacattttacgacggaccgcccttcgccaccgggctgccccattacgggcatatcctagcgggcacaattaaagatatcgtcacgcgatacgcacatcagagtggctttcacgtcgaccgtcgtttcggttgggactgccatggcctgccagtcgagtacgagattgataaaacccttgggattcgtggccccgaagatgtggcaaaaatgggaataactgagtataacaatcagtgtcgagcaattgttatgagatacagcgctgaatggaaaagtaccgtgtcccggctcggccgctggatcgatttcgataacgactacaagaccctctacccgcagttcatggagtcagtatggtgggtgtttaaacagctctacgacaaaggcctcgtgtaccggggggtgaaagttatgcctttttcaaccgcttgcaacactcctctcagcaactttgagagccatcagaattataaagatgtgcaggatccatccgtatttgtaacattccccctggaagaggacgagactgtctcgcttgttgcttggactacgacaccttggaccctgccaagcaacctggcagtgtgcgttaatcctgaaatgcagtatgtgaaaattaaggatgtcgctagaggccgtttgctcatcttgatggaagcgagattgagtgctttgtacaagctggagtctgattacgagatccttgagaggtttccgggcgcgtacctcaaggggaaaaagtaccggcccctattcgattacttcctcaaatgcaaggaaaacggtgctttcacagtgcttgtcgataactacgttaaagaagaggaaggtaccggagtggtccaccaagcaccatatttcggtgccgaggattaccgcgtgtgcatggatttcaacattataagaaaagacagcctgcctgtatgtcctgtggacgcgtctggctgttttacgacagaggtgaccgattttgccggacagtacgtgaaggacgcagacaagtctattatccgaacattaaaggaacagggtaggctgctcgtggctactactttcacgcacagctaccccttttgctggaggtctgatactcctctgatctataaagctgtgcccagttggtttgtgagagttgagaacatggtggatcagctgctgagaaataatgacctttgctattgggtgcccgaactcgtcagagagaagagatttggcaactggcttaaagatgcgcgtgattggacaattagtcgcaaccggtactgggggacacctattcctttgtgggtttcagacgattttgaggaggttgtgtgcattggatcagtagcagagctcgaagagctgtcaggcgctaagatctctgatctgcaccgagaatctgtcgaccacctcacaatcccctccagatgcggcaaaggatcacttcaccgtatttctgaagttttcgactgttggttcgagtctggctctatgccgtatgcccaagtacattacccattcgaaaacaagagggaatttgaggacgcgtttccagctgattttattgctgagggcatcgatcagaccagggggtggttttatacactactggtcctagcaacagcactcttcgggcagccccctttcaaaaatgtgatagttaatggcttagttctcgcctcagacggacaaaagatgtcgaaacgcaagaaaaactatcctgaccccgtgtcaattattcagaaatacggcgcggacgccctgcggctctatctgattaactctcctgtcgtgcgcgcggaaaacctccgatttaaagaagagggagtgagggacgtgctgaaggatgtgctccttccttggtataacgcttaccgattcctgattcagaacgtattgcgcctgcagaaggaggaggagattgagttcctgtacaatgagaacaccgtcagagagtctccaaacatcacagatcgctggattttatcttttatgcaatccctcataggattcttcgaaactgagatggccgcatacaggttatacaccgtggtgccacggctggtgaaattcgtggatatcctgacaaattggtatgtcaggatgaaccgccgacgcttgaaaggcgagaacggaatggaagactgtgttatggcattagagactctgttttctgttcttctgtcactctgtaggctgatggcaccttataccccgtttcttacagaacttatgtaccaaaatttaaaggtgttgatcgatcctgttagcgtgcaggataaagacacgctgagcatccattacctcatgctcccacgcgtgcgagaagagcttattgacaagaaaaccgaaagcgctgttagccagatgcaaagtgtcattgagctcggccgggttatccgcgaccgcaaaaccatacccattaagtaccccctaaaagaaatcgttgtaattcatcaggaccccgaagctcttaaggacataaagtctttagaaaagtacataattgaagagttaaacgtgaggaaagtgacactttccacagacaagaacaagtatgggatccggctccgcgcggagcccgaccacatggtgctagggaaacgtcttaagggtgccttcaaggctgtgatgaccagtatcaaacaactgagcagcgaggagttggagcagttccagaagaccggcacaattgtggttgagggccacgagctgcacgacgaggacatccggctgatgtacactttcgatcaagccacaggtggaactgctcaatttgaagcgcatagcgacgcccaagccctggtacttctggacgttacacctgatcagtcaatggtcgacgaaggcatggcgagggaggtgatcaaccgaatccagaagttgagaaagaagtgcaatttggtccctactgacgagatcactgtgtactataaagcaaaaagcgaagggacatacctgaatagtgtcatagagagtcacaccgagttcatattcacgaccattaaagctcctttgaagccctaccctgtgtcaccctcagataaagttctgatccaggaaaagactcaactgaaggggagtgagctggaaatcactttaactcggggatcctcgctgccagggcctgcttgtgcttatgtaaacctgaacatctgcgcaaatggttccgagcaaggcggagttcttttgcttgagaatcccaaaggggataacagactcgacctgctgaaactcaagtctgtcgtcacttctattttcggcgtgaagaataccgaactcgcggtgtttcacgacgaaaccgaaattcagaaccaaaccgacttgctgagcttaagtggaaagacactgtgcgttaccgctgggagtgcgccttctctgatcaattctagttctaccctcttgtgccagtacatcaacctgcaattgctgaatgctaagcctcaggaatgcctgatgggcaccgtgggcactcttttgttggagaacccactcgggcagaacggcctaacacaccaagggctcctctacgaagcagccaaggtgttcggcctcaggagcagaaaactgaaactgttcctgaacgagacccaaacacaggagatcaccgaggatatcccttag

SEQ ID NO: 121240 - DNA, 993 bp, Artificial Sequence
  Description of Artificial Sequence: Synthetic coding sequence
atgctccagcaagtgccagagaatattaattttcccgcggaggaagaaaagatattagagttctggacagagttcaactgcttccaagagtgtctaaaacagagtaagcataaacccaagtttaccttctacgacgggccaccctttgccaccggactgccccactacggccacatactggccggaacaattaaggacattgtaacacggtatgcccatcagtctggattccatgtggacagaaggttcgggtgggactgccacggcctgcccgtggaatacgagatcgacaagaccctgggaattcgtgggcccgaagacgtggccaagatgggcataacagaatataacaatcaatgcagggctatcgtgatgcgttatagcgcagaatggaagtccaccgtctctcgtttgggccgctggatcgactttgataatgactacaagacgttgtatcctcagttcatggaaagtgtgtggtgggtcttcaaacagctatacgacaagggccttgtctaccggggggtaaaggtgatgcccttcagcacggcctgcaatacacccctgtcaaacttcgagtcccatcagaattacaaggatgtacaggacccttctgtgttcgtgacattcccacttgaggaagacgagaccgtgtccctagtggcctggacaactacaccatggaccctgcctagtaatctggccgtgtgtgttaaccctgagatgcagtatgtcaagatcaaggatgtggcgagaggcagattgctgatattaatggaggccaggctgtcagccctgtacaagctggagtctgactacgagattctagagcgctttcccggcgcttacctgaaaggcaagaagtaccgcccactgttcgattactttctgaagtgcaaagagaatggcgcttttacagtgctggtggacaactatgtgaaagaagaagaagggaccggagttgtgcatcaggcaccctacttcggagcatag

SEQ ID NO: 121241 - DNA, 513 bp, Artificial Sequence
  Description of Artificial Sequence: Synthetic coding sequence
atggcaccctacaccccttttttgacagagctgatgtaccagaatctcaaggtcttgattgaccctgtgagcgtgcaagacaaagacactctgtccattcattatctaatgctcccaagagtacgggaagaactgattgacaagaagacagagagtgccgtatcacaaatgcagagcgttatagaattaggcagagtaataagggataggaagacaattcctatcaagctaaagggttccgaacttgagattactcttactaggggttcctctttacccgggccagcttgcgcttatgttaatctgaatatttgcgcaaatgggagcgaacagggcggcgtactgctgctcgaaaatcccaagggagataacaggctggacctcctgaagctgaaatctgtagttacgagcattttcggtgtaaagaataccgaactcgccgtgtttcatgatgaaaccgagatacagaaccagaccgatctgctgagcctgtcagggaagacgctgtgctag

SEQ ID NO: 121242 - DNA, 3789 bp, Artificial Sequence
  Description of Artificial Sequence: Synthetic coding sequence
atgctgcagcaggtaccagagaacattaattttccggcggaggaagagaagatcctagagttctggaccgagtttaattgttttcaagagtgcctgaaacaatctaaacacaaacctaagttcacattttatgatggaccaccctttgccacaggtctgccccattacggccacatccttgccggaactatcaaggacatcgtgacacgctacgcacatcagtctggtttccacgtcgatagaagattcgggtgggactgccatggacttcccgttgaatacgagatcgataaaacactgggtatcagggggcctgaggatgtggctaagatgggtataactgaatataataaccagtgcagggctatcgtgatgcgttattcggccgagtggaaatccaccgtgtcccggctgggcaggtggatcgatttcgataatgactataagaccctctatcctcagttcatggagtcagtctggtgggtctttaaacaactgtacgacaaaggtctggtctataggggcgttaaagtgatgccattctccacggcttgcaataccccactctctaattttgagagtcatcagaattacaaagatgtgcaagatccatctgtcttcgtgacttttcctctggaggaggacgagacagtgagcctggtggcctggaccaccacgccgtggaccctcccatccaacttggcagtgtgtgttaacccagaaatgcagtacgttaaaatcaaagacgttgcacgcggcagactactaatcctcatggaagcaagactctcggctctttacaagttggaaagtgattatgagatcctcgaacgcttcccaggcgcctacctcaagggcaagaaataccgaccattattcgactacttcctaaagtgtaaagaaaacggggcattcaccgtgctcgtggataattacgtgaaggaagaagaagggacgggtgtcgtgcaccaggctccttacttcggcgccgaggactatcgggtctgcatggattttaacatcatacgtaaggactccctgcccgtgtgtccagtggacgcgagcggatgctttactaccgaggtgaccgactttgcagggcagtacgtcaaggatgctgataagtcgatcattcgcacattgaaagagcaagggcgtctgctcgtggccactacattcacccatagttaccctttttgctggcggagtgatacaccgttaatctacaaggccgtacccagttggtttgtgcgtgtcgaaaatatggtagaccagctgcttaggaataatgacctctgctattgggtccccgagcttgtgcgcgagaaaaggtttgggaattggcttaaagatgctcgtgactggactattagtagaaaccggtactggggcacccctatacccctctgggtgtccgatgacttcgaggaagtggtgtgcattggcagtgtggccgagcttgaagaactgtccggcgcgaaaatctcagaccttcaccgggaaagtgtggaccatctgactattccgagcagatgtggaaaggggtccctccatcggattagcgaggtcttcgattgctggttcgaatccggtagtatgccgtacgctcaggtccactatcctttcgagaataagagggaattcgaggacgctttcccagcggattttatcgctgagggcatcgatcagactcgagggtggttctacacattgctggttttggccactgctctgtttggacagcccccttttaagaatgttattgtaaatgggttggtgctggcctccgacgggcagaagatgagcaaaagaaagaaaaattaccctgatcccgtttcaataatacagaaatacggtgccgacgccctcagactgtatcttatcaattcaccagtcgtgagggcagaaaatctccgattcaaggaggaaggagtgagggatgtgctcaaagatgtccttcttccttggtacaacgcctaccgtttcctcatacagaacgtgctccgcctgcaaaaagaggaggagattgaatttttatataacgaaaacactgtgcgcgagagccccaatatcactgaccgctggattctgtcattcatgcagtctcttatcggtttctttgagactgagatggccgcttacagactgtatactgtggtgcccagactggtcaaattcgtggatattctgacaaactggtatgtcaggatgaatcggagacggctgaagggagaaaatggcatggaagactgcgtaatggcactcgagactctgtttagcgttctcttgagcctttgccgattgatggcgccttacacccccttcctgaccgaacttatgtatcagaacctcaaggttttgattgatccagtgagcgtccaagataaagacaccctaagcatccactacctgatgttgcccagagtgagggaagagctgatcgacaaaaaaaccgagtcagccgtaagccagatgcagagtgttatcgaacttggaagagttattagagaccggaagacgatccccatcaagtatccgttgaaagagatcgtagttatccaccaagatccagaagcactgaaagacatcaaaagtttggaaaaatacataattgaggagctgaatgtgcgtaaggtgaccctgagcactgataagaataagtacggtatccgactccgagccgagcccgatcatatggtgttgggaaaacgccttaagggagcgtttaaggctgtgatgacgtcgatcaagcaattgagtagcgaagagcttgaacagttccaaaagaccggcactattgtggtcgaaggccatgagctccatgatgaggatatacgcttgatgtacacctttgaccaagcaaccggaggcacagctcagttcgaggctcatagtgatgcccaggcccttgtactgttagatgtgacccctgaccaaagcatggtcgatgaggggatggcacgggaggtcatcaatcgtattcagaagcttcggaagaaatgcaacttagtgcccaccgacgagataactgtatactacaaggcgaaatccgaaggcacttatctcaacagcgtgatcgaatctcataccgagttcatctttaccacaatcaaggccccactaaagccctaccctgtgtctccttctgacaaggtgcttatccaggagaaaacgcaacttaaaggcagtgagttggagattacacttacccggggtagctctttaccaggtcctgcttgcgcttacgttaacctgaacatctgtgctaatggttctgaacagggaggagtcctgctgctggagaatcctaagggagataacaggctcgacctacttaagctgaaatctgtggtcacctccatcttcggcgtaaaaaatactgaactggccgtcttccacgacgaaaccgaaattcaaaatcaaacagacttattatccctgtcaggcaagacgttatgtgtcactgctggtagcgcaccttcattaatcaattcttcctccactctgctgtgccagtatataaaccttcagctgctgaatgctaagccccaggagtgcctgatgggcaccgtgggtacacttctactcgagaatcctttgggccagaacggtctcactcaccaaggacttttgtatgaggccgccaaagtgtttgggctcaggagtcgaaaactgaaactgtttctcaatgagacccaaacccaagaaatcacagaagacattcctgtcaaaacattgaatatgaaaacggtttatgtcagcgtcctgcctacaaccgccgacttctag

SEQ ID NO: 121243 - DNA, 3459 bp, Artificial Sequence
  Description of Artificial Sequence: Synthetic coding sequence
atgggcatcaccgagtataacaatcaatgccgcgcaatcgtgatgcgctattctgcagagtggaaaagtactgtgagcagactgggccgctggatcgatttcgacaatgattataaaactctgtatccccaatttatggagtccgtgtggtgggtcttcaaacagctgtacgataaaggactggtataccgcggggttaaggtgatgccattctccacggcctgcaatactcctctgtccaatttcgagtctcatcaaaactataaggatgtgcaagatccctcagtgttcgtgactttcccattagaggaagatgagacggtgtctctagtggcgtggactactacgccctggaccctgccctctaacctggctgtttgtgttaaccctgagatgcagtatgtgaagattaaagacgtcgcccgtggtaggcttctcatcttgatggaggccaggcttagcgccctctacaagctggaatctgactacgagattttggagaggttccccggggcctatctgaagggcaagaaatatcgtccattattcgactacttcctgaaatgtaaagaaaatggagcattcaccgtcctcgtggataattacgtcaaagaggaggaaggcacgggtgtagtgcaccaggccccgtattttggcgccgaagactatagagtatgcatggattttaacattataaggaaggactcactgccggtatgccccgtcgacgccagcggctgtttcacaacagaggtaacagactttgccggccagtacgtaaaggacgctgacaagagtataataaggactctgaaagaacaagggaggctcctggtggcaacgactttcacacactcctatcctttctgctggagatccgacacaccgttgatttacaaagccgtccctagttggttcgtgcgcgtcgaaaacatggtggatcagctcctccgcaacaatgacctgtgctattgggtgccagaactggtgcgggagaagaggttcggtaactggttgaaagatgcccgggactggactatctcccgcaatcgatattggggtacgccaatccccctgtgggtgagcgacgatttcgaagaagttgtgtgtatcggaagcgttgcagagctggaggagttgtccggcgccaagatcagtgatctacatagagaaagtgtcgatcatctcactatcccgtcccgctgcgggaagggtagtctgcatcggatatctgaggtgttcgattgctggttcgaatctggatcgatgccatatgcccaggttcactatcccttcgagaataaaagagagtttgaggacgccttcccagccgattttatcgccgaaggaattgatcagacccgagggtggttctacacgttgctcgtgttggccactgccttgttcggacaaccgcctttcaagaatgttattgtaaatggccttgtgctggcgagcgatggtcagaagatgtccaagcgcaagaagaattacccggatccggtgtccattatccagaagtacggcgctgacgctctacgcctatacctaatcaatagtccagtggtgcgtgccgagaatctgcgctttaaagaggaaggggtgcgggatgtcctgaaggatgtgctgctgccttggtacaacgcctatagattcctgatacagaacgtgttaaggttacagaaagaagaggagattgagttcctgtacaacgagaatacagtgcgcgagagcccaaatataaccgaccgctggatcctgtcgtttatgcagtccttgatcggattcttcgagaccgaaatggccgcctataggctgtataccgtggtgccccgcctggtaaagtttgttgatattctaacgaattggtacgtgcgcatgaacaggagaaggcttaaaggtgaaaatggtatggaggattgtgtcatggcgcttgagaccctgttttctgtactcctgtccttgtgccgcctgatggctccctacactcctttcctgactgaacttatgtatcagaacctgaaggtactcatagatcctgtgagcgtgcaggataaagacactctttccatccactacctgatgttgcctcgcgtgagagaagaactcattgataagaaaaccgagagcgctgtcagccagatgcaatcggtgatagaactagggcgcgtgatccgggatcggaagaccatacccataaaatatcctcttaaggagatcgtggtgatacaccaggaccccgaagcccttaaagatataaaaagcctggaaaagtacatcatcgaggaactcaatgtgcggaaggtgactttaagcactgacaagaacaaatacggtatccgccttcgtgccgaacctgatcatatggtgctcggaaagaggctcaaaggcgcctttaaagctgtcatgacctccatcaagcaactttcaagcgaggagttggagcaattccaaaagactggcacaatagtggtggaagggcatgaactgcacgacgaagacattaggcttatgtatacttttgaccaggccactggaggcaccgcccagttcgaagcacactcggacgcgcaggcactggtgctcctggatgtgacacccgaccagtcaatggtcgacgagggtatggccagagaggtgatcaataggatccaaaaactacgcaagaagtgcaatctcgttcccactgatgaaatcacagtgtattacaaagccaaatctgagggtacatacctgaattccgtgatcgaatcacatacagaattcatcttcaccacgataaaggctcctcttaagccgtatcctgtgtctcctagcgataaagtgttgatacaggagaaaacccagcttaagggaagcgagctggaaataacgcttacccgcggcagtagcctccccggcccagcgtgcgcatatgtcaaccttaacatctgcgcgaacggttctgagcaagggggcgtgctgctcctggagaatccaaagggggacaaccgcctggacctgctcaagctcaaaagcgtagtcacctcaatctttggagtcaaaaatactgaactggctgtttttcacgacgaaaccgaaatccagaatcagaccgacctgctcagcctgtcaggcaaaactctctgtgtgacagccgggagcgcgcccagcctgataaatagtagtagcactttgctgtgtcagtacatcaatctgcagcttctgaacgcaaaaccccaagagtgcctgatgggcactgttgggacgctgctgttggagaaccccctgggccagaatggattgacccaccagggcctattatacgaggctgctaaggtgtttgggctgcgaagcaggaagcttaaactctttctgaatgagacccaaactcaggagatcactgaggatatcccagtgaaaaccctgaatatgaaaacagtttatgtcagcgtattacccactactgccgatttctag

SEQ ID NO: 121244 - DNA, 750 bp, Artificial Sequence
  Description of Artificial Sequence: Synthetic coding sequence
atggccccgtatacacccttccttacagaactgatgtatcaaaatcttaaggtactaattgatcccgtgtccgttcaggataaggacacactctctatccactatctcatgctgccccgtgtaagggaggagctgatcgacaaaaagacagagagcgccgtctcgcagatgcagtccgttatcgaacttggcagagtgatacgagataggaaaacgatccccatcaagtatccactgaaggaaatcgtagtcattcaccaggatccagaggccttaaaggacattaagagcttggagaagtatattattgaggagctcaatgtgcggaaagtgaccctttctacagacaagaacaagtatgggatccgccttcgtgctgaaccggaccacatggtgctgggcaagcgcctcaaaggtgccttcaaggcggttatgactagcatcaagcagctgtctagtgaggaactggagcagtttcagaagaccggcactatcgtcgtggaaggacacgagctgcatgatgaagacatccgactgatgtatacttttgaccaggctaccgggggcaccgcccagtttgaggctcactccgacgcacaagctctggtccttttggacgtgacccctgatcagtcaatggtggatgaggggatggctagggaggtaattaacaggatccagaagcttaggaagaagtgcaacctggtgcctaccgatgagatcaccgtgtattacaaggctaagtcttag

SEQ ID NO: 121245 - DNA, 513 bp, Artificial Sequence
  Description of Artificial Sequence: Synthetic coding sequence
atggcgccctatacgccatttctcactgagctgatgtaccagaatcttaaagtgcttattgatcccgtcagtgttcaggataaggacaccctaagcatccattatctcatgttgccccgggtgcgtgaggaactcattgataagaagacagagtccgcggtgtcccaaatgcagtcagtaattgaattgggcagagtgatccgggacaggaagacaatccctattaagcttaagggatccgaactcgagattaccttgacgagagggtccagtcttccaggaccagcctgcgcttacgtaaatctgaacatctgtgctaatggctctgaacaaggcggagtgctcctgctggaaaaccccaaaggtgataataggctggatctgttaaagctcaagagcgttgtgacgtccatctttggggtcaagaataccgagcttgcagtgtttcatgacgaaacggagatccagaaccagaccgacctgctgagcctgagcggaaaaacattgtgctag

SEQ ID NO: 121246 - DNA, 816 bp, Artificial Sequence
  Description of Artificial Sequence: Synthetic coding sequence
atgatggtactacttctgcagctggattgcctgaccatggacatatatttgcgggacaaggataccctttccattcattacctaatgctgcctcgggtccgggaggaactgatcgataaaaagaccgaaagtgccgtcagtcagatgcagtctgtgatcgagttaggaagggtgattagggatcgaaaaaccatccccatcaaactgaagggctccgagttggagatcaccttgacccgtggtagctctctgccgggacctgcctgtgcctatgtgaacctgaatatttgtgctaacggatcagaacaaggcggcgtgctcctgttggaaaatccaaaaggagacaaccgcttggaccttcttaaactgaaatcagttgtgacaagtattttcggggtgaaaaatacagaacttgctgtatttcacgatgagaccgaaatccagaaccagactgaccttctatccctgtccggcaagactctttgcgttacagctgggtcagccccttcattaatcaactcctcctctacactgctttgtcaatacattaaccttcagctgctgaatgctaagccccaagagtgccttatgggtactgtagggactctcctcctggaaaatcccctcggccagaacggcctgacacaccagggactcctttacgaggcggcaaaagttttcgggctgcggtcacggaaactgaagctttttttaaatgagacgcaaactcaagagatcacagaagacattcccgttaagactctgaacatgaagacagtttacgttagcgtcctcccaactacggccgacttttag

SEQ ID NO: 121247 - DNA, 3039 bp, Artificial Sequence
  Description of Artificial Sequence: Synthetic coding sequence
atgcgatggggattacggccacgcggaccaggggccgctgctctggctacagccaggtccctttggggaacaccaaggctaccatgcagccccggttggcagggggctacgaagaggctgctggtcagaagcgttagcggtgcaagtaatcaccagcccaacagcaactcaggacgctaccgcgacaccgtgctgctgcctcaaacttctttccctatgaagcttctcggccggcagcagcccgacacagaactcgagattcagcaaaagtgtggcttctctgaattatattcttggcagcgggaaagaaaggtaaaaaccgaattctgcttgcatgatgggccaccctacgccaacggtgacccacatgtgggtcacgcattgaacaaaatcttgaaagatatagccaaccgttttcacatgatgaacgggtctaaaatccattttgtgccagggtgggactgccacggactgcccatcgaaatcaaagtgttgagtgagctgggcagagaggcccagaatctctcagcaatggaaatccgaaagaaggccagatcctttgctaaggccgctattgaaaaacagaaatctgccttcatcagatggggcatcatggccgattggaataattgctactatacattcgacggtaaatacgaggctaagcagctgcgcactttttaccaaatgtacgacaaaggcctcgtttatagatcttataagccggtcttttggagcccttcttctcgtaccgcattggccgaagcagagctggagtataaccccgaacacgtgagtagaagtatatacgtcaaattcccgctgcttaaaccttctcccaaacttgccagccttatcgacggatcatcccccgtaagcatactagtgtggactactcagccatggacgatacctgcaaacgaagccgtgtgttatatgcctgagtcaaaatatgcagtggtgaaatgttctaaatctggcgacctatatgttctcgctgctgacaaggtagcgagcgtggcgtcaaccctggagaccacctttgaaaccatctccactctcagtggagttgatttagagaatggcacatgtagtcaccctctcatccccgacaaagcatcacccttgctgccagccaaccatgtcactatggccaaaggcactggactcgtccacacggccccagctcacggcatggaggattatggcgttgcgagccagcacaatctgcctatggactgccttgtagacgaagacggtgtgttcaccgacgttgctggacctgaactccagaacaaggctgtgcttgaggagggcacagacgtagtgatcaaaatgttacaaacggccaagaatctacttaaggaggaaaagttggtgcactcatatccttatgactggaggactaagaagccagttgttattcgtgcaagcaagcaatggtttattaacattaccgacataaagactgcagccaaagaactgctgaaaaaggttaaattcatcccaggtagcgctctaaatggcatggtagaaatgatggatcgccgtccctattggtgcatctcccgacaacgcgtgtggggtgtgccaatcccagtgtttcaccacaaaactaaggacgaatatctgatcaattcacagaccacagaacacatcgtgaaactcgttgagcaacatggtagtgatatctggtggactttgccaccggagcagctgctccccaaggaggttttatccgaagttgggggcccagatgcactggagtacgttcctggccaggacatccttgacatttggttcgactcgggcacaagctggtcctacgtgctgccggggcctgaccagagggccgatctttacctggagggcaaagatcagctgggcgggtggtttcaaagtagcttgttgacctcagtggcggccagaaaaagggcgccatataaaacagtcattgtgcacgggttcactctcggcgagaaaggcgaaaagatgagcaagagcctcggaaatgtgatccacccagacgttgtcgtgaacggcggtcaggatcagtccaaggagcccccatacggggccgacgtcctccggtggtgggtggcagattctaacgtctttactgaggtggccatcgggcccagcgtgttgaatgccgctagagatgacattagtaaactgcggaacacactcaggtttttgctgggaaatgtcgctgactttaatcctgagactgattctattcctgttaacgatatgtatgttattgatcagtacatgctccatctgcttcaggatctggccaacaagatcacagagctctacaagcagtacgatttcggtaaggtggtgagactgctgcgaactttctatacccgggaactgagcaatttctatttctccatcatcaaggataggttgtactgcgaaaaggagaatgatccaaaaaggcgcagctgccagacggctctggtcgaaatcctggacgtgatcgtacggtcattcgccccaattctgccgcacctggctgaagaggtgttccagcacatcccttatatcaaggagcccaaaagcgtatttcgtacagggtggatttccacctcgtccatctggaagaaacctggtttagaagaagcagtagagagtgcatgcgccatgcgggactcttttctggggtcaattcccgggaagaacgccgccgagtacaaagtgatcaccgtgatcgaaccaggtctgctgtttgaaatcattgagatgctccagagcgaggaaactagtagcactagccagctgaacgagctgatgatggcatctgagtctactctactcgcccaggagccaagggaaatgaccgcggacgtgattgagctgaaggggaagttcctcatcaacctggaggggggcgatatccgtgaggaatccagctacaaagtgatagtaatgcctaccaccaaggaaaaatgccccagatgttggaaatacactgccgagtccagcgatactttgtgtcctcggtgtgccgaggtagtgagcggcaaatag

SEQ ID NO: 121248 - DNA, 2823 bp, Artificial Sequence
  Description of Artificial Sequence: Synthetic coding sequence
atgaagctgctcggacgacaacagcccgacaccgagctggaaattcagcagaagtgcggcttttccgagttatattcatggcagagagagcgtaaggtgaaaaccgaattttgcctgcacgatggacctccctatgccaacggggacccgcatgttgggcacgctctgaataagatactcaaagatatagcaaatcgatttcacatgatgaatggatccaagatccacttcgttccaggctgggattgccacgggctgcctattgagatcaaggtcctgtctgagctgggtagggaggcccaaaacctgagcgctatggagattaggaaaaaagcccgatccttcgcaaaggctgctatcgaaaaacagaaatcagcattcatacgttggggaattatggctgactggaacaactgctattacaccttcgatggtaagtacgaggcaaaacagctgcgcaccttctatcaaatgtatgataagggactcgtgtatcgttcatacaagcctgtgttttggtcacctagttcaagaactgcacttgcagaagctgaactcgaatacaaccccgagcatgtgagtcggagcatctatgtgaagtttccactgttaaagcccagtccgaagctggcctccctgattgacggatcctctcccgtgagcatcctggtgtggaccacccagccctggacaattcctgctaatgaagccgtgtgctacatgccggagtccaagtatgcagtcgtcaagtgctcgaaaagtggtgatctgtacgttctcgccgcggacaaggtggcctcggtcgcatcaacgctggagacaaccttcgagactatctcaacactcagtggcgtagatctggagaacggaacgtgctcgcatcccctgataccagacaaagcctccccacttctcccagccaatcatgtgacaatggcaaagggcacgggtctggttcataccgccccagcccatgggatggaagactacggtgttgcttcccaacataatctgcccatggattgtctggtagacgaagacggggttttcaccgatgtcgctgggcccgaactccaaaataaagcagtgctggaggagggcaccgacgttgttataaaaatgttgcaaaccgctaagaacctgctgaaggaagagaagctggtgcacagttacccatacgactggagaacaaaaaaacctgttgtcatcagagcttccaaacaatggtttataaatattaccgacatcaaaacagcggccaaagaactcctcaaaaaggtgaaatttatcccaggctctgccctaaatggcatggtggaaatgatggaccgccgtccctactggtgcatatcccgccaacgtgtttggggcgtcccaatccccgtctttcaccacaaaactaaagatgaataccttatcaacagtcagactacagaacacatagttaagctggtggaacagcatggaagcgatatttggtggactttgcctcccgagcagctgctcccgaaggaagtattgagcgaggttgggggaccagacgctcttgagtacgtgcccggtcaagatatattggacatatggtttgactcaggtacctcttggagctacgttttaccaggacctgatcagcgggctgatctctatctggagggcaaggaccagctgggaggttggttccagagcagtcttctcactagcgtcgcagcccgaaagcgggctccttacaagaccgtgatcgtgcacggctttaccctcggggaaaagggagagaaaatgagcaagagtctcggaaatgtgatacaccctgatgtagtagtcaatggcgggcaggaccagtctaaggagcccccctacggggctgacgtactcagatggtgggttgccgattcaaacgtctttacagaggtggcaatcggccccagtgtgcttaatgcggctcgggatgatatctctaaactacggaataccctgagattcttactaggtaatgtggctgatttcaatcctgaaaccgattcaatccccgtcaatgacatgtatgttatcgaccagtacatgctacatctgttgcaagacctggctaataagataaccgaattgtataagcaatacgactttggaaaggtggttagattactgaggaccttttacactagggaactttccaacttttatttttccatcataaaagacagactgtattgtgagaaagaaaatgatccaaaacgcaggagttgtcaaacagccctggtggaaatcctggacgtgatcgtgcggagcttcgctccgattctgccgcatttggctgaagaagtgtttcagcatataccttacatcaaagagcctaagtcagtttttcgtactggctggatttccacatcttcgatctggaaaaaacctggcttagaagaagccgtcgagagcgcctgcgccatgagggattcctttctcggctcaatcccaggcaagaatgctgctgagtataaggttatcacagtcattgaaccgggtcttcttttcgaaataatcgaaatgcttcaatcagaagagacttcatccacctcccagctgaacgagctgatgatggcctctgaatccacacttcttgcccaagagccccgtgaaatgaccgccgacgtgattgaactgaagggaaagttcctcatcaatctggagggaggagacatcagagaagagtcttcatataaagtgatagtcatgcccacaaccaaggaaaagtgtccacgttgttggaaatatacagcagagtcaagcgataccttgtgcccacgttgcgctgaggttgtgagtggtaaatag

SEQ ID NO: 121249 - DNA, 855 bp, Artificial Sequence
  Description of Artificial Sequence: Synthetic coding sequence
atggccggatgcgccgctcgcgcccctcctgggtctgaggcacgcttatccttggccacctttcttttgggcgcttccgtgctggccctcccccttcttacaagagcaggcttgcagggtagaacggggctcgccctgtacgtggccggtcttaacgctctcctgctgttgctctacaggcctccacgataccagatcgccataagggcgtgcttccttgggtttgtgtttgggtgcggtactctgctttccttcagccagtcatcctggtcccattttgggtggtacatgtgcagcttgagtctgttccattactccgaatatttggtcacagctgtcaataaccctaaatctttaagcctggactcattcctgttgaatcactcactcgaatataccgtcgccgcactgtcgagctggctggagtttaccctggagaacatcttttggccagagctgaaacagataacctggctctctgtgactggccttttgatggtagtcttcggggagtgcctccgtaaggccgctatgttcaccgcaggcagtaactttaatcacgtggtccagaatgagaagtcagacacccataccctggtgacttccggggtgtatgcatggtttagacaccctagctacgtaggatggttctattggagtataggtacgcaagtgatgttgtgcaacccaatctgcggcgtatcctacgccctgacagtgtggcgtttctttagggaccgaaccgaggaggaggagatatccctgattcacttttttggagaagaatacctggagtataaaaagcgtgtccccaccgggttgccttttatcaagggcgtgaaagtggatttgtag

SEQ ID NO: 121250 - DNA, 351 bp, Artificial Sequence
  Description of Artificial Sequence: Synthetic coding sequence
atggccggttgtgcagcccgtgctccacccggctcagaggctcgtctgtcactcgccacattcctgcttggcgcgtctgtgctggccttacccttgctaactcgcgccggcctgcagggtagaacaggtttagctctatacgtggctggtctgaatgccctgctgttgcttctgtatcgcccacctagataccagatcgccatcagggcgtgcttcctgggctttgtctttggctgtggaacgcttctatccttttcacaatcttcctggagtcacttcgggtggagtcacctagtgcacccccactcccattgcagaatttttccctacactatgatttctgttccttag

SEQ ID NO: 121251 - DNA, 567 bp, Artificial Sequence
  Description of Artificial Sequence: Synthetic coding sequence
atgtgctcactgtccctgttccattatagcgagtacttagtgacagccgtcaataatccgaaatctctgagtctggacagtttcttgctcaatcactctctggagtacaccgtggccgccctgtcttcctggctcgaatttacacttgagaacattttttggccagagctcaaacagatcacatggctatccgtcacggggttgctaatggtcgtgtttggggagtgcttacggaaggccgcaatgttcaccgctgggtcaaatttcaatcacgtcgtgcagaacgagaagtcggacacgcacaccctggtgacctccggagtatacgcttggtttcggcatccttcctatgtaggttggttttactggagcatcggcacacaggtgatgctctgcaatccaatttgtggtgtttcttatgcgcttactgtatggcgtttctttcgcgatcgtactgaggaggaagagatatctctgattcacttttttggcgaggaatacttagaatacaagaagcgggtccctacaggcttgcccttcatcaaaggagttaaggtggacctgtag

SEQ ID NO: 121252 - DNA, 1272 bp, Artificial Sequence
  Description of Artificial Sequence: Synthetic coding sequence
atggccactgcaacgagactgctcggctggcgtgtagcctcttggaggcttaggccccccctggccggctttgtgagccagagggcccactccttgctgcctgtcgatgatgctataaatgggctcagcgaggaacagcggcagttaagacagacaatggctaaatttttgcaagagcacctggctcctaaagcccaggagatcgaccgaagcaacgagttcaaaaatttgcgggagttttggaagcaactgggcaatcttggggtgctgggcatcaccgcgcccgtgcagtacggagggtccggcctgggctacttagagcacgtgcttgttatggaggagatttcccgtgctagtggagccgtgggactgagctacggcgcccactccaacctgtgcatcaatcagctcgtacggaacgggaatgaagcacagaaagaaaagtacctgccgaaattgatatccggtgaatacattggtgctttagctatgtctgagcctaatgccgggagcgacgtagtctccatgaaactgaaagcagagaaaaaaggcaaccactacatactgaatggaaataaattttggatcaccaatggtccagacgcagacgtgctgatagtgtacgccaagaccgatctggccgcagtgccggcatcaaggggtatcacagccttcattgtggaaaaggggatgcctgggttctccacctcaaagaaactggataagctgggcatgcggggtagtaacacatgcgagttgatctttgaagactgcaaaatacccgctgctaacattctgggtcacgagaataagggggtatatgttctcatgtctgggctagatctggagaggctcgtcctcgctggtgggcctctaggtcttatgcaggccgttctggaccacacgattccatacctccacgtcagagaggccttcggccagaaaatcggccatttccaattgatgcagggcaaaatggctgacatgtacactcgcctgatggcatgccgccagtacgtgtacaatgtggctaaagcgtgcgatgaggggcactgtacagccaaggattgcgccggtgtaatcctttattctgctgagtgcgccacacaggtggctctggatggcattcaatgctttggcggaaacggttatattaatgattttcctatgggccgattcctgagggacgctaagctgtatgaaataggcgcagggaccagcgaagtccggcggctcgtcattggccgcgcattcaacgccgacttccactag

SEQ ID NO: 121253 - DNA, 1191 bp, Artificial Sequence
  Description of Artificial Sequence: Synthetic coding sequence
atggccgaaatggctacagctactagactattgggatggagagtggcatcatggcgacttcgcccccctctagccggatttgtctctcaacgggctcatagtctgctcccagtggatgacgcaataaatggactgagcgaagagcagagacaggaattctggaagcagctggggaacttgggggttctgggtataaccgcccctgtgcagtacggcgggtctggtttgggctacctggaacacgtgcttgtgatggaggaaattagccgtgcttctggcgccgtgggccttagctacggagcacattccaatttatgcatcaaccagctggtgcggaacggtaacgaagcccaaaaagagaagtacttgcctaagctgatcagcggcgaatatataggcgcattggcaatgtcagagccgaacgctggcagtgacgtggtatctatgaagcttaaagcggaaaagaagggaaaccattacatcttgaacggcaacaaattttggattactaatgggcctgacgccgacgtcttgatcgtgtacgctaagacagatctggccgcagtccctgcttcgcgggggatcaccgccttcatcgtggaaaagggaatgcccggattctcaacttccaagaagctggacaaattggggatgaggggaagcaacacatgtgagctgatttttgaagattgcaaaatacctgcggctaatattctgggtcacgaaaataaaggggtttatgttctgatgagcgggctcgacctcgagcggcttgtactggctggtggacctctgggtctcatgcaggcggtgctggaccataccataccatatttgcacgtgagggaagcattcggacaaaagatcgggcacttccaattgatgcagggcaaaatggcagacatgtacacccggctgatggcctgccgtcaatatgtgtacaacgtggcgaaggcctgcgacgagggccactgcactgctaaggactgtgccggcgtcatcctgtacagcgcggagtgcgcaacacaagtggcgcttgacggaattcaatgtttcggagggaatggctacattaacgacttccccatgggacgcttcttgcgcgatgccaagctttacgaaattggagcaggcacaagtgaggtgcgcagactcgtaataggacgcgccttcaatgcagactttcactag

SEQ ID NO: 121254 - DNA, 1281 bp, Artificial Sequence
  Description of Artificial Sequence: Synthetic coding sequence
atggctgagatggcaactgccacccgcttgttaggttggagagttgcatcatggcggctgcggcccccacttgctgggttcgttagccagagggctcatagcttactaccagtggacgacgctatcaatggcctgtcagaggaacagaggcagcttcgccaaaccatggctaagtttttgcaggaacatctcgctccaaaggcccaggaaatcgatcgttcaaatgaatttaagaatctgcgagagttctggaaacaactgggtaatctgggagttctgggcatcacagccccggttcaatacggcgggtcgggtctcggatacctggaacacgttttagtgatggaggaaatatctcgcgcaagcggagccgttggcctatcttacggggcccacagcaacctgtgtatcaatcaactagtgagaaacggtaacgaggctcagaaagagaagtacttacctaaattaatctccggcgagtatatcggggccctggcaatgagcgagccaaatgccggctctgacgtcgtgtcaatgaagctgaaagcggagaagaaagggaaccactatattctcaatggaaataaattttggataaccaacggtcccgatgcagacgtcctgatagtttatgccaagaccgatcttgcagccgtgccggccagcagaggtattaccgcattcattgtcgagaagggcatgccgggtttttccacttccaaaaagctggacaaactgggaatgagaggcagtaacacatgtgagctgatcttcgaggattgcaagattccggctgctaacatcctgggccacgaaaacaaaggagtctatgtgctcatgagcggcctcgacctggaaaggctggtgctcgcaggaggacccctgggactcatgcaagccgtccttgaccataccatcccttatttgcacgtaagagaagcttttggtcagaagattggacacttccagctcatgcagggaaagatggccgacatgtatactaggctaatggcctgtcgacaatatgtctataatgtagctaaggcgtgcgatgagggacattgcacagctaaagactgcgcaggggtaattctgtacagcgcggaatgcgccacccaggtggctcttgacggaattcagtgttttgggggcaacgggtacatcaatgacttccccatgggcaggttcctgagagatgccaaactctacgaaattggagccggcacatctgaggtcagaaggttggtgataggccgcgctttcaacgctgatttccattag

SEQ ID NO: 121255 - DNA, 1716 bp, Artificial Sequence
  Description of Artificial Sequence: Synthetic coding sequence
atgcgcgctcttcgggaccgcgcaggactgttgctgtgcgtcctgctgttagccgctctgctggaagcggcgctgggccttcccgttaaaaagccacggctgcgcggtccacgcccaggctccctcacccgtctcgctgaagtgagcgccagtccagacccaagacctctaaaggaggaggaggaggccccactccttccaagaacccatttgcaggcagaaccacatcagcatgggtgttggacggttacagaacccgcagctatgacgcccggcaacgctacccctccccggacaccagaagtgaccccactcaggctggagctccagaagttgcctgggctggctaacacaaccctttcaaccccgaatccagacacccaggctagcgcttcgcccgatcctagaccactgcgggaggaagaggaggccaggttgctcccgcgcactcacctccaggccgagttacatcagcacggatgctggacagtcaccgagcctgccgcactcacacccggcaatgcaacccccccccgcacgcaggaggtcacccctctcctattagagctacaaaagttaccagaacttgtccatgctacattatcaactcccaacccggacaatcaagttactatcaaagttgtggaggatccccaggcagaggtgtccattgacctcttggcagaacccagtaaccctcccccacaggataccctgagttggctgccagcactgtggtccttcttgtggggcgactataagggtgaagagaaagatagagctccaggagagaagggcgaagaaaaagaggaggatgaggactacccttctgaagacatcgagggagaggatcaggaagacaaagaagaagacgaagaggaacaggctctctggttcaatggtactacagacaactgggaccaagggtggctggcccctggagattgggtatttaaagactcagttagctatgattacgaaccacagaaggaatggagcccttggtcaccttgttctggtaattgctccacaggtaagcagcagcggactcgcccatgcgggtacggctgtactgcgacagaaactcggacatgtgatttgccctcctgtcccggtaccgaagataaggatactctgggactaccaagtgaggaatggaaactgttggctagaaacgctaccgacatgcacgatcaagatgtggacagctgtgaaaaatggcttaactgtaagagcgatttcttaatcaagtacctctcacagatgctacgcgacttgccctcttgtccgtgcgcctatcctctggaagccatggactcacccgtgagcctgcaggatgaacaccaagggcggtcattccgctggagagatgcctcaggacctagagaacgcttagacatctaccagccaacggctcgcttctgcttgcggagcatgttatcaggggagtcttcaaccctcgcagcccagcattgttgttatgatgaggatagtcgtctattgacgagaggaaaaggcgccggtatgcccaatctaatcagtaccgattttagccctaagctgcattttaagttcgacacgacaccttggatcttatgcaagggcgattggtcaaggctgcatgccgttcttcctccgaacaatggtcgtgcttgtactgataatccactggaagaggaatatttggctcagctgcaggaggccaaagagtactag

SEQ ID NO: 121256 - DNA, 1452 bp, Artificial Sequence
  Description of Artificial Sequence: Synthetic coding sequence
atgacgcctgggaacgccacacctcccaggactcccgaagtcacacctcttcgactggaactccagaaactgccaggtctggccaatacaactctttccacacctaacccggatacacaggcaagcgcatcaccggatccccgaccactgagggaggaagaggaggcccggctgctcccgaggactcatctccaggccgagctccaccagcacggctgctggaccgtgacagaacccgccgcgctgacacccggcaatgccacccctccacgcacacaagaggtgaccccattacttttagaactccaaaaactcccggaactggtgcacgcaaccctttctacacccaatcccgacaaccaagtgacaatcaaggtggtggaggacccgcaggctgaggtctcaatagatcttctggcagaaccctctaacccacccccccaggatactctgtcttggctacccgccctgtggtcctttctgtggggcgactataaaggcgaagaaaaggatcgcgcacccggcgaaaagggcgaggaaaaagaggaagacgaggactatcctagcgaggacatcgagggggaggatcaggaggataaagaagaggacgaggaggagcaggcactctggttcaacggaactacagataactgggaccagggctggcttgccccaggagattgggtgttcaaagattctgtgtcatacgattatgagcctcagaaggagtggtccccatggtccccatgttccggcaactgctctactggaaaacaacagaggaccagaccttgtggctacgggtgtactgccaccgaaacgcgaacgtgcgacctccctagttgccccggcaccgaggataaggatactttaggtctgccttctgaagagtggaaactgctcgcccgaaatgccaccgatatgcacgaccaggatgttgacagttgtgaaaagtggctgaactgcaagtcagacttcttgataaagtatctcagtcaaatgctaagagatctccccagctgcccttgtgcatatcctctcgaggccatggactctcccgtgagtttgcaagacgagcaccaaggcaggtctttcagatggagggatgcttctgggccccgcgagaggctagatatttaccagcccactgcacgcttctgtctcagaagcatgcttagcggtgaatcatccacgctggctgctcagcattgttgttacgatgaggactcacgtcttttgacgagggggaagggcgctggaatgcccaatttaatctccacagatttctccccaaagctccacttcaagtttgacacaactccttggatattgtgcaagggggactggagccgcctccatgccgtactgcctcctaataacggccgtgcatgtactgacaatccgctagaggaggagtaccttgcccagctgcaggaagccaaggagtattag

SEQ ID NO: 121257 - DNA, 1473 bp, Artificial Sequence
  Description of Artificial Sequence: Synthetic coding sequence
atgcgcgccctgcgcgatcgagctggactgttgttgtgcgtgctgttgttggctgctctgcttgaggccgcccttggattacctgtgaagaaaccccgcctcagaggaccaagacccggctcactgactaggcttgcagaagtcagcgccagtccggatccccgtccattgaaggaagaagaagaagcccccctgttacctcggacgcatctgcaggccgagccacaccagcatggatgctggacggtaaccgagccggcagctatgacgcctggcaatgcgacccctcctagaactcctgaggtcacccccctcaggctggagctccaaaagctgccagggctggccaatactacactgagtaccccgaatccggatacgcaggtcactataaaggtggtagaggacccgcaggctgaggtatctatcgatctgctggcagagccctctaacccaccaccccaagataccctgtcctggctgcccgctctatggagctttttatggggtgactataaaggggaggagaaggatagagcccccggggagaaaggcgaggagaaagaggaggatgaggactacccatctgaagatatcgagggcgaagatcaagaagacaaagaagaggacgaggaagaacaggccctgtggtttaatggcaccacagacaattgggatcagggatggttggcccctggggattgggttttcaaggattctgtgtcttacgactatgagcctcaaaaggagtggtccccttggtctccatgcagcggtaactgtagtacaggcaagcagcagagaactagaccctgcggttacggctgcaccgccactgagactcgaacctgtgatctaccatcatgtcccggcaccgaagacaaagatacactgggtctacccagtgaggaatggaagctactggcccgaaatgctactgacatgcatgaccaggatgttgacagctgcgaaaagtggttgaattgtaaatctgacttccttatcaagtatctatctcagatgctgcgagatctgccttcatgcccatgcgcttaccccttggaggccatggactcccccgtcagtctccaagacgaacaccagggccggagcttcaggtggagggacgcctcaggccccagagagcggctagacatctaccagccaacagcccgcttttgcctccgaagcatgctgagtggcgagtcctcaactctggctgctcagcattgctgctatgacgaagattccagactccttacgcggggcaagggcgccgggatgccaaatcttatttcgactgacttctccccaaagcttcatttcaaatttgacactactccatggatcctttgcaagggcgattggagccgactgcacgcggttctccctcctaacaatggcagagcctgcacagataatccactggaggaggagtacctagctcagttgcaggaggcaaaggagtactag

SEQ ID NO: 121258 - DNA, 1473 bp, Artificial Sequence
  Description of Artificial Sequence: Synthetic coding sequence
atgcgagcgctcagagaccgcgccggactcctcctgtgcgtcctgctgctggccgcgctgcttgaagcagctcttggcctacccgtgaagaaacctagattaagaggtcctcgaccaggaagcctcaccaggcttgctgaggcatctgcttccccagatcccagaccattgcgcgaggaggaggaggccagactgcttccacggacgcaccttcaggctgaattacaccagcacgggtgttggacggttaccgaacccgccgccctgactcccggcaacgctacgccaccgcggacgcaggaagtgactcccctgctacttgagctccagaaacttccagagttggttcacgcgacgctgtccactcccaacccagacaatcaggtcacaattaaagttgtcgaggaccctcaggccgaagtatcaattgatctcctggccgaaccctctaacccaccaccgcaggacactttgagctggcttccagctctgtggtcattcctctggggcgactataagggtgaggaaaaagatagggcaccaggcgaaaaaggcgaggagaaggaagaggatgaggactaccctagcgaggatattgaaggcgaggatcaggaggataaagaggaggacgaggaggagcaagcactgtggttcaacggaacgactgacaattgggatcaaggctggcttgctcccggagactgggtgttcaaggattcagtatcatacgactatgagccccagaaggaatggtcaccctggtcaccatgtagcggaaattgcagtacaggcaagcagcagagaacacggccttgcggttacggatgcacagccacagagactaggacgtgcgatctgccttcatgtcctggtaccgaggataaggatactctcggcctgccttccgaggaatggaaactcctggccagaaacgcgactgacatgcatgatcaggatgtcgatagctgtgagaagtggctcaactgtaaaagcgacttcctcatcaagtatctctcccaaatgctccgggatctgcccagttgcccatgtgcatatcccctcgaagctatggacagccccgtttctttgcaggacgagcatcaggggcgcagttttcgctggcgggatgccagcgggccacgggagcgtctagacatctatcagccaaccgctcgattctgccttcgctctatgttgtcgggggaatccagcacactggctgcacagcattgctgttacgacgaggactcccgactgcttacaagaggcaagggagccggcatgccaaacttgatttcaacagatttcagccctaaattgcatttcaagttcgacacaacgccatggatattgtgcaagggagactggagtcggctgcacgcagtgctgccacctaacaacggtagagcatgcactgataatccactggaagaagagtatctagcgcagctccaggaagccaaggagtactag

SEQ ID NO: 121259 - DNA, 879 bp, Artificial Sequence
  Description of Artificial Sequence: Synthetic coding sequence
atgcgagccctgagggaccgagccggcctgctcctttgtgtcctactgctggccgccttgctagaagcggctctagggctgcctgttaaaaaaccccgactgcgtggtccacggcctggctcactaacacggctggctgaagtgtctgcatccccagaccctagaccgttgaaagaggaagaagaggcaccactgctgcctagaactcacctccaggccgagcctcaccagcacggttgttggactgttactgagcccgcagccatgacacccggtaacgccacccccccacggactcccgaggtcacacccctgcgactggagctgcaaaaattacctgggttagccaatactaccctgtctactcctaaccctgatactcaggctagcgcgtccccagatccgaggccactccgcgaagaggaggaggcgcggctgcttcctcgaacccatctacaggctgaactgcaccaacatggctgttggacagtgacagagcctgccgcccttacaccggggaatgcaacaccccccagaacccaggaggtcactcccctgctcctcgagcttcaaaaattacctgaactggtacacgccaccctgtcaacaccaaacccagataaccaaactatgtccttgcgccggagcggagtgcctggcctccctgccgtgggaacggctgcgctcgcaagctcgagaggcctgggacccgtggccatggcagcgctgccacccaggccggtcccagtcacgtgtcctcccgtacttgctttgcgtacccgaactccctgggcctcacctgtcagatccggatcaagttggcccgccatgctgcgcacctgtatgatcaaaatgtggactgccgtgcgctctgggtag

SEQ ID NO: 121260 - DNA, 924 bp, Artificial Sequence
  Description of Artificial Sequence: Synthetic coding sequence
atggcaaggaatgccgaaaaggccatgacagcactcgccagattccgacaggcacagctggaggagggcaaagtgaaggaacggaggccgttcctggccagtgaatgcaccgagctccccaaggccgaaaaatggcggcggcaaatcattggcgagatcagtaagaaggtggcgcaaattcagaacgcaggattaggcgaattccggattcgtgatttaaatgacgaaatcaacaagctcctacgcgagaaaggacattgggaagttagaatcaaagagttgggtggacctgactatggtaaagtggggcccaagatgctggatcatgaaggaaaggaagtcccaggcaatcgaggatacaaatattttggagctgccaaggacttgcccggagtgcgcgagctgtttgagaaagagaggcaggtgaggtggctgatgcctgtgatcccagctctgtgggaagctgaggcaggcggtagccaggctctgccgccccccagaaagacacgcgctgaattgatgaaggcgattgatttcgagtactacggttacctggacgaggatgacggagttatcgtgccactagagcaggagtacgaaaagaaactgcgcgccgagttagtggagaagtggaaggcagaaagagaagcaaggctcgcgcggggcgaaaaggaagaagaggaggaggaagaggaagaaattaatatctatgccgtgactgaagaggagtcagacgaggaaggcagccaggagaaggggggtgatgatagccagcaaaaattcattgcccatgtaccagtgccaagccaacaggagattgaagaggcactggttaggcgaaaaaaaatggagttactccagaagtacgccagcgaaacactgcaagctcagtcagaggaggcgagaagactcctgggctactag

SEQ ID NO: 121261 - DNA, 858 bp, Artificial Sequence
  Description of Artificial Sequence: Synthetic coding sequence
atggcccgaaacgccgagaaggccatgactgcactcgcacgcttccgtcaagcccagttggaggaggggaaggtgaaggagaggcgtcccttccttgcttccgagtgcacagagctgcctaaagccgagaagtggcgcagacagatcatcggggagattagtaaaaaagtggctcagatccagaatgccgggctgggcgagttccggatccgagatcttaacgacgaaatcaataagctgctgagagagaaggggcactgggaggtgcgaattaaggagctggggggccccgattatggcaaggtaggccctaagatgctagatcacgagggaaaagaggtaccagggaataggggatacaaatatttcggcgctgcaaaagacctgccaggggtgagggagctcttcgaaaaggagcccctgccgccgccacggaagacccgcgcagagctcatgaaggcgatcgactttgagtattacggctatctggacgaggacgatggcgttattgtgccgctcgagcaggaatatgaaaagaaactccgggccgagctggtggagaaatggaaagccgagagggaagcgcggctggcccgtggcgaaaaagaagaggaggaagaagaggaagaggagatcaatatctatgccgtgaccgaggaagaatccgatgaggagggatctcaggaaaaggggggcgatgatagccagcagaaatttattgcccacgttccagtgccaagccagcaggagattgaggaagccctcgtgagacgcaagaagatggagctgctccagaaatacgcatctgaaacactacaagcacagagcgaggaagccaggaggctgcttgggtattag

SEQ ID NO: 121262 - DNA, 2712 bp, Artificial Sequence
  Description of Artificial Sequence: Synthetic coding sequence
atgtcagatagcggatctcagcttggttcaatggggtcgctaacgatgaagtcccagctccagataacggtgatctctgcaaaactcaaggagaataagaagaattggttcggtccctccccctacgtggaggtgaccgttgacggtcagagcaaaaagacggagaagtgtaataacacgaacagcccgaagtggaagcaacctttgacagtgattgtcaccccagtctctaagttgcactttagagtttggtcgcatcagacgttgaagtccgacgttctgctgggcactgcagcgctggacatttatgaaacattgaagtcaaataatatgaagcttgaggaagtggtggttacactgcagctgggaggggacaaggagccgaccgaaacaatcggcgacctttcaatttgcctcgacggtttacagcttgagtcggaagttgtgactaacggggaaactacatgttccgaaaacggtgttagcctgtgtctgcccagattggaatgcaattccgccatttctgcccactgcaatctctgcctccctggcctttctgacagtcccatcagtgccagcagagtggctgggtttacaggagcctcacagaatgatgacggctctaggagcaaggatgagacaagagtgagcactaacggcagcgacgaccccgaggatgccggcgccggtgaaaaccgcagagtcagtggcaacaactcccctagcctgagcaatggggggttcaagccctcccgaccaccgagaccctcccgcccgccccccccgacaccaaggcgcccggcatccgtgaacgggtcaccgtccgccacctcagagagcgacgggtctagtacaggctccttaccgcctacaaatactaacacaaacacatcggagggcgctacaagcggtctcatcatcccactgacgatctctggagggtcaggcccacgccccctgaaccctgttacgcaagcgccactgccccccggatgggagcaacgggtggaccaacacggcagggtgtactatgtggatcacgttgaaaaacggacaacatgggaccggccagaaccccttcccccggggtgggaacggagagttgacaatatgggccggatttactacgttgatcactttacacgcacaaccacgtggcaaagaccgaccctagagtctgtcaggaattatgagcagtggcaacttcagcggagccagctgcagggtgccatgcagcagttcaatcaacggttcatctacggaaaccaggacttattcgccactagtcagtcaaaggagttcgatccgctgggtccattgcctccaggctgggagaagcggaccgactccaatggcagagtgtacttcgtgaaccacaacaccaggatcacccagtgggaagatccacgaagccaaggacagcttaacgagaagccactgccggaggggtgggaaatgcggtttactgtggatggaattccttatttcgtggatcataatcgaagaacaacaacatacattgaccctcgcaccgggaaatccgctctggataacggcccgcagatcgcctatgtcagggacttcaaggctaaggtacagtattttcggttctggtgccagcaactagcgatgccccagcacatcaagattaccgtgactcgcaagaccttgttcgaggactccttccaacagattatgtcttttagtccgcaggacctgcggagaagactctgggtgatcttcccgggtgaagagggcttagattacgggggggttgcccgagagtggttcttcctgctgagccatgaggtgctgaatcccatgtactgtctttttgagtacgcgggaaaagacaactactgccttcagatcaatccggcttcttatattaaccctgaccacctgaagtacttccgctttattggaaggttcatcgcgatggccctgttccacggcaaattcatcgacactggcttcagcctgccattctacaagagaatccttaataagcctgtcggtcttaaggacctggagagcatcgatcccgaattctataactccctcatatgggttaaggagaacaatatcgaggaatgtgatctggagatgtatttctcagtggataaggagatactcggggaaatcaagtctcacgatcttaagcctaatgggggcaacatcctagtcacagaagaaaacaaggaagagtacatccggatggtggctgaatggcgtttaagcaggggggtcgaggagcaaactcaagcattctttgaaggcttcaatgagatattgcctcagcagtacttgcagtacttcgatgccaaagagctggaggttctgctctgtggcatgcaagagatcgatctgaatgactggcagcgccacgcaatctatcggcactacgcacggacaagtaagcaaatcatgtggttttggcagttcgttaaggagattgataatgagaagcggatgcgcctactacagttcgtcacaggaacctgccgactgccagtcggcggttttgctgaccttatgggaagcaacggccctcaaaagttttgcattgagaaggttggcaaagagaattggctgcccagaagccacacctgctttaacaggctggatctgcccccctacaagagctatgaacagctcaaggagaagctgttatttgcaattgaggagactgagggattcggccaggagtag

SEQ ID NO: 121263 - DNA, 2589 bp, Artificial Sequence
  Description of Artificial Sequence: Synthetic coding sequence
atgagcgatagtggatctcagctgggatccatgggatcactaacgatgaagagccagttgcaaattacagtgatatcagccaagttaaaggagaataagaagaactggttcggcccctctccctatgtcgaagtgacggtggacgggcagagcaagaagacagaaaagtgtaataacaccaactcacctaagtggaaacagccactgactgtcattgtcactcccgtgtcaaagctgcattttcgcgtttggagtcaccagaccttgaaatccgatgtgttactcggaactgccgccctagatatttacgagacacttaagtccaataacatgaaactggaagaggtcgtcgtgaccctacagctggggggcgacaaggaacccaccgagactatcggggacctcagcatctgtctggatggcttgcagctggaaagcgaagtggtgacgaatggcgagacaacctgttccgaatcggcttcacagaatgacgatggttccaggtccaaagacgaaacccgggtctcaaccaatgggtccgacgaccccgaagacgccggagcaggggagaacaggagagtttcaggtaacaactctcctagcctgtctaatggaggtttcaagccatcccgtccaccacgcccaagccggcctccccccccaacccctagacggccagcctccgtgaacggctccccctccgcgacctctgaatccgatggttcttcaacaggttcccttccccccacgaacacaaacaccaataccagcgagggcgccaccagcggacttataatcccgctaactatttcagggggtagtgggccaagaccactgaacccggttacccaggcaccccttccccctgggtgggagcagagggttgaccagcatggccgagtctattatgttgaccacgtggagaaacggaccacgtgggatagacccgagcctcttccacctggctgggagagacgagttgacaatatggggcgaatttattatgtcgaccactttaccagaacaactacttggcagcgtccgactctcgagtccgtacgcaactacgagcagtggcagttgcagcggtctcagctccagggtgcaatgcaacagtttaaccaacgattcatctacggcaatcaggacttgttcgcaacttcccagagtaaggaattcgaccctctggggcctctccctcctgggtgggaaaaacgcacggactctaacgggcgggtgtacttcgtcaatcacaatactagaattactcagtgggaggaccctaggagccaaggccagttaaacgaaaagcccctacctgaaggctgggagatgagattcactgtggatggcatcccatacttcgtggaccacaaccgtaggacaaccacctatattgacccgaggaccggcaagagcgccctggataacggccctcaaattgcttatgttcgagacttcaaggcaaaagtccaatacttccgattctggtgccagcagctggccatgccccaacatatcaaaataacagtcacgaggaaaacgttgttcgaagatagctttcaacagatcatgagtttttcaccccaggatctgcgccggcggctgtgggtgattttccctggagaggaaggattggactacggaggtgttgcccgggagtggttcttcttgctatctcacgaggttctcaaccccatgtattgtctgtttgagtacgccggaaaagacaactattgtctgcaaatcaatcccgcatcttatatcaacccagaccacttgaagtacttcagatttatcgggcggttcatcgcaatggccctgttccacggaaagtttatagacacgggtttctcactccctttctacaagcgcatcctcaataagccagtcggactgaaggacttagaatccatcgacccagagttctacaattctctcatctgggtgaaagaaaacaacattgaagagtgtgatttggagatgtattttagcgtggacaaggaaatccttggagaaataaagtcccacgacctgaagcctaacggagggaacatcttggttaccgaagaaaacaaagaagagtacatccggatggttgctgagtggaggttgagcagaggcgtagaagagcagacacaggctttttttgaagggttcaacgaaattctgcctcagcagtatctgcagtatttcgacgcaaaggagcttgaagtgcttctttgtggcatgcaggagatcgatctgaatgattggcagcgccacgccatctaccggcattatgcccgtacaagcaagcagattatgtggttttggcagttcgtgaaggagatagacaatgaaaaaagaatgaggctgttgcagttcgtgaccggaacatgtcgcttgcccgtgggtggatttgctgaccttatgggcagcaatggaccacagaaattttgtatcgaaaaggtgggtaaagaaaattggctgccccggtctcatacctgttttaacaggttggacctgccaccttataagtcctacgaacagctaaaagaaaagcttctctttgccattgaggagacagagggattcggtcaggaatag

SEQ ID NO: 121264 - DNA, 2259 bp, Artificial Sequence
  Description of Artificial Sequence: Synthetic coding sequence
atgaagttggaagaggtagtggttacacttcagctgggcggcgacaaagagccgacggaaacaattggggatctgtcaatttgtctcgatggcctgcagttggagagcgaggtggtcactaatggtgagaccacctgctccgaatcagcttctcaaaacgatgatggaagtaggagtaaggatgaaaccagagtgtccaccaacggaagtgacgaccctgaagacgccggggctggagaaaataggagagtgtccggcaacaattctccttctctgtctaacggcggcttcaagccttctcgcccacctcgcccatcccggcccccgcctccaacaccccggcgtccagcatctgtaaatggatccccgagcgctacctccgagtcagacggttcctctaccggatctctgcctcctactaataccaatacgaatacatccgaaggcgcaacatccggtcttattattccccttacaatctccggcgggagcgggccccggccattgaatcctgttacgcaagctcccctgcctccaggatgggaacagagagtagaccagcacgggcgggtctattatgtagaccatgtggagaagcggacaacatgggatcggccggagccgttgcccccaggatgggaacggagggtggataatatgggcaggatctactatgtcgatcatttcactcggacaaccacttggcaaaggcccactctggaaagcgtcaggaactacgagcaatggcagctgcaacgatcccaactgcagggcgcaatgcagcagttcaaccaacgctttatttacggcaaccaggatttgtttgccacatctcaatccaaagaattcgaccctttgggtccgctgcccccagggtgggagaaaaggacggatagcaatgggagagtatattttgtgaatcataatacccgtataacccagtgggaagacccacgcagccaaggacaactgaatgagaagccgttgcccgagggttgggagatgcgttttacagttgatgggatcccttattttgtggatcacaacagaagaacaaccacatacatagacccaaggaccggaaaaagtgcgctggacaacggtccacagatagcttatgtgagagattttaaggcaaaagtccagtactttcgcttctggtgccagcagttagccatgcctcagcacattaagatcaccgtcacacgcaaaacgcttttcgaggactctttccaacagatcatgagcttttccccgcaggacctgcggagaagactgtgggtgatcttccccggcgaggagggtctggattacggaggcgtggcgcgggaatggttctttttgctaagtcacgaggtgctgaaccccatgtattgtttgtttgaatacgctggcaaggataactactgtttacagatcaatccagcatcttacataaaccccgaccacttgaagtatttccgcttcatcggtcgcttcatcgccatggccctgtttcacggaaagtttatcgacacagggtttagcctgccgttttacaaacggatcctgaacaagcctgttggactgaaagatctggagtctattgatcccgaattctacaactctctcatttgggttaaggaaaacaacattgaagaatgtgacctagaaatgtacttctcagtcgacaaggaaatcctgggagaaattaagagccacgaccttaagcccaacggcggtaacattttggtgacagaggagaacaaggaggaatatattcgaatggtcgccgagtggcggctgtcgagaggggtggaagaacagacacaggcgttttttgagggatttaacgaaattctcccacagcagtacctgcagtacttcgatgccaaggaactggaagtcttactgtgtgggatgcaagaaatcgacctaaacgattggcagcggcacgcaatctatagacactacgccaggacgtccaagcagattatgtggttctggcaattcgtaaaagagatagataatgaaaaacgcatgcgcttgctgcagtttgtaacagggacctgccgactgcccgtaggcggtttcgccgacctaatgggttccaatggccctcaaaaattttgtattgagaaagtgggaaaagaaaactggctgcctcgttctcatacttgctttaacagactggaccttccaccttacaaatcttatgagcagctgaaagagaaactgctctttgctattgaagagacagagggctttggccaggaatag

SEQ ID NO: 121265 - DNA, 3717 bp, Artificial Sequence
  Description of Artificial Sequence: Synthetic coding sequence
atgcgggctcagggacgtggcagactgccgaggagactgctgttactgctcgccttatgggtgcaagctgctcgaccaatgggatactttgaactccagttgtctgctctccgcaacgtgaatggtgagctgctttccggcgcatgttgtgatggcgacggccggaccacgcgtgccggaggatgcgggcacgatgaatgtgatacatacgttagggtttgtctgaaggagtaccaggcaaaggtcacacctactggcccctgttcatacggtcatggggccactcctgttctgggtggaaactccttttatcttccccccgcaggggctgccggggatcgcgcacgggcccgggcgagggctggtggggaccaagatccaggtttagtggtaatccctttccagtttgcgtggccacgctccttcaccctgatcgtggaggcctgggactgggataacgataccactcctaatgaggagcttctcatagagcgggtcagccacgctggaatgataaatccggaagaccggtggaaatctctccacttcagtggacacgttgcccatctggaactgcagattcgagtccgctgcgacgagaattactattctgccacatgcaacaaattctgccggccaagaaatgacttctttggccactacacttgcgatcaatatggaaacaaagcctgcatggatggctggatggggaaggagtgtaaagaagccgtctgtaagcaggggtgcaacttacttcatggcggttgtacagttcccggcgaatgtaggtgctcctacggctggcagggcagattttgcgacgagtgcgtgccatacccagggtgcgtacacggtagctgcgtggaaccatggcagtgcaactgcgagacaaattggggagggttgctttgcgataaagacctcaactactgtgggagccaccacccctgcacaaacggaggaacctgcataaacgcggagccggaccagtaccgatgcacctgccctgatggctattcagggcggaactgcgagaaggctgaacacgcatgtacgtctaatccttgtgccaacggtggctcatgtcacgaggtcccatccggcttcgagtgtcactgtcccagtggatggtctgggcccacatgtgccctggacatcgatgaatgcgcctctaacccctgtgccgccggagggacatgtgttgatcaagtcgatggctttgagtgtatttgcccagagcagtgggtgggagcaacctgccagctggacgcgaacgaatgtgagggcaaaccctgtttgaacgcatttagttgcaagaatctcatcggaggttattattgtgactgcatccctggttggaaagggattaattgtcatataaatgtgaacgattgcaggggtcagtgccagcacgggggcacctgcaaggacctggtgaacgggtaccaatgtgtgtgcccacggggtttcggagggagacattgcgaactggaaagggatgaatgcgcttctagcccctgtcacagcggaggcttgtgtgaagaccttgccgacggctttcactgtcactgccctcaggggttttcagggcccctgtgcgaggtggatgtggatctctgcgagccaagcccttgtcgcaatggagcccgttgttacaatttagagggcgactattattgtgcttgccctgatgattttgggggaaaaaattgtagtgtgcctagagagccatgccccgggggcgcatgtcgcgtgatcgacgggtgcgggtctgatgctgggcctgggatgccaggaacagctgcctccggtgtgtgtggaccccatgggcgctgcgtctcgcaaccaggaggcaattttagctgcatctgcgatagtggttttactggcacatattgtcacgagaatatcgacgattgcctggggcagccctgtcgaaacgggggcacatgcatcgacgaggtcgatgcattcagatgcttctgtccgagcggatgggagggagaactctgcgataccaacccaaatgattgcctgcccgacccgtgccatagtagaggcagatgttacgatcttgtgaatgatttttactgtgcctgcgacgacggctggaaagggaaaacatgtcactctcgcgagtttcagtgtgacgcctatacctgttctaatggcggaacctgctatgatagcggtgacacgttccggtgtgcttgtcctcccggatggaagggctccacctgcgcagtcgccaagaactcatcttgtctgccaaacccctgtgtgaatgggggcacctgcgttggcagcggagctagcttttcctgcatttgccgtgatggctgggaaggacgcacatgtacccataacactaacgactgcaatcctctgccttgctacaacggggggatttgcgtagacggagttaattggtttcgctgcgagtgtgccccaggctttgccggcccagattgccgcatcaatatcgatgaatgccagtcatcaccttgtgcctatggggctacctgcgttgacgagattaacgggtatcgatgtagttgtccccccggaagggcagggcccaggtgccaagaggtgatcggctttggaagaagctgttggtcccgggggaccccttttccacatggttcttcatgggtggaagattgcaattcttgtaggtgcctagatgggcgcagagactgctctaaagtgtggtgtggatggaagccctgcctgctcgcaggtcagccagaggcactcagtgcgcagtgtcccctagggcagcgttgtctggagaaggcgcctggacagtgcctgagacccccatgtgaagcttggggcgaatgtggtgctgaagaaccacccagcacgccatgcctaccacgttccgggcacctagataacaattgtgcccgattgacgctacacttcaaccgggaccacgtcccccaggggacaaccgtaggggccatctgcagcggcattagatctcttccagcaacaagagccgtcgcacgggacagactcctggtgctgctgtgcgaccgcgcctcgtccggtgcttctgcagtggaagttgccgtgagcttcagccccgccagggatctgcctgatagctccctgattcagggtgctgcccatgctatcgtagcagccattactcagagaggcaactcatcgctcttgctggccgtgactgaggtgaaagttgaaacggtggtgaccggagggtcatccaccggtctcctggtcccggtactgtgcggcgctttttccgtgttatggttagcatgtgtcgtgctgtgtgtttggtggacccgtaaacgcaggaaggagagagagagaagtcggcttccgagagaagagtcagccaacaaccagtgggcgcccctgaatcctatccggaacccgatagagcggcccggtggccacaaggatgttttgtatcagtgtaagaatttcactcccccaccccggagagccgatgaagcccttcctggtccagccggtcacgccgccgtgagggaggatgaagaagatgaagatcttggccggggcgaggaagatagtctggaggcggagaagttcctgtcccacaaattcactaaggacccaggccgcagtcctgggcgccctgcacattgggctagcggcccaaaggtcgataaccgggcggttaggtctataaacgaggcacggtacgccgggaaggagtag

SEQ ID NO: 121266 - DNA, 3603 bp, Artificial Sequence
  Description of Artificial Sequence: Synthetic coding sequence
atgcgggcccagggacgcgggcggctgccccggagactcctgctcctgctcgccctctgggtccaggccgcacgtcctatggggtactttgaactgcagctctcagcattgaggaacgtgaatggagagctcctcagcggcgcgtgctgtgacggggacggacgaactacgagagctggaggctgcggccacgacgagtgcgacacgtatgtgagggtgtgcttaaaagaatatcaggccaaggtgactcccactgggccctgttcatatggtcatggggctacacccgtacttggcggcaattccttttacctgcctcccgctggggcagcaggcgacagggccagagcccgcgcccgagccggaggggatcaggacccaggacttgtggtgattcccttccagtttgcgtggcctagatcatttactctcatcgttgaggcatgggactgggataacgacaccacgccaaacgaggagctgctaatcgagagggtctcacacgccggaatgattaaccctgaagacagatggaagagccttcatttctcaggccacgtcgcacatttagaactccagattcgggttcggtgcgacgaaaactactactctgccacatgcaataaattctgccgacccagaaatgatttctttggacactacacgtgcgatcagtatggtaataaagcctgcatggacggttggatgggtaaagagtgcaaggaagccgtctgtaaacaggggtgtaacttgttacatggaggctgcacagtgcccggggaatgccggtgttcttacggatggcagggtcgcttttgtgacgaatgtgtcccgtatccgggatgcgtccatggctcatgtgtcgaaccatggcagtgcaactgcgagactaattggggcggattgttgtgtgacaaggacctcaattactgtggctctcaccacccatgcactaatggcggaacatgtatcaacgccgagccggatcaatatcgatgcacgtgcccagatggatatagcgggagaaactgtgaaaaggctgaacatgcgtgtacatcaaatccctgtgctaatggagggtcctgccatgaagtgccttctggatttgagtgccactgtccttcaggatggagcggacccacttgcgcactggatatcgacgagtgtgccagcaatccctgtgccgcaggtggtacctgcgttgatcaagtggatgggttcgagtgtatctgtccagagcaatgggtgggagctacatgtcagttagacgtgaatgattgtcgtggacagtgccagcacgggggcacgtgcaaggatctggtgaatggctatcagtgtgtctgcccacgcggattcggcggacgccactgtgagctcgagagagacgagtgcgctagcagcccatgccactccggcggcctctgcgaagatttggccgacggctttcactgtcattgtccgcagggattcagcggtccattatgtgaggtagatgttgacctgtgcgaaccttcaccctgcaggaatggtgcacgctgctataacctagaaggagactattattgtgcttgtccagatgactttggcggcaaaaattgctctgtgccgagagagccatgccctggcggagcctgtagggtgatcgacggatgcgggagtgatgccggtcctgggatgccaggcacggccgcatccggcgtatgcggccctcatgggcgctgtgtcagtcaacccggagggaacttctcgtgcatttgtgacagcgggtttactggcacctactgtcacgagaatattgacgactgcctgggtcaaccttgtcgtaacggcggcacctgtatcgacgaggtcgacgcttttagatgtttttgtccgtctggctgggagggagagctgtgcgacaccaatcccaatgattgcctgcctgacccatgccattcaaggggtcgctgctatgacctcgtgaatgatttttactgcgcatgcgacgatggatggaagggcaagacgtgccacagccgggaattccagtgcgacgcttatacgtgctctaacggtggtacctgttacgattcaggggacacatttcggtgtgcttgtccacctggctggaagggtagcacgtgcgccgtcgcaaaaaattcctcttgcctcccaaacccatgtgttaacggtgggacctgcgtcggcagtggcgcatcctttagctgcatttgccgcgacggatgggagggtcggacctgtacacacaacactaatgactgcaacccactgccctgctacaacgggggcatatgtgtggacggagtcaattggtttcgctgtgaatgtgcccccggctttgcaggccctgattgtcgcatcaatattgatgagtgtcaaagttcaccttgcgcatacggcgccacatgcgtggatgagatcaacgggtatagatgttcatgccccccgggccgagccggaccacggtgtcaggaagtaatagggttcgggcgctcttgttggtcaagagggacaccgttcccacacggaagcagctgggtcgaagactgtaattcctgtcgttgcctggacggaagacgcgattgttccaaagtgtggtgtggctggaagccgtgcctgctggcgggccagccggaagctctgagcgcacagtgtcctttgggacagcgttgtttagaaaaggcccctggccaatgcctccgacctccttgcgaggcttggggggagtgcggggccgaagagccaccaagcactccctgtcttccaaggtcgggccacttggacaataactgcgccagattgactctgcacttcaacagggaccatgttccccagggcacaacggtgggagccatatgttctggaatccggtctttgcctgcgacgcgtgctgtggcccgcgatcgccttctggtgttgttgtgcgatcgggcctcttctggtgcctctgctgtggaggttgctgtgtcattcagccccgcaagagacctgccagacagctccctgatccagggagcagcccatgccatagtcgcagcaatcacccaacgggggaactcatccctcctcctggctgtgactgaggttaaagtggagactgtggtgacagggggatctagcaccggactgctcgttccagtgctgtgcggtgcctttagtgtgctttggctggcttgtgtggtcctatgcgtttggtggacccggaagagacgcaaggagagagagcgatctcgattgccacgcgaggagtcagccaacaaccagtgggcccccttgaatcccatacgcaaccctatcgaacgtcccggcggacataaggacgtgttgtatcagtgtaaaaattttaccccaccaccacggcgagccgacgaggccctgcccggccccgcgggacatgctgctgtgagagaggatgaggaagacgaagatctcggtcggggagaagaggatagcctggaagctgagaagttcctgtcccacaaatttactaaagaccctgggcggagcccgggacggcccgcccactgggcgtcaggccctaaagtcgataatcgcgccgtcaggagcatcaatgaagcccgatacgctggcaaagagtag

SEQ ID NO: 121267 - DNA, 3465 bp, Artificial Sequence
  Description of Artificial Sequence: Synthetic coding sequence
atgcagtatcttaatataaaggaggactgtaacgccatggcgttttgtgccaaaatgagatccagcaaaaaaacagaggtgaacctagaagcccctgagcccggtgtggaagtcatattttacctgagcgaccgtgaacccctcaggctcgggtcaggagaatacaccgccgaggagctgtgcataagggccgctcaggcctgtcgcatctctcctctctgtcacaatctttttgctttatatgatgagaataccaagttatggtacgcacctaatcggactataacggtcgatgataagatgagcctccgactgcattaccgcatgcgcttttattttaccaactggcacgggaccaacgacaacgagcagagcgtctggcgacattcacccaagaagcaaaagaacggctatgaaaaaaaaaaaattcctgatgctaccccacttttagatgcttcctcattggaatacctctttgcacagggtcagtacgacctggtgaagtgcttagcacctatccgggatcccaaaaccgaacaggacgggcatgatattgaaaacgagtgtctgggaatggcagtcttggcaatctctcattatgccatgatgaagaaaatgcagctgcctgaactcccgaaagatattagctataaacgatacattcctgagacactcaataaaagcatcagacagaggaacctgctgacacgcatgcggataaacaatgttttcaaggactttctgaaggaattcaataacaaaactatttgcgactcctctgtgtccacacacgacctcaaggtgaagtatctcgccacactggagacactgacgaagcactacggtgccgagatttttgaaactagtatgctgctgatctccagtgaaaatgagatgaactggttccatagcaatgacggcgggaacgtgctctattacgaagtgatggtgaccggcaacttggggattcagtggcgacacaagccaaacgtggtcagtgtcgagaaggaaaagaacaagcttaagcgcaagaaactcgaaaataaacacaaaaaggacgaggagaaaaataaaatacgagaagagtggaataacttcagctactttcccgaaattactcacattgtcatcaaagagtccgtggtctccatcaataaacaagataataagaaaatggaattaaaactgtccagtcatgaggaggccctctccttcgtatcgctggtggatggatacttcaggttaactgcagacgctcaccattacctttgcactgacgtggcccctccccttattgtgcataatatccagaacggatgccatgggcctatttgtacagaatacgccattaataagctgcgacaggagggctccgaagagggcatgtacgtgttgcgatggtcctgtacagatttcgacaatatattgatgacggttacgtgtttcgagaagtctgaacaggtccaaggcgcacagaagcagttcaagaattttcagattgaagtccagaaggggcgatattccctgcatggaagtgacaggtccttcccatcattgggggacctgatgagccatctcaaaaagcagatcttaaggacggataacatttcttttatgttgaaacgatgctgtcagccaaagcctagagaaatcagcaatctcttggttgcaactaagaaagcacaggaatggcagccagtatacccaatgtcacagctctcgtttgaccgtatactgaagaaggatctggtacagggcgagcaccttggcagaggcaccagaacccacatttattccggtactctgatggattacaaggacgatgaaggcacgagcgaggagaaaaaaattaaagtcattctgaaagtcctagatcccagccatcgagacatcagtcttgcgttcttcgaggctgcatcaatgatgcggcaggtgtcccacaagcatatagtgtacctctacggcgtctgcgtcagggatgttgagaacattatggttgaggaattcgtggaaggcggccctttggacctgtttatgcaccggaaatccgacgtactgactaccccttggaaatttaaagttgccaagcagctcgcatctgctcttagctaccttgaggacaaggaccttgtccacgggaatgtgtgcaccaaaaacttgcttctggcgagagagggaatcgattctgagtgcggaccattcattaaactctccgacccaggaatccctataactgtcctttcgcgccaggagtgcatcgagcgaattccgtggattgcccctgagtgcgtggaggattccaaaaacttgtccgtcgcagcagacaaatggtcattcgggactacactatgggaaatctgctacaacggagaaattccactgaaggacaaaacgctgatcgagaaagaaaggttctatgagtcgcggtgcagaccggtgacgcccagctgcaaggaattggcagacctcatgactaggtgtatgaattacgatcctaatcaacgtcctttttttagggcgattatgagagatataaataagctggaggagcagaaccctgatattgtgagtgaaaagaaaccagctaccgaggtggacccaactcactttgagaagcgatttctaaagcggattagagacctcggtgaagggcactttggaaaggttgaactgtgccgatacgaccctgaaggagacaatacaggggaacaggtggcggttaaatccctgaaacccgaatccggtggtaaccacatagcggacctaaaaaaggagattgagatcctgagaaacctgtaccatgaaaacatcgttaagtacaaagggatctgtacagaggatggcggcaacgggattaagctgattatggagtttctgccttccggctccttaaaggaatacctgccaaagaacaagaataagataaacttaaagcagcagctgaagtacgccgttcaaatctgcaagggtatggattatctcggtagcaggcagtatgtgcatcgtgacctggccgcccgcaatgtgctggtcgaatctgagcaccaggtgaaaattggcgacttcggactcacaaaggcaatcgaaaccgataaggagtactacacggttaaggacgatcgggactcccctgtcttctggtacgcgcctgagtgcctgatgcagtctaagttctacatagcgagcgatgtatggtcatttggagtaaccttacacgaactgctcacgtactgcgactctgactcttcacctatggcattattccttaagatgatcggccctacccacggacaaatgacggtcaccaggttggtgaatacactgaaggaggggaaaagattgccttgccccccaaattgccctgacgaggtttaccagttaatgcgcaagtgctgggagttccagccctcaaatcgcaccagtttccagaacttaattgaagggtttgaggccctgctgaagtag

SEQ ID NO: 121268 - DNA, 1860 bp, Artificial Sequence
  Description of Artificial Sequence: Synthetic coding sequence
atggcaccaccctcagaagaaacacccctgatcccacaacggagctgtagtctgctcagcacggaggccggagccctgcatgtgctgctccccgccagaggacccggccccccccagaggctctctttctcctttggcgaccatcttgccgaggatctgtgtgttcaagctgcaaaagcctcaggtattctgccagtataccattccctatttgctctggccactgaagacctgtcatgctggttccccccgagccatattttctccgtcgaggacgctagtactcaggtactgctctacagaattaggttttattttcctaactggtttgggctggagaagtgccaccggttcggcctccggaaagaccttgcctctgccatattagatctcccagttctagaacatctctttgctcagcatcgctcagatcttgtgtccgggcggttgcctgttggtctgagcttgaaagagcaaggtgagtgccttagcctcgccgttctggatcttgctagaatggcaagggagcaggcccagaggccgggcgagctgctcaaaaccgtttcgtacaaagcgtgcctgcccccctccctccgagatctgattcaaggactttctttcgtgacgcgccgccggattagacggaccgtgcgcagggcacttaggagagtggctgcctgtcaagcagatagacacagcctgatggctaaatacatcatggacctggaaaggctggaccccgctggagcagccgagacatttcatgtggggctccccggggcccttggcgggcacgatggtctgggtctgctgagagtcgccggtgacggtggaattgcttggactcagggagagcaggaggtgctccagccgttctgcgactttcccgagatcgtggatatttccatcaaacaagcaccaagagtagggcccgccggggaacatcgactggtcacagtcaccagaaccgacaaccagatccttgaagccgaattccctgggctcccagaggcccttagtttcgtggcattggttgacgggtacttccggctcactacagactctcaacactttttctgcaaagaggtggctcccccccgactcctagaggaggttgcagagcagtgccacggccccattacactggactttgcaatcaacaagctgaagacgggcggctctagaccaggatcctacgtgctacgaaggagcccgcaggacttcgattctttcctacttaccgtatgcgtgcaaaatcccctgggccccgactacaagggttgcttaatcaggagatctccaaccggcacctttcttctcgtgggcctgagtcgcccgcatagctctctccgggagctccttgccacctgttgggatgggggccttcatgtggacggggtcgccgtcactttgacaagctgctgtataccacggccaaaagagaagtcaaatctgattgtggtccaacgcggccattcccctcccacctcatcgctcgtgcagcctcagagccaataccaactctcacagatgaccttccataagatccctgctgatagtctggagtggcatgagaacctaggacatggatctttcacgaagatttaccgaggatgtagacatgaggttgtggatggggaggcgcgtaagacagaggtcttactgaaggttatggatgccaaacacaaaaactgcatggagagttttctggaggcggcctctctgatgagccaggtgtcctacaggcatttggtcctgctgcatggtgtgtgcatggcgggggactctgagtctcctccacccacacacccaactccagcctctccaaagtctcgactgtttttcccacccctgttctag

SEQ ID NO: 121269 - DNA, 3375 bp, Artificial Sequence
  Description of Artificial Sequence: Synthetic coding sequence
atggcccctccatccgaggagacccctcttattccacagcgctcctgttccctgttgtccaccgaggctggtgctctgcacgttcttcttcctgcccgtgggcctggtccccctcagcgcctctcattctccttcggtgaccacctagctgaggatttgtgcgtccaagcagccaaggccagcgggattctacccgtgtatcactccttattcgccctggccaccgaagacttgtcctgttggtttccaccgtctcatatctttagtgtggaggacgccagcactcaagtgttgctctaccggattaggttctattttccaaattggttcggactggaaaagtgtcatcgatttggcttgcgcaaggatctcgcttccgccatccttgacctgccagttctggagcatttatttgctcagcacagatctgatcttgtgagcggacgcctgccagtgggactctccctaaaggagcagggggaatgcctatctcttgcggtactggaccttgctcggatggctagggaacaggctcaacgccccggcgaacttttaaaaacagtatcctacaaggcatgtctgcctccatccctacgcgatcttatccaaggactctctttcgtcactcgccgaagaataagaaggacggtgcgaagagcccttcggcgtgtggccgcttgccaggcagatcggcacagtctgatggctaagtacattatggatctagaacggctggatccagccggcgctgcggagaccttccacgtagggctccctggagcgcttggaggtcatgatggcctcggcctcttacgcgtggcaggcgacggcggcattgcctggacacaaggagagcaagaagtgctgcagcctttttgcgattttcctgagattgtggacatctctattaagcaagctccaagagtaggaccagctggagagcatagattagtgactgtcacccgcacggataatcaaattctggaggcagagtttcccgggctgccagaggctctttcatttgtggcgttggtggatggttactttcggttgacaaccgactcgcagcatttcttctgtaaggaggtggcccctcccaggctgctggaagaagtagccgagcagtgtcacggcccaatcacactagactttgcaatcaataagcttaaaactgggggcagccgaccaggaagttatgtgcttcgaaggtctccccaggattttgattccttcctgctgactgtctgcgtgcaaaacccactggggccagattacaaggggtgtctgatccggcgtagccctacgggcaccttcctgctcgttggactttcccggccccatagctcgttgcgcgagttactggcgacgtgttgggacgggggccttcacgtggacggcgtggccgtgaccctgaccagctgctgcatcccaaggccaaaggagaaatctaacctgatcgtcgtccagagagggcatagcccgcctaccagctccttggtccagcctcagtcacagtaccagctttctcagatgaccttccacaagattcctgcagactcactagagtggcatgagaatttgggccacggttcttttactaagatttatcgcggctgtcgccatgaggttgtcgatggagaggccagaaagacagaagtactgctgaaagtgatggatgcaaaacataaaaattgtatggaaagctttttggaggccgcttccctcatgtcccaggtatcttaccggcatctggtgcttctgcacggcgtttgtatggccggggatagcactatggtgcaggaatttgtgcatctgggggccatcgatatgtacctcagaaagaggggacacctggtaccagctagctggaaactgcaggttgtgaagcagcttgcttatgcccttaattatctcgaagacaaggggctgccacatggaaacgtcagcgcaaggaaagtgttactggccagagaaggtgccgacgggagcccacctttcataaaactgtctgatccaggcgtgtcgcccgcagtcctgagcctcgagatgctcaccgaccgaatcccctgggtggcaccggagtgcctaagagaggctcaaacactctccctggaggcagataagtgggggttcggggcaaccgtttgggaggtgttttccggggttacgatgccgatctcggccctggacccggccaaaaagctccagttttatgaggaccggcaacagctcccggctccaaagtggacggaattggctttgctgattcagcagtgcatggcatatgagccagtccagcgcccttctttccgggccgtgatccgtgaccttaacagcttgattagctcagactacgaattgctgagcgatccaactccgggagcactagcccctcgcgatggtctctggaatggagctcagctttacgcctgccaagatccaaccattttcgaggaaaggcacctgaagtacatttctcagctcggaaaaggcaactttggatcggtcgaactgtgccggtacgaccctctgggggacaacacaggggctcttgttgccgtcaagcagcttcagcattctggtcccgaccaacagcgagacttccagagagagatccagatcctcaaagctctgcactccgattttatcgttaaataccggggcgtgtcatatggtcctggacgccagtctctgcgcctggttatggagtacctgccttccgggtgcctgcgggattttctgcagcgtcaccgcgcgagactggatgcaagccggctccttctatatagcagtcaaatttgcaagggaatggagtaccttggctcacgcagatgtgtgcatagggatctcgctgcccgcaacatcctcgtcgaaagcgaggcccatgtgaagatagctgacttcgggctcgctaaactgctgcccctggacaaggactattacgtggtgcgggaaccaggtcaatctcccatcttctggtatgcgcctgagagcctgtcagataatatttttagtaggcagtcggacgtgtggtcattcggagtcgtactatatgagctctttacttattgcgataaaagttgcagcccttccgcagaatttttgcggatgatgggatgcgaacgggatgttcccgctctgtgcagactgcttgagcttttggaagaggggcagcgcctcccggctcccccagcatgcccagctgaagtacacgagctcatgaagctgtgctgggcaccgagtccacaggatcggccaagctttagcgctttggggccacagcttgatatgctgtggtccggatccaggggctgcgagacccacgcattcacagcacatccagagggaaaacaccacagcttgagcttcagctag

SEQ ID NO: 121270 - DNA, 3375 bp, Artificial Sequence
  Description of Artificial Sequence: Synthetic coding sequence
atggctccaccttctgaggagactccactgattcctcagcgcagctgttccctcctcagcactgaggctggtgcattacatgttctacttccggctagaggccccggaccaccccagaggctgtctttcagttttggcgaccatctggccgaggacctgtgtgtccaggcagcaaaggcttctggaatcctgccagtgtaccattcacttttcgctctggcaaccgaggacttgtcttgctggttccctccaagccacatcttttccgtagaggacgcctccacacaggtgctgctatataggattagattttatttccccaactggttcggtctggaaaaatgtcacagattcgggctgcgcaaagatttggcctctgctatactggacctacctgtgctcgaacacctgtttgcgcagcaccgctctgacctggtatcaggacgcttgcctgtgggactgagtcttaaagaacagggagaatgtctgagcctggcggtcttagacctggctagaatggctcgtgaacaggcccagaggcctggagaactgctcaagacagtgtcctataaagcctgtttacctccctcactgagagacttgattcagggactcagctttgttactcgcaggcggatccgacgaacggtgaggagagccttgcggcgtgtggccgcctgtcaagccgaccgtcattcacttatggcgaaatatatcatggatctcgagaggctggaccctgctggcgccgccgagactttccacgtgggcttgcctggggcactggggggccacgacggactgggtctcctccgagtagccggagacggaggcattgcatggacccagggagaacaagaagtgcttcagcctttttgcgacttcccagagatcgttgacatctcaattaagcaggcaccgcgggtgggtcctgccggcgagcacaggctggtgactgtgacaaggaccgacaatcagatcctggaagctgaattccctggtctgcccgaggccttgtcatttgtcgcactcgtggacggctactttaggttgactaccgactcccagcactttttttgtaaggaggtggccccacctcgcttgctagaggaggttgccgaacaatgccacggaccaattactctcgacttcgctattaacaaactgaagaccggaggcagtagacctggcagctacgtcctccggcggtccccacaggacttcgacagttttctgttgacagtctgcgttcagaaccccctcgggcctgattataagggctgcttgattcggagaagcccaaccggaaccttcctgctcgttggtctgtctaggccgcatagtagccttagagagttgctggctacttgttgggatgggggcctgcacgttgacggcgtagcagtgacactcaccagctgttgtattcccaggcctaaggagaaaagtaacctgatcgtggtgcagcggggtcactcgccccccactagctcactggtgcagccacagtcacagtaccagttatcacagatgactttccacaaaatacccgcagactcactggaatggcacgagaacctgggccacggttccttcacaaaaatttacaggggatgtcggcacgaagtcgttgatggcgaagccagaaaaacagaggtactattgaaggtgatggacgctaagcacaaaaattgcatggagtcatttttggaggctgcctcccttatgtcccaggtgtcgtaccgccatctggtgctgctgcatggtgtttgtatggcaggcgactccactatggtccaggagttcgttcatctaggcgccatcgacatgtacctccggaagcggggacacctggtgccagctagctggaaattacaagtggtgaaacagcttgcctacgcactgaattatttggaagataagggactgccacacgggaacgtgagcgcccgcaaggtccttcttgccagagaaggtgcggatgggagcccgccttttatcaagctgtctgatccgggtgtgtctccagctgtcctgagtttggaaatgctgactgacagaataccctgggtggctccagagtgtctgcgcgaggctcagactctgtccctcgaggccgacaagtggggttttggtgccaccgtctgggaggtgttttcaggtgttacgatgcctatctcagcactggaccccgccaaaaagctgcagttctatgaagaccgtcagcagctcccggcccctaaatggaccgagttggccctgctcatacagcagtgcatggcgtacgaacccgttcagagaccttcctttagagccgttataagggatctgaattccctgatttctagtgattacgagctgttgtccgatccgacacccggcgcgttggcgcctagagatggtctttggaatggagcccagctctatgcctgccaggatcctaccatctttgaagaacggcatctgaagtacataagtcagctcggtaaaggcaattttggtagcgttgagctctgcaggtatgatccgttgggggacaacacgggagctctggtagcagtgaaacagcttcaacatagtggtccagatcagcagcgcgatttccagagggaaatccagattctgaaggcactccatagcgactttattgtaaagtacagaggcgtgtcctatgggccaggtcgccagagcctgagactcgtgatggagtacttaccttccggatgtctgcgagatttcctccagaggcatcgcgctcggctcgatgctagcagactactcttgtactcttcccagatttgtaaggggatggagtatctcggcagccggcgctgcgtgcaccgcgaccttgccgcacggaacatcctggtggaatccgaagcacatgtcaagattgccgactttggcttggcaaagttgctacctcttgataaagattattatgtggtgcgtgagcccgggcagagcccaattttttggtatgctccagaaagtctatcagacaacatatttagtcgtcaaagtgatgtgtggtcttttggcgtggtgctttatgaactgttcacctactgcgataaatcctgcagtccctccgcagaattcttgaggatgatgggttgtgaacgtgacgtgccagccctgtgccggctgctcgagctcctggaggaaggtcaacggcttcctgccccacccgcctgccccgccgaggtgcatgaactaatgaaactgtgttgggccccaagcccccaggatagaccatccttttccgctctcggcccccagctggacatgttgtggtccggatctcggggttgcgagacccacgctttcactgcccacccagagggtaaacaccacagtctgtctttcagctag

SEQ ID NO: 121271 - DNA, 3285 bp, Artificial Sequence
  Description of Artificial Sequence: Synthetic coding sequence
atggcccctccctccgaagaaactcctctgatccctcagagaagctgcagcctgctctcaactgaggccggagcgctgcacgttttactgccggcccgagggccaggcccacctcaaagactctcattttcatttggcgaccacctggccgaagacttgtgcgtccaggctgccaaggcttccggcatcctgcctgtttatcactccttatttgctctggcaaccgaggatctctcttgttggtttccaccatcccatattttctccgtggaggatgcgtccacacaggtcctgctgtacagaatcagattctattttcccaactggtttggattagagaagtgtcacagatttggtctgaggaaagatctggcctcagccatactagatcttccggtgctggagcacctgttcgcccagcatcgctccgatctcgtgtccggaaggttaccagtgggcctgagtctgaaagagcagggagagtgtctatccctggccgtacttgatctggctagaatggccagagagcaggctcagcgacccggcgagctgctgaagacagtttcatataaagcttgcttacccccatctctaagagatctgatccaggggctttcatttgtaacaagaaggaggatcaggaggaccgtcaggagggccctacggcgagtggctgcgtgccaggctgacagacactccctgatggctaaatacatcatggacctggagcgcctcgatccagctggcgcagcggaaacctttcatgttggtctacctggagcattgggaggacacgatgggcttgggttgcttagagtggccggcgacggcggcattgcctggacacagggagaacaggaggtccttcagccgttctgcgatttccccgaaattgttgatatctcgatcaagcaggccccccgcgtcggcccagctggagagcaccgtctcgtgaccgtcacacggaccgataaccagatcctggaagccgagttccccggactacctgaggcactgagcttcgtcgcactggtcgatggatacttcagactgacgacagattcgcagcatttcttctgcaaagaggtggccccaccgagactacttgaagaggtggcagagcagtgccacggcccaattaccctagatttcgctattaacaaactgaaaactggtggatctcgacctggttcatacgtgctgcgcagatccccgcaggattttgattcatttcttctgacagtctgcgtgcagaacccactcgggccagattataaaggctgcttgatccgaagaagccctaccgggacatttctgttggttggcctctctagacctcatagctctctgcgagagctactggctacctgctgggatggcggcctccatgtggacggggtggccgtgacactaacgagctgttgcattccgcgccctaaagagaaaagtaacctaattgtagtgcagagaggccactcccctccaacttcttccctcgtacagccccaaagccagtatcaactgtctcagatgacgtttcacaagatcccagctgacagcttagagtggcacgagaatctgggtcatggaagtttcacaaagatctatagaggctgcaggcacgaagtggtggacggcgaagccaggaagactgaagttctcttgaaagtgatggatgccaagcacaagaactgcatggagtcttttctcgaagccgctagcttgatgagtcaggtctcttatcggcatctggtgttgctgcatggtgtgtgtatggccggggatagcaccatggtgcaagagtttgtgcatctgggggcaatcgacatgtaccttcggaaacgcggccaccttgtcccagcttcgtggaaactgcaagtcgtcaaacaactcgcctacgcccttaactacctcgaggataagggcctccctcacgggaacgtgtccgcaagaaaagtcctgctggctcgcgagggggcggatggatcacctccattcatcaaactgagcgatccaggagtgagccctgccgtcctttctcttgagatgttgactgaccggatcccatgggttgcgcctgagtgcctacgggaagcacagacactctcgctggaggctgataagtggggttttggtgctactgtgtgggaagtcttctccggtgtgactatgcccatctccgccttagatccagccaaaaaactccagttttacgaggatcggcagcagctgcctgcacccaagtggacagaactagcactgctgatccagcaatgcatggcctatgaaccagtgcagcggccttcttttagggcagtgatccgcgacctcaattcactgatttcgagcgactatgaacttttgtccgaccccacgccaggagccctggcgcccagagacggactttggaatggggcccagctctatgcctgtcaagaccctacaatttttgaagaacgccatctgaagtatatctctcaactcggcaaggggaacttcggctcggtcgagctgtgccgatacgatccactgggcgacaacaccggcgccctggttgcggtgaagcagctgcagcacagcgggcctgaccaacagcgggatttccagcgcgagatccagattctgaaggcactgcatagtgacttcatcgtgaagtatcgaggcgtcagctatggacctggacgtcagtctctgagactggttatggagtatttaccttccggatgcctacgggatttcttacagcggcaccgcgcccgactggacgcctctcgacttctgttgtattccagccagatctgtaaggggatggaataccttggcagccgccgttgtgtgcaccgggacctcgcagcacggaacatcttagttgagtcagaagctcacgtgaagatagctgatttcgggctcgccaagcttcttcctttagataaagactactatgtggtaagagaacccggccagagccctatcttttggtacgcccctgagtctctgagcgacaacatcttctcaagacagtctgacgtatggagctttggagtcgtgttatacgaactgtttacatattgcgacaaatcatgcagtccctctgctgagtttctccggatgatgggatgcgaacgggatgtgccagcattgtgccggttactcgagctgctagaggaagggcagaggctgcctgcgccccccgcctgccctgccgaggtctcagctgctggcctggccagtgtctctcagtcagtcgattgggcaggcgtctctgggaaacccgcgggggcatag

SEQ ID NO: 121272 - DNA, 1575 bp, Artificial Sequence
  Description of Artificial Sequence: Synthetic coding sequence
atgtcgggaaaaagaaaacgcgttgttctgaccataaaggataagctagatattattaagaaattggaagacggcgggtccagcaagcaactggcggtgatctacgggataggtgagaccacagttcgggatatacggaagaacaaagagaagatcattacttatgcgagctcaagcgattctaccagcctgctggccaagcggaagtcaatgaagccaagcatgtacgaggagttggaccgggccatgttagaatggtttaaccagcaaagagcaaaggggaaccctataagcggtccaatctgcgctaagagggctgaattctttttttatgccctgggcatggacggtgatttcaacccgtctgcaggatggctgacgcgcttcaagcagcggcattcgattcgggaaatcaatatccgtaatgaacgcttaaacggcgatgaaacagcagttgaggatttctgtaataattttagggactttatagagcgagaaaatctgcagcccgaacagatttacaacgcagatgaaacaggcctgttctggaagtgcctgccttcaaggatttctgtaatcaagggaaagtgtaccgtacctggccacaaatccattgaagagagggtaactataatgtgctgtgccaatgctaccggactccacaaattaaaactctgcgtcgtgggtaaggccaaaaaaccgaggtcctttaagagtacggacaccctgaatctgcccgtctcctactttagtcagaaaggcgcatggatggatctgtcaatattccgccagtggttcgataaaatcttcgttccacaagtaagagaatacctgcggtctaagggcttacaggagaaagccgtgcttctactcgacaatagcccaacccatcctaacgaaaatgtactgaggtctgatgacggacaaattttcgccaaatatcttcctcctaatgtcgcctctctgatacagccctccgaccagggcgtaattgcaacgatgaagcggaattatcgcgcgggactcctgcagaacaatctggaagaaggcaacgacttaaaatccttttggaagaagttgacactgcttgacgccttgtacgagatcgcaatggcctggaacctagttaaaccagtaactatctctcgggcttggaagaagatactacccatggtcgaggaaaaggagtccctggacttcgatgttgaagacatttcagtcgcaacagtagccgcaatattgcagcatacgaagggactggaaaacgtaactaccgagaatcttgagaagtggttagaagtcgacagcaccgagccggggtacgaagtcctgaccgattcagagatcatccggagggctcaggggcaagctgatgaatctagcgagaacgaagaagaggagattgagctcatccccgagaagcacatcaaccacgctgccgcactccagtggacagagaacctactcgactatctcgagcagcagggagacatgattctgcccgataggctcgtgatccgaaagctgcgagcaacaataaggaataagcagaagatgactaagagcagtcagtag

SEQ ID NO: 121273 - DNA, 1575 bp, Artificial Sequence
  Description of Artificial Sequence: Synthetic coding sequence
atgagtggtaagcgtaagcgggttgtgctcacaatcaaggacaagctggacattatcaaaaaactcgaggatgggggaagctccaaacagctggcagtcatttacggtatcggagaaaccacagtgcgggatatccgaaaaaacaaagagaagattatcacctatgcaagttcatccgattcgacctccctgctcgccaaaagaaagtcaatgaagccctcgatgtacgaggagttggatagagcaatgctcgagtggtttaatcagcagcgcgccaaagggaatcccatcagtgggcctatttgcgccaaacgggcagaatttttcttctacgccttagggatggacggggactttaacccgtctgctggttggctgaccaggttcaaacagcggcactccatccgcgagatcaacattcgtaacgagcggttgaacggtgacgaaacggctgtcgaggacttttgtaataatttcagggatttcatcgagcgggagaatctccagcctgaacaaatctataacgcagacgaaacgggccttttttggaagtgtttgccatcaaggatcagcgtcatcaaaggcaagtgcaccgtacctggccacaaatccatagaggaaagggtcaccattatgtgctgcgctaacgcaacaggcctccacaaactaaaactatgtgtggttggtaaagcgaagaaacctcgaagctttaagtctactgacaccttaaatctaccagtgagttacttctcccagaaaggtgcctggatggatctctctatatttcgtcaatggttcgacaagatcttcgtacctcaggtgcgggagtacctccgcagcaagggcttgcaagaaaaagctgttctcttactggataacagtccaacccaccctaacgaaaacgttctgcgctcggacgatggacagattttcgcaaagtacctccctcccaatgtggcctcgctcatccagccgtctgaccagggagtgattgctacaatgaaaagaaattatcgggcaggattgttacaaaataatcttgaggagggtaatgaccttaagagtttctggaagaaactgacactgctggacgctctgtacgagatagcgatggcgtggaatctggtcaagcctgtgactatctccagagcctggaaaaagatcctgcccatggtggaagaaaaggaaagtctggactttgatgttgaagacatctccgtggccaccgtggccgctatcttacaacacaccaagggccttgagaatgttactactgagaacctggaaaagtggcttgaagtggacagcacagaaccaggctacgaggtcttgacggatagtgagattattaggagagcccagggtcaggccgatgagagcagcgagaatgaggaagaggaaatagaactgattccagaaaagcacatcaaccatgctgccgcattacagtggactgagaacctgttggattacctggagcagcagggcgatatgattttgccagaccggctcgtcatccgaaaattgagagccactatcagaaataagcagaagatgacaaagagctctcaatag

SEQ ID NO: 121274 - DNA, 1251 bp, Artificial Sequence
  Description of Artificial Sequence: Synthetic coding sequence
atggcaggggacacccattgccctgccgagccgctcgctagggaaggcaccttgtgggaggccctgcgcgcgttgctcccccactccaaagaggatctcaaattggatctgggcgaaaaagtcgagaggagcgtagtcacactgctgcagcgagcgactgagctgttctacgaggggcgccgggacgaatgtcttcagtccagcgaagttatcttagactactcttgggaaaaactgaacaccggcacctggcaggacgtagacaaggactggcggagagtttatgcgattgggtgtctgttgaaagcactttgcctctgccaggcccctgaggatgcaaatacagtggctgctgctctgagagtttgtgatatgggtcttttaatgggagccgctatcctgggggacatccttttgaaagtggcggcaattctccaaactcacctgcctggaaaacgtccagcacgaggttccctccctgaacaaccctgcacaaagaaagcacgcgccgaccatgggctcatccccgatgtgaagttagagaaaacagtcccgcgcctgcaccgtccgtctctgcagcattttcgtgagcagtttcttgtacccgggaggccggttatactgaaaggcgtggccgatcactggccctgtatgcagaagtggtctttagagtatattcaggagattgccggctgccgtacggttccagtggaggtaggcagtaggtataccgacgaggagtggtcgcagactctgatgacggtcaatgagtttattagtaaatacatcgtgaacgagccacgtgacgtgggctatttggcccagcaccaactgtttgatcagattccggaattgaaacaagacatctccattcccgattactgcagtctgggcgatggcgaggaagaggagattaccattaacgcttggtttggcccacagggaacaatttcaccccttcatcaggacccccaacagaactttctggttcaagttatgggtaggaagtacatacgtctgtactctccccaggagtccggagctctctacccgcacgatacacatctgctgcataatacatcccaagtcgatgttgaaaaccctgatttggaaaagttccctaagttcgctaaggctccgtttctcagctgcatcttgagtcctggggaaatcttgttcataccggtcaaatattggcattacgtgagggcactggatctgagcttctccgtcagcttctggtggtcatag

SEQ ID NO: 121275 - DNA, 663 bp, Artificial Sequence
  Description of Artificial Sequence: Synthetic coding sequence
atggcaggcgacacccactgtccagccgagccactggcccgcgaaggaacgctgtgggaggccttacgcgctttactgccgcactcaaaggaggacctcaaactggatctcggggagaaggttgagaggtctgttgtgacgctcctgcagcgcgcgacggagcttttttatgagggccgcagggacgaatgcctccagtcctccgaagtcatccttgattatagctgggagaaattaaatactgggacatggcaggacgtggacaaagattggcgccgtgtatacgcaatcggctgccttctaaaggcgctgtgtctgtgccaggctccggaggatgcaaatacagtggccgccgccctccgagtgtgcgacatgggactcctcatgggagcagctatcttgggagacatcttgctgaaggttgcggcaattcttcagacgcatctccctggtaagcgaccagctcgagggtccctgccagagcaaccttgtacaaaagttgatgtggaaaaccctgacctggaaaaatttccaaagttcgctaaagctccctttctgagctgtatcctgagccccggcgaaattctgttcatccctgtcaaatactggcactacgtccgagccctggatttgtcatttagtgtcagcttctggtggagctag

SEQ ID NO: 121276 - DNA, 1365 bp, Artificial Sequence
  Description of Artificial Sequence: Synthetic coding sequence
atgtctcgcgagaagtgtagtcctggggaaggggcagaagaagggcgcggaagtgaggcaagcggcctcaaggctagcgcaggtcatggaactgagccagcagggggtggcccgatggccggcgatactcactgcccggctgagccactggcccgggaaggcacgctctgggaggcgctgagagcactgttgccccactctaaagaagacctcaagctcgatttaggtgaaaaagttgaacgcagtgtggtcacacttctacagcgggcaacagagctcttctacgaggggaggcgtgacgagtgcctgcagtcgtccgaggttatcctggactacagttgggaaaaacttaacactggaacatggcaggatgtagataaggattggagaagggtgtacgcaattggatgcctcctgaaagcactgtgcctgtgtcaggctcccgaagatgctaacacggttgccgccgcactgcgagtctgcgatatggggttgctgatgggcgccgccattctgggcgacatcctcctgaaagtggccgcaatcctacagacacaccttcccggtaaacgccctgcacgagggtctctacccgaacagccttgcacaaaaaaggcgagagcagaccacggcctgatccccgacgtgaaactggagaagactgtccctaggctgcacaggcccagtctccaacacttcagagagcagttcctagtgcctggaagacctgttatcctgaaaggcgttgctgaccactggccctgtatgcagaagtggagtctggaatacatccaggagattgccgggtgcaggacagtgccagtcgaagtgggctcccggtacaccgatgaagagtggtcacagaccctgatgacagtcaacgagttcattagcaaatacattgtgaatgaaccccgcgatgtcggctatctggctcagcaccagttattcgaccagatcccggagctcaagcaagacattagtattcccgattactgcagtctgggagatggtgaagaagaagaaatcacaattaatgcttggtttggaccccaaggcacaatttccccactccaccaagacccacagcaaaactttttggtacaggtgatgggacgcaaatacattagactttattctccacaggaaagtggagccctctacccacacgacacccatctcttacataatacaagtcaagtcgacgtggagaaccccgacctcgaaaagttccccaagttcgccaaggcgccgtttctctcatgtattttaagccccggtgagattttgtttatccccgtgaaatactggcactatgtgagagctctggatttaagcttctccgttagcttctggtggagctag

SEQ ID NO: 121277 - DNA, 441 bp, Artificial Sequence
  Description of Artificial Sequence: Synthetic coding sequence
atgaccgttaacgaatttatcagtaagtacattgtgaatgagccgagggatgttggctaccttgcacagcatcaactgttcgaccaaatccccgagcttaagcaagatatcagcatacctgactattgttcgctgggcgatggagaggaggaggagatcacaatcaatgcctggttcggccctcagggcacaatatcaccactccaccaggatccacaacagaatttcctggtgcaggtcatgggacgcaagtacatccgcctctatagccctcaggaatccggagccttatatcctcacgacacccaccttctgcataatactagtcaggtagacgtggaaaacccagatttggagaagttccctaagttcgccaaagctccattcttaagctgcatcctgtcacctggggaaattctgtttatacccgtgaagtactag

SEQ ID NO: 121278 - DNA, 1119 bp, Artificial Sequence
  Description of Artificial Sequence: Synthetic coding sequence
atgaatcataagagcaagaaacggatcagagaggccaagagatccgctcgccccgaacttaaggacagtctggattggacccggcataactactatgagagcttttcgttgagtccagcagctgtggccgacaacgtggaaagggctgatgccctgcagcttagcgtggaggaatttgtggagcggtacgagagaccatataaaccagtggtactactgaatgcccaggagggctggtcagcccaggagaaatggaccctggagaggctgaagcgcaaatatcggaatcagaagttcaagtgcggagaggataacgacggctatagcgtgaaaatgaaaatgaagtactacatcgaatatatggaatctacgcgggatgattcaccactgtacattttcgacagcagctacggcgagcatccgaagcggcgcaagctgctagaggactacaaggtgcctaaattctttacagacgatctctttcagtatgctggggaaaagcgcagaccaccctacaggtggtttgtaatgggccctccgcgctcgggtacaggcatccacatcgatcccttgggtaccagtgcttggaacgctctggtccagggtcataaaagatggtgcttgtttcctaccagcacacccagagagctcattaaagtgaccagggatgaaggtggtaatcagcaggatgaggccattacttggttcaatgtgatctaccctcggacccagctgcctacatggccacctgaattcaaacctctcgagattcttcaaaaacccggcgaaacagtgttcgtgccaggcgggtggtggcatgtagtactcaacttagataccacgattgctattacacaaaacttcgctagcagcaccaatttcccagtggtctggcataaaactgttcgagggcgccctaagctgagccggaagtggtaccggatactgaagcaagagcatccagaattggccgtattagcggactcagtcgatctgcaggaaagcaccggtatcgcctccgactcttccagcgatagcagctcatcttcgagcagctcttcatctgatagtgactcagagcgtatccgcgatacatgtggcggccgcgcacacccttag

SEQ ID NO: 121279 - DNA, 1212 bp, Artificial Sequence
  Description of Artificial Sequence: Synthetic coding sequence
atgaaccacaaatccaaaaaacggatcagggaggcaaaaaggtcagccagacctgaattgaaggattcactggattggactaggcataactactacgaatctttttccctctcgcctgcagctgtggctgacaacgtcgagcgtgctgatgccttgcagctgagtgtcgaagagtttgtcgagcgatacgaacggccttacaagcccgtggttctcctgaacgcacaggagggctggtcagctcaggagaaatggacactggagagactgaagcgtaaataccggaatcaaaaattcaagtgcggcgaggataacgatgggtactccgtcaagatgaagatgaagtattacatcgagtacatggagtccacccgcgacgactccccactttatatctttgatagctcctacggcgagcatcccaagagacgcaagttattagaagattataaggtccctaagttctttaccgatgacttgtttcagtatgccggtgagaagagaaggccaccataccgctggttcgtgatggggcctccacgttccggcacaggcatacacatcgacccactcggtaccagtgcgtggaacgctctcgttcaaggacacaaacgctggtgcctatttcccacttctaccccaagagagctgatcaaagtgacccgtgatgagggcggcaatcagcaagatgaagccattacatggttcaatgtcatatacccacgtacccagctccctacatggcccccggaattcaaaccactggaaattctgcaaaaaccgggtgagacagtgtttgtgcccggcggctggtggcatgttgtactaaacctggacacaacaatcgcaataacgcaaaactttgcatcctctaccaatttccctgtggtgtggcacaagaccgttcggggacgtccaaagctctcccgtaagtggtaccgcattctgaaacaggagcaccctgagcttgcagttctcgccgactccgtggatctgcaagaatccaccggcattgcctcagactcttcctctgacagcagtagtagctcgagtagtagctcaagcgacagtgacagcgagtgtgaatctggaagcgagggtgatggcaccgtgcaccgacgaaagaaaaggaggacatgctcaatggtggggaatggggacactaccagccaggatgattgtgtgtcaaaggaaagatcctccagccggtag

SEQ ID NO: 121280 - DNA, 1245 bp, Artificial Sequence
  Description of Artificial Sequence: Synthetic coding sequence
atgaatcataaaagtaaaaagaggatccgtgaggcaaaacgatcagcccggccagaactaaaagacagcctggattggaccaggcacaactactatgaaagcttttcactgagccctgcggccgtggcagataatgtggagagagcagacgctcttcagttgagcgtggaggagttcgtcgagagatatgagagaccatacaaaccagtcgttttgcttaacgcccaagaggggtggtccgcccaagaaaagtggaccctcgagaggttgaagcgaaaatataggaaccagaagttcaaatgtggagaggacaatgacggatacagcgtgaaaatgaaaatgaagtactacatagagtacatggaatctacgcgggacgactcccctctgtatatttttgacagctcatatggggaacatcccaaacgacggaaactgctcgaagactataaagtccctaagttctttactgatgatttgtttcagtacgccggagaaaagaggaggcctccgtatcgctggtttgtgatgggtccccctagatccggtactggcattcacatcgatcctcttggtacaagcgcatggaacgctctggtgcagggacataagcgctggtgtctgttcccaaccagcacaccgcgcgagctgattaaagtcacacgtgacgagggaggcaatcagcaggatgaggctatcacttggttcaatgtgatttatccccgaacacagctacctacttggcctcccgagtttaagcccctcgaaattctccagaaacctggtgaaacagtgtttgtgcctggcgggtggtggcacgttgtgctcaatctggacacaactatcgcaatcacgcagaatttcgcttcttctaccaatttccctgtcgtgtggcacaaaacagtgcgagggcgaccaaagttgagtcgtaagtggtatcgaatactgaagcaggagcatccagagctggccgtgctggcagatagtgtggacttgcaggaatctaccggaattgcatccgacagctcttcggactcctcctcgtcttcgtccagcagttcttccgacagcgattcggagtgtgagtccggatccgagggagacggtaccgtgcacagaaggaaaaagagacgcacttgctcaatggtgggaaacggtgacacaacttcacaggacgactgcgtatctaaggagcgcagtagtagccggatccgggatacatgtggcggaagggcccatccttag

SEQ ID NO: 121281 - DNA, 441 bp, Artificial Sequence
  Description of Artificial Sequence: Synthetic coding sequence
atgctcgctggcgccggacgtccgggacttccacagggccgccacctgtgttggctgctttgtgcatttacattgaagctctgtcaggccgaggcacccgtccaggaagaaaaactgtctgccagcaccagcaacctcccatgctggctcgtcgaagagtttgtggtggccgaggagtgttccccctgttctaatttccgcgcaaagactactccagagtgtggcccaactggctatgttgagaagataacgtgctcttcttctaagaggaacgagtttaaatcctgtcgaagtgcgttgatggaacagagactgttctggaagttcgagggggccgtggtctgcgtggctcttatatttgcctgcctcgtgataatcagacagcgacagctcgaccgaaaagctctcgaaaaagtgcggaaacagatcgagtccatctag

SEQ ID NO: 121282 - DNA, 354 bp, Artificial Sequence
  Description of Artificial Sequence: Synthetic coding sequence
atggcctgggggtggcatttgtcatttctgagcgcgtcaaccagcaacctgccctgttggctggtggaagaatttgttgtggcagaggagtgctccccttgctcaaatttccgggctaagaccacacccgaatgtggacctaccggctatgtggaaaagattacctgtagttcatctaagaggaacgagttcaagagctgccggtccgctctaatggaacagcggctgttctggaaattcgagggcgctgtcgtatgtgtcgcccttattttcgcctgcctggtaataattcggcagcgccaactggaccgaaaggctctggaaaaggtccggaaacagatcgaaagtatatag

SEQ ID NO: 121283 - DNA, 354 bp, Artificial Sequence
  Description of Artificial Sequence: Synthetic coding sequence
atggcctggggttggcatttgagctttttgtctgccagcacgtcgaatctgccctgttggctcgtcgaggagttcgtggtggcagaagagtgctcaccatgttccaactttcgtgccaaaacgacccctgagtgcggaccgacaggttatgtggagaaaatcacatgctctagttctaaacggaacgagttcaagtcatgcagaagtgcgctgatggagcagcggctcttttggaaatttgaaggggccgtggtgtgcgtggccctgattttcgcttgcttggtaataattcgtcagcgacagctggacaggaaagcactcgagaaggtgaggaaacagatagagagtatctag

SEQ ID NO: 121284 - DNA, 354 bp, Artificial Sequence
  Description of Artificial Sequence: Synthetic coding sequence
atggcttggggatggcacctgtctttcttgtccgcaagcacgtcaaacctgccttgctggttggtcgaagaatttgtggtagccgaggaatgttcgccctgctcgaattttcgggccaaaaccactccagagtgtgggccgactggctacgtggaaaaaatcacgtgttctagcagcaagcggaatgagttcaagagttgcaggtctgctctgatggaacaacgccttttttggaagttcgaaggcgctgttgtgtgcgtggctctcattttcgcttgcttagtgatcataagacagcgccagctcgatcggaaggccttggaaaaagttcgcaagcagatcgagtcaatctag

SEQ ID NO: 121285 - DNA, 1044 bp, Artificial Sequence
  Description of Artificial Sequence: Synthetic coding sequence
atggaaacacccttttacggggatgaggctttgagcgggctgggaggcggagcctcaggaagcgggggatcgttcgccagccccggcaggctgtttccaggcgcgcctccgacagcagcagcaggctcaatgatgaagaaggatgcgttaaccctctcactgtcagagcaagtggcggcggcccttaagcctgccgctgcccctccacccaccccccttcgggccgatggcgctccaagcgcagccccccccgatggactgctggccagcccagatctgggtctattgaagttagcctctcccgagctggagagattaatcattcagtcaaacggactggtgacaactacaccgacatcatcgcagtttttgtatccgaaagttgctgcgtcagaagaacaggagttcgctgaaggatttgtgaaggctctggaagatttacacaagcagaaccaactcggtgccggggccgcggccgcagctgccgcagccgccgccggaggtccatccggcacggcaaccggtagcgcaccgcctggcgagttagcaccagctgccgccgccccagaggccccagtctacgcaaatctgtcttcatatgccgggggggcaggtggtgcagggggagcggctaccgttgcgtttgcggcagagccggtccccttccctccccctcccccaccaggggccttgggaccaccaaggctggccgcactgaaagacgagccacagactgtgcccgacgtgcccagctttggcgagtcccctcctctcagtcctatcgacatggacacacaggagcggattaaggctgaacggaagcggcttagaaatcgtatcgctgcaagcaagtgtagaaaaagaaaacttgaacgcatatcacgccttgaggagaaggtcaaaactctaaagagccagaatactgagctcgcgagcacagcaagtctgttgcgcgagcaggtcgcccagctgaagcagaaggtgctgtcccatgtgaactccggctgccaactcctgcctcagcatcaggtgcccgcctattag

SEQ ID NO: 121286 - DNA, 2934 bp, Artificial Sequence
  Description of Artificial Sequence: Synthetic coding sequence
atgagctttgccctcgaggaaacgctggaatcagactgggtggcggttaggccacatgtattcgatgagcgtgagaagcacaagttcgtgttcatcgtggcctggaatgaaatcgaaggcaagttcgctataacttgtcataacagaaccgcccagcggcaacgctctggcagtcgcgagcaagccggcgcccggggcggcgctgaggccggtggggcagcctccgatggcagccggggcccggggagtcctgcggggcgaggtcgcccagaggcaacagcatctgcgacactagttcgatctcccggacccagacgtagcagcgcgtgggctgaaggtggtagcccacgcagcactcgaagcctgctgggcgacccccgcctccggagccctgggtcgaaaggggctgagtcaagactgaggtctcccgtcagagccaaacctatccccgggcagaaaacatctgaggcagacgatgccgctggcgctgcagcggctgcagccaggccggcacctcgcgaagcgcaagtgagcagtgtgcggatcgtctccgcctctggcaccgtgagcgaggagatcgaggtgctggaaatggtcaaagaagatgaggcccccctggccctaagtgatgccgagcaaccacctccagcgacagagctcgaaagtcctgcagaagaatgctcctgggctggcctgttttcattccaggatctgcgggctgtccaccaacaactctgttccgtaaattcacagttggagccttgcctgccagttttccctgaagaaccatccggtatgtggactgtcctattcgggggagctccggagatgaccgagcaggagatagacaccctgtgttatcaactgcaggtatatttgggacatgggttggatacatgtggatggaaaatcctgagccaggtactgttcacagaaaccgacgacccagaggagtactacgagagcctgtcagaacttaggcagaagggatatgaggaagtgcttcagagagccagaaagcgtattcaggagctgctggacaagcacaaaaacacagagagtatggttgagttgctggacctgtatcagatggaagacgaagcttatagtagcctggcagaggcaacaactgagctctaccagtacctgctccaaccttttagggacatgagggaactcgctatgcttcgtcgccagcagattaaaattagtatggaaaatgactacctggggccaagacggatagagtcgctccagaaggaagacgcagattggcagaggaaagcacacatggcagtgctgtctatccaagacttgaccgtgaagtacttcgaaatcacagcaaaggcacagaaagcagtttacgacagaatgcgggcagaccagaaaaagttcgggaaggccagctgggctgccgccgccgagcgtatggaaaagctgcagtacgctgtgagcaaagagacacttcagatgatgcgcgctaaagagatctgcctcgaacagcgtaagcatgctttgaaggaggaaatgcagtctctccgcggggggactgaggccattgcaagactcgatcaactagaagccgactactatgacctgcaattgcagctgtatgaggtacagttcgaaatcctgaagtgcgaggagctgttactgacggcacagctggagagcatcaagcggctgatctccgagaaacgggacgaagtggtttattatgacacctacgaatctatggaggccatgctggaaaaggaggaaatggcagcctccgcctacctgcaacgggaagagctccagaaactgcagcagaaggcaagacagctggaggctcgtcggggcagagtctcagctaaaaaaagctacctgagaaataaaaaggagatttgcatcgctaagcataatgagaagatccaacaaaggactcggatagaagatgagtaccgtacccatcacactgtgcagctcaaacgagaaaagctgcatgatgaagaagagcgcaagtccgcctgggtgtcccaggaaaggcagcgtacccttgaccgactcaggactttcaaacagaggtacccaggtcaggtgattctgaagtccactcgcctgcgactggctcacgcgcgtaggaaaggggcagcatctccagtgttacaggaagatcattgtgactccctcccctcggtgcttcaggtcgaggaaaaaactgaggaagtgggtgaggggcgggtgaagcgaggcccttcccagacaacggagcctcagagtctcgtccagttagaggatacttcactgacccaactggaggctacaagcctccccctgagcggcgtgaccagcgaactgcctcctaccatttctcttccacttctcaataataacctggagccctgtagtgttacaattaatccattgccttccccgctccctcctactccaccccctccactcccagtggccaaggactctgggccagaaacactggaaaaggacctgccaaggaaagagggcaatgagaagagaattcctaaatccgcgagcgcccctagtgcacacttgtttgacagtagccaactcgtcagcgccaggaaaaaattgcggaagacggctgaaggcttgcagaggaggagagtctcatctcccatggacgaggtgctcgctagcctcaagcggggcagttttcacctaaagaaggtggagcaacgaacacttccaccatttccagacgaggacgacagcaataatattcttgctcagattagaaagggggtgaaacttaaaaaggtgcagaaagatgttctgcgtgagtcattcacactgctgccagacaccgatccccttacgagatctatccacgaggcgctacgcaggatcaaagaggcatcacccgagagcgaggatgaagaggaggcgctgccttgtactgattgggagaactag

SEQ ID NO: 121287 - DNA, 2967 bp, Artificial Sequence
  Description of Artificial Sequence: Synthetic coding sequence
atgagcttcgccctcgaggaaacactcgaaagcgattgggtggctgtccgaccacatgttttcgatgagcgcgagaagcataaattcgtattcatagtggcctggaatgagattgagggaaaatttgcaatcacatgtcacaaccgaaccgcacagaggcagaggtccggatctcgtgaacaggccggagcccggggaggcgcagaagctggcggggcggcctccgatggttcacgtggacccggctcacccgccgggagaggccggcccgaggctactgctagtgccaccttagttcggagcccgggaccccggaggtcaagcgcctgggccgagggcgggtcccctcgatctactcgatccctgcttggagatccccgcctcaggtcacccggctccaaaggagctgaaagccgactgcggtcacccgtcagggccaaacctattccggggcagaagacttccgaagccgacgatgcggctggcgccgcagctgccgcagcccgcccagctcctagagaagcccaagtgtcgagcgtcaggattgttagtgccagcggaactgtctctgaggagattgaagtgctggagatggttaaggaggatgaggctccattagcgctgagtgacgcagaacagcctccaccggccacggaactcgagtcacctgctgaggagtgcagctgggccggcttgttctccttccaggacttgagagccgttcaccagcagctgtgcagtgtgaactcacagcttgaaccttgcctgccagtctttcctgaagagccctcaggaatgtggacggttttgtttggcggcgcgcctgagatgaccgagcaggagatcgacacactctgctaccaacttcaagtgtacttagggcatggtcttgatacgtgtggatggaagatactgagtcaggtgctcttcaccgagaccgacgaccctgaggaatactatgagtctctttctgagctcagacaaaaaggatatgaggaggtactgcagagagcccggaaacgtatccaggagctgcttgacaaacataagaatacagagagtatggttgagctgctggacctgtatcagatggaggatgaagcttactcaagcctagctgaggccactacggaactttaccagtacctgctccaaccatttcgcgatatgcgcgagcttgcaatgctgcggaggcaacagatcaagatcagtatggagaatgactatctgggtccacgcaggatagaaagtcttcagaaggaggacgcagattggcagagaaaagctcatatggccgtgctcagtatccaggatctcaccgttaagtatttcgagattacggccaaggctcaaaaggccgtctacgatcgaatgcgggccgaccagaaaaagttcggcaaggcctcctgggccgcagcagcggaacgcatggagaaactgcagtacgctgtgagtaaggaaaccctgcagatgatgcgggctaaggagatttgcctggagcagcggaagcatgcccttaaggaggaaatgcagtccctgcgaggcggaacagaagctattgctagacttgaccaattggaggctgactactacgatctgcagttgcagttgtatgaagtgcaatttgaaattctgaaatgtgaggagctcctactgaccgcccaacttgaatctattaagaggctcatatccgaaaaacgcgacgaagtagtgtactacgatacctacgagtctatggaagccatgttagagaaagaggagatggctgctagtgcttacttacaaagggaagagctgcaaaagcttcagcagaaggctcgccagcttgaagcacgccgggggagagtgagcgccaagaagagctatcttcgtaataaaaaggagatatgtattgccaaacacaatgagaaaatccagcaacgaactagaattgaagacgagtaccgcactcatcataccgtgcagctgaaacgcgaaaaactgcatgatgaggaggaaaggaaatcagcctgggtgtctcaggagcgtcagcgtacgctggatcggctgcggacgtttaagcagagatacccgggacaggtgattcttaaaagcacgcgactcaggctggctcacgcccgaagaaaaggcgcagcatctcccgttcttcaggaggaccactgtgacagcctcccttcagtgttacaggtagaggagaagactgaagaagtcggcgagggccgcgtcaagaggggaccgagccagactactgaaccccagtccctggtccaactggaggatacttccttgacccagctggaggccacctccttgccactgtctggggtgacatctgagcttcctcctacaatctcactccctctgttgaacaacaatttagaaccctgcagtgtgacaattaatcctctcccgtcccctctccccccaacccccccacccccaccccctcccccgccaccgcccccacctccccccctgccagtagccaaagactctggtcctgaaacactggagaaagatctcccccgaaaagaaggcaacgaaaagaggatcccaaagtcagcatcagctcccagtgcccacctatttgactcttcacagctggtcagcgccaggaaaaagctaaggaaaacagctgagggactgcaacgccgcagggtttcatcgccaatggatgaggtcctagctagcctcaagcggggttcttttcacctcaaaaaggttgagcagagaacactccctccctttcccgacgaagacgactcaaataacatactagctcaaatcagaaagggcgtgaagttgaagaaggtgcagaaggatgtcctgcgcgagtcatttactctgctgccagatactgacccactgaccaggagtatccatgaagcactacggcgcattaaggaggcgtcacccgagtccgaggacgaggaggaagctctgccatgcacagactgggaaaactag

SEQ ID NO: 121288 - DNA, 2238 bp, Artificial Sequence
  Description of Artificial Sequence: Synthetic coding sequence
atggaggtgatgaacctgatggagcagcctatcaaagtgaccgaatggcagcagacttatacctatgacagtggcatccatagtggtgctaatacttgtgtgccttctgtttctagcaagggtatcatggaggaggacgaagcatgcgggcgccaatatactcttaagaaaacaaccacctacacccagggggtccccccctcccaaggggatcttgaatatcagatgtctaccaccgctcgcgctaaaagagtcagagaggcaatgtgtcccggagtgtccggtgaagatagttctctgctgctggcgactcaggttgagggccaggctaccaaccttcagaggttggccgagcccagccagctgctcaagagcgcgattgtgcatttgattaattatcaggatgatgccgagctggccacgcgagctcttcccgaacttactaaactcttgaacgacgaagaccctgtagtggtaacaaaggcggcgatgatagtgaaccagctttcgaagaaggaagcctctcgacgagctctgatggggtcccctcagctggtggcagcggtggttcgcacaatgcagaatacgagcgacttagatacagcaagatgtaccacaagcatactgcataatctgtcacaccacagggaagggctgttggccatttttaagtctggggggatcccagccttagttaggatgttaagttcacctgtcgagtccgtcctcttttacgccatcaccacccttcacaatcttctgctgtatcaggaaggcgccaagatggcagtccgactcgccgacgggctccaaaaaatggtgcccttactgaacaagaacaaccccaaatttttggctatcaccacagactgcctgcagctcctggcttacggcaaccaggagtctaaactgatcatcctggcaaatggcgggccgcaggcactggtccaaatcatgcgaaactacagttatgaaaaactgctgtggacaacatctagagtattgaaggtcctgtccgtctgcccgtccaacaaacccgctatcgttgaggccggcggaatgcaggctctaggcaagcatctcacatcgaactcaccccgactggtgcagaactgcttatggacgcttagaaacctgtccgatgtggcgacaaaacaagaagggcttgagtctgtgctcaagattctggttaaccagctgagcgtagacgacgttaatgttctcacatgtgctaccggtacattgtccaatctgacatgcaataacagcaagaataagacacttgttacacagaacagcggagttgaggccctcattcatgctatattgagagccggtgataaggacgacattacagagccagctgtctgcgcgctgcgtcatcttacatctcgtcatcccgaagcagaaatggcacaaaattctgttcgcctgaactatggcatccccgcaatcgtaaagctgttgaaccagcccaaccagtggcctctggtgaaggccacgattggacttatccggaacctcgccctgtgtcccgccaaccacgcccctctacaggaagctgccgtgatcccccggctggttcagttactcgtcaaggcacaccaggacgcacagcgccacgtcgctgcaggaacgcaacaaccatacactgacggggtcagaatggaggaaatagtagaaggctgtacgggcgctctgcacatcctggctcgcgaccctatgaaccgcatggaaattttcagacttaacactatccccctgttcgtgcagctgctctattccagcgtggagaatattcaacgggtcgccgcaggcgtgctctgtgaactagcccaagacaaagaggctgccgatgcaatcgacgcggaaggggcctcagccccgctcatggaattgctacatagccgcaacgaagggactgctacctacgccgccgctgtcctgtttcgaatttccgaagacaagaatcctgactaccggaagagagttagtgtcgagctgacaaatagcctgttcaagcacgaccccgcggcctgggaggctgctcagtcgatgattccgattaatgagccatatggagatgacatggacgctacatatcgccccatgtacagctcagacgtcccactcgacccactggagatgcacatggacatggatggcgattatcctatcgatacatattccgatggcctgcgccccccatatcctacagctgatcatatgctcgcctag

SEQ ID NO: 121289 - DNA, 2238 bp, Artificial Sequence
  Description of Artificial Sequence: Synthetic coding sequence
atggaagttatgaatctcatggaacagcctatcaaagtgacagagtggcagcagacatacacgtacgattcgggcattcatagcggcgctaatacctgtgttccatctgtctcgtcgaaaggtatcatggaggaagatgaggcctgtggtaggcaatacaccctgaagaagaccacaacatatacacaaggagtccctcctagccagggtgacctcgagtatcagatgtccaccacagcccgcgcaaagcgcgtgcgggaagctatgtgtcctggtgtgagtggcgaggattctagcttactgctagcaacgcaggttgaaggccaggctacgaacctccaaagactggctgagccttcccagctgctgaagtcagctatcgtccatctgatcaactaccaggacgatgccgagctggctactcgggctctgccggaactgacgaaactgctaaacgacgaagacccagtggtggtgacaaaagctgctatgatcgttaatcagctgtctaagaaggaggcaagtaggagagcactaatgggttcccctcaacttgtggccgccgtggtccggaccatgcagaatacctcagatttggataccgccaggtgcacaaccagtatcttacacaacctgtcccatcaccgcgaaggtctcctagcgatattcaagagtggaggaattccagccttggtacgcatgctttcttcaccagtggaaagtgtgctgttttatgcgattactacattacataatcttctcctataccaggagggcgctaaaatggccgtgcgcttagccgatggattacagaagatggtgcccttactaaataagaataaccccaagttcctagcgatcaccacggactgcctgcagctgctcgcttacggaaatcaagaatctaagctgattatcctggccaacggcggccctcaggcactggttcagatcatgcgtaactactcatacgagaagcttctctggacgacaagcagagtgctgaaggtgctaagtgtgtgccccagcaataaacccgctatagtggaggctggcggaatgcaggccctagggaagcatctgacctctaactcaccacgtctggttcagaattgcctgtggaccctgcggaatctgtcagatgtcgctactaagcaggaaggccttgagtctgttctaaagatcttggttaaccagctgtccgtcgatgatgtgaacgtattgacctgcgcaaccggaacattgagcaacctgacctgtaataattccaaaaataaaaccctagtgacacagaactctggggtcgaggctctgattcatgccatcctgcgcgcaggcgataaggacgacatcacggaacctgctgtctgtgcacttcgtcatttgacttcccgccatccagaggcagaaatggctcagaactccgtccggctcaactatgggatccccgccattgttaagctactcaatcaaccaaatcagtggccactcgtgaaggcaacaatagggctgatccgtaatctcgctttgtgtccggctaaccatgcacccttgcaggaggcagccgtcatccctaggctggtgcagctgctggtcaaggcccatcaagacgcccaacgtcatgtggcggccggcacacagcagccatatactgatggagtgaggatggaagaaattgtcgagggctgcacgggagccctccacattctagctagggaccctatgaaccggatggagatctttcgattgaatactatccccttatttgtccagctgctctattcgtccgtggaaaacatccagagagtagcagccggagtactgtgcgaactcgcgcaggacaaagaagccgctgacgccatagatgccgagggagccagtgcccccctcatggagctcctgcactctcgaaatgagggcacagctacatacgctgccgcagtgctgttcaggataagcgaggacaagaacccagattaccggaaacgggtctctgtcgaattaaccaactccttattcaagcacgaccctgctgcctgggaggccgcccagagcatgattcccattaacgaaccatacggggacgatatggacgcaacttatcgtcccatgtatagttctgacgtgcccctcgatccacttgagatgcacatggacatggacggcgactacccgatcgatacatatagcgacggtctgcgtcctccctacccaaccgccgaccacatgttagcctag

SEQ ID NO: 121290 - DNA, 2238 bp, Artificial Sequence
  Description of Artificial Sequence: Synthetic coding sequence
atggaggtgatgaacctcatggaacagcctatcaaggtgacggaatggcagcagacctacacttatgatagtgggatccactcaggtgcaaatacgtgtgtgccttcagtgtcaagtaaagggattatggaagaagacgaagcctgcggcaggcagtacactttgaagaagacgactacatatactcagggagtcccaccatcccagggggaccttgagtatcaaatgtccaccacagcccgcgcgaagagggttagagaagcaatgtgccccggcgtgtctggagaagactcctctctcctgctcgccacacaggtggagggacaggcaacaaacctgcagagactggctgagccctcacagctgctaaaaagcgcaatcgtgcacctaataaactatcaagatgacgctgaactcgcaaccagggctttgccggagcttaccaaacttcttaatgatgaagaccccgtcgtggtcactaaggctgcaatgatagtcaatcagcttagtaagaaagaagcgtcgaggagagccttaatggggagcccccagcttgtggcagccgtggtccgaactatgcagaatacctccgatctggacaccgcccggtgtaccacttccattctccacaatctgtctcaccaccgggaaggactcttggccatcttcaagagcggtgggatccctgccctggtgcgcatgttgagctcacccgtggaatcggttctattctatgcgatcactacgctccacaatcttctgttgtaccaggagggtgctaagatggcagtgcgattggccgatggactccagaagatggtacccctcctgaataagaacaaccccaagttcttggcaatcacaacggactgtttacagcttttggcctatggaaatcaagagtcaaaactgatcatcctggcaaacggaggtccccaagcattagttcagatcatgcgaaactacagctatgagaagctgctctggaccacaagtagagtactgaaagtactgtcggtatgtccctcaaataaacccgcaatagtagaggctggtggcatgcaagccctaggaaaacatctcaccagcaatagcccccgacttgtgcagaactgtctctggaccttacggaacttgagcgacgtggctaccaagcaggaaggccttgaaagcgttctcaagatcctcgtcaatcagttgtccgtggacgacgtgaatgttctgacctgtgctacaggtactttgtcaaacctcacttgcaataatagtaagaacaaaacccttgtgacccagaatagcggcgtggaagcgctgatccatgctatcctccgggcaggcgataaggatgacatcaccgagccagcagtgtgtgccctgcgccatctcacgtcccgccatcctgaggccgagatggctcagaacagtgttcgactcaactacggcatacccgctatcgtcaaattactaaaccagccaaatcagtggccccttgtcaaggcaactattggcctgatcaggaacctcgccctctgtcccgcaaatcacgctccactgcaggaagcagcagtaataccacgtctggtccagttgcttgttaaagctcatcaagatgcccagaggcacgtggccgcaggaacccagcagccctatactgacggcgtgcgaatggaggagattgtggagggttgcacgggcgctctccatatcttggctcgggaccccatgaatcgcatggagatcttccgcctcaataccattcccctgttcgtgcagctgctttattcaagcgtggagaacattcaacgcgtggctgctggtgtgctgtgcgaactagctcaggacaaagaggcagcggacgccatcgacgccgagggtgcttccgctcctctcatggagctgctgcactcaagaaacgagggaaccgccacgtatgcggccgccgtcctctttcgcatatccgaggataaaaaccccgactaccgaaagcgggtttccgtggaactcaccaattctcttttcaagcacgatccagcagcgtgggaggccgcacagagcatgatcccaattaatgagccctacggggacgatatggatgccacttatcgcccaatgtactccagcgatgtgccactcgatcctttggagatgcacatggacatggacggagactatcccatcgacacttattccgacggcttacgccctccgtatccaaccgccgatcacatgctggcgtag

SEQ ID NO: 121291 - DNA, 834 bp, Artificial Sequence
  Description of Artificial Sequence: Synthetic coding sequence
atggaagtgatgaatttaatggagcagcccatcaaggtcactgaatggcagcaaacgtatacatatgactcggggattcactcaggcgccaatacatgtgtccccagtgtgagctcaaagggaatcatggaagaagatgaagcttgtggacgtcagtatacgctcaagaagaccaccacgtatacccagggcgtgcccccatctcaaggtgatctcgaataccagatgagtaccaccgccagggctaaaagggtcagggaggccatgtgccctggggtgagcggtgaggactccagtctgcttctggcaacacaggttgaaggccaggccaccaatctgcagcgtctggccgagcccagtcaacttctgaaatccgctattgtgcacctcatcaactaccaggatgacgccgaactggcaactcgcgccttgccagaattaacaaaattgttgaacgacgaggaccccgtagtcgtgacaaaggctgcaatgattgtgaaccagctgagtaaaaaggaagctagccgccgggcactcatgggcagtccccaacttgtggctgccgttgtcaggacgatgcaaaacacctcggatttggacaccgcccggtgtactacgtctatccttcacaatttgagtcatcacagagaagggctcctggccattttcaaatcggggggcatccctgccctcgtgcgcatgctgtctagccctgtcgagtctgtgctcttctacgcaattacaaccctccataaccttctgctttatcaggagggagctaaaatggcagtgaggctcgcagatgggctccagaagatggtcccgcttttgtag

SEQ ID NO: 121292 - DNA, 708 bp, Artificial Sequence
  Description of Artificial Sequence: Synthetic coding sequence
atggaagttatgaacctgatggagcaacctatcaaggtgaccgaatggcaacagacctacacctacgatagcgggatccactcaggtgctaatacgtgtgtcccctccgtgtcgtcgaagggcataatggaggaggatgaggcttgtggacgccagtatacactgaagaagactaccacctatactcagggggtgcccccctctcagggcgacctggaataccaaatgagcacgactgctagagctaagagggtgagggaggcaatgtgcccgggggtgtcaggagaagattcgtcactcctgctggcaacccaggtagagggtcaggccacaaacttgcagcgccttgccgagccatctcagctcctgaaatcagcgatcgtacacctgattaactaccaggacgacgcagaactggccactcgggccctgcctgaactcacaaagctgctaaacgatgaggatccggttgttgtcactaaagccgccatgatcgttaaccaactctcaaagaaagaagcaagcagacgagcattaatgggatctcctcaactggttgcagccgtcgttaggacaatgcaaaacaccagcgacttggataccgcccggtgcaccacatctattttacataacttgagtcaccaccgcgagggactgttagccatattcaaatccggcggaatccctgccctggtgagaatgctgtag

SEQ ID NO: 121293 - DNA, 891 bp, Artificial Sequence
  Description of Artificial Sequence: Synthetic coding sequence
atggaagttatgaacctgatggagcagcccatcaaagtgaccgaatggcaacaaacttacacctacgatagcggcatccactctggggccaacacttgtgtgccttctgtgtcctccaagggcattatggaggaggatgaagcctgcggcaggcaatatactctgaaaaaaactactacctacactcaaggggtgccaccaagccagggcgatttggagtatcaaatgagcaccacagcccgagccaagagggtgcgcgaggccatgtgccctggcgtgtccggcgaagacagcagtctcctgctagccacacaggtagaaggacaggccacgaaccttcagcgtctcgccgaaccttcccaactgttaaaatccgccatcgtgcacctgatcaactaccaggatgacgcagaactggcgactcgagccttaccagaactgactaaactgctgaacgacgaagacccggtggttgtcactaaggcagccatgatcgtcaatcagctgtcaaaaaaggaggcctctcgccgggcccttatggggtctccacagctggtggctgctgtggtcagaaccatgcagaacacctcagacctagatacagcaagatgtaccactagtatactgcataatcttagccaccacagagaggggctgctggcaatcttcaagtcaggaggaatcccggctttggttaggatgcttagcagcccagtggaatccgtcctcttttatgccattactacactccacaatctgctcctctaccaggagggcgctaagatggctgtgcgtctggccgacgggttacaaaagatggttccactgctgaataagaacaaccccaaattcctggcgataacaactgattgtctccagttgttagcttag

SEQ ID NO: 121294 - DNA, 261 bp, Artificial Sequence
  Description of Artificial Sequence: Synthetic coding sequence
atggaggtcatgaatcttatggaacagcctataaaagtgaccgagtggcaacaaacttacacctatgacagtggtatccattcgggcgccaatacttgcgtcccatcagtcagctccaagggcataatggaggaagatgaagcttgtgggcgccagtacaccctaaaaaagacaactacttacacacagggtgtgcctccctcccagggagacttggaataccaaatgtcaacaacggctagagccaaacgggtgagatag

SEQ ID NO: 121295 - DNA, 897 bp, Artificial Sequence
  Description of Artificial Sequence: Synthetic coding sequence
atggaagttatgaatctcatggagcaacctatcaaggtcacagaatggcaacagacttacacttatgattccggtatccactctggagcaaatacctgtgtgccctcggtgtctagcaagggcatcatggaggaagatgaagcttgtgggcggcagtacacgctaaaaaagaccacgacttacacgcagggcgtgcctccttcacagggcgacctcgagtaccaaatgtccacgacagcccgcgctaagcgagtccgtgaggcgatgtgccctggtgtctcaggagaggacagctcactcctgctcgctacacaggtggagggacaggcgaccaatctgcagaggttagccgagccgtctcagcttcttaagtccgcgatcgtccatctgatcaactaccaggacgatgcggaacttgcgactcgggctcttcccgagctaaccaagctccttaacgacgaagaccccgtagtggtgacaaaagcagcaatgatcgtcaatcagctgagtaagaaggaggcctccagacgcgccttgatgggatcacctcagctggtggccgccgtcgtgaggactatgcagaacacttccgacttagatactgcgaggtgtaccacaagcatccttcacaacctgagtcaccatagggaaggactgctggccatattcaaaagtggcgggatcccggctctggtgaggatgctctccagccctgttgagtctgtgctgttctacgcaatcacgacattgcataacctcctgctttatcaggagggggctaaaatggctgttcgcttggccgatgggttacagaagatggtcccactacttaataagaacaacccaaaattccttgcaattacgaccgattgcctccaattactggcttatgggtag

SEQ ID NO: 121296 - DNA, 1776 bp, Artificial Sequence
  Description of Artificial Sequence: Synthetic coding sequence
atggaagttatgaatcttatggagcaaccgattaaggttacagagtggcagcagacatacacatatgacagcggaatccactctggcgcaaacacgtgcgtacccagtgtgtccagtaagggcattatggaggaagatgaagcctgcggacggcagtacactctcaagaaaaccacaacctacacccagggagttcccccctcccaaggtgaccttgaatatcagatgtccactacggccagagctaaacgcgtgagggaggccatgtgtcccggagtgagcggagaggatagtagtctgctgctggccacgcaagtagagggacaagcaacaaatctacagcgtctggccgagcccagtcaactactgaagagcgcaatcgtgcacttaataaactaccaggatgacgccgagctggcaacaagggctctccctgagctgaccaagctactcaatgatgaggatccagtggtcgtaacgaaggccgcaatgatagtgaaccagcttagcaagaaagaagcctccagacgggcactaatgggaagtcctcagctggtggccgccgtggtgcggaccatgcagaacacaagcgatctagacaccgctcggtgcaccacatctattctgcataatctgtcccatcacagggaagggctgctggccatcttcaagtcgggtggcataccggctttggttcgcatgctcagttccccagtcgaaagcgtgctgttttatgcaatcactactcttcataatcttctgctctatcaggagggcgcaaagatggctgtgcggctggcagatggcctccagaagatggttccactgctgaataagaataatccaaaatttctggctattactaccgactgcctccagctcttggcctacggaaatcaggaatccaaaattttgaccgctacagtggacaatgcaaacattcttcttcagatcgataacgcgcgccttgccgcagacgatttcagaaccaagtttgaaaccgagcaggccctgcgactgtccgttgaggcggacattaatggcctgcggcgagtcctggacgagctcacactagccagagccgatctggagatgcaaattgagaacttaaaggaggaactggcttacctgaaaaagaatcatgaggaagaaatgaacgctttgagagggcaggtcggcggggagatcaacgtagagatggatgcagcaccaggggtggatctgtccagaatcctcaacgagatgcgggatcagtacgaaaaaatggcggagaagaatagaaaggatgcggaggattggttcttctcgaagaccgaagagctgaacagggaggttgctactaattcagaactggttcagtcggggaaatcagagatttcagaactccggagaacaatgcaggcgttggaaattgaactccagtcccaactgtcaatgaaggcttcattagagggcaacctggcggaaaccgagaataggtactgcgttcagctgtcccagatccaagggctgattggatctgtggaggagcagctcgcccaactgcggtgtgagatggagcaacaaaaccaggaatataagatcctgttggacgtcaagaccaggctcgagcaggagattgcaacctatagaaggctcctggaaggcgaggatgctcacctcacacaatataaaaaagagcccgttaccacacgccaggttagaacgattgtggaggaagtgcaggacgggaaggttatatcctcccgagagcaggtacaccaaaccacccgctag

SEQ ID NO: 121297 - DNA, 897 bp, Artificial Sequence
  Description of Artificial Sequence: Synthetic coding sequence
atggcgaggagatctcgacatcgacttctgctgctcctattgcggtacctggtagtggctctggggtatcacaaggcctatgggttctctgccccaaaggaccagcaggtggtcactgccgtggaataccaggaagccatcttagcctgtaagactcccaagaagacagtctcctctcgacttgagtggaaaaagctcggtcggtcagtctcctttgtctactatcagcagaccctgcagggggactttaagaatagagcggagatgatcgatttcaacattcggattaaaaacgtgactcggagtgatgcaggaaagtatcgatgcgaagttagtgccccttctgagcaggggcagaatctagaggaggatacagtgacactggaagtcctcgtggccccagcagtccctagctgtgaggtcccctctagtgcattgagtggaacagtggtagaactgagatgccaggataaagagggtaaccccgctcccgaatatacttggtttaaggatggcattagactgctggagaacccacggctaggtagtcagtccaccaatagcagttataccatgaacaccaagactggcacactgcaatttaacacggtgagtaagctcgacaccggagaatattcctgcgaggcccggaactccgtgggatacaggcggtgtcctggaaaaaggatgcaggtggacgatctcaacatctctgggataatcgccgccgttgttgtggtcgctcttgtaatctccgtttgtggactgggagtgtgttatgcccaacggaagggttactttagctccaagtacatgtttatgaagtcaaatagttctagcaaagccaccaccatgagcgagaacgatttcaagcacacaaaatctttcatcatatag

SEQ ID NO: 121298 - DNA, 789 bp, Artificial Sequence
  Description of Artificial Sequence: Synthetic coding sequence
atggcccgacgtagcaggcacagattgctgttgctgcttctgcggtacctggtcgtggccctgggttatcacaaggcttacggcttctccgcacccaaagaccagcaggttgtaacagcagtggaataccagggcgatttcaaaaacagggcggagatgatagactttaatatccgcatcaagaatgtcactagatctgatgcgggaaaatataggtgtgaggtgagtgccccgtccgaacaaggacagaatctggaggaggatactgttacgttggaggtattggtcgctccggctgtaccgagctgtgaagtaccttcatccgcgttgtcaggtactgttgtggaactcagatgccaggacaaagagggcaaccctgcccccgagtacacttggttcaaagatgggattcgtctgctggaaaatccaaggctgggaagccagagcactaactcctcatataccatgaatactaagaccggcacactgcagttcaatactgtgtccaaactggacacaggtgaatactcctgtgaagctagaaacagtgttggttatagacgctgcccaggcaagcggatgcaggtggacgacttgaatatcagtggcatcatagctgccgtggtggttgttgccctcgtgattagtgtctgtgggttaggcgtttgttatgcccaacggaagggctacttcagcaaggagacctccttccagaagtccaactcaagcagcaaggccacaacgatgagcgaaaatgacttcaaacataccaagtcctttatcatttag

SEQ ID NO: 121299 - DNA, 897 bp, Artificial Sequence
  Description of Artificial Sequence: Synthetic coding sequence
atggcgaggagatctcgtcaccgtctgctgttgctcctgctgcgctacctggttgtggccctgggctaccacaaggcctatgggtttagcgcccccaaagatcagcaggttgtcaccgccgtggagtatcaagaggcgattcttgcctgcaagacccctaagaagacagtgagctctcgcctggaatggaaaaaactgggccggagtgttagcttcgtctactatcagcagactctccagggtgacttcaagaacagggccgaaatgatcgatttcaacatccgcattaaaaacgtgacaaggagcgacgccggcaaataccgctgcgaagtttccgcaccctctgagcagggccagaatctggaggaagataccgtcactctggaggtccttgtggccccagcggtgcccagctgcgaggtgccatcttctgctctgtccggcaccgtcgttgagcttcgctgccaggataaggaaggcaatcctgcccctgaatacacatggtttaaggacggaattcgactgcttgaaaacccgcgcctggggtcacaatccaccaacagctcttacacgatgaacaccaaaacaggtacgctgcagtttaacaccgtctccaagcttgacaccggggaatattcatgcgaggcgagaaacagcgtggggtaccgacggtgccccggcaagcgcatgcaggttgacgatcttaacatctctggtatcatcgccgcggtggtcgtggttgccttggtcatctccgtgtgcggcctgggtgtatgctatgcccagagaaagggctatttcagtaaggagacttcctttcagaaatctaattccagttctaaagccaccactatgagcgagaacgactttaagcacaccaagagctttattatctag

SEQ ID NO: 121300 - DNA, 939 bp, Artificial Sequence
  Description of Artificial Sequence: Synthetic coding sequence
atggcgagaaggtctcggcacaggttgcttttactcctgctgaggtatctggtggtcgccctcggctatcacaaagcctatggcttcagtgctccgaaggatcagcaggttgtgaccgcggtcgagtaccaggaggccatcctcgcatgtaagactccaaaaaagactgtgagcagtcggcttgaatggaagaagctgggcaggtctgtctccttcgtgtattaccagcagacattgcagggggatttcaaaaatcgggcagaaatgattgatttcaacattagaatcaagaacgtaacccgctcagatgctggaaaatatagatgtgaggtctcagcacccagtgagcaaggccagaatctggaggaagatacagtaacactcgaagtcctcgtcgcccctgctgtgccatcctgtgaggtgccctccagtgcactgagtggcaccgtcgtggagctaaggtgccaggacaaggagggcaatccggctccagagtatacgtggtttaaggacggaattagactcctagagaacccccggctcgggtctcagagcacaaactcgagctatacaatgaatactaaaaccgggacacttcagttcaacactgtgtccaagctggatacgggagagtactcatgcgaggcaaggaactccgtggggtatagacgctgtcccggcaaacgcatgcaggttgatgatttgaatatttctggtattattgcagccgtggtggtcgtagcactggtgatttccgtgtgcggactaggagtgtgctacgcccagagaaagggatattttagtaaagagaccagttttcaaaaatccaattcttccagcaaagccaccactatgagcgaaaatgttcagtggctaaccccggtgatcccagctttgtggaaagctgccgccggaggctcaaggggccaggaattttag

SEQ ID NO: 121301 - DNA, 933 bp, Artificial Sequence
  Description of Artificial Sequence: Synthetic coding sequence
atggccctgcgtcggccccccaggctgcggttgtgcgcgaggctccctgacttctttctcctgctgctctttaggggctgcctgattggggcggtaaatttgaaatcctctaatagaactccggtggtgcaggagtttgagtctgtagagctgtcatgcattatcacagacagccagacctccgacccccgaatagagtggaaaaagatccaggatgagcagactacatacgtcttcttcgacaacaagatccagggtgatctggccggccgggctgagatcctaggtaagaccagcctgaaaatttggaacgtgacgcgccgcgattccgccctttacagatgtgaagttgtggcgcggaatgatcgcaaggagatcgacgagattgtcattgagttgactgtgcaagttaagccagtgaccccggtgtgtcgggtccccaaggccgtgccagtcggaaagatggcaaccttacattgtcaggagtctgagggtcacccgagaccgcattacagctggtatcgcaacgacgtgccactaccaaccgacagcagggccaatccacgtttccggaatagcagcttccacttgaactctgagactggtactctggtgtttaccgcagttcataaggacgactctggtcaatactattgcatcgcgtccaatgatgcagggtctgcccggtgtgaggagcaggagatggaggtatacgacttaaacataggggggatcataggtggcgtgctcgtcgtgctggctgttcttgcccttattacactcggcatctgttgtgcctacagaagaggttactttatcaataataaacaagacggcgaatcctacaagaacccagggaagccggatggcgtaaactatatcagaactgacgaagagggcgattttcgccacaaatcctcatttgtcatatag

SEQ ID NO: 121302 - DNA, 780 bp, Artificial Sequence
  Description of Artificial Sequence: Synthetic coding sequence
atggcgctaagacgcccgccgcgccttcggctgtgtgctcgccttcccgacttcttcttacttctattatttagagggtgcctcataggggccgtgaatctgaaaagttccaatcgcacacccgtggtccaagaatttgaatccgtcgagctgtcctgtattatcaccgattcccagaccagcgaccctcggattgagtggaaaaagatccaagacgagcagaccacctatgtttttttcgataacaagatacaggtcaagccagttacacccgtttgtcgcgtgcccaaagcggtaccggtgggcaaaatggccaccctgcactgccaggaaagtgaagggcatccccggcctcactattcttggtaccgaaatgatgtccctcttccaactgatagcagagctaatcctaggtttaggaacagcagtttccacctgaattcagaaaccggcaccctggttttcactgcggtgcataaagacgactccggccagtactattgcattgcaagtaatgacgcaggcagcgctagatgcgaggaacaagaaatggaagtctatgacctgaacattggtggaatcattggtggcgttctagtcgtgctggctgtacttgcgttaataacactgggaatctgctgcgcctaccgtaggggctactttatcaataacaaacaggacggcgagagctataaaaatccagggaagcccgacggtgtgaattatatcagaaccgatgaggagggtgattttaggcataagagtagttttgtcatctag

SEQ ID NO: 121303 - DNA, 1068 bp, Artificial Sequence
  Description of Artificial Sequence: Synthetic coding sequence
atggtaccagcccgactggggcctgcggtggccatggtaaccggggcaggaaggcgtgttctggccgggtgggcccacgcccgtggcgactacaaaccccggagggcggctgcaggcccttctgccactctggacatggcactgaggcggcctccccgacttagactgtgcgccagactgcctgacttctttctgctgttgctgttcagggggtgtttaatcggcgccgtcaacctgaaatcttctaacaggactcctgtcgtccaggagttcgagtctgtcgagctgtcctgtattattactgatagtcaaacctcagatccccgcatcgaatggaagaagatccaggacgagcagacaacatatgtattctttgataacaaaattcagggggacttggccggacgggccgagattctcgggaaaacaagtctgaaaatttggaacgtcacacgaagagacagcgctctgtaccgatgtgaagttgtggctcgcaatgacaggaaggaaattgacgagattgtcatcgagctgaccgtacaggtgaaaccggttactccggtgtgtcgcgtgccaaaagcagttcccgttggaaagatggccaccctgcactgccaagagagcgaggggcatcctaggcctcattacagttggtatcgtaatgacgtcccgctccccaccgacagcagggccaacccccgatttaggaacagctctttccacttaaactctgaaactgggacgctggtctttacggccgtgcacaaggacgattctggccagtattactgcattgccagtaatgacgccgggagtgctcgatgtgaagagcaggagatggaagtgtacgatctgaacattgggggtatcatcggcggagtcctcgtggtcttggccgtattggccctgatcacacttgggatctgctgtgcctatcgtcgaggatactttattaacaacaagcaagacggcgaaagttacaaaaatcccggcaaacccgacggagtgaactatatcaggaccgatgaagagggcgatttccggcacaaaagtagttttgtgatctag

SEQ ID NO: 121304 - DNA, 1986 bp, Artificial Sequence
  Description of Artificial Sequence: Synthetic coding sequence
atgaccggcgggcggtttgactttgacgacggaggcacctattgtgggggctgggaggagggtaaggcgcacggacatggcatttgcacagggcccaagggacagggagagtattctggatcatggtcccacggttttgaggttgttggaggctacacatggcctagtgggaatacctaccaaggctactgggctcagggaaagcgccatggcctcggtgtggaaaccaagggaaagtggatgtatcgcggcgaatggtcacacggcttcaaagggaggtacggcgtccggcagagcttatgtactccagcccgttatgaagggacctggagcaatggcctgcaggatgggtacggagttgagacctatggcgacgggggcacctatcaagggcaatgggccggaggcatgcggcatggctatggggtgcgacagtctgtcccctacggcatggcaaccgtcataaggtcaccactccgtacctccctggcctccctccgttcggagcaatccaacggctctgtgttgcatgacgctgcagctgcagccgactctcctgccggaacgcggggcggattcgtgctgaattttcacgctgatgccgagctggccggcaaaaagaaggggggccttttcagacgaggctcactcctcggttcaatgaagctcagaaagagtgaatctaaatcctcaatctcttcaaagagatcatcggttcgttctgacgccgcaatgagccgcatttcttcttctgacgccaatagcaccatttccttcggagacgtggactgtgatttctgtcccgtcgaggatcatgttgacgccaccacaacagaaacgtacatgggtgaatggaaaaatgataagcggaacggattcggcgtctccgagaggagcaacgggatgaaatatgagggagagtgggctaacaataaacgccacgggtacggatgcacggtgttccctgacggaagcaaggaggagggtaagtataagaacaacattttggtgaggggaattcggaaacaattgattcctatacggcacaccaaaaccagagagaaggtggaccgagccatcgaaggggctcagagggcagccgcaatggcacgcactaaggtggaaatcgccaactcccgcactgctcacgcacgcgccaaagctgatgcagctgaccaggccgctctcgcagctaggcaagaatgtgatatcgctcgcgcggttgcacgcgagctgagtccagatttttatcaacccggaccagattacgtgaaacagcggtttcaggagggagtagatgccaaagagaatcctgaggagaaggtgccagagaagcccccaactcctaaggaatcccctcacttctaccggaaaggaactacacccccccggagtccggaagccagcccaaagcactctcactctcccgctagtagcccgaagcctctgaagaagcaaaacccaagcagcggtgcacgactcaatcaggataagaggagcgtggccgacgagcaggtaaccgcaatcgtcaacaagcccctgatgtccaaggcacccaccaaagaggccggtgctgtcgtgccgcagtctaagtacagcggacggcatcacataccgaacccttcaaacggcgagctgcattcccaatatcacggctactacgtgaaactaaatgccccccaacatccacccgttgacgtggaggacggcgacgggagctcccaatcttcgtcagccctggtgcataagccaagcgctaacaagtggtcccccagtaagtctgtaactaaaccagtggccaaagagtctaaggccgagccgaaagcaaagaaatctgagcttgcaatcccaaagaatccagctagcaacgattcctgccctgctctagaaaaggaagctaactctggccccaatagcattatgatcgttctggtgatgttgctgaatattgggttggcaatccttttcgtgcactttctgacttag

SEQ ID NO: 121305 - DNA, 390 bp, Artificial Sequence
  Description of Artificial Sequence: Synthetic coding sequence
atgagcggcggccgattcgatttcgacgatggaggggcttattgcggcgggtgggagggcgggaaagctcatggccacggcctctgcaccgggcctaagggacagggggagtactctggatcctggaattttggattcgaggttgcaggagtgtacacatggccaagcggaaatacctttgagggttattggagccagggcaagagacacgggctgggcatcgaaacaaaaggacggtggctctataagggcgagtggacccacggcttcaaaggcagatacgggatccggcagtcatctagctcaggggctaagtacgaaggcacctggaacaacggccttcaagacggatatggtaccgaaacttatgccgacggaggcatgtgttag

SEQ ID NO: 121306 - DNA, 2091 bp, Artificial Sequence
  Description of Artificial Sequence: Synthetic coding sequence
atgtcaggaggccgattcgactttgacgacgggggcgcatactgcgggggttgggaggggggcaaagctcacggacatggcctctgcacggggcctaagggtcagggggaatactccggaagttggaacttcggcttcgaggtagccggcgtgtacacctggccctcaggtaatacatttgagggttactggtcacagggtaagcgtcacggcttggggattgagactaaaggaaggtggctctacaagggcgagtggactcacgggtttaagggacgatatgggatcagacagtcttcttcctctggggcaaagtatgaagggacttggaataatgggctccaggacgggtatgggacagaaacatacgccgacggaggtacttaccaggggcagttcaccaacggaatgaggcatggttacggggtcaggcagagcgtaccgtacgggatggccgttgtagtgcggagtccactgcgaacctcactgagctccttgcggtctgagcattctaacgggaccgtggctcccgactcccccgcctctccagcgagcgatggccccgctctgccgtctcctgcgatcccccgcggtggtttcgcactctccctgctcgcaaacgcagaggctgccgccagggcccctaaaggtggcgggctttttcagcgaggggcactactgggaaaattaaggagagcagaatcgcgcacgtcagtaggtagccagagatctagagtttcttttctcaagagtgatctgtctagtggggccagcgacgcagctagtaccgcttccctgggggaggctgccgagggcgccgacgaggctgccccatttgaggccgatatcgatgccacaactacagagacctacatgggggagtggaagaacgacaagcgctccggcttcggtgtcagcgaaagatccagtggtctgaggtatgaaggagagtggttggacaatcttaggcatggttatggttgcaccactctcccagatggtcatcgggaggaagggaaataccgccacaacgtattggtgaaagatactaagcggagaatgctccaactcaagagcaacaaggtgaggcagaaggttgaacacagtgtggaaggcgcacaaagggccgcggcaattgcacggcagaaggcggaaattgccgcctcaaggacaagccacgctaaggcaaaagcagaagcggcagagcaagccgctctggccgccaatcaagagtccaatattgctcgcaccctggcaagagagttggcccccgatttttatcagccaggcccagagtatcagaaaaggcgtttgttgcaagagattttggagaactccgagagcttacttgagccgccggatagaggcgctggcgccgccggactacctcagccccccagagagtcacctcaactccatgaacgtgagacgccgaggcctgaggggggctccccatcgcccgcaggcacgcctcctcagcccaaacgcccacgacctggagtgtcgaaggacggactgcttagccccggtgcttggaacggggaacccagtggagagggcagcaggagcgtgactccctctgaaggcgcaggaaggagaagcccagcccgccctgccacagaacggatggccatcgaggcgttgcaggcgcctcccgcacccagccgcgagccggaggttgccctttaccagggttaccactcttatgctgtgcgtacgacccccccggagcccccccctttcgaggatcagcccgagcccgaggttagcggtagtgagtccgccccatcgtctcctgcaactgccccccttcaggctcccactttgcgcgggcccgaaccagccagagaaacacccgccaaactggaacctaaacccataattccgaaggccgagccgagagcgaaggctaggaaaaccgaggcaagggggctgaccaaagccggggcgaagaagaaagcaaggaaagaagcagcactagctgcggaggccgaggtggaggtggaggaagtgccgaatacaatcttaatttgcatggtgattctgctcaatattggactggctatcttgttcgtccacctgctgacttag

SEQ ID NO: 121307 - DNA, 2247 bp, Artificial Sequence
  Description of Artificial Sequence: Synthetic coding sequence
atgtcctcaggaggaagattcaacttcgacgacggagggtcttattgcgggggctgggaggacggcaaggcgcatggacacggtgtttgcactggtcccaagggccagggtgagtatactgggtcctggagccatggttttgaggtgctcggggtctacacatggccatctgggaacacctaccagggcacctgggcccagggcaagaggcatggtatcggcctggaatcaaagggcaaatgggtgtataaaggcgaatggactcatggcttcaaaggtcgctacggagtgcgtgagtgtgccggaaacggggccaagtatgagggcacatggtctaacggtctccaagacggatacgggaccgaaacctactccgatggcggtacttaccaaggacagtgggtaggaggcatgagacaaggctatggcgtccgccagtctgtgccatacggcatggcagccgtgatccgctcacctctgaggaccagtataaatagtctgcgatccgagcatactaacggcaccgctctgcatcccgatgcctccccggcggtcgcagggagcccagccgttagcagaggcgggtttgtgctagttgcacatagcgacagcgaaatcctaaagagtaaaaaaaagggcctttttagacgaagcttgctgagcgggttgaagctgcggaaaagtgaatccaaatccagcttggcctcccaaagaagcaagcagtcctcatttcgcagcgaggcaggcatgtctaccgtgagttcaaccgcaagtgatatccacagtaccatctctctgggcgaagccgaggcggagctggccgtgatagaggacgatatagatgcgacaactacagaaacctatgtcggtgagtggaagaatgacaagcggagcgggtttggggttagtcagaggagcgacggattgaagtacgagggagagtgggcttcaaaccgacggcatggctacggatgtatgacattccccgacggaacaaaagaggagggaaagtacaaacagaacatcttggtgggcggaaaacgaaagaatctgatacctctacgcgccagtaagatacgcgagaaagtggatagagccgtggaagccgccgaacgggccgcgactatagctaagcaaaaagctgagatcgctgcatcacggaccagccactcaagggccaaagccgaagccgcccttaccgcagcgcagaaagcccaggaagaagcgcgcattgcgcggattacagccaaagagttctccccatccttccagcatcgtgagaacggcctcgagtaccaaaggcctaagaggcagacaagctgcgatgacattgaggttctatccaccggcacaccactgcagcaggagagtcccgagttgtacaggaaaggcacgaccccttccgacctcaccccggatgattcgccccttcaatcatttccgactagccccgcagccactcctccgcctgctccagccgcacgcaacaaagtcgcacacttctcccgccaggtgagcgtggacgaagagagagggggagatatacaaatgctactcgaaggtagagccggggattgcgcccggtcaagctggggagaggaacaggccggagggagtagaggtgtcaggtccggcgccctgcgcggtggcttactggtggacgactttcgaactcgggggtccgggaggaaacagccgggcaacccgaagccgcgcgaaagacgcactgagtctccccctgttttcacttggaccagccatcacagagcgagcaaccactcccccggcggttcaagactgctcgagctgcaggaggagaaactgtccaactaccgtatggaaatgaaaccactattgagaatggagactcatcctcagaagaggcgatatagtaaaggaggagcctgcaggggcctcggagacgaccacagacccgaggatagggggtttggcgtgcagagactccggtcaaaggctcaaaacaaagagaatttccgtccggcctcaagcgcagaacccgcagtgcagaagctggcatctctgcgactgggcggggccgaaccccggttattgcggtgggatttgacattttctccacctcagaaatcacttccagtggccttggagagcgatgaggagaacggggatgaactgaaatcctcaactggtagcgccccgatactggtggtgatggtgatactcctgaacattggcgtcgccatcctctttatcaattttttcatttag

SEQ ID NO: 121308 - DNA, 561 bp, Artificial Sequence
  Description of Artificial Sequence: Synthetic coding sequence
atgagctcagggggcaggtttaactttgatgatggcggtagctactgtggtggatgggaggacggtaaggcccatggccacggcgtctgtacaggcccaaaaggccaaggcgaatacacgggttcctggtctcacggcttcgaggtgcttggcgtttatacttggcccagcggaaatacctaccaaggcacgtgggcccagggcaaacggcatggtattggactggaaagtaaaggaaaatgggtctacaaaggcgaatggactcatggttttaagggaaggtacggcgtcagagaatgtgctggcaacggagcaaagtatgagggcacatggagcaatggactgcaggatggatacggaacagagacctacagcgatggcgacgctaccgcttttggtgctgaacctggcccagaggctagagagctgcccgcagccgccgctgccgccgccgcagccgccgccgccgcagtgcgctggttcttgtgcagggagccctggcccgctctccagctgccggcatgccttgactctccaataagcacccctcaatgcacatag

SEQ ID NO: 121309 - DNA, 96 bp, Artificial Sequence
  Description of Artificial Sequence: Synthetic coding sequence
atgccaccccattccggccagtcgcgggggcgcaagcctggctcttgcctgctgctgttgctgctgctgctccttctacttcttctcctgctctag

SEQ ID NO: 121310 - DNA, 1836 bp, Artificial Sequence
  Description of Artificial Sequence: Synthetic coding sequence
atgaggcaagggtatggggtgcggcagagtgtcccatacgggatggcggccgtcataaggtcacctctcaggacctccatcaactctcttcgatccgagcacactaatggcactgccttgcacccagacgcatccccagccgttgccggttctcctgcagtaagcaggggaggatttgtgctcgtcgctcacagcgactctgaaatactcaagagcaagaagaaaggtcttttccggaggtctttactgtctggacttaagctgcggaagtctgaatctaagagcagcctggcatcccaacgtagcaaacagtcttctttccggtccgaggcgggaatgtcgactgtgtccagtaccgcctctgatatacattcaactatttcccttggggaagcagaggccgaacttgcggtcatagaggatgacatagacgccacgacaacagagacgtatgtcggggaatggaagaacgacaaacggtcaggtttcggtgtcagtcagagaagtgatgggctgaaatatgaaggcgaatgggcttctaaccgcagacacggctatggctgcatgacttttccagacggaacaaaggaggaaggcaaatataagcaaaatattctcgtaggggggaaaaggaagaatctaattccactacgggccagtaaaattcgagagaaggtcgaccgggctgtcgaggcagctgagcgggcagctacaattgctaagcagaaggccgagattgccgcgtctcgaacatcacatagcagagctaaagccgaagccgcacttaccgctgcccagaaggctcaagaagaggctagaattgcgcgaattacagccaaggagttttcaccaagttttcagcaccgggagaatggtctggaataccaacggccaaagagacagacctcatgcgatgacattgaggttctctccactggcactccactgcagcaggaaagccccgagctgtaccgcaagggcaccaccccctccgaccttaccccagatgactccccactacaaagcttccctacatctcccgccgccacccctcccccagcacctgcggctcggaataaggtcgcccacttctcgagacaagtatctgtggacgaagagcgcggaggggatatccagatgctgctggaggggcgcgcgggcgattgtgccaggagttcatggggagaggaacaggccggcgggtcacgcggagtgagaagtggagcgttacgcggaggactgctcgtggatgactttcgcactagagggtccgggaggaagcagcctgggaatcctaaacctcgggaaagacgcacagagagtccaccggtgtttacatggacttctcatcacagggccagtaaccattcacccgggggctctcgcctgctggaactgcaagaagagaaactgagcaattataggatggaaatgaagcctctccttcggatggaaacccatccacaaaaacgtcggtactcaaaaggcggtgcatgtcgaggtttgggcgacgaccatcgcccagaagaccgtggcttcggagtacagaggctgagatcaaaggctcagaataaagaaaactttagaccagcttcttcagctgagccagccgtgcaaaaactcgccagtcttcgcctgggcggtgcagagccaaggctactgagatgggatctgactttttctccccctcagaagtcactgcctgttgccctcgaatctgacgaggagaatggagatgagctgaagtcttcaaccggctcagcacctattttagtcgttatggtaatattgttgaacattggcgtcgctatcctctttatcaactttttcatttag

SEQ ID NO: 121311 - DNA, 1347 bp, Artificial Sequence
  Description of Artificial Sequence: Synthetic coding sequence
atgacgtcgtcttgttgtgtgactaacaacttgcaagcctctctgaaatcttgtccacgccccgcgtcagtgtgcagttctggcgtgaattgcaggccagagttgtgcctgggctacgtgtgtcaacctatggcctgcttgccttccgtctgccttccaacaacattccggccagcatcgtgcctttccaagacttacctttcctcttcttgccaggccgcatctggcattagtgggagtatgggaccaggatcctggtattcagaaggcgcattcaacggtaacgagaaggaaacaatgcagttccttaatgacagattggcctcttacttgactcgggtgaggcaactcgagcaggagaacgccgaactggaaagtagaatccaggaagctagccactcgcaggtactgactatgacacccgattatcagtcacactttcgtaccattgaggagctgcagcagaaaatcctgtgcaccaaggcagagaacgctcgcatggtggtcaatatcgataatgcgaaattagccgcagacgacttccgcgctaagtatgaggcggagctcgccatgcgtcagctcgtggaagccgacataaatgggctgcgaaggatcttagacgatttgactttatgcaaggctgacctggaagcccaggtcgaatctctaaaggaggagttgatgtgccttaagaagaaccatgaggaggaagttggcagcctcagatgccagttgggcgacaggctgaatatcgaagtcgacgctgccccacccgtggatttaacacgggtgctagaggagatgagatgccaatacgaggcaatggttgaggctaatcggcgtgacgtcgaggaatggtttaacatgcagatggaagaactgaatcaacaggtggccacatcctccgaacagctacaaaattaccagtccgacatcatcgacttgagacgaactgtaaacactctggagattgaactgcaggcgcaacattccctcagagatagcctagagaatactttaacagagtccgaggctagatactcctctcagctggcccaaatgcagtgcatgatcacaaacgtcgaggcccagttggctgagatacgagcagacctggagagacagaatcaagaataccaagtgcttttagacgtgcgcgccaggttggagggcgagatcaacacatacagaagcttgttagaaaacgaggattgtaagttgccatgcaatccctgcagcacccccagctgcactacctgcgtgccttcaccttgcgtacctcgaaccgtctgcgtgcctaggaccgtgggtatgccttgctccccctgtccacaggggcggtactag

SEQ ID NO: 121312 - DNA, 1641 bp, Artificial Sequence
  Description of Artificial Sequence: Synthetic coding sequence
atggccgaagtcgtgagccccgtgcccggtgctggcaggcgcgagcccggcgaggtgggtagggcccgaggtccaccagtcgctgatcctggcgtggctttgtccccacaaggcgaaatcattgaagggtgtagactgccagtcctgcgccgaaaccaagacaatgaggatgaatggcccctcgccgaaatactgtccgtcaaggacattagcggcagaaaactgttttacgtacattacattgacttcaacaaacgacttgatgagtgggttacacatgaaaggttagatcttaaaaagattcagttccctaagaaggaagccaaaacacctaccaagaacgggttgcctggttctaggccaggatcgccagagcgagaggtcccagcctctgcccaggccagcggcaaaacactgccaattcctgtacagatcactctcagattcaacctccctaaagaacgagaagcaatccctggcggagagccagaccagccgctctcaagcagttcttgtcttcaaccaaatcataggagtactaaacggaaggtggaggtggtatcacccgctaccccggtgccctccgaaaccgcaccagcttctgtcttccctcagaatggtgccgcccggagagctgtcgccgctcagcctgggcggaaaaggaagtccaattgtctagggactgacgaagactctcaggactcctccgacgggattccttccgcgccacgtatgactgggtccctggtgagcgatcggtctcacgatgacatagttacccgaatgaagaacattgaatgtattgagcttggacgccaccgcctgaagccctggtacttcagtccatacccacaggaactgacgactctgcctgtgctttatctctgcgagttttgtctgaagtacggaagatccctgaaatgtctgcagaggcatctcactaagtgtgatctgcgccacccaccagggaatgagatatacagaaagggcactatctcatttttcgaaatcgacggacggaaaaataagagttatagccaaaatctttgcttgctggctaagtgtttcttagatcataaaacattgtactatgataccgatcccttcttgttttatgtgatgactgagtacgattgcaagggcttccacatcgttgggtattttagcaaggagaaggagtctaccgaggactataatgtggcttgcatcttgacactgcccccataccagaggaggggctacggcaagcttcttattgagttctcctacgagctcagtaaggtggagggcaaaaccggcacgcctgaaaagcccctttcagatctcggactcctcagctatcgctcctactggagccagaccatcctcgagatactgatggggctgaaaagcgaatcaggtgaaaggccccagattaccatcaatgagatatctgaaatcacatccattaaaaaagaagacgtgatttcaacactgcaatatcttaatctgattaactattataaggggcagtacatcctgacgctttctgaggatatcgtggacggacatgaaagagccatgctgaaaagactgctgagaattgactccaagtgcttgcacttcacgcctaaagattggtctaagcgcggcaagtggtag

SEQ ID NO: 121313 - DNA, 1386 bp, Artificial Sequence
  Description of Artificial Sequence: Synthetic coding sequence
atggctgaggtaggtgagatcatcgaaggatgtcggctacccgtgcttcggagaaatcaagataacgaggacgaatggccactggcggagattctgtcagtgaaggatatctctgggcgcaagctgttttacgtccactacatagactttaataaaaggctggatgaatgggtcacccatgagcgtctggacctgaagaagatacagttccccaagaaagaggctaaaactccaactaaaaacggcctgcctggctcccggcccggatcgccggagcgggaagtcaagcgaaaagtggaggtggtgtcccccgccacccctgtgccttccgaaaccgcccccgcctctgttttcccgcagaacggcgccgctaggagggcagtagctgcccagcccggaagaaagcggaaatcaaactgtctaggtaccgatgaagactcacaggattccagtgatggtattccaagtgctccaagaatgaccgggtcactagtgtctgatcgctcccatgatgatattgtgactaggatgaaaaatatcgaatgcatcgaacttggccggcacaggctgaaaccctggtacttctcaccgtacccccaagaacttaccactttacccgtgctctatctttgtgagttctgcctgaaatatgggcgcagcttaaaatgcttacagcgccacctgactaagtgtgatctgcgccaccctcccgggaatgaaatctacagaaagggcactatttccttctttgaaatagacggtagaaagaacaaatcttacagccagaacttatgcctactggccaagtgctttttggaccacaaaacactctattacgacacggatccctttctgttttatgtgatgaccgaatacgattgcaaaggcttccacatcgtaggctatttttctaaagaaaaggaatccacggaggattataatgtggcgtgtatcttgaccctgcccccataccagagacggggctacggaaagctccttatcgagttctcttacgagctgagtaaggtcgaagggaaaacaggaacgcctgaaaaacctctctcggatttgggactgctcagttacaggagctattggtcccagacaatcctagaaatactgatgggcctgaaaagcgagtcaggcgagagacctcaaatcacaatcaatgagatctccgagatcacctccatcaagaaggaggatgttatttctactctgcaatatctgaatctgataaactattacaaggggcagtatatactgacgctgagcgaggacatcgtggacgggcatgaacgcgccatgctcaagcggctgctcaggatcgacagcaaatgccttcactttacaccaaaggactggtcaaaaagagggaagtggtag

SEQ ID NO: 121314 - DNA, 1542 bp, Artificial Sequence
  Description of Artificial Sequence: Synthetic coding sequence
atggccgaggttggcgagattattgaaggttgccggcttcccgtgcttaggcgaaatcaagataatgaggatgagtggcctttggcggaaatactcagcgtaaaagacatctcgggcagaaaactgttctacgttcactacatcgatttcaataaacgacttgatgagtgggtgacacacgaacgactggacctgaaaaagatccagtttcctaagaaggaagcaaaaactcctaccaagaacggccttccgggttcaagacctgggagcccagaacgggaggtccccgcatccgcacaggcttccggtaaaacgctgccgatcccggtccagattaccctccgcttcaatttgcccaaggaaagagaagcaatcccggggggtgaacccgatcagcccctttctagttccagttgtctgcagccaaatcatcgttctaccaagcggaaggtggaggttgtgtctcccgcaacacccgtaccctcagagactgcaccagcctcagtctttccacagaatggtgctgctcgcagagccgtagcggctcaaccaggcagaaagagaaaaagcaattgcctgggaacagacgaagattcccaggactcaagcgacggtattccctcggctcctcggatgaccgggagcctggttagtgaccggtcacatgatgatatcgtgacccgtatgaaaaatatcgagtgcatcgagttggggagacatagattaaaaccgtggtatttctcaccttacccacaggaattaactactctcccagtcctgtacctctgtgaattctgcttgaagtacggacgaagtctgaagtgtctgcaacggcacttgaccaaatgcgatctaaggcaccccccagggaatgaaatttatcgtaaaggcaccataagcttttttgagattgacggaaggaagaacaaaagctattcccaaaacctgtgcctgctggcaaagtgttttttggatcataagactctctactacgatacggaccccttcctcttttacgtcatgacagaatatgactgtaagggcttccatatcgtggggtacttctctaaggaaaaagagtctaccgaagattacaatgtagcctgtatactgacgctgcctccatatcagcggcgcggatatggaaagctgctgatagagttcagctatgagctttcaaaagtcgagggcaaaaccggtaccccagaaaagcctctgtcagacctaggcctgctcagctaccgcagttactggagccaaaccatcctagagattcttatgggcctgaaaagtgagtctggcgagaggcctcaaatcaccattaatgaaatctcggagattacctcaatcaagaaggaagatgttatcagtactctgcagtacttgaatcttattaactattacaaaggacagtatatcctgacgttaagcgaggacatcgttgatggccacgagagggctatgttgaaaaggttgctccgcattgactcaaaatgcctgcactttacccctaaggactggtcaaaaagaggtaagtggtag

SEQ ID NO: 121315 - DNA, 1485 bp, Artificial Sequence
  Description of Artificial Sequence: Synthetic coding sequence
atggcggaagtggttagccccgtgccaggcgctggccggagggagcctggagaggtgggccgggcccgtggccccccagtcgcagaccccggagtggctctcagtccacagggcgagatcatcgagggctgcaggctgcccgttcttcggagaaatcaggacaatgaggacgaatggcctctggcagaaatcttgtctgtgaaggatatctcggggcgcaagttattctacgtgcattatattgactttaataagcggctggacgagtgggtaacccacgagcgactagacctaaagaagattcagtttcccaaaaaggaggctaagacaccaacgaagaacgggcttccaggttctcggccaggctccccagaacgggaagtgaaaagaaaagtcgaggtggtgagccctgcaacaccagtgccatcagaaaccgcgcctgctagtgtattcccccagaatggtgccgctagacgagccgtagccgcacagcctgggcggaagcgcaagtccaattgcctgggaacagacgaggactcccaggacagttcagacggcattccaagcgcaccaaggatgaccgggagcttggtaagtgacaggtctcatgacgatattgtgacgcgaatgaaaaatatcgagtgcattgagttgggaagacaccgcctgaagccttggtatttcagtccctacccccaggagctgactacgcttcccgtcttatatctgtgtgagttctgtttaaagtacggccgaagccttaagtgtctccagagacacctgaccaagtgtgatctgaggcatcctccgggaaatgaaatctatcgtaagggcacaattagcttctttgagatcgatggacggaaaaataagtcatatagtcaaaatctctgtctgctggccaaatgctttcttgatcacaagaccttgtattacgatacagacccatttttgttttacgtgatgacagagtatgattgcaaggggttccacatcgttggctactttagtaaggagaaggaaagtaccgaggactacaacgtggcttgcattctgacattacccccttaccagcggagaggatatggaaagctcctaatagagttttcctatgagctatctaaagtcgagggcaaaacaggtactcctgagaaacctctgagtgacctcggcctgttgtcataccggtcctactggagccaaaccatccttgagatcctcatgggtctcaaaagtgagtccggcgagcggccgcaaattactatcaatgagatcagtgaaattacgtcgatcaaaaaagaggacgtgatttcaaccttacagtatctcaatttgatcaactattacaagggccaatacattttgaccttgtccgaggacatcgtcgatggccatgagcgcgccatgctcaagcggctcttacgcatcgattcgaaatgcctccattttacccccaaagactggagcaaacggggtaagtggtag

SEQ ID NO: 121316 - DNA, 6222 bp, Artificial Sequence
  Description of Artificial Sequence: Synthetic coding sequence
atggtaaaattggccaacccattgtacacagagtggattctagaggccatccagaagatcaaaaagcagaaacagaggccaagcgaggaaagaatctgtcacgcagtgtctacgtcacatggacttgataagaagaccgtgtccgagcagcttgaactgagtgtgcaggatggtagtgtgctgaaagttactaataaagggttggcctcttataaggacccagataatcctggccgattttcttctgtgaagccagggacctttccgaaatcagctaaaggatctcgcgggagctgcaacgacttaagaaacgttgactggaataagttactgagacgggcaatagagggtctggaggagcctaatgggagttcacttaagaacatagagaaatatctccgctcccaaagcgatcttacaagcaccaccaataatccagcattccagcagcggctcaggctgggcgctaagcgggcggtgaataacggccggctgttaaaagatggaccccaatacagagtgaattacggttccctggacggcaagggggcaccccagtacccctctgcattcccctcttcgctcccccctgtcagcctgctgcctcacgaaaaagaccagcctcgggccgaccccatacctatttgttccttctgcttaggaaccaaggagtcaaatcgagagaagaagccagaggaactgctctcgtgcgcagactgcggtagcagcggccaccctagctgccttaagttttgcccagagctgaccaccaacgtaaaggcccttagatggcagtgtatcgaatgtaagacatgcagcgcatgtcgcgtgcagggccggaatgctgacaatatgctgttttgtgactcctgtgatagagggttccacatggaatgctgtgaccccccactgtctcgcatgcctaaggggatgtggatctgccaggtttgtaggcccaagaaaaagggacgaaagctcttgcatgagaaagccgcacagatcaaacggcgctatgcaaaaccaattggacgacctaagaacaagctcaagcaaagacttttatcagtaacaagtgatgaggggtctatgaatgctttcacaggccgcggatctccgggacgcggccagaagactaaggtgtgtactactcccagctcagggcatgctgcctcaggtaaggacagctcttcgcgcctcgcagtcactgaccccaccaggcccggggccacgaccaaaatcaccaccacatccacctatatcagtgcctccacactcaaagtcaataagaaaaccaaggggttaattgacgggctgacaaaattcttcacaccgtcaccagatggtcggaggtccagaggggaaataattgacttttcaaaacactatagacctagaaagaaggtctcgcagaaacagtcctgtacaagccacgttttggcaaccggcactacccaaaaattgaagcccccgccttcttcactgccaccacctacacctatcagcggccagagccccagttcgcagaaatcgagcactgctacatcttccccatcccctcagtcctcctcatctcagtgctccgtgcctagtctgagttccctgaccactaacagccaacttaaagctctgtttgatggtctctcccatatctacaccactcagggacagtcacgtaaaaaaggtcatcccagttatgccccacccaagcgtatgcgccgcaagacggagctcagtagtacagccaagtcaaaggctcatttcttcgggaagcgagacataagatctcgattcatctctcactcttccagcagctcctggggcatggcccgcggcagtattttcaaggcaattgctcacttcaagcgaaccacatttctcaagaagcaccgcatgctgggtcggctcaagtataaagtgactccacagatgggcaccccttcacctggcaagggatcactgaccgacggccggattaaaccagaccaagatgatgataccgagattaagattaatattaagcaggaatcagcagacgtcaatgttatcggcaacaaagatgtggttacggaagaggatttggatgtgtttaagcaagcacaggaactgtcatgggagaagattgagtgtgaatcgggtgttgaagattgtggcagatacccatccgtcatcgagtttggcaaatatgagatccagacatggtattcctcaccctacccccaagaatacgcccgcctgcctaagctgtacctctgcgagttctgcctaaagtatatgaaatctaagaatatactgttgcgtcacagcaaaaaatgcgggtggtttcatccccccgctaacgaaatatatcgacgcaaggacctctctgtcttcgaagtggatggtaacatgtccaagatatactgtcaaaacctttgcctccttgcgaaactgttcctggaccacaagacactttactacgatgtcgagcccttcctcttttacgtgcttactaaaaatgacgaaaaagggtgccacctggtgggctactttagcaaggaaaagctatgtcaacaaaaatataacgttagctgcattatgattatgcctcagcaccagaggcaggggtttggacgatttctaattgacttttcctatctcctgtcccgcagggagggccaggcaggcagtcccgagaaacccctgagtgatctgggtaggctctcatatctggcatattggaagtccgtcatccttgagtatttgtaccaccatcacgagcggcatatatcgatcaaggccatttcccgcgccactgggatgtgcccccacgacattgcaaccactttgcagcaccttcatatgatcgataagcgggatggacgtttcgtgataatccgaagggaaaagcttatcctgagtcacatggagaaactgaagacctgttcacgggccaatgaactcgatcccgactccctccgctggacccccattctaatctcaaatgcggctgtcagcgaggaggaaagggaagccgagaaggaggccgagcggttaatggaacaggcctcatgttgggagaaggaggaacaggagattctgagtactcgcgcaaattcaagacagtccccagcgaaagtgcagtccaagaacaagtacctgcacagtcctgaaagtcggccggtgaccggggaacgcggccaactgctggagttgtccaaggagtctagcgaagaggaggaggaagaggaggacgaagaagaggaggaggaggaagaggaggaggaggaagatgaggaggaagaggaagaagaagaggaggaggaggaagaggagaacatccaatcgtctccacctagactgaccaagccccagtctgtggccattaaaagaaagagaccatttgttttgaagaagaagagagggcgcaagaggaggaggatcaactcctccgtgaccaccgaaactatttcagaaaccactgaggttctcaacgagcctttcgataattccgacgaagagcgtccaatgcctcagctcgagcccacctgtgagattgaggtggaggaagacggcagaaaacccgtcctccggaaagcgttccagcatcagcccgggaagaagaggcagacagaggaggaggaagggaaggataatcactgtttcaagaacgctgacccatgtcgaaataatatgaatgacgactcttctaatctgaaggagggtagcaaggataacccagagccactgaaatgtaaacaggtctggccaaagggcacaaagcgcgggctgagcaagtggcgacaaaataaagaacgtaagacagggtttaaacttaacctctacactccccccgagactcctatggaacccgacgagcaagtcactgtggaggagcagaaggagacttctgagggaaagacatctccttcaccaatccgtatcgaggaagaagtgaaggagacaggggaagcacttttaccacaagaggaaaatcgtcgggaagaaacctgcgccccagtgtctcccaacaccagtcccggcgagaagcctgaggacgaccttattaagcccgaagaggaagaagaggaagaagaagaggaggaagaagaggaagaagaggaagagggcgaggaagaggagggaggcggcaacgtggaaaaagaccctgacggcgccaaaagccaggaaaaagaggagcccgaaatctccactgagaaagaggactccgcccgattggacgatcacgaagaagaagaagaggaagatgaagaacccagtcataacgaagatcacgatgctgatgatgaggacgactcccacatggagtccgctgaagtagagaaagaagagctcccccgggaaagcttcaaagaagtgttagagaaccaggagacatttctggatctcaacgtgcagcctgggcactccaaccctgaagtgttgatggattgcggtgtcgatctaactgccagctgtaacagcgaacctaaagagctcgccggagatccagaggccgtgccagagtccgacgaagagcctcccccgggcgaacaggcacagaagcaagaccagaaaaactcgaaggaggtagacacggagtttaaagagggaaaccctgcaaccatggaaattgatagcgagacagtccaggcagtgcagtccttgacccaggagtcatcggagcaggacgatacgttccaggactgcgcagagacccaggaagcctgccgatcactccagaattatacccgcgccgaccagtctccccaaattgcgacaacactcgacgattgccaacagtctgaccactctagccctgtgagctcagtgcattcccaccccggacaaagcgtacgaagcgttaatagtccgtccgtcccggcactggagaacagctacgcgcaaatttcccccgaccagtccgctatctcagtcccatcactgcaaaatatggaaacaagtcctatgatggatgttccctctgtctccgaccactctcagcaggtggttgacagtgggttcagcgatttaggttctatagaatctactactgagaattatgagaaccctagtagctacgatagtaccatgggggggtccatttgtggcaatggttcctcccagaactcttgtagctattctaatctgactagttcttcacttacccagagttcatgtgccgtgacccagcagatgagtaacataagcggttcttgcagcatgcttcaacagactagtatatcgagtcctcctacatgttccgtcaagagcccacaaggctgtgtcgtggaacgcccaccatcaagcagccaacaactggcccagtgctctatggcagctaacttcacgccccccatgcagctggctgagattcctgagacttccaacgcgaatatcgggttgtacgaaagaatgggacagagtgattttggcgccggccattacccacagccctctgcgaccttcagtctcgctaaactgcaacaactgaccaataccttgatagaccatagcctgccctactcccacagcgctgcagtgacaagctacgcgaattccgcttcactctccacaccactatcgaacactggactcgtgcaattgtcccagtcaccacactcagtgcctggaggcccacaggcccaggctaccatgacaccccctccaaaccttacgccccccccgatgaatctcccacctccactgctgcaacggaatatggccgcgtctaatattggaatttctcacagccaaagattgcagactcaaatagcatctaagggccacatctcaatgcgcacgaagtcagccagcctgtctcccgctgcggctacacaccagtctcaaatctatggacgatcccagactgtcgcaatgcaaggcccggctcgaacgctaaccatgcagcgaggtatgaatatgagtgtgaacctgatgcccgctcccgcatacaacgtgaacagcgtcaatatgaacatgaacacactgaatgccatgaacgggtattcaatgagccagcctatgatgaattctggctatcactcgaatcacggttatatgaaccaaactcctcagtaccctatgcagatgcagatgggcatgatgggcactcagccttacgcacaacagcccatgcagacaccaccgcacggtaacatgatgtatactgcccctgggcatcacggctacatgaacacagggatgagcaaacagagcctgaatggcagctatatgagaaggtag

SEQ ID NO: 121317 - DNA, 5673 bp, Artificial Sequence
  Description of Artificial Sequence: Synthetic coding sequence
atggtgaagctggctaaccctctatatacagagtggattctggaggctattcaaaaaatcaagaagcagaaacagcgaccttccgaagagcgaatttgccatgcagtatctacctcccacggattagataagaagacggttagtgaacagttggagttgtctgtgcaggatggaagtgtactgaaagttacgaacaaaggacttgcctcctacaaggaccccgacaatccagggaggttttcatcagtgaaacccggcaccttccctaagtccgctaagggttcccgtgggagctgtaatgaccttcgcaatgttgactggaacaaattgctacgcagggccatcgagggtctggaagagccaaatggttcctctctgaagaatattgagaaataccttcgatcacagtctgacctgacaagcacaaccaataatcctgcattccagcaaagactacggctgggagcaaagagggcagtcaataacggccgcttactcaaggacgggcctcagtatagggtgaactacgggtccctggacggaaagggggccccccagtacccctctgcctttccttctagcctgccacctgtttctctgttgccccatgagaaggaccagccgcgcgcggacccaattccaatttgctccttctgtttgggaaccaaggagagtaatagggaaaaaaagcctgaggagttattgtcttgtgccgactgtggatccagtggccacccatcctgtctgaaattttgtccggagctgacaaccaacgtcaaagccctgagatggcagtgcatcgaatgtaaaacatgttcagcctgcagggttcagggcagaaacgctgataatatgctgttctgtgactcgtgcgatcgcggatttcatatggaatgctgtgaccctcccttgtcccgcatgccaaagggtatgtggatttgccaggtatgtaggcccaaaaaaaaaggcagaaagctcctgcatgagaaagccgcacagatcaagcggaggtacgccaagccaataggtaggcccaaaaacaaactgaaacagaggcttctatcagtgacatccgatgaggggtcaatgaatgcgttcacgggcagaggaagccccggccggggccagaagaccaaggtttgcacaactccctcttcaggacacgcagcttcaggaaaagattcttcctctcgtttagctgtgacggaccctacccgccctggcgccactactaaaatcacaaccacctcaacctacatctcagcgtccacgttgaaggttaataagaagactaaaggcctgattgatggtttaaccaagttctttacaccatcccctgacgggcgcaggtctcggggcgagattatcgacttttcaaagcactacaggcctcggaagaaagtgtcacagaagcagtcttgcactagccatgtgttggccaccgatacggaaatcaagattaacattaaacaggagagcgctgatgtgaatgtcattggcaataaggatgtcgtcaccgaggaggatctcgacgttttcaagcaggcccaagaactcagctgggagaagatcgagtgtgaatcgggagtcgaagactgtggcaggtacccatccgtgatcgagtttggaaaatacgagattcaaacttggtattccagtccataccctcaggagtacgcaaggctgccgaaactatacctctgtgaattctgcctcaaatatatgaagtctaagaatatactgctgcgccattcaaaaaaatgtggctggttccatccacccgctaatgaaatataccgccggaaggacctctcagtgttcgaagtcgatggcaacatgtccaaaatatactgccaaaatctttgcctgctcgccaaattatttcttgatcacaagaccctctactatgacgtcgagccattcctgttttacgttctaaccaaaaacgacgagaagggctgtcacctcgtggggtatttctctaaagagaaactctgtcagcagaaatataatgtctcatgcattatgattatgccccaacaccagaggcagggttttggaaggtttctcattgatttcagttacctcttatccagacgggagggacaggccggaagtcctgagaaaccactctcagacctcggtcgcctgtcgtatttagcttactggaagtctgtaatcctggagtatctgtatcatcaccacgagaggcatatttccatcaaagcgataagtcgagccactggtatgtgtcctcacgacatcgcaactacattacaacatctgcacatgattgataagcgagacgggagattcgtgattattcgccgcgagaagctgatcctgtcccatatggagaaattaaagacgtgttctagagctaatgagttagacccggatagtcttcgctggaccccaatccttattagtaacgcagctgtttctgaagaagaaagagaagcagaaaaagaagccgagcggctgatggaacaggcttcctgttgggagaaagaagagcaggagatccttagcactcgagcaaactcccggcagtctcctgccaaagttcagtccaagaacaagtatctccatagcccagaaagccgacccgtaactggggagagaggtcaattgctcgagttaagcaaggagtcttcagaggaggaagaagaggaagaggatgaggaagaggaagaggaggaagaagaagaggaggaggatgaggaggaagaagaagaagaagaagaagaagaagaagaggaaaacattcagagctcccccccccgactaacgaagcctcaatctgtcgcaatcaagcgcaagcgcccgtttgtgctgaagaaaaagaggggccggaaacggcgccgcatcaacagctcggttacaaccgagacaatatctgagaccactgaagtgctgaatgagccttttgacaacagcgatgaagagaggcctatgccccagcttgaacccacctgcgagatcgaggtcgaggaagatggacgaaagccggtcttaagaaaggcatttcagcaccaaccaggcaagaaaaggcagacagaggaggaggaggggaaggataaccactgctttaagaacgcagatccctgccggaataatatgaatgatgactcaagcaacctcaaagaagggtcgaaggacaacccagagcccctgaaatgcaagcaggtgtggccgaagggaactaagagaggtctgtcaaagtggcgccagaacaaagagcgaaaaacaggattcaagctcaacctctacaccccacctgaaactcccatggaacctgacgagcaagtgactgtggaggagcagaaggagaccagcgaaggcaaaacctccccctcacccattagaatagaggaagaggtaaaagaaaccggggaggcattacttccacaggaggagaacaggcgcgaagagacatgcgccccagtcagtcccaacacaagccccggagaaaagcccgaggatgacctgatcaagcctgaggaggaggaagaagaagaggaagaggaggaggaggaagaggaggaggaggagggggaggaagaggagggaggaggcaacgttgaaaaagatcctgacggcgccaagagtcaggaaaaagaagagccagaaatctctaccgaaaaagaggattcagcgcggttagacgaccacgaggaagaggaggaagaggacgaagagccttcccataatgaggaccatgacgcggacgacgaggacgactcacatatggagtccgctgaggtagaaaaggaggagcttccgagggaatcctttaaggaggtccttgaaaaccaggaaacgttcctcgacttgaacgtgcagccaggacacagcaacccagaggtactaatggactgtggcgttgacctgacggcttcttgtaatagcgaaccaaaggagctcgctggcgaccccgaggctgtccccgagagcgacgaagaaccgcctccgggggagcaggcacaaaagcaagaccaaaagaacagcaaagaagttgataccgagttcaaggagggcaacccagccactatggaaatagattccgaaaccgttcaggcagttcagagccttacacaagagtctagcgagcaggacgatacattccaggactgcgccgagacccaggaagcttgtaggtctcttcagaattacactagggccgaccagtcaccccagattgcaactaccctggacgactgtcaacagtccgaccacagctcccctgtgagtagtgtccattcccaccccggccagtccgtacgctctgtgaatagcccttctgtgccagcactggagaacagctacgcccagattagtcccgatcagtccgcgatctcggttccatccctgcagaacatggaaacaagtcctatgatggacgtgccaagcgttagcgaccacagccaacaagtcgtggattctggtttcagcgatctgggatcaatcgagtctaccactgagaattatgagaacccaagttcatatgattcaactatgggagggagtatttgcggtaacggtagtagtcagaattcttgttcctatagtaatctgacatcctcatctctcacacagagctcctgcgccgtgactcagcagatgtctaacatctcaggttcttgctccatgcttcaacaaacctccataagctccccccctacctgtagcgtgaaatctccccagggctgcgtggtcgagagaccacctagcagcagccagcagctcgcccaatgctctatggccgccaattttactccacccatgcagctcgcggagattccggagacaagtaatgcaaatattggcctgtatgagcgaatggggcaatctgatttcggcgctggccattacccccagcctagtgctaccttctctttagccaagctgcagcagttgaccaacacattgatcgatcatagcctcccttattcccactcagccgcagtgacttcttatgccaactctgcctccctgtctacgcccctttctaacacaggactagtgcaactgtcccaatctcctcacagtgtgcctggcggacctcaggcccaagccactatgacccccccccctaatttaacccccccaccaatgaaccttccgcctcccctgctccaaagaaatatggcggccagtaatataggcatatcgcacagtcagagattacagacacagatcgcctctaagggacacatctccatgaggactaaaagcgcctctctgtctccagcagccgcaactcatcagagccaaatctatggaaggtcccagacagtggccatgcaggggccagcacgcacattaacaatgcagcggggtatgaacatgagcgttaaccttatgcccgcacctgcttataacgtgaacagcgtgaatatgaacatgaataccctgaatgccatgaatgggtattctatgagtcagcctatgatgaattccgggtaccattccaaccacggttatatgaaccagacacctcaataccccatgcagatgcagatgggaatgatggggacacagccatatgcccagcagcccatgcaaacaccccctcacggcaacatgatgtacacggccccgggccatcacggctacatgaatactggtatgtctaaacagtctctgaacgggagctacatgcggcgctag

SEQ ID NO: 121318 - DNA, 5346 bp, Artificial Sequence
  Description of Artificial Sequence: Synthetic coding sequence
atggtgaaactcgcgaaccccttgtacaccgagtggatccttgaagcaattcagaaaattaagaaacagaagcagcgacctagcgaggaaaggatctgtcacgcggtgtccaccagccatggcttggataagaaaaccgtttcagaacaactagaactgagcgtgcaggatggatcagttctcaaggtgactaacaaaggattagctagttacaaagatccagacaaccccggtagattcagttcagtgaagcccggaacattccccaaatctgccaaggggagccgggggagctgtaacgatttgaggaatgtagactggaacaagctgttaaggagagctattgagggactggaagagcccaatggaagctccctcaagaacatcgagaaatacctgcgaagtcagagcgacttaactagtacaactaataatcccgctttccagcagcgtttaagactcggagccaaaagggctgtgaacaacggccgtcttctcaaagacggaccgcagtatagagttaactatggatccctcgacggcaagggagccccccagtacccctccgcctttccttcgtctttacctcccgtcagcctactgccacacgagaaggaccagccccgagcggatcccattcctatttgctccttttgcctagggacgaaggagtcaaatcgggagaagaagccagaagagctgttaagctgtgccgactgcggcagttcggggcacccctcgtgtttaaagttttgccctgaactgaccacgaacgttaaagcattaaggtggcagtgtatagagtgtaaaacctgttctgcgtgtcgagttcaaggtagaaacgccgacaacatgcttttctgcgatagctgcgaccggggcttccacatggagtgctgcgacccacctctttctaggatgccaaaaggcatgtggatctgtcaggtgtgccgacctaaaaagaagggcagaaaactgctgcacgagaaggctgcgcagattaaacggcgttatgccaaacccatcgggcggccaaagaacaagctcaaacagcggttactctccgtgacctctgatgaggggtctatgaacgcctttacaggtaggggtagccccgacacagaaatcaagatcaacataaagcaggagtcagcagatgtcaacgtgatcggaaataaagacgtagttacggaagaagacctagacgtgttcaagcaggcacaagagctcagctgggagaaaattgagtgtgagtccggggtcgaagactgcgggcgatacccctccgtgattgagtttggcaagtacgaaattcaaacatggtattccagtccgtatcctcaagaatacgccagactgcctaagctgtatctctgtgagttttgtcttaagtacatgaagtctaaaaacatactgctccgacactctaaaaagtgcggatggtttcaccctcccgccaatgagatctaccggaggaaagacctgtcagtatttgaggtcgatggcaatatgtccaaaatctattgccagaatctgtgtcttctcgctaaactttttcttgaccacaagacactgtattatgacgtggagccgttcctattctatgttctcaccaagaatgacgagaaggggtgccacctcgtaggctacttcagcaaggaaaaactatgtcaacagaaatacaacgtgtcttgcatcatgatcatgccccagcaccagagacaaggcttcggtaggtttctgattgatttttcgtacctcttgagtcgcagggaggggcaggccggatctccagagaaaccactctcagacttaggcaggttatcctacctggcatactggaaatcagtcatcctcgagtacctctatcaccatcatgagcgacacatctccatcaaggctatctcccgcgccactggtatgtgtcctcacgacatagcgactacgctccagcacctgcacatgatcgataagagagatgggcgttttgttataatcagaagggaaaagctgattctttctcacatggaaaagctgaagacctgctcgagagctaatgagctggaccccgatagcctgcgctggacccccatcctgatatccaacgcagccgtctcagaggaggaaagggaggctgagaaggaggctgaacgcttgatggaacaggccagctgctgggagaaggaagaacaagaaatcttgagcacacgggccaattcgaggcaatcacccgcaaaagttcagtctaagaataaatacctccactcgcccgaaagccgaccagtcaccggagaacgcggccagctgttagagctgtcgaaggagtcctcggaggaggaggaggaggaagaggatgaagaggaggaggaggaggaggaggaggaagaggaggacgaggaggaggaggaggaagaagaagaggaggaagaggaggaaaacatacagtcatccccaccaagactcactaaacctcaatcagtggccatcaaacggaagcggccatttgtgttgaaaaaaaagaggggccgcaaaaggcgtaggatcaatagctctgtaactactgagacaatctcggagactaccgaggtgctgaacgaacccttcgataacagtgatgaagaacggccgatgccacagctagagccaacttgcgaaatagaggtggaggaagatggccgcaagccagtgctccggaaagcattccaacaccaacccggcaaaaagcggcagacagaggaagaagaagggaaggataatcactgcttcaagaacgctgatccgtgtcgcaataatatgaatgatgacagttccaatctaaaagagggtagtaaggataatcccgagcctctcaaatgtaaacaggtttggcccaagggtacgaaacggggcctgtctaaatggaggcaaaacaaggaacgcaaaacagggtttaaactgaacttgtacacgccacctgaaacacctatggagcctgacgaacaagtgaccgtggaagagcaaaaggagacatcagagggaaaaaccagtccttcccccattaggatcgaagaggaagttaaggagactggagaagccctgttgccccaagaggaaaatcgcagggaagagacttgtgctccagtgagtccaaatacatcccccggagagaaaccagaagatgaccttatcaagcccgaagaagaggaagaggaggaagaggaagaggaggaggaggaagaagaggaagagggcgaggaggaggaggggggcggcaatgtcgaaaaggatcccgacggcgcaaaaagccaagagaaggaagaacctgaaatttccacggaaaaggaagattctgctcgcctcgacgatcatgaggaggaggaggaagaagacgaggagccctctcacaacgaagaccatgacgcagacgatgaagacgactcacatatggaaagcgccgaagtcgaaaaggaagagcttccgagagaaagctttaaggaggtgttggagaaccaggagactttcctcgatctcaatgtgcagcctggacattcaaacccagaagtgttaatggactgtggggtggaccttactgcaagctgcaacagtgaaccaaaggagcttgccggtgatcccgaggcagtcccagagagcgacgaggaaccacccccgggggaacaagcccagaagcaggaccagaaaaactccaaagaagtggacaccgagtttaaagaggggaatccggcaacgatggaaatcgatagcgaaaccgtccaggccgtgcaatcgctgacccaggagtcatccgaacaggacgacacattccaggactgcgcagaaactcaggaggcctgtagatctcttcagaattacactcgagcagatcagagtccacagattgctaccacactcgatgattgccagcagagtgatcactcttctccggtgtcatccgtacattcccacccaggccagtccgttcgcagcgtgaatagtcccagcgtgccggctctcgaaaacagctacgcccagatctctcctgaccaaagcgctattagcgttcctagcctgcagaatatggaaacatcccccatgatggatgttcctagtgtgtctgatcattcccagcaggtcgtggatagtgggttctccgatctcggatccattgaatccaccactgagaactatgagaaccccagctcctatgatagcaccatgggtggttccatctgcgggaacgggagcagtcagaactcttgttcgtacagtaacctgactagctcctcccttacacagtcttcctgcgcggtcacccagcagatgtctaacataagcggttcttgctccatgttgcagcagacaagtatctcatctcctccaacatgttcagtgaagtctccacaaggttgcgtagtggagcgtccacccagctctagccagcagctggcgcaatgctctatggctgccaactttacgcctcccatgcagctggctgagatccccgaaacttctaatgctaatatcgggctgtacgagaggatgggccaatccgattttggcgcgggtcattacccacagccctcggcaacgttttcactcgctaaactgcaacagttgaccaacacactaatagatcattccctcccatattcccacagcgccgccgtcacctcctacgcaaattcggccagcttgtccactccattgagtaacaccggcctcgtccagctgtctcagtctccacactccgtacccggtggaccacaggcccaagcaactatgacacctcctcccaatctcacaccacctcccatgaacttacccccccctctgctgcaaaggaacatggccgcctctaatatcggcatatcacacagccagagactgcaaactcagattgcttcgaaaggacatatatctatgaggacaaagtccgcctcgctgtctcctgcagccgctacacatcaatctcaaatctacgggagatcccagacagtggctatgcaaggtcccgcccgtactctcaccatgcaaagaggcatgaatatgtccgtgaatcttatgccggcaccggcatacaacgtcaactccgtgaatatgaatatgaatacacttaacgctatgaacgggtacagcatgtctcagccgatgatgaattctggctaccatagcaaccacgggtatatgaaccaaacacctcaataccccatgcagatgcagatgggcatgatgggcacccagccttatgcccagcagccaatgcagacaccaccccatggaaatatgatgtataccgccccaggccaccacggatatatgaacaccggcatgagtaagcagtcactgaacggttcatacatgcgacggtag

SEQ ID NO: 121319 - DNA, 5346 bp, Artificial Sequence
  Description of Artificial Sequence: Synthetic coding sequence
atggttaaactggctaacccactatataccgagtggattctggaagcaatccagaagattaaaaagcagaagcagaggccctccgaagagcgtatctgccatgccgtgagtacctctcacggcctcgataagaagacagtgagtgaacaattggagctgagcgtccaggacggaagcgtacttaaagtgactaacaagggcctcgctagctataaagaccccgacaacccgggtagattctctagtgtgaagccgggcacgttccccaaatccgccaaagggagccgcggaagttgcaacgatctgagaaatgtggattggaacaaattgctgaggcgggcgatcgaaggactagaggaacctaatgggtctagtctgaagaatattgagaaatatctgcggagtcagagcgacctcaccagcacaacgaacaaccctgcgttccagcaacggttgcgtttgggggctaaacgggctgtaaataatggcagattgctgaaagacggtccacagtaccgcgtgaattacggctcattagatggaaagggggcacctcaatatccgtccgccttcccttccagtctgccacctgtttccctgctcccccacgaaaaggatcagccacgggcggaccccattcctatttgttcattttgcctgggaaccaaagagtctaatagagagaagaaacccgaggagctgctctcatgcgccgattgtggttcaagcgggcatccttcttgtctcaaattttgtcccgagctcacaaccaacgtgaaggcgctgcgttggcagtgcatcgagtgcaagacttgctcagcttgcagagtgcaggggaggaatgcggacaacatgttattctgtgactcctgcgacagaggctttcatatggagtgctgcgatccccctcttagccgcatgcctaagggtatgtggatctgtcaggtgtgtaggcctaaaaaaaaggggcggaagctcctacacgagaaggcagcccaaatcaagcggcggtatgccaagccgattggtagaccgaaaaataagctgaaacagcgactgctgtccgtgacttcagatgaaggcagcatgaatgcttttaccggccgcggtagcccagataccgaaatcaagatcaacataaaacaggaatctgcagatgtgaacgtcataggtaataaagacgttgtgactgaggaagacctggacgtgttcaagcaggctcaggagctatcgtgggaaaagatagagtgtgagagtggcgtcgaggactgcggccgctacccttccgtgatcgaatttggcaagtatgagattcagacttggtattcctcaccctatccacaggagtacgccaggttgcccaaattgtatctctgtgaattctgcctgaagtacatgaagtccaagaacatcctgctgcggcattccaagaagtgtggatggttccatcccccggccaatgagatctaccgtaggaaggatttgtcggtctttgaggtagacggcaatatgtcaaaaatttactgccagaacctgtgcctgctcgctaaactatttctggatcataaaacactttattatgacgtcgaacctttcctgttctacgtgctgaccaaaaatgacgagaaaggctgccacttagtgggctacttcagcaaagaaaaactgtgccagcagaagtataacgtatcctgtatcatgattatgccacagcaccagcgccaggggttcgggcggttcctcatcgacttctcctaccttctctccagacgggagggtcaggcgggatctcccgagaagcccctgtcggatcttggacgcttatcctatctcgcctattggaaaagtgtgattctggaatacctgtaccatcaccatgagagacacatcagtataaaagccataagtagagccactggaatgtgtcctcacgatattgctactacattacagcacttgcatatgatcgacaagcgggacggcaggtttgtcattattaggagggagaaactaattctgagtcatatggaaaaattgaagacctgcagtcgtgctaatgagctggaccctgattcactccggtggacaccaattcttatctcaaacgccgccgtcagcgaagaggaacgcgaggctgaaaaagaagcagaacgccttatggaacaggcgtcatgttgggagaaagaagaacaggagattttaagtacacgtgcgaactcaagacaatctccagcaaaggtgcaaagtaagaacaagtacctccattccccggagtcccgcccagtcacaggagagaggggacagctcctggaactgtccaaggaaagttctgaagaggaagaggaggaggaggacgaggaggaggaagaggaggaggaggaagaagaagaggacgaggaagaggaggaggaagaggaggaagaggaggaggaggagaacattcagtcatctccgcctagacttactaagccccagagtgtcgcgattaagaggaagcgacctttcgtcttgaagaaaaagagaggacgcaaacggagaaggattaattcatctgttactactgagaccatctcagaaaccactgaggtgcttaacgaaccatttgataatagcgatgaggaaagaccaatgccccaattagagccgacttgtgagatcgaagtggaagaggatggaaggaagccggtgcttcgtaaggcctttcaacaccagcccgggaaaaaaaggcagacggaggaggaagaaggtaaagacaaccattgtttcaagaatgctgatccatgtcgcaacaacatgaacgacgactccagtaaccttaaagaaggttcaaaggataatccagagcctctgaagtgtaaacaagtttggcctaaagggacaaagcggggcctttccaagtggcgccagaacaaggagcgcaagaccggctttaaattgaatctctacacaccgccagagacacctatggaacccgatgaacaggttaccgtcgaagaacagaaggagaccagtgagggcaagacttcacctagtcctattagaattgaggaggaggtgaaagaaacgggggaggcgctattgcctcaagaggagaaccgccgtgaagaaacctgtgcaccagtttcgcctaacacctccccaggcgagaaacccgaggatgacctcatcaaacctgaggaagaagaggaggaggaagaggaggaggaagaggaggaagaggaggaagaaggtgaagaagaggaaggcggaggtaacgtggaaaaagaccctgacggtgccaaatcgcaggagaaggaggagccagagatctccacagaaaaagaggactcagctcggctggacgaccatgaggaagaggaagaggaggacgaagaaccctcccacaacgaggatcacgatgcagacgacgaggatgacagccatatggagtcagccgaggttgaaaaggaagagttaccgcgcgagtctttcaaggaggtactggaaaaccaagagaccttcctagacctgaacgtgcaacccggtcactccaacccagaggtgctgatggactgcggggtcgatctgacagcctcctgcaactccgagcccaaggagctggccggagatcccgaagccgtgcccgaatcagatgaggagccccccccaggagagcaggctcaaaagcaagatcagaagaacagtaaggaggtggacactgaattcaaggaaggaaatcctgcgacaatggagatcgacagcgaaacagtgcaggccgtgcaatctctcactcaggagagtagcgagcaggacgatacattccaagattgtgcggagacccaggaagcctgcaggtccctccaaaactatacccgtgccgaccaaagtccgcaaatcgccactaccctcgacgattgccagcagagtgatcactcttccccagtgtcctcagtccatagtcatcccggacagtctgttaggagcgttaactctccctcagtgcccgctctggaaaatagctatgcacagatttcaccagaccaaagcgcaatatcagtgccgtccctgcagaatatggagacgtctcccatgatggacgtgccctccgtctcagatcattctcagcaggttgtcgactctggcttctcagatctcggatctattgaatcaacaaccgaaaattacgaaaacccttcctcgtatgactcaactatgggaggttcaatctgtggaaacgggagctctcaaaactcatgcagttattccaatctaacatcatcatcgttgactcagtcatcttgcgctgttacccagcaaatgtcgaatatcagcggctcctgcagcatgttgcagcagacctcaatatcttcccctcccacatgttccgttaagagcccgcagggttgtgtagtggaaagacctcccagctcttcgcagcagctcgcccaatgtagcatggccgcaaattttaccccccccatgcaactggccgagatccccgagacatctaacgcaaacatcggcctgtatgagcgcatgggccagtccgacttcggggctggtcactatccgcagcctagcgcaacattttctctcgctaaattgcagcagcttacaaacaccttgattgaccactccctgccttactcgcattccgccgcagttacttcatacgctaatagcgcctctcttagtactcccttgagtaatacaggcttagttcagctgagccagtcaccacactccgtgccaggtggaccccaggcacaggcgaccatgacaccgccacctaacttgactcctccacccatgaacttaccaccaccattgctacaaaggaacatggccgcttctaacatcggaatctcccattcacagagattgcagacacagatcgccagcaagggccacataagcatgcgcacaaaatctgcatcattatcccccgccgctgccacccaccaaagccaaatttacgggcggtcccagacagttgctatgcaaggaccagctagaaccttgaccatgcaacgcgggatgaatatgagcgtaaacttgatgccagcaccggcctataacgtaaacagtgtgaatatgaatatgaatacgctcaacgctatgaacgggtacagcatgagccagcctatgatgaactccggttatcacagcaatcacggctacatgaaccaaactccgcagtaccctatgcagatgcagatggggatgatggggacccaaccatacgcacaacaaccaatgcagacaccaccccacgggaacatgatgtacactgcacccggacaccacggctacatgaacactggcatgagtaagcagtcactcaacggctcatacatgaggaggtag

SEQ ID NO: 121320 - DNA, 5346 bp, Artificial Sequence
  Description of Artificial Sequence: Synthetic coding sequence
atggtcaaactcgctaatcctctatacactgagtggatacttgaagccattcagaaaatcaaaaaacaaaaacaacggccttccgaggaacgcatttgccatgcagtttccaccagccacggcctggataagaaaacagtgagcgagcagctcgagctgtcggtccaagacgggagcgtgctgaaagtgaccaataaggggttggcgagctacaaggatcccgacaaccccggtagatttagcagcgtgaagccggggacatttcctaaaagcgcgaagggaagccgtggttcttgcaacgatctccggaacgtagactggaacaaactcctgcgccgagcaattgagggacttgaagagcccaatggatcctctttaaagaatattgagaagtatttgagaagtcaaagcgatctgactagcactacaaacaacccagcgtttcagcagaggctgcggctcggcgctaagcgagccgttaataatggtcggttgctaaaggatggaccgcaataccgcgtgaattatggctctctagacggaaaaggcgccccacagtaccccagtgcctttccttcctccttgcctcctgtgtccctattaccacacgaaaaagaccagcccagggcggaccccatcccaatttgttccttttgcttggggactaaggagtctaaccgtgagaaaaagccagaagaactgctatcatgcgccgactgcggatcctctggacacccttcatgtcttaagttttgcccagaacttaccacgaacgtgaaggcactcagatggcagtgtatcgagtgcaaaacctgctctgcctgtcgagtgcaggggcgaaatgccgacaatatgctcttctgcgacagttgtgatagaggattccatatggagtgttgtgacccaccccttagtcgcatgccaaaaggaatgtggatctgtcaggtgtgcagacccaagaagaagggcaggaaactgctacatgagaaagctgcccaaataaagagaagatacgccaagccaattggcaggcccaagaacaagctgaagcagcgcttgttgtcagtaaccagcgacgaaggcagcatgaacgcatttactggacgaggcagtccagacactgaaattaagatcaacatcaagcaggaaagcgccgacgtgaatgtgatagggaacaaagatgtagttaccgaggaggacctggacgtttttaaacaagcccaggaattgtcttgggaaaaaattgaatgtgagtccggggtcgaggattgtggacgatacccatctgttatagagtttggtaaatatgaaattcaaacttggtactcgtctccttacccacaagaatacgcccggctgcccaagctgtatctttgtgaattttgcctgaaatacatgaaatccaagaacattttattaaggcactcgaaaaaatgcggctggttccatccccctgcaaatgaaatatacaggcgaaaggacctgtctgtcttcgaagttgatggtaacatgtctaaaatatattgtcaaaacctgtgcctgttagccaaactcttcctggaccataagaccctatattacgatgtcgagcccttcctgttttacgtgctgacaaagaacgacgagaaagggtgtcatctggtaggctatttctcaaaggaaaagttgtgccagcagaaatacaatgtatcctgtatcatgataatgccccagcaccagagacaggggttcggacgattcctcatcgacttttcttacctcttgtcccgccgggagggtcaggccggaagtcccgaaaagcccctgtctgacttaggccggttatcatatctagcctactggaaatctgtgattctagagtacttataccatcatcacgagcgccacatctccatcaaggcgattagcagggccactgggatgtgccctcacgatatagctacgacactgcagcatctgcatatgatcgacaagcgtgatggaaggttcgtgatcattcggcgcgaaaagctgattctcagccatatggaaaagctgaaaacgtgttcacgcgcaaacgagctggatccagacagtctgcggtggacacccattctcatttcaaacgcagcggtaagtgaggaagaaagagaagctgaaaaagaggctgagcggttgatggagcaggcatcttgctgggagaaagaggaacaggaaatactgtccacccgcgccaattctcggcagagcccggcaaaggttcagagtaaaaacaaatacctccactccccagagagtaggccggtcacgggcgagcggggacagctgctcgagctgtccaaagagagtagtgaggaagaagaagaggaagaggacgaagaggaagaagaagaggaggaagaagaagaggaggacgaagaagaggaggaggaggaggaggaagaagaagaggaggagaacatccagagctctcctccccggcttacgaaacctcaatctgtggccatcaaaagaaaaaggccttttgttctcaaaaagaagaggggcaggaaaaggagacgcataaactcctctgtgacgaccgagaccatctcagagaccactgaagttttgaatgagccattcgacaactcagacgaagagagacctatgccacagcttgagccgacctgcgaaatagaagtcgaggaggatggacgcaaaccggtgctgagaaaggcgttccaacatcagccaggcaaaaaacggcaaacggaagaagaggagggaaaggacaaccattgtttcaagaatgcagacccctgccggaataatatgaacgacgatagctcaaatctcaaagagggaagcaaagacaacccagaaccactgaaatgtaagcaggtgtggcctaagggcaccaagcgtggcttgtctaaatggagacagaataaagagcggaagacaggatttaagcttaatctctacaccccacccgagacccccatggaaccggacgaacaggtgactgtggaggagcagaaagagacttctgaaggaaagacttccccgtcccctatccgaatcgaggaagaggtcaaagagacaggagaggcacttctccctcaagaggagaatcgacgggaggaaacctgcgccccggtttctccaaatactagtcccggggagaagcccgaagatgatctgattaagcccgaagaggaggaagaggaggaggaggaagaggaggaggaggaggaggaggaggaaggtgaagaagaggagggaggaggcaatgtggagaaggatcccgacggagcgaagtcccaggagaaagaagagcccgagatctctacagaaaaggaagacagcgcgagactcgacgaccacgaggaggaagaggaggaggacgaggaacccagtcacaatgaggatcatgatgcagacgacgaggatgattctcatatggagtccgctgaagtcgaaaaggaagaactgccacgggaatctttcaaggaagtgctcgaaaatcaagagacgttcttggatctgaacgtacagccagggcactcaaaccccgaagtactgatggattgtggggtcgacttgaccgcctcttgcaactccgagcctaaggaactggcaggcgatccagaagcagtccccgagtctgacgaagaaccccctcccggggagcaggcccagaagcaggatcagaaaaattccaaagaggtggacacagaatttaaggaaggaaatcctgctaccatggaaattgacagcgagaccgtccaagctgtccagagtctcactcaggagtcgtcagaacaggacgacacattccaggactgtgcggagactcaggaggcctgtagatctttgcaaaactatacccgggccgatcagagtccccagatcgcaaccacactggacgactgccagcagtccgatcactcgagcccagtgtccagtgtccattctcaccccggacaaagtgtcagaagcgtgaactccccctctgtgcctgccctcgagaatagttacgcccagatctctccggaccagtcagctatctccgtgccttctctgcagaatatggagacatctccgatgatggatgtcccctccgtgtcagatcactcccagcaagtagtggacagtggcttctcagacctgggatctatcgagagcacaaccgaaaactatgagaatcccagtagttacgatagtaccatgggcggcagcatttgcggtaacgggtcaagtcagaatagctgttcgtacagcaacctcacttcatcatccctgacccagagcagttgtgcagtgacacagcagatgagcaatatcagtggctcatgctctatgttacagcaaactagcataagtagccccccaacgtgttctgttaagagtccacagggttgcgtagtggaacgccctcctagttctagtcagcaattggcccagtgctctatggccgcgaacttcaccccccctatgcagcttgccgaaattcccgagacctcaaacgcaaacatcgggctctatgagaggatgggacaatcagactttggagctggacactacccacagcccagtgccaccttttcactggccaagctgcagcagctgacaaatacgctcattgaccatagcctgccctatagccatagtgcagcagtgacttcttatgctaactcagcatccctgagcacacccctaagcaacaccggattagtgcagctcagtcagtctccacactcagttcctgggggtcctcaggcacaggcaactatgaccccgcctccaaatctgaccccgccccccatgaatcttccccctccgctgttgcaacgaaatatggctgcctcaaatattgggatctcccacagccagcggctccaaacacaaatcgctagtaagggccacatcagtatgagaacaaagtctgcctcactcagtccggcagcagctacacaccagtcgcagatttacggtcgatcgcagactgtggcaatgcaaggaccagccaggacacttacgatgcagcgcggaatgaacatgtccgtgaatttgatgcccgccccagcgtacaacgtcaactcagtgaacatgaatatgaacactctgaatgccatgaatggatatagcatgtctcagccaatgatgaatagtggctaccattccaaccacggctacatgaaccaaacgccacagtaccctatgcagatgcagatggggatgatgggtactcagccatatgctcaacaaccaatgcagactcccccacacggcaatatgatgtatacggcgcccggacaccacggctacatgaacactgggatgtccaagcagagtctcaacgggagctatatgcgccgttag

SEQ ID NO: 121321 - DNA, 4992 bp, Artificial Sequence
  Description of Artificial Sequence: Synthetic coding sequence
atgaccgatcgcttttgggaccaatggtacctctggtacttgcgactgctgcgattgctcgatcgcgggtccttccggaacgacgggctgaaggcgtcagacgtgctgcccatcttaaaagaaaaggtcgccttcgtgtccggggggcgcgacaagaggggagggcccatcctgacattccctgcaaggtcaaatcacgaccgaatccggcaggaggatcttaggaagctggttacatatctggcatcagttccgtccgaggacgtgtgtaagcggggcttcaccgtaatcatcgacatgaggggcagcaaatgggatctgatcaaacctcttctgaaaacccttcaagaagcctttcccgccgagattcatgtcgctctcataataaaaccagataatttttggcagaaacagaaaacaaacttcggatcatcaaagtttatctttgaaacgtccatggtctctgtcgaagggctgacgaaactggttgatccctcgcagttaactgaagagtttgatgggtccctggactacaatcatgaagagtggatcgagctccgactgagcctggaagagttctttaacagtgctgtacacctgctcagccggctggaggacttgcaggagatgctcgcgcgaaaggagtttcctgttgatgtggagggctccaggcggcttattgacgaacacacacagctgaaaaagaaggtgttaaaggctccggttgaggaactggaccgggaaggacagaggctcctgcagtgcatccggtgctcggatgggttcagcggtaggaactgcatccccggaagcgccgattttcaaagtctggtgcccaaaatcacctcccttcttgataaactccattccactaggcaacatctgcaccagatgtggcatgtgcgaaaactaaaattagatcagtgctttcagttacgcctgttcgagcaggacgcagaaaagatgttcgactggatctcacacaacaaggagctgtttctgcaatcccatacagagattggagtgtcatatcagtatgcactggacctacaaacacagcataaccattttgctatgaatagtatgaacgcatacgtgaacattaacaggatcatgtccgttgcatcccgcttatcagaagctggacattacgcaagtcaacaaatcaagcaaatttcaacccagctcgatcaggagtggaagagctttgccgcagccttggacgagcgatcaaccatactggcaatgtcggccgtgtttcaccaaaaagctgaacagtttctgtctggcgtggatgcctggtgtaaaatgtgtagcgagggggggctgcctagtgagatgcaggatcttgaactggccatccaccaccaccaaacactttacgaacaggtgacacaggcgtacactgaggtgtcccaggacgggaaagctctgcttgatgttctacagcgccctctttcccctggcaactctgagagtttgactgccaccgctaactacagtaaagctgtgcaccaggtgctggacgtcgtccatgaggtactgcaccatcaacgacgcctggaatctatctggcaacatcgtaaagtgaggctgcatcagcggctgcagctttgcgtttttcagcaggatgtgcagcaggtgctggattggattgagaaccatggtgaggcttttctgtcaaagcacaccggtgtgggaaagtctctgcatcgggctagagcactgcagaaaagacacgatgactttgaggaagtcgcacaaaacacttacaccaatgctgataagctcttggaagcggcagagcaactcgctcagacgggggaatgtgatcccgaggaaatatacaaagcagcaagacatctagaggtaagaatccaagactttgtgcggcgcgttgaacagaggaaattgctccttgatatgtctgttagcttccacacccatacgaaggagctgtggacttggatggaggaccttcagaaagagatgctcgaggacgtgtgcgccgactcggtggatgccgttcaggagctcatcaagcagttccagcagcagcagaccgctactctcgacgctacattaaatgtgataaaagaaggggaggatcttattcagcagctgcgatcggcaccccctagccttggagaaccaagcgaggcacgtgattccgctgtatccaataacaagacgccacactcaagcagcatcagtcacattgaaagtgtgctgcagcagttagacgacgctcaagtgcaaatggaggagctttttcacgaacggaaaattaagctagatatcttcctgcagctgcggatattcgagcaatataccatcgaggtcaccgcagagctggacgcatggaatgaggacctgctgagacagatgaatgactttaataccgaagacctgaccttggcagagcagaggctgcaaagacatactgagcgcaaactcgcaatgaacaatatgacgttcgaggtgatccagcaggggcaggacctgcaccagtatatcactgaggtgcaagcctctggaattgagctgatatgtgagaaggatatagacctggctgcccaagtgcaggaactcctcgagttcctgcatgaaaagcagcacgagctggagctgaacgctgagcagacgcacaagagactggagcaatgtttgcagcttagacacctccaagccgaggtgaagcaggtgctgggttggatacggaatggagaatcgatgcttaatgcttccttggtgaatgctagtagcctgagtgaagcggagcagttgcagagggaacacgaacaattccagctggctatcgagagtcttttccatgcaacgtcacttcaaaaaacacatcagtcagccctgcaagtgcaacagaaagcagaggtgttgctgcaggcgggtcattacgacgcagacgccatacgcgagtgtgctgagaaagtagctctgcactggcagcagctgatgctgaagatggaggaccgtctaaaactggtcaatgcttctgtggcattctacaaaacctcagagcaggtgtgctctgtgttagagtcgcttgagcaggagtaccggcgtgacgaggattggtgtggaggccgtgataagcttggtccagccgctgaaattgaccacgtcatccccctaatttccaagcacctggaacagaaggaggcctttctcaaagcctgcactctggccaggagaaacgccgaggtgttcctgaaatacatacatcggaacaacgtgtccatgcccagcgtggccagtcacacccggggacctgagcagcaggtgaaggccatacttagcgagctactccagcgagagaatagagtgctccacttctggaccctcaaaaagagaagactagaccagtgtcagcaatacgttgtgttcgaacgcagcgcaaagcaggctctcgattggattcaggaaactggggagttctatttgtctacacacacatctacgggcgaaacgaccgaggaaacccaggagcttcttaaagagtatggggaatttagagtgccggccaaacaaactaaggagaaagtgaaattactcatccagctcgctgactccttcgtagagaagggtcacattcacgctaccgaaatacgtaaatgggtgactaccgtggacaaacactatcgggatttcagcctgcggatgggaaagtaccgctactctctggagaaggcgctcggcgtaaacacagaagacaacaaggatctcgaactggatatcatccctgccagcttatcagaccgggaggtgaaactgcgggacgctaatcatgaggtcaatgaagaaaagagaaaaagcgcacggaagaaggagtttattatggccgaattgctacaaaccgaaaaagcctacgtgcgagatctgcatgagtgtcttgagacttatctctgggaaatgacgtcaggcgtagaagaaatcccacccggaatccttaataaggagcacatcatctttggcaatatccaggaaatctatgacttccacaacaacatatttctgaaagagctagagaagtacgaacagttgcccgaagacgtgggccattgtttcgtgacatgggccgacaagtttcagatgtatgtgacctattgtaagaataagcccgattctaatcagctcattcttgaacatgctggaaccttcttcgacgaaatacagcagcgccatggtctggcaaacagcatcagctcttatctaattaagcccgtccagaggatcacaaaatatcagctgctgctgaaggaactgctgacatgctgcgaggaagggaaaggcgagctcaaggatggcctggaggtgatgctgagcgtgcctaaaaaagcgaatgatgccatgcatgttagtatgctcgagggatttgacgaaaacctcgacgtccagggcgaactgattctccaggatgcttttcaggtttgggaccctaagagcttgatcaggaagggcagagaacgacacttatttctgttcgaaatctccctagtgtttagcaaggaaatcaaagattcctccggtcacacgaagtacgtgtacaaaaataaactcttaacatctgaactgggagttaccgagcacgtggaaggggatccatgtaagtttgcactctggtctgggcggaccccttcgtcagacaacaagaccgtgttgaaagcctctaacattgaaacgaagcaggagtggatcaagaacattagagaggtgatccaggagagaattatccatctgaagggcgcattgaaggagccattgcagctgccgaagacaccagctaaacaacgcaataactctaaacgcgatggggtcgaggatatagatagtcagggggacggctcgagccagcccgacacaatctcaatcgctagcaggactagtcagaacacggtggatagtgacaaagacggaaatctcgtgcctcgctggcaccttggcccaggagatccttttagcacctatgtttag

SEQ ID NO: 121322 - DNA, 3870 bp, Artificial Sequence
  Description of Artificial Sequence: Synthetic coding sequence
atgaagggcggtgatcgggcctatacacgggggccatccttggggtggctgttcgccaaatgctgttgttgtttcccatgtcgtgacgcctactcccacagctcctctgagaatgggggcaaatccgaaagtgtagcgaatttgcaagcccagccatccttgaacagcattcactcctctcccgggccgaagagatctaccaataccctgaagaagtggctaacttctcccgtgaggagactgaattctggcaaggcagatggaaacattaagaaacaaaaaaaggtgcgtgacgggagaaaatcattcgacctcggatctccaaaacctggtgacgaaaccactccccagggggactctgctgatgagaagtctaagaaggggtggggggaggacgagccagatgaggagtctcacacaccattaccgcctccaatgaagatctttgacaacgatcccacccaggatgagatgagctcatccctcctagccgcccgtcaggcttccaccgaggtgcccacggctgcagacctggttaatgccatcgaaaaactggtgaaaaataagctctccctggagggcagttcctaccggggctctctaaaggaccccgccggctgtctgaacgaaggcatggcgccacccacgccccctaagaatcccgaagaggagcaaaaagctaaagccctccgtggaaggatgttcgtgctcaacgagctggtccagaccgagaaagactatgtgaaggacctcggcattgttgttgaagggtttatgaaacgcatagaggagaaaggtgtgcccgaagacatgcggggcaaagataagattgtgttcggtaatattcaccagatatacgactggcataaagatttttttctcgctgagctggaaaagtgcattcaggagcaggatcgtcttgctcaactattcatcaagcacgaacggaagctccacatttacgtgtggtattgccagaacaaaccgagatcagaatatatcgttgcagaatacgacgcttatttcgaagaagtgaaacaagagattaatcagcgccttactctctcggatttcttaatcaagcctattcagcgcataaccaagtatcaattactgctcaaagatttcctcaggtactccgaaaaggcaggactcgaatgttcagatatcgaaaaagccgttgagctgatgtgtttggtccccaaaagatgtaacgacatgatgaatctaggccgtctccaggggttcgaaggaacactcactgctcaggggaagctattgcagcaggacacattctatgtaattgaattagatgcaggcatgcaatcccggaccaaagagagacgcgtgttcctttttgaacagattgtgatcttctcagaattactgcgcaagggcagtctaacaccaggctatatgtttaaacgatccattaagatgaactatctcgttctggaagagaatgtagacaatgacccctgcaagttcgccttgatgaacagggaaacctctgagagggtggttctgcaagcagctaatgcagatatacagcaggcttgggtgcaagacattaaccaggttctggagactcagcgcgattttctgaatgcgctgcaaagccctattgagtaccaaagaaaggaacggtcaacagccgttatgcgaagccaaccggcccggctgccacaagcctctcctcggccatattcaagtgtcccagccggatccgagaagccaccaaaagggagctcctataatcctcccttaccccctttgaagatatcaactagcaatggaagtcccggatttgaataccatcagcccggggataagttcgaggcctcaaagcaaaacgacctgggcggatgtaatggaaccagttcaatggccgtgatcaaggactattacgcgttgaaagaaaatgaaatctgtgtatctcagggcgaggtggtccaagttctcgcggtaaatcaacagaatatgtgcttggtgtaccaaccggcctcggaccatagcccagccgccgagggctgggtgcctggctcaattctggctccactaacaaaggcgacagcagccgagagcagtgatggcagcataaagaaatcttgcagctggcacacattgcgcatgcgcaagcgggccgaagtggagaacacaggaaaaaatgaagccacaggaccaaggaagcccaaggatatcttgggaaacaaagtttcagttaaggagaccaacagttccgaggagtccgagtgtgacgatctagacccaaacacaagcatggaaatacttaatcccaatttcatccaggaggtggcacccgaatttctggtgcctcttgtggatgtcacctgcctgttgggcgacacagtgatcttgcagtgcaaggtgtgtggtagaccaaaacccactatcacctggaagggccctgatcagaatatactcgataccgataacagctccgctacctacactgttagcagttgcgacagcggcgaaatcaccctgaagatttgtaacctcatgcctcaggacagcggaatctatacctgtatcgccacaaacgaccatgggacaacaagcacgagcgcaacggtcaaagtgcagggcgtacccgctgcaccaaatcggccaattgcacaggagagatcctgcaccagtgtaattcttcggtggctgccaccatcttccactggcaactgcacgatttcaggctacaccgtcgaatatcgggaggagggctcacaaatctggcagcagagtgtggcttcaaccctggacacatacttggtgatcgaggatctgagccctggctgcccctatcagtttcgggtatccgcctccaatccgtggggtatatctctgccttccgagccatcagaattcgtccggttacccgaatatgatgccgccgccgatggtgctacaatctcttggaaggagaactttgacagcgcttacacagaattgaacgaaataggcagggggaggttctcaattgtgaagaaatgcattcataaggccacgaggaaagatgttgccgttaaattcgtatcaaaaaagatgaaaaaaaaagagcaggcagcccatgaggccgccctccttcagcatctgcagcatccccaatatattacactgcatgacacatacgaaagcccaaccagttatatcttgattctggaactaatggatgatggccggttgctggactatctcatgaatcatgatgagcttatggaggagaaagtcgccttctacatcagagacattatggaggccctacagtacctacacaattgtcgggttgcacacctggacataaagccagaaaatctactcatcgacctgcgcattcctgtaccacgcgtcaaattaattgacctggaggatgccgtacaaatctctggccactttcatattcaccatcttctgggcaatcccgaatttgctgcgcccgaggtgatccaaggaatccctgtttcccttggtacagatatctggtctattggagtccttacctacgttatgctatctggcgtgtcacctttcctggacgaaagcaaagaggaaacatgtatcaacgtgtgcagagtggacttctctttcccacacgagtatttttgcggagtgagcaatgcagctagggattttattaacgttattttgcaagaagacttccgccgcagaccaactgcagcaacatgtctgcagcacccctggttgcagcctcataatggcagctattccaagatacctctggacacgagcagattagcatgtttcatcgagcggaggaaacaccaaaacgacgttcggccaattccgaatgtgaagtcatatatcgtaaaccgagttaatcagggtacttag

SEQ ID NO: 121323 - DNA, 8961 bp, Artificial Sequence
  Description of Artificial Sequence: Synthetic coding sequence
atgaccgaccggttctgggaccagtggtacctgtggtatcttaggttgctccggctcctcgatcgcggcagtttccggaatgacgggcttaaggcctctgatgtcttacctatcttgaaagagaaagtggcattcgtatccggagggagggataagagaggcggccccatccttacctttcctgcgcgatctaaccatgaccggatccggcaagaagatctcaggaaactggtgacctacctagcctcagtgccgtccgaagacgtgtgcaagcggggcttcaccgtgatcattgacatgagggggtccaagtgggatctcatcaaaccactcttaaagacgctgcaggaggctttccctgcagagatccacgttgccctcattattaagcccgataacttctggcagaaacaaaaaaccaatttcgggagctccaagtttatattcgagacttctatggtgagtgtggagggccttactaaattagtggacccatcacaactgactgaggagttcgatgggtccttagattataaccatgaggagtggatcgaactgcgcctctctttagaggagttctttaatagcgctgtacatctgctgagtcggttggaagatctccaggaaatgttggcccgcaaggagtttcccgtggacgtcgaggggagtcggaggttgatcgatgaacatacacaactaaagaaaaaggtattgaaggcgccggtggaagagctggatcgagagggtcagcgcctgctccagtgtatcaggtgctccgacggtttctctggacgcaattgtatcccaggctctgccgacttccagagcctagtccccaagataacatcattgctggataagctgcactccacccggcagcatctccaccagatgtggcacgtacgcaagctgaaactggaccagtgcttccagctgcggctgtttgagcaggacgctgaaaagatgtttgactggataagccacaataaggagctcttcctgcaatcacataccgagatcggggtgtcctaccagtatgctcttgacctacagacacaacacaatcactttgcgatgaattccatgaacgcgtatgtgaacataaaccgaattatgtctgtagcctcccgccttagtgaagcgggccactatgcgagtcaacagataaagcaaatctccacccaactcgatcaggaatggaagagctttgccgctgccttagacgagaggagcacaatcttggcgatgagcgctgttttccaccagaaagcagaacaatttctctcaggtgtagatgcttggtgtaagatgtgttctgagggcggtctcccctccgaaatgcaggatctcgagttggctattcatcaccatcaaaccctctacgagcaagtcacccaggcctatacggaagtctcacaggacggcaaggccttgttagacgtcctccagcgccctttaagcccaggaaatagcgaatctctcacagctacagccaattactcaaaagcagtccaccaggtgctcgatgtggtgcacgaggtcctgcatcaccagaggcgcctcgaaagtatctggcagcaccggaaggtgagattacatcagagacttcaattgtgcgtcttccagcaggatgtgcaacaggtcttagactggatcgaaaatcacggcgaggcattcctttcaaaacacaccggcgttggcaagagtctgcaccgcgcgcgcgctctacagaaaagacacgacgattttgaagaggtggcccaaaacacctataccaacgcagacaaactgttggaagcagcagaacaactggcccagacaggggagtgcgatcctgaagaaatttacaaggccgcccgtcacctcgaagtgcggattcaggacttcgtgaggagggtggaacagcgcaaattgctcctcgacatgtccgtgagctttcatacacacaccaaagagctgtggacctggatggaagatctgcaaaaggagatgttggaggatgtctgcgccgatagcgtggacgcagtccaagagctcataaaacagttccaacagcaacagacggctactctcgacgcaacactgaacgtcatcaaagagggcgaggaccttatccagcaactccgctcggcaccacctagcctgggcgagcccagcgaagctagggattccgccgttagcaataacaaaactcctcattcctcttcaatcagccacatagagtccgtccttcagcagttggatgacgctcaggtccagatggaagagttgtttcatgagcgcaaaatcaaattggatatatttctgcaactgcgaatcttcgaacagtatacaatagaggtgaccgccgagttggatgcttggaacgaagatcttctgagacagatgaatgattttaataccgaggacctcacgttagccgaacaacggctccaaagacacactgaacggaaactggctatgaataacatgacttttgaagttatacagcaggggcaagacttacaccaatacatcacagaagtgcaggcatccgggattgaactgatttgcgaaaaagatatcgatctggctgcacaggttcaggagctgctggaattcctgcatgaaaagcagcacgagctggagctgaacgccgaacagacacacaagagattggaacagtgcttgcagctgcgccacttacaggccgaggtcaagcaggttctcggctggattcgtaacggggagtcgatgctcaatgcatcgctggtaaacgcctcctcattgtcagaagcagaacaattgcagcgtgaacacgagcagttccagttggccattgaaagcttgttccatgccacgtcgctccagaagacccaccagtcagctctgcaggtgcagcagaaagcggaagtcctgctccaagctggccattacgatgctgatgccattagagaatgtgctgagaaagtagcactccattggcagcagctaatgcttaaaatggaggacaggctcaagctggttaatgcatccgttgcattttataagacctccgagcaggtttgctctgtcctggagtccctggagcaagaatataggcgtgacgaggattggtgcggcggcagggataagcttggccctgcagccgagatcgatcatgtgattccactgattagcaagcacctcgaacagaaggaggcgttcctgaaagcttgcaccttggcgcggagaaatgctgaagttttcctgaaatatatccatcgcaataatgtgagtatgccctccgtcgccagtcacacccgtgggcccgaacagcaggtcaaagctatactgtcagagctgctgcagcgcgagaacagagtgctccacttttggactctgaaaaaaaggagactggaccagtgtcaacagtacgtagtgtttgagcgctccgccaagcaggccttggattggattcaggaaacaggagagttttatctgtcaacccatacttccacaggcgagaccacggaagaaacacaagagctgctgaaggagtatggcgaattcagggtgcctgccaaacagacaaaagagaaagtaaagcttctcatccaactcgccgatagcttcgtcgagaagggccacattcacgctactgagatcaggaaatgggtaacaacagtggacaaacactaccgggatttttctcttagaatgggcaagtatagatattccctggagaaagcactgggtgtaaatactgaagacaataaggatcttgagttggatataattcccgctagtctcagtgacagggaggtgaaactgagagacgccaaccacgaggtcaatgaggagaaacggaagagcgccagaaaaaaagagttcattatggccgagctgcttcaaactgagaaggcttacgtgagggacttacacgagtgcctggagacatatttgtgggagatgaccagtggagttgaggaaattcctcctggcatcctcaacaaagagcacatcatatttggaaacattcaggagatatacgattttcataacaacatcttcctgaaggagctggaaaagtacgagcagttaccggaagacgtcggccactgtttcgtcacttgggcggataagtttcagatgtatgtcacatactgtaaaaataagccagattcgaatcagctaattctcgaacatgcgggcactttcttcgatgagattcagcagcgccatggattggccaattcaatctccagttacctgataaaaccggtgcaacgaatcactaagtatcaacttcttctgaaggaactgttgacatgttgtgaagaaggtaagggggagctgaaagacgggctggaggtcatgctcagtgtacctaaaaaagcgaatgacgccatgcacgttagtatgctggaaggatttgatgagaatctcgatgtccagggggaactgattttgcaggacgcatttcaagtatgggatcccaaaagcctgatcagaaagggccgggagaggcacctttttctgttcgagatctctctggtgttcagtaaggaaattaaggactcctccggccacacaaagtacgtgtacaaaaataagctcctcacgagtgagctcggagtgacagagcatgttgaaggagacccatgtaagttcgcactttggagcggtagaacccctagctccgacaataaaactgtcctgaaggcctctaatatcgaaaccaaacaggagtggatcaaaaatatccgcgaggtcatccaggagaggataatccacctgaagggtgccctgaaggagccgctgcaactccctaaaactcctgccaagcaacggaataactctaaacgggacggggtcgaggacatagatagtcagggtgatggatccagtcagccagatacaattagcatagcttccaggacatctcaaaacacagtggacagtgataagctgtcagggggctgcgagttgaccgtcgtcctgcaggatttctccgctggacacagcagcgagctcaccatccaggtaggccaaaccgtggagctactggagagacccagcgagcgccccggctggtgcttagttagaacaactgagagaagtcctcctcttgaaggactcgttcccagttctgcattgtgcataagccactcccgaagttccgtggagatggattgcttttttcccctcgtaaaagacgcctactctcatagcagttctgaaaacggcggaaaatctgagtctgtcgccaacctccaggcacagccttcgctgaatagcattcactcatccccaggcccaaagagaagtacaaacacactcaaaaaatggctaacaagtcctgtgcggagacttaactccggtaaggctgacggtaacatcaagaagcagaagaaagttcgggacggccgcaagagctttgatctgggcagtccaaagcccggagacgagaccaccccccagggggatagcgcagacgagaagagtaaaaagggatggggggaagatgagcccgatgaggaaagtcatacccccctcccaccccctatgaagatttttgacaacgatcccacccaggatgaaatgagttccagtctgctagctgctagacaggccagtactgaggtccccacagccgctgatctcgtcaatgctatcgagaaactggtaaagaacaagctgagtctggagggctcaagctatagggggagcctgaaagaccccgcaggctgtcttaacgagggaatggccccgccaacaccgcctaagaatccagaggaggagcagaaagccaaggctttgcgagggagaatgttcgttctgaacgagctggtccagacggaaaaagattacgtgaaggatctcgggattgtagtggagggttttatgaaaagaattgaagagaaaggagttcctgaagatatgaggggaaaagacaaaatcgtgttcggtaatattcatcagatctacgactggcataaagatttcttcctcgctgaactggagaagtgcatacaggagcaggaccgcctagcacagctttttattaaacacgaacgcaaactgcacatctacgtttggtactgtcagaataaaccccgttccgagtacattgtcgcagagtacgatgcgtacttcgaagaagttaaacaggagatcaatcagaggctcacactgagtgacttcctcattaagcctatccagaggatcacgaagtaccagctgctgctgaaagactttctccgctactcagagaaggccggcctcgaatgtagcgacattgaaaaggccgtcgagttaatgtgcctggtgccaaagcgctgcaatgatatgatgaatctggggagattgcaaggtttcgagggcactctcacagctcagggcaagctgctgcagcaggatacattttacgtgatcgagcttgacgcaggtatgcaaagccggactaaagagcggcgcgtgtttttatttgagcagatcgtcatctttagcgagctgctccggaaggggtctctgactccaggctacatgttcaagagatctatcaagatgaattatctggtgctagaagaaaacgtggataacgacccatgtaagttcgctctgatgaatcgcgagacgagtgagcgtgttgtcctgcaggcagctaatgcggatatccaacaggcctgggtgcaggacataaaccaggtcttggaaacgcaacgtgacttcctgaacgcccttcagtccccaatcgagtatcagcgaaaggagcggtccaccgccgtaatgaggtcccagcctgcccgtctaccacaggcttcacctcgaccatattcctcagtgcccgccggttcggaaaaacctcccaagggcagctcgtacaacccacccctgccaccactgaagatctctactagcaatggaagccctgggtttgagtatcaccagccaggagacaaatttgaagcttccaagcagaatgatctgggtggttgtaacggcacaagttcgatggccgttatcaaagactattatgctttgaaggaaaatgagatttgcgttagtcaaggggaggtggtccaggtgctggcagttaaccagcagaatatgtgtctggtttaccaaccggcaagcgatcactcccccgccgcggagggctgggtcccaggatccatcttggcccccttgactaaggccacagcagctgagagttccgatggttcaatcaaaaaaagttgttcgtggcacacccttagaatgcgtaaaagggccgaggtggagaacacaggcaagaatgaagccacaggcccccgcaagcctaaagacattttggggaacaaagtaagtgtgaaggagactaactcatccgaggaatcagagtgcgatgatctagatcctaacactagcatggaaatccttaatcccaattttatacaagaagtagcccccgaatttctcgtgcccctagttgacgtgacctgtctgctgggagatactgtgattcttcaatgcaaagtgtgcgggcggcctaagcccacaatcacctggaaaggcccagatcagaatatcctggacactgacaatagttctgccacatatactgtgtcaagttgtgattccggagagattacactcaagatttgcaatctcatgccacaggactctgggatttacacttgtatcgctactaacgaccacggcactacctcgacatccgctactgtcaaggtccagggagttcccgccgcccccaatagacccatcgcccaggagaggtcttgtaccagcgtgatcctcagatggcttcctccgtctagcacaggtaattgcaccatcagcgggtatacggttgagtaccgggaagagggctcccagatctggcaacagtcggtggcttcaactttggacacctatttggtgatcgaagatctttcaccgggttgcccataccagttccgcgtttcagcctcaaacccctggggaatctcactcccatcagagcctagcgagttcgtgaggctgcccgagtatgatgctgcagcagacggagctactatctcatggaaagagaattttgacagtgcttacaccgagctgaacgaaattgggcgcgggcgcttcagtattgttaagaaatgcatacataaagctacgagaaaggatgtagcagtgaaattcgtgtccaaaaagatgaagaaaaaagagcaggccgcccacgaagcagcactgttgcagcatttgcagcatccccaatacatcaccctgcacgacacttacgaatccccgacctcatacattctcatactggaacttatggatgatgggagactccttgactatcttatgaaccacgatgagctgatggaagagaaggtggccttttatatacgcgacatcatggaggcgctgcaatatctccacaactgcagagtcgcccacctcgacattaagcctgagaatctgctgatagacctccgcatccctgtgccacgggtcaaacttatcgatctcgaggacgccgtgcaaatcagtggtcattttcacatacaccacttgcttgggaatcccgagtttgcagcccccgaagtgatccaggggattccagtgtccctgggcaccgatatatggtcaatcggcgtgttgacatacgtgatgctctcaggcgtgtcacccttcttggatgagagtaaagaagagacatgcataaacgtttgtagggtggactttagtttccctcacgaatatttttgcggtgtgtcaaacgctgcccgggactttatcaacgtgattctgcaggaggactttagaaggaggcctaccgctgctacctgcctgcaacacccttggctgcagccgcacaatggatcctacagcaagatccccctggatactagccgcctggcctgtttcatcgagcgacgaaaacaccagaacgacgttcgtccaatccccaatgtaaagagttatattgtgaaccgggtaaaccaagggacctag

SEQ ID NO: 121324 - DNA, 3774 bp, Artificial Sequence
  Description of Artificial Sequence: Synthetic coding sequence
atgaagggtggagatcgtgcttacaccagaggaccttcccttggttggttgttcgctaagtgttgttgctgtttcccctgtcgcgatgcctactcacacagcagttctgagaacggggggaagtccgagagcgtggccaacttacaggcccagccttcactgaatagcatccatagctctcctggacctaaaaggtccactaatactctcaaaaaatggctaaccagccctgttaggagactaaactcaggaaaggcagacggtaacattaagaaacagaagaaggtccgtgacggccggaaaagcttcgacctgggctccccaaaaccaggggacgagacaaccccacaaggggactcagcggatgagaaatccaaaaagggctggggagaagacgagccggacgaggaaagccacacacctctgccacctcctatgaagattttcgacaacgatcctacacaagatgaaatgtccctggagggatcctcctatagggggagcctcaaagacccagctggatgtctgaatgagggcatggcacctcctactccacccaagaatcctgaagaggaacaaaaagcaaaggccttaagggggcgcatgttcgtattgaacgaattggtacaaaccgagaaagattatgttaaagatctgggcatcgtcgtggagggctttatgaaacgcatcgaggaaaagggggtgcctgaggatatgcgcggaaaagacaaaatagtcttcggtaacattcaccagatctatgattggcataaggatttttttttagctgaactggaaaagtgcatccaggagcaagaccgtcttgcccagttattcattaagcatgagaggaaactccatatatacgtttggtactgtcaaaataaaccccggagcgaatacatagtggctgagtatgatgcatattttgaggaagtgaaacaggaaatcaatcagagacttaccctgtctgatttcctgatcaagccgatccagagaattactaaatatcagttgctcctgaaagattttctgagatacagcgagaaggccgggcttgaatgttcagacatcgagaaggcggtcgagctaatgtgcctcgtgccaaaaagatgtaatgacatgatgaatctcggaaggctgcagggattcgagggtaccctcaccgcacaagggaagttgctgcagcaggatacgttctacgtgatagaattggatgcaggcatgcaatctcgcacaaaagaaaggcgggttttccttttcgagcagattgttatttttagcgagctgctaaggaaggggtcattgaccccgggatacatgttcaagaggtccataaaaatgaattacttagtgttggaagagaatgtcgataatgatccgtgcaagtttgctctgatgaaccgcgaaacatcggaacgggtcgttttacaagctgcaaacgccgatatccagcaagcctgggtgcaggatataaatcaggtgctggagacacagagggattttctcaatgccctacaaagccctatagaataccagcggaaggaacggtcaacagccgtgatgagaagccagcctgcacgactacctcaggcctctccacggccctacagctctgtccccgcaggttctgaaaagcctccgaaagggtcctcctacaatcctcccctgccccccctgaagatcagcacctccaacggaagccccgggtttgagtatcaccagcctggcgataagttcgaggcctcaaaacagaacgatctgggcgggtgcaatggaacatcctctatggcagtaataaaggactattatgctttgaaggaaaatgaaatatgtgtctcccagggtgaagtggtgcaagttctggccgtgaaccaacagaatatgtgccttgtgtaccagcctgcctctgatcattccccagcagcggaagggtgggtccccgggtccatattagcgcctttaacgaaagcaactgcagccgaatcgtctgacggttctatcaagaaaagctgtagttggcataccctcaggatgaggaagcgggccgaggttgagaacaccgggaagaatgaggccaccggaccgcggaagcctaaggatatcctgggcaataaagtcagtgtgaaagagactaactcatctgaagagtcagaatgcgacgatttggatcctaacacgagcatggagattctgaacccaaactttatccaggaagtggctcctgaatttttggtgccactagtggacgtgacctgtttgttaggtgacacagtgattcttcagtgtaaagtgtgcggcaggccaaaacctacaattacttggaagggtccggatcagaacatcctggacaccgacaactcgagcgccacctacaccgtgtccagttgtgatagcggtgaaattacactgaaaatctgcaatcttatgccgcaggacagtggtatttatacttgcatagctaccaacgaccatggcacaaccagtacctcggccactgtgaaggtgcagggggtgccggctgcgccaaaccgccccatcgcccaagaacgttcatgtacttccgtcatcctccgctggctgccgcctagctctaccggaaactgtaccatctccggctacactgtcgagtacagggaggagggctcacaaatatggcagcagtctgtggcctcaactttagatacctatctcgtgatcgaagatttaagtcctggttgtccttaccagtttagggtgtccgcctcaaatccttgggggatctcactcccttctgaacctagtgagtttgtgagactgcccgaatacgacgcagccgctgatggggcgaccatttcctggaaggagaacttcgatagtgcctacaccgaacttaacgagatcggccgcggccgcttcagcattgtgaaaaagtgcattcataaggcaacccggaaagacgtggctgtgaaattcgtttctaagaagatgaaaaaaaaggagcaggcggcgcacgaagcagctctactgcagcatctacagcatccccagtacatcaccctccacgacacctacgagagcccaacttcttatattctgattttagagttgatggatgacggacggctgctggattaccttatgaatcacgatgaactcatggaggaaaaagtcgcgttctacatccgggacataatggaggcactccagtacctgcacaactgccgcgtcgcccatctggacatcaaaccagaaaatctgcttatagatctcagaatacctgtgcctcgagtgaaactgatcgatttggaagatgctgtgcaaatatccggccatttccacattcaccaccttctgggcaacccagagttcgcagcacccgaggtaattcaaggtattcctgtgagcctaggcacagacatttggagtattggggtgctgacgtatgtgatgcttagtggggtgagtccttttctggacgagtccaaggaagaaacttgtattaacgtgtgtagggttgatttcagctttccccatgagtatttttgcggtgtgagcaatgctgcccgggactttattaatgtgatcctgcaggaagatttccgccggaggcccactgcagcaacttgtctacaacatccatggttacagcctcacaacgggagctactctaagatacctctagatacatccaggctggcctgctttattgagcggaggaaacaccagaacgatgtacggccaatccccaacgtgaaaagttacattgtaaatcgggtcaatcaaggcacctag

SEQ ID NO: 121325 - DNA, 4965 bp, Artificial Sequence
  Description of Artificial Sequence: Synthetic coding sequence
atgaccgaccgtttttgggaccagtggtatctctggtacctgcgcttactgcgactgctggatcgcgggagttttaggaacgacggcctgaaggccagtgacgtgctgccaattctcaaggagaaggtggcctttgtctcaggcgggcgggacaaacggggtggacctattcttacgtttcctgcccgaagcaaccacgataggatcagacaggaagatctcagaaagctggtgacttacctggctagtgtcccatccgaggacgtgtgtaaacgggggttcacagtgattatcgacatgcgcggctctaagtgggatctcataaaacctcttcttaaaacacttcaggaagcgtttcccgccgagattcatgttgcactgattatcaaaccagacaatttttggcaaaagcaaaaaacaaatttcggtagttccaaattcatcttcgaaacgtctatggtgtcagtggaaggattgaccaaactggtggatccttcccaactcaccgaagagtttgacgggagcctggattataaccacgaagagtggatcgaactgcggcttagcctggaagagttctttaacagcgcagttcacctgctctctaggcttgaagatctacaagagatgctggcaagaaaggaattcccagttgacgtagagggctctcggaggctgattgacgagcacacacagctcaaaaagaaggttttgaaggctcctgtggaagaattagatagagaaggccaacggcttctacaatgcatacgctgcagcgatggattcagcggtcgaaactgtatacctggatccgctgatttccagtctctggtgcccaaaattacctccttactggataaactgcattctacccgccaacacctccatcagatgtggcacgtccgaaagctgaagctggaccagtgttttcagctgcgactgttcgagcaggatgccgagaaaatgtttgattggattagccacaataaggagttgttcctgcagtcacacactgagattggggttagctatcagtacgccctcgacctgcagacccagcataatcatttcgccatgaactcaatgaacgcttatgttaatattaaccgcattatgagcgtggcctctcggttgagcgaggccggccactacgcatcccaacaaatcaagcaaatcagcacccagctggaccaagagtggaagagttttgccgcggccctagatgagcgctcaactattcttgccatgtccgcagtttttcatcagaaagctgaacagttcctgagcggcgtggacgcctggtgcaaaatgtgctctgagggcggcctccccagcgaaatgcaggaccttgaactggctatccaccaccaccagaccctctatgagcaggttacccaggcttataccgaggtgtctcaagacggcaaagcgctgttggacgtcctacagcggccactgtccccgggtaattcagaaagcctgaccgccactgccaactacagtaaagcagtgcatcaagtcctggacgtagtacacgaagtgctgcaccatcagagacggctagagagtatctggcagcacaggaaggtacgactgcaccagcggctccagctgtgtgttttccagcaggatgttcagcaggttctggattggattgagaaccatggagaagcatttctcagtaagcataccggggtcggaaaatcattgcatagagccagggccctccaaaaaagacatgatgattttgaggaggtagcacagaatacgtatacaaacgctgataagctcctagaagcggcagaacagctcgctcagacgggcgagtgtgatccagaagagatctataaggccgctcggcatctcgaagtgcgcatccaagacttcgtacgaagggtggagcagaggaaattattactggatatgagcgtttcatttcatacgcacacgaaagagctctggacctggatggaggatctgcaaaaggagatgctcgaggacgtctgtgcggatagcgtcgatgcagtgcaggaacttattaaacagttccagcaacagcagaccgccacactggacgccactcttaatgtcattaaggaaggcgaggatctcatccagcaattacgctccgctcctccatcactgggagaaccctcggaggctcgggacagcgctgtctccaacaacaagacgccccatagctcaagtatttcccatatagaatccgttttgcagcaattggacgatgcccaggtccaaatggaagagctcttccacgaaagaaagatcaaactggatatcttcctgcagctgcgcatttttgagcagtacacgattgaggtaactgcagagcttgatgcttggaatgaagacctgcttcgacagatgaatgacttcaacactgaggatctaactcttgccgagcagaggctgcagagacacaccgagcgcaagcttgccatgaacaacatgacatttgaggtgatccagcaggggcaggacctccatcagtatatcaccgaagtgcaggcttcgggtatagaacttatttgtgaaaaagacattgatttggcggctcaggtgcaggagctcctggagttccttcatgaaaagcagcacgagctagaactgaatgcagagcaaactcacaagcgtctggagcagtgcctccagctgcggcatcttcaagctgaagtcaaacaagtcctgggttggattcgcaatggggaatcaatgctcaatgccagcctggtgaatgcctctagtctgagtgaagctgagcagctgcagcgggaacacgaacagtttcagcttgctatcgagaagactcatcagtctgctctccaagtccagcagaaggcagaagtgctgctgcaggcgggccattacgacgctgatgcaattcgggagtgcgccgagaaagttgctttacactggcaacagctcatgctgaaaatggaggataggctcaaactggtaaatgcttctgttgcattttataagacttctgagcaggtgtgtagtgtgttggaatcactggaacaggagtatagacgtgacgaagactggtgcggcggccgcgacaagctggggcctgctgcggagattgatcacgtcataccactaataagcaaacaccttgaacaaaaggaagccttcctgaaagcctgtacactggcaaggcgtaacgcagaggtctttctgaaatacatccacaggaacaatgtgtccatgccaagcgtggcatcccacacacgcggaccggaacaacaggtaaaagccatcctgagtgagctgctccaaagagaaaatagggtactgcacttttggacgctgaaaaaacgaaggttagatcagtgccagcaatacgtggtgtttgagcgctccgccaaacaggctctcgactggattcaggaaactggggagttttacctcagcacacacacttctaccggagagactacagaagaaactcaagagctcctcaaggagtacggagagtttcgcgtgcctgccaagcagactaaagaaaaagttaagttgctgatccagctggcagattcatttgtcgagaagggtcatatccatgctacagaaatcaggaaatgggtgacgaccgttgataagcattacagagatttttctctcagaatgggaaaatacagatactcattggagaaagctcttggagtgaacactgaagacaacaaggacttggagctggatatcattcccgcctccctgtctgaccgtgaggtaaagcttagggatgctaatcatgaagtcaatgaagagaaacggaagagcgcaagaaagaaagagtttatcatggctgagctgctgcagactgagaaagcctacgttcgagatttacatgaatgccttgagacttatctttgggagatgaccagcggcgtcgaggagatacccccggggatcctcaataaagagcatattatctttggaaacatccaggaaatatatgatttccacaacaatatcttcctgaaggaactggaaaagtatgagcagctgcccgaggacgtgggacattgttttgtgacatgggccgacaagtttcagatgtacgtcacatactgcaagaacaagccggattcaaaccaattaatccttgagcatgcaggcacattttttgatgaaatccagcagcggcatgggctggctaacagcatcagctcctatctcataaagccagttcagagaataaccaaatatcaactcctgttgaaagaacttctgacatgttgtgaagagggtaagggcgagctgaaagacgggctggaggtgatgctcagcgttccgaagaaagccaatgatgctatgcacgtgtccatgttagaggggtttgacgagaatctggatgtgcagggggaactcatcctccaggacgcatttcaagtatgggatccgaaaagcctcattcggaagggccgggagcggcacctgttcctcttcgaaatctcacttgtgttttccaaggagataaaggactcctccgggcataccaagtacgtgtataaaaacaaattactaacttccgaactcggagtgacggaacacgtcgaaggggacccgtgtaaatttgctctctggagcggaaggactccttcgtcggacaataaaacagtattgaaagccagtaacatcgaaactaaacaggaatggattaagaacatcagagaggtgatacaggaaagaattattcacttgaaaggggcgttgaaagagcccctgcaactgcctaaaaccccagccaagcagaggaataattctaaacgcgacggagtagaggatattgattcccagggtgatggttcatcccagccagataccatttccatcgcgtcgcggacaagccagaataccgtcgatagcgacaaagacggaaacctggtacccaggtggcatctggggcccggcgacccgttctcaacttacgtttag

SEQ ID NO: 121326 - DNA, 789 bp, Artificial Sequence
  Description of Artificial Sequence: Synthetic coding sequence
atgtggtttctcgtgctctgtctcgccctgagtctggggggcacaggagcagccccccctattcagtccagaatagtaggtggatgggaatgcgagcagcactcacagccatggcaggcagctctgtatcacttctccacctttcaatgcgggggaattttagtacaccgccaatgggttctcactgccgctcactgtatcagtgataactaccaattgtggctcggccgtcacaatctttttgatgatgaaaatactgcgcagttcgtccacgtatctgaatcttttccccacccaggctttaacatgagcctgttagagaatcatacccggcaggccgatgaagactatagccatgatcttatgctgctgaggctcacagagccggccgatacaatcaccgatgccgtcaaggtggtggagctgcccaccgaggagccggaagtgggcagcacctgcttggcctccggttggggatccattgagcccgagaattttagttttcctgacgatctacagtgcgtggatttgaaaattttaccgaacgatgagtgcaaaaaagcccatgttcagaaagttactgacttcatgctctgcgtgggccacctggaaggaggtaaagatacctgtgtaggggatagcggcggtcctctgatgtgcgatggcgtcctccaaggggtaacatcttggggttacgtgccctgcggaaccccaaataagccctctgttgccgtgcgggtcttgtcctacgtaaaatggattgaagatacaattgccgagaacagttag

SEQ ID NO: 121327 - DNA, 483 bp, Artificial Sequence
  Description of Artificial Sequence: Synthetic coding sequence
atgagcctccttgaaaaccatacaaggcaggctgatgaggactattcccacgacctcatgctgcttaggctgaccgagcctgccgacaccatcaccgacgccgtgaaggtcgtggagcttcccacagaggaacccgaggtgggctccacctgcttggcatcggggtggggctctatcgagcctgaaaacttttcgttccccgacgatcttcagtgcgtggacctcaaaattctgccgaatgatgagtgtaaaaaagcccatgtgcagaaggtgactgattttatgctgtgtgtgggtcatctggagggcggaaaggacacctgtgtgggggactctgggggccccctgatgtgtgatggggtcctgcaaggtgtgacaagttggggatacgtcccctgcggaactcctaataagccctccgtggccgtgcgggtgctgagctacgtgaaatggatagaggatacaattgctgaaaactcctag

SEQ ID NO: 121328 - DNA, 1917 bp, Artificial Sequence
  Description of Artificial Sequence: Synthetic coding sequence
atgattctgtttaaacaagccacttactttatatcattgttcgctactgtctcctgcgggtgcctgacgcaattgtacgagaacgcctttttcagggggggggatgtggcgtctatgtatacgcctaatgcccagtactgtcagatgagatgcacgtttcaccctaggtgtctccttttttctttcttacctgcttcaagtatcaacgacatggagaagcgcttcggatgttttcttaaggatagcgtaacagggacccttccaaaggtgcatcgaaccggtgccgtgtcaggccattccctcaagcaatgcggccaccaaatttcagcctgtcacagggatatatataagggagtcgacatgcgcggcgtgaattttaacgtgtctaaggtgagctctgttgaagaatgccagaaacgctgcacctccaacatcagatgccagttttttagctacgccacacagacattccacaaggcagaataccggaataattgtctcttgaaatattcaccaggggggactcccactgccattaaggtcttgagtaacgtcgagtcagggttttcccttaaaccatgtgccctgtctgagataggatgtcatatgaacatctttcagcaccttgccttctcagacgtcgatgttgccagagtgcttacacccgatgccttcgtgtgccgcacaatttgtacttaccaccctaattgtctgttcttcacattctataccaatgtctggaaaatagagtcccagagaaatgtgtgcctgctaaaaacaagtgagtctggcacaccatcttccagtacccctcaagagaatacgataagtggctactcactcttaacttgtaagcggactctgccagagccctgccacagtaaaatctaccccggagtggacttcggtggggaggaacttaatgtcacattcgtcaagggagtcaacgtgtgtcaggaaacctgcacaaagatgattcggtgccaatttttcacctattccctgttacctgaagactgtaaggaggaaaagtgtaagtgttttttgcgcctctctatggacggctcacccacccgtattgcctacgggacgcaagggagctcagggtactctctgcgcctgtgcaacacaggggataatagcgtgtgtacaactaaaacttctactcggatcgtcggcggcacgaactcttcatggggcgagtggccatggcaggtttccctgcaggtgaagttgacggctcagagacatttgtgcggaggatctttgattggacatcagtgggtgctcactgctgcgcattgttttgatggattgccccttcaggatgtgtggcgaatttactcaggcatactgaacctctccgatattacgaaagatactccgttttcacagattaaggagattatcatccaccaaaattacaaagtgtccgagggcaaccacgacattgctctaattaagctgcaggccccgctgaactacacagaatttcagaaacccatctgcctcccaagcaagggtgacacctctactatttataccaattgttgggtgacaggctggggcttttccaaagagaagggggagatacagaatatcctgcaaaaagttaacatcccactcgttactaacgaggagtgccagaaaaggtatcaggactacaagattacccagaggatggtctgcgcgggctataaagagggtgggaaagacgcgtgtaaaggtgattccggcggtccactggtctgcaaacacaacggcatgtggcggctggtcggaatcaccagttggggcgagggctgcgccagaagggagcagcctggcgtgtacaccaaagtggcagaatacatggactggatcttggagaagacccagtcctcagatggaaaagcccagatgcagtccccggcctag

SEQ ID NO: 121329 - DNA, 1545 bp, Artificial Sequence
  Description of Artificial Sequence: Synthetic coding sequence
atgtacacccccaatgcccagtattgccagatgcgctgtacgtttcatcctcgctgtcttttgtttagctttctgccagccagtagtatcaatgacatggaaaaacgattcggatgttttctgaaggatagcgtaaccgggaccttgcccaaagtgcacagaactggcgccgtgtccggccattctcttaagcagtgtggacatcagattagtgcctgccatcgcgatatctataagggcgtagacatgagaggtgtgaacttcaacgtgtccaaagtttctagcgtcgaagaatgtcagaagcggtgtacgtcaaacatccgctgccagtttttctcttacgcaactcagaccttccacaaggcagagtatcgcaataactgcctgctgaagtattctcccggtggcactccaaccgcaatcaaggttctgagcaatgttgaatcagggttcagcctgaagccttgcgctcttagcgagatcgggtgtcacatgaacattttccagcacctggctttctccgacgtcgacgtcgccagagtgttaacacccgacgctttcgtctgccgcaccatttgcacttaccaccccaattgcctgtttttcaccttctacactaacgtctggaaaattgagtcccagaggaacgtgtgcctgctgaagacgtccgaaagcgggacaccttcctcctccaccccgcaggagaacaccatttctggttattcattactgacgtgcaagcgcactttgccagaaccctgccacagtaaaatctacccaggggtagactttggaggagaagaattaaatgtaaccttcgtgaagggggtcaatgtatgccaagaaacatgcactaagatgattcggtgtcagttctttacttactctcttttacccgaggactgcaaggaggaaaaatgtaagtgtttcctccggctttctatggacggttctcctacgcgcatcgcttatggcacccagggctcgagtggctatagtttgaggctctgtaacactggtgacaactccgtctgcaccacaaaaacgtccactaggatcgtcggggggacaaacagcagctggggagagtggccctggcaggtgtccctacaggtaaagctcacagctcagagacatctgtgtggaggctcactgatcggtcaccaatgggtgctgaccgccgctcattgctttgatggcctccccctacaggacgtttggagaatttactccggcatactcaacctgtctgacattaccaaagacactcctttttcacaaataaaggagattatcatacaccagaattacaaagtgtcggaagggaaccatgacattgcgcttatcaaactccaggcaccgctaaactataccgaatttcaaaagcctatctgtctccccagcaaaggagacacttcaaccatctataccaattgctgggttacagggtgggggttttcaaaggagaaaggacgcttcagatggtccctcagcctgcagacacagtggaatgtggcctttgggggccaccaccagctgggctag

SEQ ID NO: 121330 - DNA, 447 bp, Artificial Sequence
  Description of Artificial Sequence: Synthetic coding sequence
atgatattgtttaaacaagctacatactttatctccttatttgcaactgtgagctgcgggtgccttacacagctgtatgaaaacgcattctttcgaggaggtgatgtggcttctatgtacacccctaatgctcaatactgtcagatgcgctgcacttttcacccacgctgtctgcttttttcctttctgcctgcctcatctatcaatgacatggagaagaggttcggctgctttcttaaggacagcgtgaccggaactctgcctaaagttcaccgcactggcgccgtttctgggcacagtctcaagcaatgtgggcaccagattagcgcctgccacagagacatctataaaggagtagacatgagaggagtgaacttcaacgtcagcaaagtgtctagtgtcgaagaatgccagaagaggtgtacgtccaatattaggtgtcagtag

SEQ ID NO: 121331 - DNA, 753 bp, Artificial Sequence
  Description of Artificial Sequence: Synthetic coding sequence
atgcggatcctacagctaatactgctcgctcttgccacaggccttgtaggtggagagactagaattataaaaggctttgaatgtaagcctcacagccagccatggcaagccgccctcttcgagaagaccagactgttgtgcggagcaacacttatcgccccacggtggctgttgacagcagcacattgtctgaaaccccggtacatcgtgcatttaggccaacacaacctgcaaaaagaagaggggtgcgagcagacaagaacagcaaccgagtcattcccgcatccgggcttcaacaactccctccccaataaagaccatagaaatgacattatgctggttaagatggcgtcacctgtgagcatcacctgggccgtacgtcctctgacccttagcagcaggtgcgtcacggcaggcaccagctgcttgatctcaggatgggggagcacctcatctccgcaattaagactgccccacacactccgttgtgccaacataaccattattgagcaccagaagtgtgagaatgcctatcccgggaacattaccgacacaatggtgtgcgcctctgtgcaagaggggggaaaggactcatgtcagggggacagcggtggccccctcgtgtgcaaccagtcccttcagggcattattagctgggggcaggacccatgcgcaatcacacggaaacctggcgtctacacaaaagtgtgtaaatacgttgactggattcaagaaaccatgaagaacaactag

SEQ ID NO: 121332 - DNA, 849 bp, Artificial Sequence
  Description of Artificial Sequence: Synthetic coding sequence
atgcagcggctaaggtggctgcgggactggaaaagctccggtagaggacttaccgcggccaaggaaccaggggcaagaagtagtcctctgcaggccatgcggatccttcagttgattctcctcgcattggctacgggcctcgtgggaggcgaaaccagaatcatcaaggggtttgagtgtaagccccacagccagccttggcaggccgccctttttgagaaaacccgacttctctgtggggcaacactaatagcacccagatggctcctgacggccgcccattgtctgaagccccgatacattgtgcatcttggacagcacaatttacaaaaggaggaaggatgcgagcaaacccgcaccgccaccgagagctttcctcatccaggctttaataattcgttgccgaacaaggatcaccggaatgacatcatgctcgttaagatggcctcccccgtaagcatcacgtgggccgttcgtccactgaccctgtcctcgcgatgcgtgaccgccggcacatcgtgtctgatttcaggctgggggtccacatcgtcaccacagctaaggttaccacataccctgagatgcgcaaatatcacaattatagaacaccagaagtgcgaaaacgcgtacccgggtaatattacagacacaatggtgtgtgcctcagtacaggaaggcggcaaggactcctgccagggggactctggagggcctcttgtctgtaatcagtccttgcaaggcattatcagctggggccaagatccttgcgcgatcacccggaagccaggggtttacacaaaagtatgcaagtatgtcgactggattcaggagacaatgaagaataactag

SEQ ID NO: 121333 - DNA, 828 bp, Artificial Sequence
  Description of Artificial Sequence: Synthetic coding sequence
atgcggattctccagctgattcttttagcattggccactggcttagtgggtggcgaaactaggataatcaaagggttcgagtgcaaaccccactctcagccctggcaagctgcgctgttcgagaaaaccaggctcctgtgcggagcgactctgattgcccccagatggcttctcacagctgctcactgtctgaaaccatgggtcagtttaacctcgcccacccatgtcagtcctgaccttagttcctctaactactgtctgtcccacctgagtcgctatatcgtgcatctcggacagcacaatttgcagaaggaggaaggatgtgagcagactagaacagccacagaaagcttcccacatccaggcttcaacaattccctgcccaataaagatcatcgaaatgatatcatgcttgtgaagatggccagcccagtgtccataacctgggctgttaggcctcttactctttctagccgctgtgtgactgcaggtacgtcctgtctcatttctggctggggaagcacgagttccccacagctgcgcctgccacacaccctgagatgcgctaacataacaattatagaacaccagaaatgtgagaacgcctaccccggcaatatcacagacactatggtgtgcgcgagcgttcaggagggaggtaaggattcatgtcagggtgattcagggggccctctggtttgtaatcagtctctgcaaggaatcatttcttggggtcaagacccctgtgccataacaagaaagccaggagtttacacaaaggtgtgcaaatacgtggactggattcaggaaacgatgaagaacaactag

SEQ ID NO: 121334 - DNA, 753 bp, Artificial Sequence
  Description of Artificial Sequence: Synthetic coding sequence
atgaggattctccagctcatcttgctcgctctcgccacaggcttggtgggcggtgaaacgcgtatcatcaagggtttcgagtgcaagccacacagccagccctggcaggcagccctattcgagaaaactcgactgttgtgtggtgccacccttattgcgcctagatggctgctgaccgcagcccactgcctgaagccgcgatatattgtgcacctgggccagcacaacctccaaaaggaagaaggttgtgaacagactaggaccgccacagaatccttcccacatccagggttcaataattcactgcctaacaaggatcacaggaacgatatcatgttggtgaaaatggcaagtccggtgtccatcacttgggcagttcgaccacttacactgtcgagcaggtgcgtcaccgctggaacttcgtgtctgatttctggatggggcagtacaagctcaccacaactccgcctgccacacactctgaggtgcgctaatatcacaattattgaacaccagaaatgcgaaaacgcataccctggaaatataacagacaccatggtgtgtgcttccgtgcaagagggggggaaggatagctgccagggggacagtgggggacctttagtctgtaatcagagcctccaggggatcatcagctggggccaggatccctgcgctatcacgcggaagcccggcgtgtataccaaagtgtgtaagtacgtcgactggatccaagagaccatgaaaaacaattag

SEQ ID NO: 121335 - DNA, 849 bp, Artificial Sequence
  Description of Artificial Sequence: Synthetic coding sequence
atgcagaggctccgctggctgcgggactggaagagctccggtcggggtctgacagctgctaaagagcctggggcccgtagcagtcctctccaggcaatgaggatcctacagctgatcctactcgcactcgccaccggcctggtgggtggtgagactcgaattattaaaggctttgaatgcaagccccatagccagccatggcaggccgcactgtttgagaagactagactactctgcggagccacacttattgctcccagatggctgcttactgccgcgcactgtctgaagcctcgctacattgtgcaccttggccagcacaacctgcagaaggaggagggatgtgaacaaactcgcacagctactgagtcttttccccatcccgggtttaacaacagtcttccgaacaaagatcataggaatgacatcatgcttgtcaaaatggcttcacctgtatcgatcacatgggccgtgcggccacttactctgagttccagatgtgtaaccgcaggcacatcctgtctgatcagtggctgggggagcacctcttccccgcagttgcgactgccccatacgctgcgatgcgcaaacataacgatcatcgagcatcagaagtgtgaaaacgcgtaccctggcaatatcacagataccatggtgtgcgccagcgttcaggaggggggtaaagatagctgtcagggagacagcggcgggcctttggtctgcaatcaaagcttacaaggtatcatttcctggggtcaggatccatgtgccatcacaaggaagcccggcgtgtataccaaagtgtgtaaatatgttgactggatccaggaaaccatgaagaataactag

SEQ ID NO: 121336 - DNA, 765 bp, Artificial Sequence
  Description of Artificial Sequence: Synthetic coding sequence
atgggactgtcaatattcctgttgctgtgtgtcttggggctgtcccaagccgccacacctaagattttcaatggtactgagtgcggtcggaattcccagccttggcaggttggcctctttgaaggcacatcgctacgctgtggcggtgtactgattgatcatcgctgggtccttactgctgctcactgcagtggttctcgatattgggtcagacttggggaacactccctatcccagctggactggaccgaacagattcgtcatagcggattctccgtgacgcatccgggctacttgggcgctagcacttcccatgagcatgatttgaggctgttgcggctgagactccctgtccgagtaacatccagcgtccagccactgcctcttccaaatgactgcgcgactgccggcaccgaatgccatgtgtctggatggggaatcactaaccaccctagaaatccattccccgacctcctgcagtgtctcaacctttccattgtcagccatgctacatgccacggagtgtaccccggacgtatcacctccaacatggtgtgcgccggaggcgtgcctgggcaagacgcgtgtcagggggactccggcgggcccttagtgtgcggtggggtgctccaggggctagtttcctggggaagcgtcggaccatgcggccaagacgggattcctggtgtttatacatacatctgcaattcaacgttggtgggattgggaacatcttggaattttaattcatgtcagccgttttag

SEQ ID NO: 121337 - DNA, 435 bp, Artificial Sequence
  Description of Artificial Sequence: Synthetic coding sequence
atggcactctcggtgggagttactcactcacggggaagatgggggtgcctgcgggcccccgcttgtgccgcaggtgtctctttactgaccaccggtgggagcagccaacgtcttaccgccgccgctgatccttttcctgatctgttgcagtgcctgaacctgagcatcgtgtcacatgctacatgccatggtgtctatcccggtcgaatcacttccaatatggtgtgcgcaggcggcgtgcccggccaggatgcctgccagggtgacagtggaggccctctcgtgtgtgggggagtccttcaaggattagtgtcctggggaagcgtgggcccttgtggacaggatggaatccccggcgtctatacctatatttgtaactcaaccctggtcggtttgggcacatcatggaacttcaactcctgccagccattctag

SEQ ID NO: 121338 - DNA, 747 bp, Artificial Sequence
  Description of Artificial Sequence: Synthetic coding sequence
atgggcctttcaatctttctgctcctctgtgtactcggcctgtctcaggcagctactcctaagatatttaatggtaccgagtgtggacgcaattctcagccttggcaagtggggttgttcgagggtacttccctgagatgtggaggagtgcttattgatcacagatgggtgctgacggccgcccactgtagcggtagtcggtattgggtgagacttggcgagcacagcctgtcccagcttgattggactgaacaaatccggcactccgggttttccgtgacccaccccggctacctgggggccagcacttcccacgagcacgatctaaggctgcttcgacttcgccttcctgtcagagtgacatcaagtgtgcaacctctccccctacctaacgattgtgccactgccgggacggaatgccatgtgtctggatggggtattacgaaccaccctaggaacccctttcctgatctcctgcagtgtctgaacctgtctatcgtttcccatgctacttgtcatggcgtgtatcccggtaggatcactagtaacatggtgtgcgctggcggcgtcccgggacaggatgcttgtcagggagatagcggcggaccactggtttgtggaggagtcctccaagggctggtgtcctggggaagcgttgggccttgcggacaagacggaatccccggtgtgtacacctacatatgtaagtacgtcgactggattcggatgatcatgcggaataattag

SEQ ID NO: 121339 - DNA, 747 bp, Artificial Sequence
  Description of Artificial Sequence: Synthetic coding sequence
atgggactgtctatcttcctactactgtgcgtgcttggactgtcacaggccgcaacacccaagatattcaacggcactgagtgcggaagaaacagtcagccttggcaggtgggtctcttcgaaggcacttcactccgatgcggtggcgttttgatcgatcatcgatgggtattaacagctgcacattgcagtggctcgagatattgggtgcggctaggtgagcactcactgtcacagcttgactggactgaacagattcgccattctgggttctccgtgactcaccctggttatctgggtgccagcactagtcacgaacacgacttaaggctgctccgcctaaggctgcctgttagagtaacttcatctgttcagcccctccctctccctaatgattgtgcaaccgccggtaccgagtgtcacgtctcaggctggggtatcaccaatcaccctcgtaacccgttcccagatcttttgcagtgcctgaacttgagcatcgtgtcccacgccacctgtcacggcgtttatcccgggaggattacatcaaacatggtgtgcgctggcggtgttcccggccaggatgcctgccaaggggattctggtgggcccctcgtctgcggaggagtgctgcagggactcgtttcgtggggatccgttggaccttgtggacaggatggcatccccggagtgtatacgtacatctgtaaatacgtcgattggatacggatgattatgcggaacaattag

SEQ ID NO: 121340 - DNA, 336 bp, Artificial Sequence
  Description of Artificial Sequence: Synthetic coding sequence
atgggattgtcaatctttcttcttctgtgtgtcctcggtctcagtcaggcggcaacgccaaaaattttcaacggaaccgaatgtggtagaaacagccagccctggcaagttggtctgttcgaaggcaccagtttacgctgcggaggggtgctgatagatcaccggtgggttcttacggcagcccattgtagcggaagacccattcctgggagtgctcccgtgccccaacccctgcatcggcttccttgtcacctgccctggtgcgtctccagagagaatcatgaacagcacggcgtgtgccggcgaaggcctggcgcaggctgcctccctggctag

SEQ ID NO: 121341 - DNA, 834 bp, Artificial Sequence
  Description of Artificial Sequence: Synthetic coding sequence
atgtggcccctggcactagtgatcgcaagcctgactctcgctctaagtggcggggtgtcacaagagtcctcgaaggttctcaacacgaatggcaccagcggattccttcccggcggctatacctgtttcccacatagccagccttggcaagcagccctcctggtacaggggcgattactctgcggtggcgtgcttgtgcaccccaaatgggtacttacagctgcccactgcttgaaggagggccttaaagtttatttgggtaaacatgctctgggaagagtcgaggccggggaacaggttcgcgaggtagtgcacagtatcccccatcctgagtatagacggtccccgacacacttaaatcatgatcacgatataatgctgctcgaactacagtctcctgttcagctcacggggtacatacagactctgccgctctcccataataacagattgaccccaggaacgacatgcagggtttcagggtggggcacgactacatccccacaggtgaattatcccaaaacattacagtgcgccaacattcagcttcgaagcgacgaagagtgtagacaagtgtatccaggcaagattaccgataacatgctgtgcgctgggactaaagagggtggcaaggactcatgtgagggggactccggggggccactcgtatgtaatcggaccttgtacgggattgtgtcttggggtgattttccctgtggccagcccgatcgcccaggtgtttacactcgtgtaagtagatacgtgctttggatccgtgagactatccgaaaatacgagacacaacaacagaaatggctgaagggacctcagtag

SEQ ID NO: 121342 - DNA, 378 bp, Artificial Sequence
  Description of Artificial Sequence: Synthetic coding sequence
atgtggcccttagctctagtcatcgcctctttaacattagccctgtctggagtcaattacccgaaaacgctccagtgtgccaacatccagttgagaagtgacgaagaatgccgacaggtgtacccaggaaaaatcacagacaacatgctttgcgctggcactaaggagggcggcaaggacagctgtgagggagactctgggggcccattggtgtgcaatagaacattgtacggaatcgtctcctggggcgactttccatgcgggcagcctgatagacccggggtctacactcgggttagccgctatgtactttggatccgggaaaccattaggaagtacgagacacaacagcagaagtggttgaaaggacctcagtag

SEQ ID NO: 121343 - DNA, 297 bp, Artificial Sequence
  Description of Artificial Sequence: Synthetic coding sequence
atgggcttgatttacaaatgccttcccgagaaagtgactgttaatatcgagaccaggtgtctgcctggtgtgtttcagggcagccagcatcagtgggaccaatgggtgtcccctcggtggctgcatctgctcccacctctaagtgcccttgctggttgccccacaagcgcacgggctgccaccttgtgggggtcccccggcccaccccagatggggccccattgtcggaccctgtcaaaagggggggcccaatctctgccccgtcaggctaggccaagagcttgcggctcttggtag

SEQ ID NO: 121344 - DNA, 282 bp, Artificial Sequence
  Description of Artificial Sequence: Synthetic coding sequence
atgtggcccctggccctggtcattgcaagcttgactctcgccctgtccggtggtgaagatttcaaggaaccatcccaaggtcctagggacgtgatggcggcatctcggcctgaggctttcccaaagggcctgacactagagccacgcccagaaaaagggggtatctgcggatgcctcgcacctgggaccatcctcggcctgaaagtaggatggcttttttcatccggcgatacaccctggattcatgccagagccacccctgaatgccacactctgggctag

SEQ ID NO: 121345 - DNA, 834 bp, Artificial Sequence
  Description of Artificial Sequence: Synthetic coding sequence
atgtggcccctcgccctagtcattgcaagcctcaccttagcattgtctggcggggtatcccaggaaagctctaaggtgcttaatactaacggcacctcagggtttctgcctggagggtatacttgcttccctcactctcaaccctggcaagccgcccttctggtccagggacgtttactgtgcggtggcgtgcttgttcaccccaagtgggtgctcactgcagcccactgcttgaaagaagggctcaaagtatacctgggcaaacacgctcttggtagagtcgaggcgggagagcaagtgagagaggtagtgcatagcatccctcaccctgagtacaggcgatcacccacccatctgaatcacgaccacgacatcatgctgctggagctgcagagtccagtgcagttgactgggtatatccagaccctgccgctctctcacaacaatcgactaacaccaggcacaacctgccgcgtttcaggctggggcaccacgacatctccccaagtcaattacccaaaaaccctacagtgcgcaaatatccagctcagaagcgacgaggagtgtcggcaggtctatccgggcaagattacagacaacatgctgtgcgcaggaacaaaagaaggaggcaaggattcatgcgaaggtgatagtggcggtccactcgtatgcaatcgtacactatatggtattgtttcatggggcgactttccttgcggccagcccgatcgcccaggggtgtatactcgtgtgtcccgttacgttctctggatcagagagaccatcaggaagtacgaaacccagcagcagaaatggctcaagggaccgcaatag

SEQ ID NO: 121346 - DNA, 804 bp, Artificial Sequence
  Description of Artificial Sequence: Synthetic coding sequence
atgtccttaagggtgctgggatcaggaacatggccctccgcccccaagatgtttctgttgctgaccgcactgcaggtcctagcaattgccatgacacagtcacaggaagatgagaataaaataatcggcggccacacatgtacccggtcgagccagccttggcaggctgccctgcttgcaggacctagacgccggttcctctgtggcggagctctgctctccggtcagtgggtaatcactgcggcccactgtgggcggcctatactgcaagttgcgctgggaaagcataatttgcgcaggtgggaagcaacccaacaagtgctgcgtgtggttcgtcaggtcactcaccccaattataatagccgaacacatgataatgatctgatgctcttacagttgcagcagcccgccagaattggcagggcagtgcgccccatcgaggttacccaggcttgtgcatcaccaggaacctcatgccgggtcagtggttggggcaccatttctagcccgatcgcccggtaccccgcatctttacagtgtgtcaatatcaacatatctcctgacgaagtgtgtcagaaggcttatccccgtaccatcacgcctggaatggtgtgtgctggggtgccgcagggcggaaaggactcttgccagggcgattccggcggaccactcgtgtgtcggggccagctgcaaggcctcgtgagttggggcatggagcggtgtgctctgccaggttacccaggagtgtatacaaatttgtgtaagtatagaagctggatagaggaaacgatgcgagataagtag

SEQ ID NO: 121347 - DNA, 804 bp, Artificial Sequence
  Description of Artificial Sequence: Synthetic coding sequence
atgtccctgagagtactggggagcggaacatggcctagcgctcccaaaatgtttctcctgctgaccgcactgcaggtgctcgcaattgccatgacacagtcacaggaggacgaaaacaagattataggcggccacacctgtactcgctcctcgcaaccttggcaggccgctctactcgcgggccccagaaggagatttctctgtggcggggcactactttcaggacagtgggtgatcactgcggcccattgcggccggccaatcctgcaggtggccctgggcaaacataacctccggagatgggaggccacccagcaagtgctgagggtagtgagacaggtcacacatcccaattacaacagccgcacccacgataacgacctgatgctgctacaattgcagcagccagcgaggatcggaagagctgttagacctattgaggtgactcaggcctgcgccagcccgggcacaagctgcagagtgagtggttgggggactatatctagtccaatcgcacggtacccagccagtctgcagtgtgtgaatatcaatattagcccagacgaggtctgccagaaagcttatccgcgcactattacgccaggaatggtgtgtgcgggcgtgcctcaaggaggcaaggactcttgccaaggggactctggcggacctctcgtttgccgcggacagctgcagggcttagtttcttggggcatggagcgctgtgccctgccaggttaccctggcgtgtatacaaacctttgtaaataccgaagttggattgaggagacaatgagagacaaatag

SEQ ID NO: 121348 - DNA, 804 bp, Artificial Sequence
  Description of Artificial Sequence: Synthetic coding sequence
atgagcctgagagttctgggcagtggaacttggccttctgcccctaaaatgttcctcctgctgaccgctctgcaggtgctggctatagcaatgacccagagccaggaagacgaaaacaagatcatcggaggacatacatgtacccgatcctcccagccatggcaggccgccctcctggctgggcctagaagaagatttctgtgtgggggagcactgctaagcgggcagtgggtgattacagccgctcactgtggcaggcctatccttcaggtagcactgggaaagcacaaccttcggcgttgggaagccacccaacaagtgctgcgcgtcgtacggcaggtaacccacccgaactataatagtagaacacatgataatgacttgatgctgctccagctgcagcagccggcccggatagggagggccgtgaggcccatcgaggttacacaggcgtgcgccagtccgggaactagctgccgcgtttcaggctgggggacaatatcttcccccatcgctagataccctgccagcttgcagtgtgtgaatatcaatatctctcctgatgaggtgtgtcagaaagcctacccccggaccatcaccccaggcatggtatgtgctggggtgccacaaggaggcaaagattcttgtcaaggtgattctggcggtccgctagtctgcaggggtcaactccaggggctggtctcgtggggtatggaacgctgcgccctccctgggtatcccggcgtgtacacaaatctgtgtaagtatcgatcctggattgaggagacaatgcgtgataagtag

SEQ ID NO: 121349 - DNA, 486 bp, Artificial Sequence
  Description of Artificial Sequence: Synthetic coding sequence
atgtggctcctgctcacactaagcttcctgctggcctccaccgctgcccaggacggagataaactcctcgaaggtgacgaatgtgctcctcacagccagccgtggcaggtggccctgtatgaacgcggaaggttcaactgtggagcttcattaatcagcccccattgggttctgtcagccgctcattgccaaagcagattcatgcgcgttcggttgggggagcacaacctgcggaaacgcgatggccccgaacaactccggacgacctcccgcgtgattccgcaccctcggtacgaggcccgcagccaccgcaatgatatcatgttactgagactggtgcagccagctaggctgaacccccaggttagaccagctgtattaccaaccagatgccctcatcccggagaagcttgcgtggtcagcggctgggggctggtgtcccataacgagcccggcaccgccggctcaccgcgctcccagggatag

SEQ ID NO: 121350 - DNA, 771 bp, Artificial Sequence
  Description of Artificial Sequence: Synthetic coding sequence
atgtggttactgcttaccctgagctttctgctggcatccacggcagcacaggatggcgataagctcctcgagggtgatgagtgcgccccgcactcacagccctggcaggtggcgctgtatgaaagagggagattcaattgtggtgcatccctcatatcaccccactgggttttaagcgccgcgcattgccagtccaggttcatgcgggttcgtttaggggagcacaatctcagaaagagagatggacccgagcagctcaggacaaccagccgggtcattcctcaccctaggtatgaagcaaggtctcataggaatgacattatgctgttacggctggttcagccggcaaggctgaatccccaggtgcggccagctgtgctccctacacggtgccctcacccaggcgaagcctgtgtggttagtggatggggtctcgtatctcataatgagcccgggaccgccgggagccccaggtcacaggtaagtctccctgacactctgcattgtgctaacatctccatcatctccgacacatcatgcgacaagagctaccccggccggctgaccaatacgatggtctgcgccggcgcggaaggccggggtgccgagtcttgcgaaggggactctggcggtcctctcgtgtgcggtggtattttgcagggaatcgtgtcatggggagacgttccttgcgataacaccacaaaacccggagtgtacaccaaagtctgccattatttagaatggattagggagactatgaaaaggaattag

SEQ ID NO: 121351 - DNA, 516 bp, Artificial Sequence
  Description of Artificial Sequence: Synthetic coding sequence
atgtggctgttgctgactttatctttcctgttagcatcgacagcggcccaggacggtgacaaactgctggagggtgatgaatgcgccccccatagccaaccttggcaggtcgctctgtatgagcgaggccggttcaattgcggcgccagcctgatcagccctcattgggtgttgagcgccgcacattgtcaatcccgattcatgcgcgttcggctcggcgagcacaatttgcggaaacgcgacggtcctgagcaactcaggaccacatcacgagtcattccacatcccaggtatgaagcccgatcccaccgaaatgacataatgcttctacgcctggtgcagcctgctcgcctcaatccgcaaggggattccggcgggcccctcgtgtgtgggggcattttacaggggatcgtaagttggggcgacgtgccttgcgataataccaccaaacctggggtgtacaccaaggtgtgtcattaccttgagtggatacgcgagacgatgaaacggaattag

SEQ ID NO: 121352 - DNA, 489 bp, Artificial Sequence
  Description of Artificial Sequence: Synthetic coding sequence
atgtggctgctgctaactctgagctttctacttgcttccaccgccgcccaggacggcgacaagctgctggaaggtgatgaatgtgcgccacattcccagccctggcaggtcgcactgtacgaaagagggagatttaattgcggagcttctctcatttctcctcattgggtcctgagcgcagcacactgccaatcaagattcatgcgagtaagactgggggaacacaacctacgcaagcgcgacggccccgaacagctgaggacaacttcaagagtgatccctcaccctcgatacgaggctcgctcacataggaacgatatcatgttactgcgcctggtacagcccgctcgactaaatccccaggtgcgcccagccgtactgcccactaggtgccctcatcccggcgaggcttgtgttgtctctggctggggccttgtgagccacaacgaacctgggacagcggggtccccacgctcccagggggcctag

SEQ ID NO: 121353 - DNA, 771 bp, Artificial Sequence
  Description of Artificial Sequence: Synthetic coding sequence
atgtggctcctcctgacattgtccttcctgttagcctccaccgccgcccaagacggtgataagctccttgaaggtgacgaatgcgcaccccattcacagccctggcaggttgccctttacgagagggggagattcaactgcggagcaagtctgatctcgccccactgggtcctgagcgcagcacattgtcagagtaggtttatgagggttcggctgggagagcacaacctcaggaaaagagatggacctgagcaactccgcaccacctcaagagttattcctcacccaaggtacgaagcacggtctcaccgcaatgatatcatgcttctccggttggtacagcctgcaaggctgaatccccaggtgagaccagcagttctgcctacccggtgtccccaccccggagaagcttgtgtggtgagcgggtggggattggtaagccataatgaacccggaaccgccggcagcccaagatcgcaggtatcccttccagataccctacactgcgccaacatctcaattatcagtgacacatcctgcgacaagtcttaccctggaaggctgaccaatactatggtctgtgccggcgccgagggaagaggagccgagagctgtgaaggcgactcagggggaccactggtgtgcggggggatcctgcagggaattgtatcttggggcgacgtaccatgtgacaatacaaccaagcctggagtgtacacaaaggtgtgccactatcttgagtggattcgcgagactatgaaaaggaattag

SEQ ID NO: 121354 - DNA, 786 bp, Artificial Sequence
  Description of Artificial Sequence: Synthetic coding sequence
atgtgggatctcgtcttgtctatcgctttgtcagtgggttgcacaggtgcagttccactgatccaaagcagaatcgtgggcgggtgggaatgcgaaaagcactcacagccttggcaggtagcagtgtacagccacggatgggctcattgcggtggcgtcctggtgcacccccagtgggtgctcaccgccgctcactgcctcaagaagaacagccaggtgtggctgggccggcacaatctattcgagccagaagatacgggccaacgggttcccgtcagccacagctttccccaccccctctacaacatgagcttgcttaagcatcagtctctccgcccagacgaggacagctcacatgatctgatgctgctcagactgtccgaacctgcaaagattaccgacgtggtgaaggtcctgggcctccccacccaggaaccagccctgggtacgacatgctatgcgagcgggtggggctcaatcgaacccgaggaattcctgcgacctaggtctcttcaatgcgtgtccttacatctgctgagcaacgacatgtgcgcacgcgcatactccgagaaagtgaccgaatttatgctgtgcgccggcctgtggacgggcggcaaagatacctgtgggggcgacagtggcggcccactggtatgtaacggtgtacttcagggaatcacctcctggggtccggaaccatgcgccctgccagagaagccagctgtatacacaaaggtcgtgcattacagaaagtggattaaagataccattgccgcaaacccttag

SEQ ID NO: 121355 - DNA, 672 bp, Artificial Sequence
  Description of Artificial Sequence: Synthetic coding sequence
atgtgggacttagttctcagtattgccttgagcgttggctgcactggcgctgtccctctgatccagagtcgcatcgtgggggggtgggagtgcgagaagcactcacagccgtggcaggtggccgtgtattcgcatgggtgggctcactgtggcggagtacttgtacaccctcagtgggtgttgaccgccgcccactgtctcaagaagaattctcaagtatggctgggccgccataatctcttcgagccggaagacacaggccagcgggtgccggtctcacactcatttcctcatcctctctacaatatgagccttctgaaacaccagtctctgcgaccagatgaggatagctcgcatgaccttatgctcctgcggctgagtgagccggccaagatcaccgacgtcgtgaaagtactgggtctgcccactcaggaaccagccttggggactacctgctacgctagtggctggggatcaattgaacccgaagaatttttgcgccctcggagcttgcagtgtgtgtctttacatcttctgagtaacgatatgtgcgcgcgggcctactccgagaaggtgaccgaattcatgctgtgcgcaggactatggactggaggcaaggacacgtgcggcgtgtctcatccttacagccagcatctcgaggggaagggatag

SEQ ID NO: 121356 - DNA, 480 bp, Artificial Sequence
  Description of Artificial Sequence: Synthetic coding sequence
atgagcctgttaaaacatcagagccttcgaccggacgaagatagctctcacgatctgatgctattacgtctgtccgagcctgctaagatcactgatgtagtcaaagtccttggactgcctacacaagaaccagccctcgggactacctgttacgcttccggctgggggagcattgagcctgaggaatttctgaggcccaggagcctgcagtgcgtctctctgcatctgctcagcaacgacatgtgcgctcgtgcctactctgaaaaagtgactgaattcatgctttgcgccgggctatggacaggtgggaaagacacctgcggcggggattccggaggaccactggtgtgcaatggcgttctgcaagggattacaagttgggggcctgagccctgcgccctgccagagaagccagcagtttacaccaaagtcgtgcattatagaaagtggattaaggatacaatcgcagcaaacccctag

SEQ ID NO: 121357 - DNA, 786 bp, Artificial Sequence
  Description of Artificial Sequence: Synthetic coding sequence
atgtgggtccccgtcgtgttccttacactgtcagtgacttggataggtgccgcccccctgatactatcaagaattgtcggaggctgggagtgtgagaaacattcacagccctggcaggtgctggtagcatcaagaggtagagctgtttgtggcggagtgcttgtgcacccccagtgggtacttaccgcagctcactgcattagaaacaaaagtgtgatactgctggggaggcatagcctcttccaccccgaagacactggacaggtgtttcaagtgtcccattcgttcccccatcccttatatgatatgagcctgctgaagaatcgctttctgcgacctggagacgatagctcacacgatctgatgctactccgcctctcagagcccgccgagctaacagatgccgtgaaagtcatggacctacctacccaagagcctgccctaggcacaacctgctatgcctccggctggggcagtatcgagccggaggagtttctgacccctaagaagttacagtgtgttgaccttcacgtgatcagtaacgacgtgtgtgctcaggtacatcctcagaaggtgaccaaattcatgctgtgtgccgggcgctggaccggcggcaagtccacatgcagtggggacagcggcggccccctcgtgtgcaatggagttctgcagggtatcacgagttggggctctgaaccttgtgccctgcctgaacgcccatcactctacacaaaagtggtgcattaccggaaatggatcaaggataccatcgtggcgaacccctag

SEQ ID NO: 121358 - DNA, 663 bp, Artificial Sequence
  Description of Artificial Sequence: Synthetic coding sequence
atgtgggtccccgtggtatttctgaccctctccgtgacatggattggcgcagctcccttgatcctatctcgcatcgtgggtgggtgggaatgcgagaaacactctcaaccatggcaggttctggtggcctctcggggacgggcagtctgcgggggcgtgctcgtgcatccacaatgggtgttgaccgctgcccattgtatcagaaacaaatccgtgattctgctgggaaggcatagcttgttccatccagaggatacgggacaggtgttccaggtgtcccatagctttcctcatccattgtacgacatgtcccttttgaagaacaggttccttcggccaggtgacgatagctctattgaaccagaggaatttttgactccaaaaaaattgcagtgcgtggatttgcatgtcatcagtaatgatgtgtgtgcgcaggtgcacccacagaaagtgaccaagtttatgctgtgtgccggacgctggaccggaggaaaaagtacttgctcgggggattctggcggcccattagtctgcaatggcgtcctccagggcatcacatcttggggctctgaaccctgtgccctgccggagagaccgtctttatacacaaaggtggtacattacaggaagtggattaaggacactattgttgccaacccctag

SEQ ID NO: 121359 - DNA, 717 bp, Artificial Sequence
  Description of Artificial Sequence: Synthetic coding sequence
atgtgggttcctgtggttttcctcacactgtctgtcacctggataggggctgctcccctcatactctcccggatcgttggcggatgggagtgtgaaaagcactcgcagccttggcaggtccttgttgcctcaagaggcagagcagtgtgtggcggggtcctggtccatccgcaatgggtgctgacggctgctcactgcatccgaaataaatccgtcattctgctcggacgacacagtctatttcaccccgaagacacaggtcaggtgtttcaagttagccattcattccctcatccgctttacgacatgagtctactgaagaatcggttcttgcgcccgggagacgacagtagtcatgacctcatgcttctccggttgagcgaaccagccgagttaaccgatgccgtgaaggtcatggacctgcctacacaggagccggcccttggtactacctgctatgcaagtggatggggctcgatagaacctgaagaattcctaacaccgaagaagctgcagtgcgttgatctgcacgtcatctctaatgacgtctgcgcccaggtccatcctcaaaaggtcactaaattcatgctctgtgccggacgatggacagggggtaaaagcacatgttcttgggtaattctgatcacggagctgactatgccagccctgcctatggttctgcatggcagcctggtgccatggcgtggcggagtctag

SEQ ID NO: 121360 - DNA, 657 bp, Artificial Sequence
  Description of Artificial Sequence: Synthetic coding sequence
atgtgggtgccagtggtgtttctgaccctgtccgttacctggataggagccgctccactcattctgtcacgcatcgtgggcggctgggaatgtgaaaaacattcacaaccttggcaggttctggttgctagcagggggcgggccgtatgcggaggtgtattggtgcatccccagtgggtcctcactgctgcccactgcattaggaagccaggcgacgactcttcacacgacctcatgctcctgagactgtccgagccagccgaactgacagacgctgtaaaagtaatggatctcccaacccaggaaccagccttgggaacaacatgttacgcgtccggttgggggagcatcgagcccgaggaattcctgacccctaagaagctgcagtgtgtggatctgcacgtgatcagtaacgatgtatgtgcccaggtacatccacagaaagtgactaaatttatgctttgcgctggccgttggactggtgggaagagtacctgttctggagactctggtggtcccctggtgtgtaacggtgtgctccagggcataacttcctgggggagcgagccatgcgcgcttcctgaacgcccttccctgtacaccaaggtcgtgcactaccgcaagtggatcaaggatactatcgtggccaacccttag

SEQ ID NO: 121361 - DNA, 210 bp, Artificial Sequence
  Description of Artificial Sequence: Synthetic coding sequence
atgtgggtgccggtggtattcttaacactgtcagttacttggatcggagccgcgcctctcatacttagcagaattgtgggcggatgggagtgtgaaaagcactcccaaccttggcaggtgctcgtagcaagtcggggtcgagctgtatgcggcggagtgctggtccacccccagtgggtgctcaccgctgcccattgcataaggaaatag

SEQ ID NO: 121362 - DNA, 765 bp, Artificial Sequence
  Description of Artificial Sequence: Synthetic coding sequence
atggccacagcggggaatccatggggatggttcctgggatacctgatcctgggggtggcagggagcctcgtctctggtagttgtagccagattataaatggggaagactgctccccccactctcagccctggcaggccgcgttggtcatggagaacgaactgttttgttctggtgtattggtgcatcctcagtgggtgttgagcgcagcccactgctttcagaatagctacaccataggtctcggactccactctctggaagcagatcaggaacctggatctcagatggtcgaggctagcttgtcagtccggcatcccgagtacaatagacccctgctggcgaatgacctgatgctgattaagctggatgaatctgtgagcgaatctgacacaattagaagtattagtatcgcaagccagtgccccactgctggaaactcctgcctcgttagcggatggggccttctggctaatgggcgcatgccgactgttctacagtgtgtaaatgtcagtgttgtgtccgaggaagtctgcagcaaattgtacgacccactctaccacccttctatgttctgtgccggtggtgggcacgaccagaaggattcctgtaacggcgattccggggggccgctgatttgtaacgggtatctccaggggcttgtctcttttggtaaggctccttgcggccaggtcggtgtgcccggcgtatacaccaacctttgtaaattcactgagtggatcgaaaaaaccgttcaggcatcctag

SEQ ID NO: 121363 - DNA, 333 bp, Artificial Sequence
  Description of Artificial Sequence: Synthetic coding sequence
atggaaaacgaactattttgctctggagtcctggtgcacccgcagtgggtgctttccgcggcccattgtttccagaacagctacaccataggcctcggactccacagcctggaagcagaccaggaacctgggtcccagatggtggaagccagccttagtgtcagacacccagaatataaccgccccttgctggccaatgacctgatgctaatcaagctggacgagtccgtcagcgagagcgatacaatccgcagtatctcaatcgcctcgcagtgccctacagccggcaatagctgtttagtgagcggatgggggctgctggctaatggatag

SEQ ID NO: 121364 - DNA, 735 bp, Artificial Sequence
  Description of Artificial Sequence: Synthetic coding sequence
atgaagaagctcatggtggttctgtcactgattgcagcagcttgggccgaggaacagaataaactcgtgcacgggggcccttgcgacaagacctcccacccatatcaagccgcactgtacacgtccgggcacctcctttgcggtggcgtgctgatccatccactatgggtcctcaccgccgcgcactgcaaaaagcctaatctccaggtctttctaggaaagcataaccttaggcagagggaatctagccaggagcaatcttctgtggtccgtgccgtgatccatcccgactacgatgcagcttctcatgatcaggacattatgctgcttcgactggcaaggccagccaagctttccgagttaatccagccactgccattggaaagggattgttccgccaatacaacctcttgccacatcctcgggtggggaaaaacagccgatggcgacttccctgacactatccagtgcgcttatattcacctcgtatctagggaagagtgcgagcacgcctaccctggacaaatcactcagaatatgctgtgtgccggagacgagaaatatggtaaggactcctgtcagggagattcaggaggaccacttgtctgtggggatcacctgcggggattagtatcgtggggaaatattccatgtggaagcaaggagaaaccgggggtctacaccaacgtatgtagatataccaactggatccagaaaacaatccaggcaaagtag

SEQ ID NO: 121365 - DNA, 735 bp, Artificial Sequence
  Description of Artificial Sequence: Synthetic coding sequence
atgaaaaagctgatggtggtgctttcgctcatcgccgcagcatgggccgaggaacagaacaaactggtgcacggggggccatgcgacaaaaccagccacccttatcaggctgccctgtatacctctggacatcttctttgcgggggcgtacttatccatcctctttgggtattaactgctgcgcactgcaagaagccaaacctgcaggtcttcttggggaaacataatctccggcagcgagaaagctctcaggaacagtcctctgttgtccgagcagtcatacatccagattacgatgcggcctcccacgatcaagatataatgttactgcgcctggctaggccagctaagttgtcagaactgattcagccactgcccctcgaacgtgactgtagtgccaatacgacttcatgtcacattctggggtgggggaaaacagctgatggcgactttcctgatacaatccagtgtgcttacatccaccttgtctctcgcgaagagtgtgagcacgcctacccaggacaaattactcagaatatgctttgtgccggcgacgaaaaatatggcaaagactcctgccagggggatagcggtgggccacttgtatgcggggatcacttgcgaggattggtgagttggggaaatatcccgtgtggctctaaggaaaagcccggtgtctacacgaatgtctgccgctacaccaactggatccagaaaacaatccaagccaaatag

SEQ ID NO: 121366 - DNA, 363 bp, Artificial Sequence
  Description of Artificial Sequence: Synthetic coding sequence
atgaaaaagttaatggtggtgctgagtctgattgccgctgcttgggctgaagagcagaacaaactggtgcacggcggtccgtgcgataaaacctctcacccataccaggcagcactttatacaagcggccatctgctgtgtgggggcgttctgattcatcctctgtgggtcctaaccgctgcacattgcaaaaagcctgttatcctgggcgtacgctggtacgtagaaactacgagtgaggccttgtgtcatggcgttacgagtccagtagaccaacgccgctcacaggaatctacccccacctcggcagacacccgcaccggaagcaagaaacccttcagaccttctgacccagacatgtag

SEQ ID NO: 121367 - DNA, 414 bp, Artificial Sequence
  Description of Artificial Sequence: Synthetic coding sequence
atgctgctaaggctcgctcgccccgccaaactgtctgagctgatccagcctctgcccctcgagcgagattgcagtgcaaacacaaccagctgtcatattcttgggtggggcaagaccgctgacggagactttcccgacactatccagtgcgcctatatacatttagtgagccgtgaagagtgcgagcacgcttacccaggccaaattacccagaacatgctgtgcgcgggagacgaaaagtatggcaaagattcctgtcaaggagacagtggaggcccgctcgtatgcggagatcatttgcgcggcctggtgagttggggcaatattccatgtggctctaaagagaagcccggggtatacacaaacgtgtgcaggtacaccaattggatacagaagacaattcaggccaaatag

SEQ ID NO: 121368 - DNA, 123 bp, Artificial Sequence
  Description of Artificial Sequence: Synthetic coding sequence
atgaaaaagctgatggtcgtactaagcttaatcgccgccggtatttttagatccagctgggggtccataacctttggcaagggacgcgtcccacgctccagggtcttgctgtccggcttgtag

SEQ ID NO: 121369 - DNA, 414 bp, Artificial Sequence
  Description of Artificial Sequence: Synthetic coding sequence
atgctcctgagactggcacggcccgccaagctgtcggaactcattcagccactgccgttagagcgtgactgttccgcgaatactaccagctgccacattctgggatgggggaaaacagcggacggtgacttcccagacacaatacagtgcgcatacatccacctggtgtctagggaagaatgcgagcacgcatatcccggtcaaatcactcagaatatgctttgcgctggcgacgaaaaatacggaaaggattcctgtcaaggcgactctgggggacccctggtctgcggagaccatctgcgggggctggtgtcctggggaaacattccatgtggtagcaaagagaagccaggagtctatactaacgtatgtagatacacaaattggatccagaagactatccaggccaaatag

SEQ ID NO: 121370 - DNA, 783 bp, Artificial Sequence
  Description of Artificial Sequence: Synthetic coding sequence
atgggccgacccaggcctcgcgccgcaaaaacctggatgttcctgctcctgctgggcggcgcctgggctgggcactcccgcgcgcaagaggacaaagtcttgggaggtcacgagtgccagccgcactcacagccatggcaggccgctctgtttcagggccagcagctgttatgtgggggagtcttggtcggaggcaactgggtgttgaccgccgcccattgcaagaagcccaagtacacagtgaggctaggagaccacagcctccagaacaaggacggtccggagcaggagattcctgtcgttcagagcataccccatccctgctacaactccagtgatgttgaggaccacaaccacgatttgatgctgttacagttacgggatcaagcctccctgggctctaaggtgaagccgatctccctggccgaccactgcactcagcctggacaaaaatgcacagtcagtgggtgggggactgtgacctctcctcgggagaattttcccgatacactgaactgtgccgaggtcaagatttttccgcagaaaaagtgtgaagacgcctatcccgggcaaataaccgatgggatggtgtgcgctggcagttctaagggcgctgacacatgtcagggcgacagtggcggtccccttgtttgcgacggtgccctccaagggatcacgagctggggatccgatccctgtggacgatccgacaaacctggggtctataccaacatctgcagataccttgattggatcaagaagatcatcggttcaaagggctag

SEQ ID NO: 121371 - DNA, 99 bp, Artificial Sequence
  Description of Artificial Sequence: Synthetic coding sequence
atggggcggcctaggccgcgcgccgccaagacctggatgttcctcctcctgctcggcggcgcgtgggccgggagattctggaggcctcccggagtctag

SEQ ID NO: 121372 - DNA, 360 bp, Artificial Sequence
  Description of Artificial Sequence: Synthetic coding sequence
atggggaggccaagaccacgggccgctaagacatggatgttccttctgctgctcggcggcgcgtgggcagagaacttcccggacaccttgaattgcgctgaggtgaagatcttccctcagaaaaagtgtgaggatgcctaccccgggcaaataacagacggtatggtgtgcgcgggtagctccaaaggggctgacacttgtcaaggggatagcggcgggcccctcgtttgtgatggtgccctgcaggggatcacatcttgggggtcagatccatgtggccgaagtgacaaacctggcgtgtatactaacatctgtcggtatctcgactggatcaaaaagatcattgggtcaaaggggtag

SEQ ID NO: 121373 - DNA, 918 bp, Artificial Sequence
  Description of Artificial Sequence: Synthetic coding sequence
atgggcagacctcggcccagggctgcaaaaacctggatgttcctgctactcctaggaggggcgtgggccgcatgtggcagtcttgacctcctcacaaagctttacgccgaaaacctcccctgcgtccatctgaacccccagtggcctagtcagccatctcattgccctcgtgggtggagaagtaatccactacctcctgctgccggccatagcagggcccaagaggacaaagtcctaggtggccacgagtgccaaccacactcacagccttggcaggcagccctgtttcagggacagcagctgctgtgtggaggcgttctggtgggtggcaactgggtgttgacagcagcgcactgtaagaaacctaaatataccgtgaggctgggcgaccactctctgcagaataaggacggacccgagcaggaaattccggtcgtgcagagcatcccccacccatgttacaactccagcgacgtagaggaccacaaccatgatttgatgctactccaactaagagaccaggcttccctcggatcgaaagttaagcccatttcactggccgatcattgcactcagcctgggcagaagtgtaccgtgtccggctgggggaccgtaacctccccacgagagaattttcctgatacactgaactgtgcagaggtaaaaatctttccccagaagaagtgtgaggacgcgtaccccggccagataacagatggaatggtctgcgcgggatcgtctaagggcgctgacacttgccaaggggacagcgggggaccactcgtgtgtgacggcgccctgcagggaattactagttgggggtcagacccttgcggcagaagcgacaaacctggcgtgtacacaaacatatgccgttacctcgactggattaaaaaaatcataggtagtaaagggtag

SEQ ID NO: 121374 - DNA, 783 bp, Artificial Sequence
  Description of Artificial Sequence: Synthetic coding sequence
atgggtagaccaaggccccgagcggccaaaacatggatgttccttctgttgctcggcggcgcttgggctggtcactctcgggcacaggaggacaaggttctgggcggccacgagtgtcagccccactcccagccttggcaggctgcactctttcagggacagcaactgctgtgtggcggggttctggtcggaggcaattgggtcttaacagctgcccattgtaaaaagcctaaatatacagtgagactcggagaccattcccttcaaaataaggacggaccagagcaggaaattcccgttgttcagtctataccccacccatgttacaacagtagtgacgtggaggatcacaatcatgacttgatgcttctgcagctgcgggaccaagctagcctaggctctaaggtcaagcctatcagcttggctgatcactgtacacagcccggacagaagtgtactgtgtccggctggggaaccgtcacctcccctcgcgagaatttcccagacactctcaactgtgctgaagttaaaatcttcccccagaagaagtgcgaggacgcctaccccggtcagatcactgatggaatggtgtgcgccgggagctccaaaggcgctgatacctgtcagggcgactcgggtgggccactggtgtgtgatggcgctctacagggcatcacttcttggggaagcgatccttgcgggagatctgataagcctggagtgtacacgaatatatgcaggtacttggactggattaagaaaatcataggatctaaagggtag

SEQ ID NO: 121375 - DNA, 753 bp, Artificial Sequence
  Description of Artificial Sequence: Synthetic coding sequence
atgaagctaggactactgtgtgctcttttatctctactggccggacacggatgggctgacaccagggcaattggtgccgaggagtgcaggccgaattctcagccctggcaagcaggtttgttccatctaacacggctattctgtggcgctacacttatctctgatcggtggctgttgactgctgcccactgtcgcaaaccttacttgtgggtgcgcctaggcgagcatcatttatggaagtgggaaggacccgaacagctcttcagggttaccgacttttttccccacccagggttcaacaaagacctgtccgctaatgatcataacgatgacatcatgctgattagattgccccgtcaagcacggcttagtcctgctgtccagccactcaatctttcacaaacctgtgtgtcacccggcatgcaatgcctgatctcaggatggggggccgtgtcgagccctaaagccctgttcccagtcaccctccaatgcgcaaacatcagtattctggaaaacaagctctgccactgggcctatcccggacatatcagtgattccatgctctgcgccgggctctgggaaggcggtaggggatcttgtcaaggagattcaggaggaccgctagtctgtaatggcaccctggccggcgttgtaagcggaggcgcagaaccgtgttctaggccaagaaggcccgccgtctatacttccgtctgccattatctggactggatccaggaaatcatggaaaattag

SEQ ID NO: 121376 - DNA, 753 bp, Artificial Sequence
  Description of Artificial Sequence: Synthetic coding sequence
atgaagttgggccttctctgtgctctgctcagccttttggctggccacgggtgggctgacacccgggctatcggggccgaggagtgcaggccaaattcccagccgtggcaggccggcctcttccatctgactagactattctgcggcgctacccttatttccgaccggtggctgctgaccgccgcacactgtcgtaaaccctatctctgggtcaggttgggcgaacatcacctgtggaaatgggaaggacccgaacaactcttcagagtaacagacttcttcccccatcctggctttaataaagacctcagcgccaatgaccacaacgacgacatcatgttgatccgactccctaggcaggcccgattgagccccgccgtgcagcccttaaatctgagccagacctgtgtctcacccggcatgcagtgtctaatctccggatggggtgccgtgtcctcgcctaaggctttgtttccggtgaccctgcagtgtgctaatatcagtatcctcgagaacaaactgtgccactgggcctatcccggccacattagtgactcaatgttgtgtgcagggctatgggaaggggggagaggtagctgccagggggattctggagggccacttgtgtgtaacgggacactagctggagtggtgtctggcggagccgagccctgctccagaccacgcagaccagctgtgtataccagcgtgtgccattacctggactggatccaggagatcatggaaaactag

SEQ ID NO: 121377 - DNA, 186 bp, Artificial Sequence
  Description of Artificial Sequence: Synthetic coding sequence
atgaagctcgggctgctctgtgccctgctcagcctgctcgccggcatatgtggaagtgccctcgagtctacgaccagtgggaacggtagggtgagatcatcgtgctctgggttgcggacatcaagccctacccttgcttccacacgaacctctgctccgatgaccaccatgatgacatcctgctag

SEQ ID NO: 121378 - DNA, 2043 bp, Artificial Sequence
  Description of Artificial Sequence: Synthetic coding sequence
atggtacccggggtccctggcgccgtattgacactgtgcctatggcttgctgcatcatcagggtgtctggcagctggccctggggcggccgccgctcgccgtctggacgagagtctctccgcagggtcggttcaaagggccaggtgcgcctcccggtgtcttagtctgcaaattacaaggatcagcgcattctttcaacacttccagaacaacggctcactggtatggtgccagaatcataagcagtgttcgaaatgcttagagccgtgcaaggagtccggcgatttgcgcaaacaccagtgtcagtctttttgtgaacctctcttcccgaagaagagctatgaatgtttgacctcgtgtgaatttctgaagtatattttgctggttaaacagggtgactgcccagcaccagagaaggcaagcggctttgcagccgcctgcgtggaaagttgtgaggtcgacaacgagtgctcaggagtcaagaaatgctgtagtaacggctgtggtcatacctgccaggtgccaaaaacattatacaaaggggtgcctcttaagccccgcaaagaactgcggttcaccgaacttcagagcggccaattggaagttaaatggtcctcaaagtttaacattagtatcgagcccgttatttacgttgtacagagaaggtggaattatggcattcaccccagcgaggacgatgcaacccactggcagacggtcgctcagacaaccgatgagcgtgtgcaactgaccgacatcagacctagccgctggtatcaatttcgggtggcagccgtcaatgtgcacggcacacgcggctttaccgccccatccaaacactttcgatcttcaaaggatccttcagcccctccagctcccgccaatctgcgcctggcgaatagcaccgtgaattcagacggaagcgtgacagtgaccattgtgtgggacctgcccgaagaacctgatatccccgtgcaccactacaaggtgttctggtcatggatggtcagttccaaatctttggtgcctacaaagaaaaagaggcggaagacaaccgacgggttccaaaatagcgttattctcgagaagttacagcctgattgtgactacgttgttgaactacaggcaatcacctactggggacaaacaagactgaaaagcgcgaaggtatccttgcacttcacaagcacacatgccaccaataacaaagagcagttggtgaaaactcgaaaagggggaatccagactcaactaccctttcagcgcaggaggcccactcgccccttggaggttggcgccccattctaccaggacggccagctgcaggtcaaggtgtactggaaaaagacagaggatcctaccgtgaacagataccatgtcaggtggtttcccgaggcttgtgcacataatcgcaccaccgggagcgaggcctcttctggcatgacgcatgagaattacataattctgcaagatctctccttttcgtgtaagtataaagtcactgtgcagccaataaggcccaaatctcattcaaaagctgaggccgtgtttttcactacgcccccatgctctgccctgaagggcaagagccataaaccagtgggctgcctgggggaggccggacatgttctgtcaaaagtactggccaaaccagagaacctgtcagcctccttcatagtccaggacgtgaacatcacagggcatttttcttggaagatggcaaaggcaaacttgtatcaacccatgactggctttcaggtgacttgggccgaagtgacaacagaatctagacagaatagcctgcccaattctataattagccaaagccagattctgccttccgatcactacgtgctcacagtccctaacctgagaccatcgaccctgtacaggcttgaagtgcaagtgctgactcctggtggagagggcccagcaacaattaagacctttaggactcctgagctgcctcctagcagtgcacacagatcgcatttgaagcaccgccatccacatcattacaagccttcacccgaacgttactag

SEQ ID NO: 121379 - DNA, 2631 bp, Artificial Sequence
  Description of Artificial Sequence: Synthetic coding sequence
atggagttgatcacgatcttggagaaaaccgtgtctcctgatagactggagctagaagctgcacaaaagttcttagagcgggctgcagtggaaaatttaccgacgtttctggtggaactcagcagagtgctggccaaccccggaaactcccaggttgccagggtggcagccggcctgcagattaaaaacagtctcacgtccaaagatcccgatataaaggctcagtatcaacagaggtggctggccattgacgcaaatgcccggcgggaggtgaagaactacgtgctgcagactctgggaaccgaaacatacaggccttccagcgcttcccagtgtgtggctgggatcgcctgcgcagagatccctgtaaaccagtggccagaactgattccacaactggtggctaatgttaccaatcctaactcgaccgagcatatgaaagaaagcacccttgaggctatcggctatatttgccaggacatagacccagaacaactgcaagacaaatcgaacgagatactgaccgccatcattcaggggatgcgcaaggaagaacctagcaataacgtgaagctagcagctaccaacgccctccttaactctctagaattcaccaaggctaacttcgacaaggaaagtgagagacacttcataatgcaggttgtctgcgaggctacgcagtgcccagacactagggtaagagtggcggccctccagaatctggtgaaaatcatgtcgttatactatcagtacatggaaacatatatgggaccagccctttttgctatcacgatcgaggcaatgaagtcagatatagacgaagtggcgttacaagggatagagttctggagtaatgtgtgcgacgaggagatggatttggccatcgaggcatccgaggccgcagagcaaggccggcccccggagcacaccagtaagttttacgccaagggcgccctacagtacctggttccgatcctgacccagacactcaccaagcaggacgagaatgacgatgacgacgattggaacccttgcaaggctgccggggtctgcctgatgcttctggctacgtgctgtgaggacgacatcgttccgcacgtgttaccattcattaaggagcacatcaaaaatccggactggcgataccgcgacgcagccgtcatggcgtttgggtgtattttagaaggccccgagccctcgcagttaaagcctcttgtgatacaggcgatgccaaccctgatcgaattgatgaaggatccctcggtggtagtgcgggataccgcggcctggaccgtgggccgcatttgtgaacttctccccgaagctgctataaatgatgtgtacctggcccccttgttacagtgccttatagaaggcttgagtgctgaacccagggtggccagcaatgtttgttgggcatttagcagtctggccgaggccgcgtatgaggccgccgatgtggccgatgatcaggaagagccagccacatattgtctgtcttccagttttgagctgattgtccagaagctattggagactactgaccgtccagacggccaccagaataacctcaggagcagcgcatacgagtctctgatggagatcgtaaaaaactccgccaaggactgctacccggctgtccagaaaacgaccctcgtcatcatggaacgcctgcagcaagtactccagatggagtctcacattcaatcaacctctgatcggattcaattcaatgatcttcagtctctgctctgtgctacactgcagaatgtgctcagaaaagtgcagcaccaggatgcccttcagatctccgacgtcgtgatggcctcccttctccggatgttccaaagcactgccggctccggtggggtgcaagaggatgctctcatggccgtctccactctggtcgaagtcctggggggcgagtttctgaaatatatggaggcatttaagccctttctcggcattggactgaagaactatgcagagtatcaggtatgtctagcggccgtgggtctggtcggggatctatgccgtgcccttcagagtaatattatccccttttgcgatgaggtgatgcagctcctgttagagaatctcggcaacgagaatgtccatcgcagtgttaagccccagatccttagcgtgttcggcgatatcgcactggctatcggcggggagtttaagaagtatctcgaggtcgtacttaataccttgcaacaggcctcacaggctcaagtcgacaagtctgactatgatatggtagactacttaaatgagttaagggagagttgtcttgaagcttatacaggcatagtgcagggattaaagggtgaccaggagaacgttcatccggatgtcatgcttgtgcaacccagagtggagtttatcttgtccttcatcgatcatatcgccggcgacgaagaccacactgatggtgtggtggcctgcgctgccggcctgattggggatctgtgtacagcctttggcaaggacgtgctgaaactcgtggaggctagacccatgattcatgagctcctcactgaaggcagaaggtctaagactaacaaagccaagaccttggctacttgggccacaaaagagctgcgaaaattgaagaaccaggcctag

SEQ ID NO: 121380 - DNA, 2196 bp, Artificial Sequence
  Description of Artificial Sequence: Synthetic coding sequence
atgaaggaatctactctggaggcaataggttatatctgtcaagacatcgaccccgagcaactccaggataagtctaacgaaatcctgactgccatcatccaaggcatgaggaaggaggaaccatccaacaacgttaaacttgctgccaccaacgctttacttaactcattagaatttactaaagcaaatttcgacaaagaaagcgaaaggcactttataatgcaagtcgtatgtgaagcgactcaatgccccgatactagagtgagggttgccgccttacagaatctagtaaagattatgtccttatactaccagtatatggagacctacatggggcctgccctgttcgcgatcacaattgaggctatgaaatccgatatcgacgaggtggcgctgcagggtattgagttctggagcaatgtgtgtgatgaagagatggatctcgcaattgaagcatctgaagccgcggagcaaggacgtccccccgaacacacttctaagttttatgcgaagggtgcactgcagtatctggtcccaatcctaacccagacgttgaccaaacaggacgaaaacgacgatgacgacgactggaatccatgcaaggccgccggcgtgtgtctaatgctactggccacgtgctgtgaggacgacattgtgccccatgttcttccattcatcaaggaacacatcaaaaacccagactggcggtacagagacgcagctgtaatggccttcggctgtatactggaggggccagagcctagccagctgaagcccctcgtcattcaagccatgccgacgctcatcgaactgatgaaagacccatcagtggtagtgagagataccgctgcctggaccgttggccgcatttgtgaacttctccctgaagccgccatcaatgatgtatatctggctccactgcttcagtgtttgattgagggtctcagtgccgagccgcgtgtggctagtaacgtgtgctgggccttcagctccttagccgaggcagcatatgaagctgccgatgttgccgacgatcaggaggagcctgctacatactgcctgtcaagcagttttgaactgattgtgcagaagctcctcgagaccaccgaccgtcctgatggacaccagaacaacctgcggtcctccgcttacgagtccctgatggagattgtcaagaattctgctaaagactgttaccctgccgttcagaagactactctggtgatcatggaacgcctacagcaggttctgcagatggaaagccatatccagagtacctccgatagaatccagtttaatgacctacagtcactgctatgcgccacattgcagaacgtgctccgcaaggtgcagcaccaggacgccttgcagatcagcgacgtcgtgatggcgtccctgcttcgcatgttccagagcaccgcgggctccggcggtgtgcaggaagacgccctgatggccgtgtcgactttagtcgaggtcctcggcggtgaattcttgaagtatatggaagctttcaaaccatttcttggcatcggtttgaagaattacgctgaatatcaggtatgcttggccgccgtggggctggtgggcgatctctgcagagccctgcaatccaatatcatccctttctgtgacgaagtaatgcagctgcttttggagaatctagggaatgagaatgtgcaccggtccgttaagccacagatactttccgtgttcggtgacatagctctggccatcggaggggagttcaaaaagtatctcgaggtcgtcctgaatacactccagcaagccagtcaggctcaggtggataaatccgattacgatatggtagattatctgaacgagctcagagagtcctgtctggaggcgtacaccggcatcgtacagggtcttaaaggtgaccaggagaacgtccatcctgacgttatgctagtgcagccccgtgtagagtttatactgagcttcattgatcacattgctggcgacgaagatcacacagacggcgtggtggcctgtgccgcaggattgattggtgacctgtgcaccgcttttggcaaagacgtgctgaaattagtggaagctcggcccatgatccatgagctgcttacagagggccgtcgcagcaagaccaataaagctaaaaccctggccacttgggcaaccaaggaactgcgcaagctgaagaaccaagcttag

SEQ ID NO: 121381 - DNA, 1983 bp, Artificial Sequence
  Description of Artificial Sequence: Synthetic coding sequence
atgaaggaaagcactctggaggctatcggctatatctgccaagacattgaccctgaacagcttcaggataaatctaacgagattctgactgccattatacaaggtatgagaaaggaggaaccttctaacaatgttaaactggctgctaccaatgcgcttctcaactctctggagtttaccaaggctaatttcgataaggagagcgagaggcacttcattatgcaggtggtgtgcgaagctactcagtgtccggacaccagagtgcgtgttgccgcactccagaaccttgttaaaattatgtccctgtattatcaatacatggagacctacatgggaccagcgctgtttgcagatgagaacgatgacgacgacgactggaatccttgcaaggccgctggcgtgtgtctgatgttgctcgccacatgctgtgaagacgacattgtgccacatgtgcttccatttattaaagagcatattaaaaacccggactggcggtacagggatgctgcagttatggcttttggatgtatactcgagggccctgagccgagtcaactgaagcctctggttattcaagccatgcctacgctcatcgaactcatgaaggatccttctgtggtagtacgcgacactgccgcctggactgttggtagaatttgcgaattgctcccggaagccgcgatcaacgacgtgtatttggccccactcttgcagtgcctgatcgagggactctccgccgagccacgcgtggccagcaacgtctgttgggcgttcagctcccttgccgaagcggcgtacgaggccgccgatgttgctgacgaccaagaagagcctgccacttattgtttatcgagtagcttcgagctgatcgtgcagaaactgctggaaactactgacagacccgatggacaccaaaacaatttaagatctagcgcttacgaatccctcatggaaattgtgaaaaactcagcgaaggactgttatcctgctgtccagaagacgacgctggttattatggagcgtttgcagcaggtgctgcagatggagagccacatccagtcaacctctgacaggattcagttcaatgatttgcagagtctcttgtgtgcaacgctacaaaatgttctccggaaggtgcagcaccaggacgcccttcagatctccgacgtggtcatggcatcactacttcgtatgttccagtctactgccggatccgggggcgttcaggaggacgcacttatggctgtgagcacattggttgaggttctgggaggggaatttctcaagtacatggaggcgttcaagcctttcctggggatcggcctgaaaaactacgcagaatatcaggtctgcctcgctgctgtaggtctggtgggagacctctgccgggctctccagagtaatattatacctttctgtgacgaggtgatgcaattgcttctcgagaatctgggtaacgaaaatgtccacagatcagttaaaccccagatattaagcgtgttcggggatattgccttggctattgggggagagttcaaaaagtacctggaggtggtgttgaacactctccagcaggcgtcacaggcccaggtagataagtcagattatgatatggtggactatttaaatgaattgcgcgagtcttgtcttgaagcgtataccgggatcgttcaaggtctcaagggagaccaggagaatgtacaccccgatgtgatgctcgtgcagccccgcgtggaatttatcctgtcatttatcgaccatattgccggggacgaggaccatacggacggcgtggtggcttgtgccgctggactaatcggggatctgtgtacggcctttggaaaggatgtgctcaagctggtcgaggcgaggcctatgatccatgaactcctcacagaggggcgccggtccaagactaacaaagcgaagactctggccacctgggcgacgaaggaactgagaaagctgaagaaccaagcctag

SEQ ID NO: 121382 - DNA, 2196 bp, Artificial Sequence
  Description of Artificial Sequence: Synthetic coding sequence
atgaaagagtccacccttgaggctattggctacatctgtcaggacattgatcctgaacaactgcaggataagtcaaatgaaattctcacagctatcatacaggggatgaggaaggaagaaccaagcaataatgtgaaactcgccgcgacgaacgccctgctcaattcattggagttcacaaaggcgaactttgataaggaatctgagaggcacttcatcatgcaggtcgtttgcgaagccacacagtgcccggacacacgcgttagagtagctgcccttcagaacctcgttaagatcatgtctctctattatcagtacatggaaacctacatggggccagctttatttgccataactatcgaggcaatgaagagcgatattgatgaggtggccctccaggggatcgaattctggtcaaatgtgtgtgatgaggaaatggacctcgctatcgaagcctcagaagccgctgaacagggccgaccccccgagcacacttctaaattttatgctaaaggcgctctacaatatctggtccctattttaacgcagacccttacaaagcaggacgaaaacgatgatgatgatgactggaacccctgtaaggccgcaggcgtttgtctcatgctgctggctacatgttgcgaggacgatatcgtaccccatgtgttaccgtttattaaggaacacatcaagaacccagactggaggtatagggatgccgcagtgatggcgttcgggtgtatcttagagggacctgagccatcccagctgaagccattggtgattcaggctatgcctactctgattgagctgatgaaagatcctagcgtggtagttcgtgacacggccgcttggaccgttggtcgaatctgcgagctcctccccgaagcagcgatcaatgacgtgtatctcgcccccttgcttcaatgcctcatcgaagggttaagcgcagaacccagagtggcgagcaatgtttgctgggctttcagcagcctggccgaagccgcgtacgaggccgccgatgtggccgatgatcaagaggaaccagctacttactgtctcagctctagctttgaactcatagtgcagaagctgctggaaaccactgatagaccggacggccaccagaacaacttgagatctagcgcatacgagtcgctgatggagatcgtgaaaaattcagcgaaggactgctatcccgccgtgcagaaaacaaccctggtgatcatggaacgtctccagcaggtattacagatggaatcccacattcagtccacatcagatagaatccaatttaatgatctgcaatccctgctttgcgctacgctacagaatgtgttacgaaaagttcagcaccaggatgcactgcaaatctctgacgtagtgatggcatcactcctccggatgttccagtctacagccggcagcggcggcgtccaagaggatgctcttatggccgtgtctaccctcgtcgaagtgctggggggagagtttttgaaatacatggaggcatttaagcccttcttgggaatcgggctgaagaactatgccgaataccaggtctgcctcgccgctgtgggtctggtgggcgacctatgcagggctctccagtccaatataattccattttgtgacgaagtgatgcaattgttgctggagaatctggggaacgagaatgtccataggtctgtgaagccacagatcttaagtgtgttcggggacatcgccctggcaatcggcggcgagttcaaaaagtacctggaagtggtgctgaatacgttacaacaggcttcgcaggcgcaagtggataagagtgactacgatatggtggactacctaaatgagctccgagaatcctgccttgaggcctacactggcattgtgcagggattaaaaggcgaccaggaaaatgtgcatcctgacgtgatgctcgtgcagccccgcgttgagttcattctgtcgtttatcgaccatatcgcaggtgacgaggatcataccgacggggtggtcgcatgtgctgccggcctcataggtgacttgtgcactgcttttggcaaagatgtccttaagctggtggaagccagaccaatgatccacgagctgttgacagagggacgaaggagcaagacaaacaaggccaagactctggccacttgggcaactaaagaactgcggaagctgaaaaatcaggcctag

SEQ ID NO: 121383 - DNA, 1617 bp, Artificial Sequence
  Description of Artificial Sequence: Synthetic coding sequence
atgactactcctggtaaggagaatttcaggctgaaaagttataagaataagagcttaaatccagacgagatgcgaaggcggagggaggaagaaggcctgcagcttagaaaacagaaaagggaagaacagctgtttaagagacgcaacgtagcgacagccgaggaagaaacggaagaagaggttatgagcgacggggggtttcacgaagcccagatcagcaatatggaaatggcacccggcggagtgattacttccgatatgatagagatgatcttctccaaaagccccgagcagcagctaagcgccacacagaaatttcgtaagctactgagtaaagagccaaaccccccaatcgatgaggtgattagcactccaggcgtggttgctcgattcgtggagttcctgaagagaaaggagaactgtaccctacaattcgagtccgcctgggtcctgacaaacatcgctagtggcaattccttacaaactagaatcgttattcaagctggtgccgtgcctattttcattgagctgttgtcctctgagttcgaggatgtgcaggagcaagccgtgtgggccctggggaatatcgcgggggattccacgatgtgtagagattacgtgcttgattgtaatatcctgcctccactgctccagttattctccaaacagaataggctgacgatgacaaggaacgcggtctgggctttgtctaacctgtgccgggggaagagccctccgcctgaattcgctaaagtctccccatgcctgaatgtgctcagctggctgctgtttgtgagcgacactgacgtgctggctgatgcctgctgggctttatcttacctgtccgacggtcctaatgataagatccaggccgtgatcgacgcaggggtatgccggcgtttagtggagttgctcatgcacaacgactataaagtcgttagccccgccctgcgcgctgtcggtaacatcgttaccggcgacgatattcagactcaagtgatcctgaattgcagtgcactgcagagcttgctgcatcttctttctagccccaaggaatccatcaaaaaggaagcatgctggaccatctccaatattacagccgggaatcgcgcccagattcaaacagtcattgatgcgaacattttcccggccttgatctctatcctgcagactgcggaattcagaacaaggaaggaggccgcgtgggctataaccaatgctacatccggcggctctgcggaacaaattaagtacctcgtggagctggggtgtatcaaacctttgtgtgatctgctcactgtcatggactccaaaattgtccaggtggcactgaatgggctggaaaatatcctcagactcggagaacaagaggctaagaggaacggcacaggaattaatccctattgtgccctgattgaggaggcctatggactggacaaaatagaattcctgcagagccacgaaaaccaggagatctaccaaaaggcattcgatttgatcgagcattatttcggcactgaggatgaggacagtagcatcgctccccaggtggatctgaaccagcagcaatatatttttcagcagtgcgaagctcccatggaaggttttcaactttag

SEQ ID NO: 121384 - DNA, 987 bp, Artificial Sequence
  Description of Artificial Sequence: Synthetic coding sequence
atgacaaccccaggcaaagagaacttccgtctgaagtcttataagaataagagcctgaaccccgatgaaatgcgcaggcggcgggaggaggagggtttacaactgaggaagcagaagcgtgaagagcagctcttcaaacgacgcaatgtcgcaactgccgaggaggagactgaggaggaggtcatgtctgacgggggattccacgaggcccagatctctaacatggagatggccccaggaggagtgatcacgtctgacatgatagagatgatcttcagcaaaagcccggagcagcagttgtctgcaacgcaaaagtttagaaaactgttgtcaaaggagcctaacccccctattgacgaggtaattagcacaccaggcgtagtagctaggttcgtggagttcttaaaacgcaaggagaactgcacactacaatttgaaagcgcgtgggtgctcacaaatattgcctctgggaatagcctccagaccaggatagttattcaagctggcgctgtcccaatcttcattgaactgctttcctccgaatttgaggatgtgcaagagcaagccgtgtgggcactaggaaatatcgcaggagactccacaatgtgccgggattacgtgttggactgcaatattttgcctccgcttttacagttgttctccaagcagaatcggctgaccatgactcgcaacgcggtgtgggccctctcgaacttgtgcaggggtaagtcacctccccctgagttcgcaaaggtttccccttgcctgaacgttctctcttggttattgtttgtgtccgatacagacgtcctcgctgacgcctgttgggccttgtcttacttgtcagacggccccaacgacaaaatacaagctgtgatagatgcaggagtgtgtcgccgattggtagaactgctgatgcataacgattacaaggtcgtctctcccgcactcagggccgtgggcaacatcgttaccggagacgattag

SEQ ID NO: 121385 - DNA, 648 bp, Artificial Sequence
  Description of Artificial Sequence: Synthetic coding sequence
atgactactcccggtaaggaaaattttaggttgaaatcctataagaataaaagccttaaccctgatgagatgcgccgaaggagggaagaggagggattgcagctgcgaaaacaaaagcgtgaagaacagctcttcaagcgaaggaacgtagcaacggcggaggaggaaactgaggaggaggttatgtccgacggcgggtttcacgaggcacaaatttctaacatggaaatggccccaggcggtgtgatcacaagcgacatgattgagatgattttctctaagtcgcctgaacagcagctcagtgctacacagaaatttcggaagctgctcagcaaagaaccgaatcccccaatcgacgaagtaatttcaacaccaggcgtggtagcacgattcgtggagttcctgaagagaaaggagaattgtacgctgcaatttgagagcgcctgggtgctgacaaacattgccagcggtaactcccttcaaactcgcatcgtcattcaggctggtgcggtacccatcttcatcgaactgctgtcaagcgaatttgaggacgttcaggagcaagcggtctgggcactggggaacatagcaggtgactctactatgtgccgagattatgtgctggattgtaacatcctgcccccatag

SEQ ID NO: 121386 - DNA, 525 bp, Artificial Sequence
  Description of Artificial Sequence: Synthetic coding sequence
atgaccacacccgggaaggaaaacttcaggctcaaaagctataaaaataagtctttgaatccagatgagatgagacggcgaagggaggaggaaggtctgcaactgcggaagcagaagcgtgaggaacagctgtttaagagacggaatgtggccaccgcggaagaggagacagaagaggaggtcatgtcggatggtgggttccacgaggctcagattagtaatatggagatggctccgggcggagtgattaccagcgacatgatcgaaatgatcttctctaaatcacccgagcagcagttaagtgcgacccaaaagtttcgcaagcttctcagtaaagaaccaaacccgccaatcgatgaagtaatatctacaccaggggttgttgcacggtttgtggaattcctgaagcggaaggaaaattgcacgctgcagtttgagagcgcatgggtgttaaccaatattgcttccggcaattctctgcagactcgtatcgtgattcaggctggagctgttccaatcttttag

SEQ ID NO: 121387 - DNA, 1566 bp, Artificial Sequence
  Description of Artificial Sequence: Synthetic coding sequence
atggcagagaacccttctctagagaatcaccgaatcaagtcatttaagaacaaaggcagggatgtcgagacaatgagacgtcaccggaacgaggtgaccgttgagctgcgaaagaacaagagggatgagcatctgttgaagaagcgaaatgtgcctcaggaggagtctctggaggactcagacgtggacgctgactttaaagcccaaaatgttactttggaagcgatccttcagaatgccacaagtgacaaccctgtggtgcaactcagtgcagtgcaggctgccagaaagctgctgtcgagtgatcggaacccccccattgatgacctgatcaagtctggaattctcccaatcttagtcaaatgcctcgaaagggatgacaacccctcattgcaatttgaggccgcgtgggctttgaccaatattgcctccggtacctctgcccagacgcaggccgtggtacaatctaacgcagtaccgctgttcttacgcctcctaaggagcccccaccagaatgtctgcgagcaggccgtatgggctctgggcaacatcatcggtgacggaccccagtgtcgagattacgtgatttctctgggggtcgtcaagccgctcctctcttttatatccccttctatcccaattaccttcttgaggaatgtgacatgggtcatcgtgaacctatgtagaaacaaggacccccccccgcctatggaaactgtgcaggaaatactccccgcactttgcgtgcttatttatcatacagatatcaacattttagtggatacagtgtgggcccttagttatctaacggatggggggaatgagcagatacagatggtcatcgattcgggcgtggtgccgtttctagtgccgctgttgagccaccaggaggtcaaggtgcaaacagcggcacttagagccgtcggaaacattgttaccggcacagatgagcagacccaggttgtgctcaactgtgacgtgctctctcactttcccaatctactgagccatcccaaggagaaaataaacaaggaggccgtgtggttccttagcaatatcaccgccggtaaccagcagcaggttcaggctgtgattgatgccggactgattcccatgatcattcaccaactagcaaagggggacttcggcactcagaaggaagctgcatgggctatatcaaacctgaccatctcaggtcggaaagaccaggtggagtatcttgtccaacaaaacgtcatccctccgttctgtaatttactgtccgttaaggactcacaggttgtccaggttgtgctcgatgggttgaaaaatatcctaataatggctggtgatgaggcctctacaattgctgagataatcgaggagtgcggcggcctcgagaagattgaggtgctacaacagcacgagaatgaggatatctacaagcttgcttttgaaatcattgaccaatacttctctggcgacgacatcgatgaggatccatgtctcattcctgaggcgacacagggcggcacatacaactttgatcctacagccaacttgcagaccaaggagttcaatttttag

SEQ ID NO: 121388 - DNA, 1566 bp, Artificial Sequence
  Description of Artificial Sequence: Synthetic coding sequence
atggcagataatgagaaactggataaccagcgcttgaagaatttcaagaataaaggaagggatttagagacgatgagacgccagcgaaacgaggtcgtggtggagttgcgaaagaacaagagagacgagcatctcttaaaaaggcggaacgttcctcacgaggatatttgtgaagacagcgacatcgacggggactatagagtccagaacacctccctcgaagctatcgtccagaatgctagtagtgacaaccaggggattcagctgtctgctgtgcaagccgcaagaaagttgctgtcctctgaccggaatccacctatcgatgatctcataaagagcggtatcctgcccatcctggttcactgtctggaaagagatgataaccccagcctgcagttcgaagcagcgtgggcattgacgaatattgctagcggcacaagtgagcagacccaagccgtagttcagtctaatgctgtgcctctttttttgcggctgctgcacagtcctcatcaaaacgtctgcgagcaggctgtgtgggccctgggcaacatcattggagatggtccccaatgcagagattatgttatatccctcggcgtagttaagccactgctgagctttatcagcccttctataccaattacgtttctgaggaacgtaacctgggtcatggtgaatctgtgccgccacaaagaccccccccctccaatggaaaccatccaggagattttgccggccctctgcgtcctcatccaccacacagacgtgaacatattagttgacacggtttgggccctgagctatcttactgacgcagggaatgagcagatccagatggtgatcgattcaggcatagtgcctcatctggtgcccctgcttagccatcaggaggtgaaggtgcagacagcagccctgagggccgtagggaacattgtgactgggaccgatgaacagacacaggtggttcttaattgtgatgccctttcacactttcccgcattactgacacaccctaaggaaaaaattaacaaggaagcagtgtggttcctgagcaacatcactgccggaaaccagcagcaagtccaggcagtaattgatgctaacttggtccctatgataatccatctcctggacaaaggagactttggtacccagaaggaagccgcatgggccatttcgaacctgacaataagcggcaggaaggatcaagtggcctacctgatccagcaaaacgtcatccccccattttgcaatctgttaacagtcaaagacgctcaggtggtacaagttgtcctggatggcctgagcaacatcctgaaaatggccgaagacgaagcagagaccatcggtaatctcatcgaggagtgtgggggcctggagaaaattgaacagctccagaatcacgaaaatgaagacatctataaattggcctacgagattattgaccagttttttagttctgatgatatcgatgaggaccctagcctcgtacccgaggccatccagggaggaacctttggctttaattcatcagctaacgttccaactgagggtttccagttctag

SEQ ID NO: 121389 - DNA, 1551 bp, Artificial Sequence
  Description of Artificial Sequence: Synthetic coding sequence
atgcctacgctagacgcccctgaggagcggaggagaaagtttaaatatagaggtaaggatgtgtctcttcggcggcagcagcgaatggcggtgtccttagaactccggaaagcaaaaaaagatgaacagacactcaagcggagaaatattaccagtttctgtcctgacactcctagtgaaaagacagcaaaaggtgtggcagtttcactgacacttggtgaaataattaaaggagttaattcatcagatcctgtgctgtgtttccaggccacacagactgcacgcaaaatgttatcccaggagaaaaaccccccactgaaattggtcatcgaagccggcctgatcccccgaatggtggagtttctgaaatcgagcctctacccttgtttacagtttgaggcagcatgggccctcacaaacatcgcaagtggcaccagtgagcagaccagggccgtggtggagggtggcgccatccagcctctcatcgagttgctgagctcaagtaatgttgccgtgtgcgagcaggccgtctgggctctcgggaatatcgccggagatgggcccgaatttcgggacaacgtcattacatcaaatgccatacctcacctcctggcactcatttcccccacactgccgataacgttcctccgaaatatcacatggactcttagtaacctgtgccggaataaaaacccttatccttgtgataccgcggttaagcagattctgcctgccttgttgcatttactacaacaccaggattctgaagtactcagcgacgcctgctgggcccttagctatctgactgacggctcaaacaagcgtatcggacaggttgtcaatacgggagtgctgccccggctggttgtgttgatgacttcaagcgaactcaatgtactaactcccagtctgaggacagtcggaaacattgtgactgggacagatgaacagactcagatggctattgatgccggaatgctgaatgtgcttcctcaactacttcagcataacaagccctccattcaaaaagaggccgcatgggcactatctaacgttgcggccggtccctgccaccatatccaacagttactggcttatgatgttctacccccactcgtggccctattgaaaaatggtgagttcaaagtgcagaaggaagccgtttggatggtggccaattttgccactggcgcaaccatggatcagctgatccagctcgtgcatagcggagtgctcgagcccctcgtcaacctactgaccgctcccgatgtgaagattgtgctgattatactcgatgtgatttcttgtatcctgcaggccgccgagaagagatctgagaaagaaaatttgtgtctgctgattgaagaattgggcggcatagataggattgaagctcttcagttgcacgagaaccggcagattggacagtccgcccttaacatcattgagaagcattttggtgaggaggaagatgagagccagacactactgtcgcaggtgatcgatcaggattatgaatttatcgattacgagtgcttagcaaaaaagtag

SEQ ID NO: 121390 - DNA, 3318 bp, Artificial Sequence
  Description of Artificial Sequence: Synthetic coding sequence
atggccgccatggccccagctctgactgacgctgcggcggaggcacaccacattcgtttcaagttagcccctccatcctcaaccttatcgccgggaagcgctgagaataatggaaatgccaacatactgattgccgccaatggcacgaaacgaaaggccatcgcagcagaggatccgtctctggacttccgcaacaatcccacaaaggaggaccttggcaaactgcaaccgctggtggcctcatatctgtgctctgatgtaacgagtgtgccttcaaaagagagtctgaaactccagggggtcttcagtaaacagaccgttctgaagtcacaccctctgctgtcccagtcatatgaactgcgcgcagaactgctgggaagacagccggtccttgagtttagcctcgagaatctccggaccatgaacacctccggccagacagcactcccccaagcccctgtgaatgggttggctaagaaactgacgaagtcatctacacacagcgaccacgataatagcacgagcctcaacggcggaaagagggctctgacttcctccgccttgcacggcggagagatgggcggcagcgagtcgggagacctgaaagggggtatgaccaactgtacgctcccccacagaagtcttgacgtcgaacacaccactttgtatagcaacaacagtaccgcgaacaagtcttcagtgaattcaatggagcagcctgcattacagggtagctcacgactatcacccggcacagactcgagcagcaatctgggaggcgtcaagctggagggcaagaaatcaccgctcagctcgattctgttttcggccctcgatagtgacacgcggatcaccgccttacttcggcggcaagctgacatagagagccgcgccagaaggcttcagaagaggttgcaggtagtgcaggctaaacaggtggaaagacacatccagcaccagcttggtgggtttctggaaaagaccctatcaaaacttcccaatctcgaatccctgcgaccaagatcccaattgatgcttacccggaaggcagaggccgccctgaggaaagccgcttccgagaccaccacgtctgagggcctgagtaacttcctgaagtcaaacagcatcagcgaagaactcgagcgcttcacggcctccggtatcgcaaacttgcgctgtagtgaacaggcgttcgatagtgacgtgactgattccagctccggtggtgaatccgatatagaagaagaggaactgacccgggccgatcctgagcagcgccacgtgcctttacgtagacgaagcgagtggaaatgggcagcagatagagcagcaatcgtgtcacgctggaattggctccaggcacacgtgtccgatttggaatataggatcaggcaacagaccgacatctacaaacaaattcgtgccaacaaaggattgattgtgctgggagaggtgccaccacctgaacacaccacggatctgtttctacccctgagcagtgaggtgaaaacggaccacggaactgataagctcatcgaatcagtcagccagccactggagaatcacggcgcccgtattatcgggcacatatctgagtccttaagcaccaagtcttgcggagcgctgaggcccgttaacggggttattaacaccctccagccagtgctagcagatcacatacctggcgactcttccgatgccgaggagcagctgcacaaaaaacagaggctgaaccttgtttcttcctcttctgacggcacgtgcgttgctgcacgaacacggcctgtgctgtcttgtaagaaacggcgccttgtccgtccaaacagtattgtacctctctccaagaaagtacatcgcaatagcacgataaggcctggatgcgacgtaaacccatcatgtgccctctgtggttctggctccattaatacaatgccacctgaaattcactacgaagcaccccttctggagaggttatcccagctcgatagttgtgttcatccagtactggcctttccagatgacgtgcccacttctctccattttcagagcatgctcaagtcccagtggcagaataagcctttcgataaaatcaagcccccaaagaagctctctttgaagcacagggctcccatgcccggaagcctgcctgatagcgcaagaaaagacaggcacaagcttgtttcatcctttctgacaacagcaaaactcagtcaccatcaaacccgtccggatcggacgcacaggcagcacttagacgacgtgggcgcggtgccaatggtggagagagtcactgcgcctaaggccgagcgactgttaaatcctcccccccctgtgcacgatcctaatcactcaaaaatgaggctgagagaccactccagtgagcgtagcgaagtgttgaagcatcacaccgacatgtcatcatcttcttatcttgcggccacacatcatccaccccattctcccttagtcagacagctgtccaccagctctgacagccccgcacctgcatcctcctctagtcaggtcacggcaagtactagtcagcagccggtcaggaggagaaggggcgagtcaagcttcgatattaataacattgtgatcccaatgagcgttgccgccactacacgggttgaaaaactgcagtataaggagatcctgacacctagctggagagaagtggacctgcagtcgctgaaaggttcgccagatgaagaaaacgaggagatcgaggacctgtcagatgccgcttttgcggcgctgcacgccaaatgcgaggagatggaacgagcaagatggctgtggactaccagcgtcccccctcagcggcggggaagtcgttcatacaggagcagcgacggcagaacaaccccgcagctgggcagtgcaaatccttccactcctcaaccggcatctcccgatgtgtcctcctcacacagcttgtcagaatacagccatggacaatcccctagaagcccaatctcacctgagttgcactccgccccccttacgccagttgcgagagatactcccaggcacctcgctagtgaggacacgcgctgctctaccccagaactcgggctggacgagcagagtgtccaaccttgggagcgtagaacctttcctctggcccattctccacaagccgagtgcgaggaccagctggacgctcaggagcgagctgcccgttgcacaagacgcacctctggttccaaaaccgggagagagactgaagccgccccaacatcccctccaattgtgcccttgaaatcacggcatctggtggctgccgcaacagcccaacggcccacccataggtag

SEQ ID NO: 121391 - DNA, 1200 bp, Artificial Sequence
  Description of Artificial Sequence: Synthetic coding sequence
atgccacctgagatccactacgaggcgccactcttggagaggttatcacagctggattcctgtgttcaccctgtgcttgccttcccagacgacgtccccacctccctgcatttccagagcatgttgaagtcacagtggcagaataagcccttcgacaagattaaaccgccaaagaagctaagcttgaagcatagggcgcccatgcctggctcccttcctgacagcgccagaaaagaccgccacaagctggtctcaagttttctgactacagcaatgctgaagcaccatacagacatgagcagcagctcatatctggccgctacccatcacccacctcactcccccctcgtgaggcaactgagcacttcatcggacagtcccgctccggccagctcatcttcgcaggttactgccagcacgagccagcagcccgtgcgccgccgcaggggcgagagcagctttgacatcaacaatatagttatccccatgagtgtggccgctactacacgggtggagaaacttcagtacaaagaaatcctaacaccctcctggcgtgaggtggatctgcagtccctgaagggaagccctgatgaagagaacgaggagatagaggacctgtccgatgccgctttcgcagccctgcatgccaaatgcgaggagatggagagagcccgctggctgtggactacttctgtccctccccagcggagggggagccgatcctatagaagttcagatggacggacaacacctcagctgggatccgccaatccctctactccgcagcccgcaagcccagatgtcagctcgtcccattcactgtcagaatattcccacggccagagtccacgtagcccgatcagcccagaacttcattccgctcctttgacccctgtggctcgtgacaccccccggcatctggccagcgaggatacacggtgtagcacccctgaactggggttggacgagcagagcgtccagccatgggaaaggaggacttttcctcttgcccattcgccccaggctgagtgtgaggatcagctggacgcccaggaaagagcggctcgctgcacgcggaggacatcaggatccaaaacaggacgagaaaccgaggcagcgcccaccagcccacctatcgtgcccttgaagagcagacacctcgtcgcggccgccacagcccagcggccaacacaccggtag

SEQ ID NO: 121392 - DNA, 3318 bp, Artificial Sequence
  Description of Artificial Sequence: Synthetic coding sequence
atggcagccatggctccagcactgactgacgcagccgcggaggcccaccatatcaggttcaagctcgctcctccttccagcacactgagtcctgggtccgccgagaataatggcaacgctaacatactcatcgccgccaacggtaccaaaagaaaagcgatagccgcagaagatcccagtttggactttaggaataatcccaccaaggaggaccttggaaagctgcagccactggttgcaagttacctttgttccgacgtgacgagcgtgcctagcaaagagtcattgaaactccagggcgttttcagcaagcagacagtgttgaagtcccaccccctcttatctcagtcttacgaattacgcgccgaactgttgggacgacaacctgtcctagaattctccttggagaacctccgaaccatgaacacatctggccagactgcgctaccccaggcgcccgttaatgggctggccaagaagctcacaaagtcttctacccactcagaccatgacaactccacaagtctgaacggggggaagagagctttgactagctctgctctccacggaggtgaaatggggggcagcgagtctggggacttgaaggggggaatgacgaactgtacactaccacaccggtcgctagacgtcgagcacaccaccctgtacagcaataacagtactgccaataaatcatctgtgaactcgatggaacaacccgctttgcaggggtcttccaggctcagccctggcaccgattccagttccaacttaggaggggtaaagctggaaggaaagaagtctccactgtcctcgatcttattctcggccttggattccgacacaaggatcacagccctcctgcgccgccaggccgatatagaaagccgagctcgccgactccagaagagattgcaggtggtccaggcaaaacaagtagaaaggcacatacaacaccagcttggaggattccttgaaaaaactctatctaagctccctaaccttgaatctttacgacctcgctcgcagctcatgctgactagaaaagccgaagcagccctgaggaaggcagcctctgaaactacgacctctgaaggacttagtaactttctcaaatcaaactcaattagcgaggaactggagagattcaccgcatcagggatagccaacttgcgctgttccgagcaggcttttgattccgacgtgactgatagctcatccggcggagaaagcgacatcgaagaagaggaactgacaagggctgaccctgagcagcgtcatgtccctttacgacggcgatctgagtggaaatgggccgcggatcgagccgcaattgtgtcacggtggaattggctgcaagcccacgtgtctgatctcgaatacagaattaggcaacaaacagatatatacaagcagatccgcgcaaataaaggtttgatcgtgttaggggaggttcctccgccagagcatacgacggatttgtttctgccactgagtagcgaggtgaagactgatcacggcactgacaaactcatcgaatcagtcagccaaccgctcgagaatcacggcgctcgcattatcggccacatctctgagagcttgtccaccaaaagctgcggagctctgagacccgtcaatggcgtgattaacactcttcagcccgtcttagcagaccatattccaggggatagctcagacgccgaagagcagctgcataaaaagcagcgactgaatctggtgagctctagtagcgacggaacttgtgtggcagccaggactcgccccgtactatcttgcaagaaaagacggttggtaaggcctaactcaattgtaccactgtctaaaaaagttcaccggaacagtacaatacgcccagggtgcgacgtaaatccatcatgtgcgctttgcggtagtggcagtattaataccatgccaccggagatccattacgaggcccctctgctcgaacggctgtcccaactcgattcctgtgtgcatcctgtcctggcattcccagacgacgtgccgacatcattgcacttccagtctatgctgaaaagccagtggcaaaacaaaccgtttgacaagatcaaaccacccaagaaattgtccctgaagcacagagcgccaatgccagggtccctgcctgactccgcgcgtaaggacaggcataaactagtttcttcatttttgacaaccgcaaaactgtcgcaccatcagacacggccggatagaacccacaggcagcacctcgatgatgtgggagctgtcccaatggtagagagggtgaccgcccccaaagccgagcggttgctcaatcctcctccacccgttcacgatcctaatcacagcaaaatgagactgcgagatcatagctcagagaggagcgaagtgctgaaacaccatacagacatgagcagtagcagctacctcgccgcgacgcaccaccccccgcattcccccttggttcgccaactcagtacctcatcagatagccccgcacctgcatcttcttcatctcaggttacagcctctaccagtcagcaaccagtgcgtaggcgcaggggagagagttcttttgacatcaacaatatcgtgataccgatgagcgtcgctgctacaacacgagtggagaaactacaatacaaagaaatactgactccttcctggcgcgaagtcgatctccagtcactgaaaggtagccccgacgaggagaatgaggagatcgaagacttgagcgacgctgccttcgcagcactacatgctaaatgtgaggagatggaacgggccaggtggctctggactacatcggtgccaccgcagaggagagggagcagatcctaccgctcctccgatggacgaactaccccacagttgggctctgccaatccgtcgacccctcaacctgcgtccccagacgttagcagcagtcatagcctgtccgagtattcccatggtcagtcccctcgatctccgataagccccgagcttcattcagccccccttacacccgtggcgcgggacacgccccgccaccttgccagcgaagacactcgttgttccacacctgagctgggcttggatgagcaatctgtgcagccctgggagagacgcacctttcccttagctcacagtccccaggcagagtgcgaagatcagttagacgctcaggagagagccgcgcgctgtacgagaagaacatcagggtcgaagactggaagggagacggaggcagccccaacgagcccccccatcgtgccattaaagagtagacatttagttgctgcagcgaccgcacagcgccctacccacagatag

SEQ ID NO: 121393 - DNA, 3318 bp, Artificial Sequence
  Description of Artificial Sequence: Synthetic coding sequence
atggccgccatggcccccgccctaacagacgctgccgcagaggctcaccacatccgctttaagctggctcctcccagcagcacactgagccctggcagcgctgagaacaatggtaatgctaatattctaatcgccgcaaacggaactaaacgaaaggcaatcgccgcagaggacccatctttggacttccggaacaaccctacaaaggaagatttggggaaactacagccactggtcgcttcttacctctgctcagatgttacttccgtcccatctaaagagagcctgaaactacagggggttttctctaagcagaccgttctgaagagccaccctctcctgtcccagagctacgagcttagagcagagttgctggggcgccagcccgtgttggaattctccctcgaaaacctgaggactatgaacacatcaggacagaccgcgctgcctcaggctcccgtgaatggactggctaaaaagctgacaaagagctcaactcacagtgatcatgacaacagtacctctctcaacggaggaaaacgcgctttgaccagtagtgctttacatgggggagagatgggggggtccgaaagtggggacttgaaggggggaatgactaattgcacactccctcacaggagtttggacgtcgagcacacaaccctgtactctaataattccaccgcaaataagtcctctgtgaatagcatggaacagcccgccctccaggggagctcaaggctctctcctggcaccgattcgagtagcaatctgggaggggtcaaattggagggaaaaaaatcaccgctatctagtatactattcagtgctctcgattcagacacccggatcaccgcactgctgaggagacaggcagatattgaatctagagcccgccgattgcagaagagactgcaggtggttcaagctaagcaggtagagcggcatatccagcaccagcttggaggatttcttgagaagactctctccaaactaccaaatctagagtcgctcaggcctcgatcccaactcatgttgacccggaaagctgaagcagctctgcggaaagctgccagcgaaacgactacatctgaagggttgtcaaactttcttaaatcaaactctattagcgaggaattagagcgtttcaccgcctcaggaatagccaacctgcgatgttcagagcaagcatttgattctgatgttacagactcctcctcaggtggcgaatccgacatagaggaggaggagttgactcgtgcagacccagaacagagacacgttccccttagaaggcggtcagaatggaaatgggccgcagatcgcgctgctattgtgtccaggtggaattggcttcaggcccatgtgtcggacctggagtaccgcatccgccagcagactgatatttacaagcagattagagctaataaagggctgattgtgctgggggaagtccccccacctgagcataccaccgatctctttctgcctctgagttcagaggttaaaaccgatcacggcactgacaagttgatcgaaagtgtgagtcaaccgctcgaaaaccacggcgcacggatcatagggcatataagcgaaagcctatctactaaaagctgcggggctctgcggcctgtgaatggcgttattaataccctgcagcctgtcctcgccgatcatatcccaggagatagcagcgacgctgaggagcagctgcacaagaagcaacgactgaaccttgtgagctcgagctctgatggtacctgcgtagcagcccgtactcggcctgtgctgtcttgcaagaagagaagactcgtgcggcctaattcaatcgtccccctctccaagaaggtacaccgtaacagtacaattcgccctggatgcgatgtgaatccgtcttgcgccctgtgcggtagcggtagtatcaacacaatgcctccggaaattcattacgaggcaccacttctcgaaagactaagccaactcgactcttgcgtgcatcctgtgctggcattccctgatgacgttcctacttcattacacttccagagcatgcttaagagccagtggcaaaataagccattcgataagatcaagccgccaaagaagctctcccttaaacacagggccccaatgccaggttcgctgcctgatagtgccagaaaggatcgtcacaaactggtgagcagttttctgactacagccaaactcagccaccatcaaacgcgtccagatcgcacgcatagacagcatctggatgatgttggggccgtcccgatggtggagcgcgtcactgccccgaaagccgaacgcttattaaaccctccgcctccagtgcacgatcccaaccactcaaaaatgcgccttcgagaccatagctcagaacggtctgaagtgttgaaacaccacactgacatgagttcttcctcttacttggccgccactcatcacccaccacattcaccacttgtaagacagttaagtactagtagcgacagtccagcgccggctagcagctccagccaggtaacggcgagcacctcccaacaaccagttagaagacgaaggggagagtctagttttgatataaataacatagttatccctatgagcgtcgccgcaactactcgcgtggaaaagctgcagtataaagaaatcctgacacccagctggcgggaagtggaccttcagagcctgaagggcagcccagacgaagagaatgaagaaattgaggacctctccgatgcggcttttgccgccttgcacgcaaagtgtgaagagatggagcgggctagatggctctggaccacgtcagtgccccctcagcgccggggctctcgcagctatagaagttctgacggccgcactacgcctcagctggggtccgctaacccctctactccacagccagcctcacctgatgtcagttcctcccactcactgtcagagtatagccatggccaaagtcctcgatcccctatatccccagagctgcactccgctccactcactcccgtcgccagagacacgcctcgtcatctcgcctccgaggatacgcgttgctccacacccgaactcggtctggacgagcagtctgtgcagccatgggaacgccgaacctttcctttggcccatagccctcaggccgagtgtgaagaccaactcgatgcacaggagcgcgctgcaagatgtacaaggaggacaagtggaagtaagactggcagggaaacagaagcagcacctacaagccctcccatcgtaccccttaagagtcggcacctagtggccgcagcaaccgcacagcgtccaacacatcgctag

SEQ ID NO: 121394 - DNA, 3318 bp, Artificial Sequence
  Description of Artificial Sequence: Synthetic coding sequence
atggcggcaatggctcccgcgttgacagatgccgctgccgaggctcaccatatcaggtttaaactggcacccccctcgtccactctatccccaggcagcgctgaaaacaatggcaacgccaacattcttattgccgccaatggcaccaaacgcaaagcaattgctgccgaggacccatcacttgattttaggaataatcccactaaggaggacctggggaagctgcagcctctcgtcgcgtcttacctgtgttcggatgtcactagcgttccatctaaagagagcctgaaactccagggagtatttagtaaacagactgttttgaagtcacaccccttacttagtcaatcctacgaactgagggccgaattactcgggcgtcagcctgtactggaatttagtttggagaacctcagaacaatgaacacatccggccagaccgccctgcctcaggctcctgtcaatgggctggcaaagaagctcaccaaaagcagtacccatagcgatcatgataattctacatcactcaatggcggcaagagggcccttacatcaagtgcacttcacgggggagaaatgggcggtagtgagtccggagacctgaaaggcggcatgacaaactgcactctgcctcacaggtccctcgacgtggagcatacaacactgtactccaataatagtactgcgaacaaatcctcagtcaattctatggagcaaccagctttgcaaggttcatccaggctcagtcctggtaccgactcgtctagcaatctcggcggggtgaagctcgaagggaaaaaatctccactgagcagcattctgttttcagcactggattctgacacccgcataaccgcccttctgagaaggcaggctgacatcgaatctcgtgcaagaaggctgcagaaacgattgcaggttgtacaagctaaacaggtggagcggcacattcagcatcagctcggcgggttcctcgagaagaccctgtcaaagttacctaaccttgagagcctacggcctcgctcccagctgatgctgaccagaaaagcagaggcagctttgcgcaaggctgctagtgagacaacaacatccgaggggctgagcaactttctgaaatctaacagtatatcggaggagctagagaggttcacggccagtggcatagctaacttgcggtgtagtgaacaagcgttcgattccgatgtgaccgatagtagcagcggcggggaatcagacatagaagaggaggagttgacaagagcggaccctgagcaacgccacgtgcctcttaggcgcaggagtgaatggaagtgggccgccgaccgagctgccatcgtctctcggtggaactggcttcaggcgcatgtgtccgaccttgagtaccgtattcggcagcagacagacatctataagcagatcagagctaacaaggggctgatagtgctgggggaggttccgccacccgagcatacaaccgacttgttccttccactgagctctgaagtcaaaacagaccatgggacagataaactgatcgaatctgtatctcaaccccttgaaaaccacggcgcccggattatcggccatatatctgagtccttgagcaccaagagttgtggagccttaaggcctgtgaacggagtcatcaacacactccaacccgttctcgccgaccacatccccggagatagtagtgacgccgaggaacaactacataagaagcagaggctgaacctggtttcctcctcttctgacggaacttgcgtagccgccaggactaggcctgtactcagctgcaagaaaaggcgactcgtgcgacccaatagcattgtccctctcagtaaaaaggtacaccgtaactctacaattagaccgggttgcgacgtaaatccttcctgcgctctctgcgggtcaggaagtatcaatactatgcctcctgagattcattatgaagcccccttgctcgagcggttgtcccagcttgacagttgtgtgcatcccgtcttggcgtttcctgacgatgtacccacatctctgcatttccaaagcatgttaaagtcacaatggcagaataaaccctttgataaaatcaaaccgccgaaaaagctctcattaaagcacagggccccaatgcctggttcactgcctgactccgctcggaaggatagacacaagctggtctctagctttttaacaacagcaaagttgtcgcaccaccaaacacgtcccgatcgaactcaccggcaacatctggatgacgttggcgccgttcccatggtggaaagggtaaccgcccccaaggcagagagactcctaaaccccccaccgcctgtacacgatcccaatcactcaaaaatgaggttacgcgaccactctagtgagagatccgaagtactaaagcaccatacagatatgtcttctagttcatacttggccgcaacccatcaccctccgcactcgccgctagtcaggcagctctccactagctcggattcacctgcacctgcctcttcgagctcccaggtgactgcaagcacaagccagcaaccggtccgccgtagacgtggtgaatccagttttgacatcaacaatatagttattccaatgagtgtcgcagccactactcgtgtggagaagctgcaatacaaggagatcttgaccccgagctggcgggaagtagatctgcagtctttaaaggggagtccagatgaggagaatgaggagatcgaggacctgagcgacgccgcatttgcggccctgcatgcaaagtgcgaggaaatggagagagctagatggctatggactacatcggtaccgccgcagcggagaggctctcgcagttaccggtcaagtgacggcagaaccactccccagctgggctcagcgaatccttccaccccccagccagctagccccgacgtttcatcatctcactccctctccgaatacagtcatggacaatcgccgcgtagcccgatctccccggagctccattcggcccccttgaccccggtcgccagggacacacctagacacttggcttctgaagatactagatgcagtacccctgagctgggacttgacgaacaatcagtgcaaccgtgggagaggcgcacctttcccctcgcccactccccacaagctgaatgcgaggaccagctggacgctcaagaaagggccgctaggtgcacaagacggacatccgggagtaagaccgggagagagaccgaggctgctccgacgtccccaccaatcgttcccctgaagtccagacacctggtcgcagccgccacagctcagagacctacccaccgttag

SEQ ID NO: 121395 - DNA, 936 bp, Artificial Sequence
  Description of Artificial Sequence: Synthetic coding sequence
atgagtttgttgatgatcagcgaaaatgttaaactggcccgggaatatgcgctgcttggcaattacgatagtgccatggtttactaccagggcgtgttagaccagatgaataagtacctttatagcgtgaaggatacctatcttcaacaaaaatggcagcaagtctggcaagaaatcaacgtcgaagccaagcacgtgaaagatattatgaagacgttggaatctttcaagttagattctacccctctcaaagccgctcagcatgacctgcccgcatccgagggagaagtgtggtccatgccagtgcccgttgaaagacggcccagcccaggtcctcgcaagagacaatcatcccagtatagtgatccgaaaagccacggcaatcggccttccacaacggtccgggtacataggtcttcagctcaaaatgtacacaacgaccgcggcaaggccgttcgctgtagagagaagaaggaacagaataagggtcgagaggaaaagggcgtgctcatggtgggcccacctgggactggtaaaactttgttggcgaaagctgttgcaaccgagtgtaagacaacttttttcaatgtcagctcctcaacattgacgagcaagtaccgtggggaaagcgagaagctggtgaggctgctgttcgagatggcccgcttttacagcccagccactatatttattgatgagattgactccatatgcagtaggaggggaacctccgaagaacacgaggccagcaggagagtgaaagccgagcttctggttcaaatggatggcgttggcggcacaagcgagaacgatgacccctccaagatggtaatggtgttggcggccacaaattttccctgggatatcgatgaggctctcaggcggcgacttgagaagaggatatatatccccctgccatcaggcatgcggccctag

SEQ ID NO: 121396 - DNA, 1476 bp, Artificial Sequence
  Description of Artificial Sequence: Synthetic coding sequence
atgagtctgcttatgattagcgagaatgttaaacttgctagagagtatgctcttttgggcaattatgacagtgctatggtgtactaccagggagtcctggatcagatgaacaagtacctctatagcgtgaaggacacctaccttcagcaaaaatggcagcaagtgtggcaggagatcaacgtggaagccaaacatgttaaagacatcatgaagaccttggagagctttaagctggattctactcctctgaaggcggcccagcacgatctgccagcatcagagggcgaagtgtggagcatgccagtgcccgtcgaacgcaggccctccccgggtccaagaaaacgtcagtccagccagtattctgaccccaaaagccatggcaatagaccatccacaactgtgcgcgtacataggagcagcgcccagaatgtgcacaatgacaggggcaaggccgtgcggtgcagagagaagaaagaacaaaacaaggggagagaggaaaagaacaaaagccccgccgccgtcacagaacccgagaccaacaagtttgactcgacaggctatgataaggatctggttgaggccctcgagcgagacatcatatcacagaaccccaatgttcgatgggacgacattgccgatctcgtggaggcaaagaagctgctgaaagaagcagtggtgttgcccatgtggatgcccgagttctttaaaggtatccgaaggccttggaagggtgtcctcatggtgggcccacccggaactggtaagaccctgctagctaaggccgtggccaccgagtgtaagacaacattcttcaacgtgagcagttctacactcacttccaagtataggggagagtctgagaagctggtccgattgctgtttgagatggcaagattttattccccggccactatctttattgatgagatcgactctatttgctcacggcgaggaactagcgaagagcacgaagctagcaggcgggtcaaggctgagctgctggttcagatggatggggtgggaggcacctcggaaaacgatgatccaagcaagatggtgatggtccttgccgcgaccaattttccttgggacattgatgaagcgttaagaagaagactggagaagcgcatctacatccctctgccctctgcaaagggcagagaggaactgctgcgaatttcccttagggaactggaacttgccgacgatgttgacttggccagcattgccgaaaatatggaggggtattcaggggccgatatcaccaatgtttgcagggacgctagcttaatggcaatgcgccggagaattgaaggtctgacccctgaggagatacgaaatctgagcaaagaggaaatgcacatgccaacgacaatggaggacttcgaaatggccctaaaaaaagtgtccaagagtgtgtctgccgccgacatcgagaggtatgagaaatggatctttgagtttgggagctgctag

SEQ ID NO: 121397 - DNA, 1476 bp, Artificial Sequence
  Description of Artificial Sequence: Synthetic coding sequence
atgtccctgctaatgattagcgaaaacgtcaagctcgccagagaatacgccctgttaggcaactatgattctgccatggtgtattaccaaggggtgctggatcagatgaacaagtacctgtattcagtaaaggacacttacctccagcagaaatggcaacaggtctggcaggagatcaacgtggaggcaaagcacgtgaaggatatcatgaagacacttgaatcgttcaagttggattccactccactgaaggctgctcaacatgatttacccgccagcgagggtgaagtttggagcatgccggtcccggttgaacgccggcccagccctggacctaggaagagacagtcttcacaatatagtgacccgaagtctcatggaaataggccgagcacaactgttagagtgcaccgaagctcagctcagaacgttcataacgaccgcggaaaagccgtccgatgccgcgagaaaaaagaacagaacaagggtcgggaagagaagaataaatccccagccgcagtgactgaacctgaaaccaacaaattcgactcaaccggctatgacaaggacctcgtcgaagctctcgagagggatatcattagtcagaatcccaatgtgcgatgggatgacattgctgacctcgtggaggctaagaagttgctcaaagaagcagtcgttctgcctatgtggatgcccgagtttttcaaagggatacggaggccctggaaaggggtactgatggtgggccctcctggaacggggaagacgctgcttgctaaggctgtagccaccgagtgtaagactacattcttcaatgttagttcatccaccctaacctcaaagtatcgcggcgagagcgaaaaacttgtgagacttttattcgaaatggccagattctacagccctgctaccattttcatagatgagattgacagtatatgctcgaggaggggcacatctgaagaacacgaggcttcacgaagggtgaaagccgagcttctcgtccagatggacggagtgggcgggacaagtgaaaatgacgatccgtccaaaatggtcatggtgctggctgccactaactttccttgggatatagatgaagccctgcggaggcgattggaaaaacgcatttacatcccactgccctccgccaaaggcagggaggaacttttacgtatttccctcagagagctggagctggccgacgatgtcgacttggccagcatcgcggagaatatggaagggtactccggagctgatatcacaaacgtgtgccgcgatgcgtccctgatggctatgaggagacgcatcgaaggcctcacccccgaagaaattagaaacctgtccaaggaagagatgcacatgcctacaactatggaggatttcgagatggcacttaaaaaagtctctaaatctgtgtctgcagctgatatcgaacgttatgagaagtggatatttgaatttggctcctgctag

SEQ ID NO: 121398 - DNA, 636 bp, Artificial Sequence
  Description of Artificial Sequence: Synthetic coding sequence
atgtccctcctaatgattagtgaaaacgttaaactggctcgcgaatacgccctactcggaaactacgatagcgccatggtgtattaccagggggtcctggaccagatgaacaagtacctttattcagtgaaggacacgtacttgcaacaaaagtggcaacaagtgtggcaggagataaacgtagaggccaagcacgtcaaagacattatgaaaacactggaatcctttaagctggacagcacaccccttaaagcggctcagcatgacctcccagcatccgagggcgaggtttggtccatgccagtgcccgtggaacggagacccagtcctggtccaagaaagcggcagagctctcagtatagcgatcccaagagccacggcaaccggccaagcactaccgtgagggtacacagaagcagcgcgcagaatgtccataatgatcggggaaaagccgtgcggtgtcgcgagaagaaggaacagaacaaggggagggaagaaaaaaacaaatcacccgctgccgtcaccgaacctgagacaaacaagttcgacagcacagggtacgacaaggaccttgtggaagccctggaaagagacattatcagtcagaaccctaacgttcgttgggatgatatctag

SEQ ID NO: 121399 - DNA, 843 bp, Artificial Sequence
  Description of Artificial Sequence: Synthetic coding sequence
atgtccttgctgatgatatcagagaacgttaaattggccagagagtatgctttgctggggaactatgacagtgccatggtgtattatcagggcgtgctggatcaaatgaataaatatctgtattccgtgaaagatacctatctgcagcaaaaatggcagcaggtctggcaggagattaatgtcgaggccaagcacgttaaagatatcatgaagactcttgaatctttcaagcttgactcaacaccacttaaagcggcccagcacgacctccccgccagcgaaggtgaagtgtggagcatgcccgtgcccgtagaacgacgcccgtctcccggacctagaaaacgacaaagctcccagtactccgaccccaagtctcacggtaaccgccccagtacgacagtgagggtacaccgctcatccgcccaaaacgtgcacaacgatagagggaaagctgtgcggtgcagggagaagaaagagcagaataaaggcagagaagagaagaataagtcgcctgcagccgtcacggagcctgaaactaacaaatttgacagcaccggttatgacaaggacctcgtggaggccctcgaacgagatatcatcagccagaaccctaatgtcagatgggacgatatcgcagatttggtggaggctaagaagttattaaaagaggcggtggtgctccctatgtggatgcctgaattttttaaagggattaggcgaccctggaagggcgtacttatggttggcccccctggaacgggcaaaactctcctggcgaaagcagtcgcaacagaatgcaagaccaccttcttcaatgtgagctcctccacgcttacatcgtag

SEQ ID NO: 121400 - DNA, 429 bp, Artificial Sequence
  Description of Artificial Sequence: Synthetic coding sequence
atgaattgtagcgagagccaaaggctgcggaccctacttagcaggctgctgcttgaattacaccaccgcggcaacgcaagcggcttaggagccggccctcgcccaagcatggggatgggcgttgtgcccgatcctttcgtgggtagagaggtaacatccgctaagggcgatgacgcttatctgtacattctgttaatcatgattttctatgcttgccttgctggcgggctaattctggcctataccagatcccgcaaactagttgaggcgaaggacgaacctagccaggcctgcgccgaacacgaatgggcaccgggaggtgcattgaccgccgacgctgaggctgctgccgggtcacaggcagagggcagacgccagttggcctcagaggggctgccagcccttgcccagggcgccgagcgcgtatag

SEQ ID NO: 121401 - DNA, 1509 bp, Artificial Sequence
  Description of Artificial Sequence: Synthetic coding sequence
atgttcggcactctcctgttgtactgtttcttcctcgctacggtcccagcactcgctgagaccgggggtgaaagacagctgagtcccgaaaagtcagagatctgggggccagggctgaaggcggacgtggtcctgcctgccagatatttttacatccaggcggttgatacctctgggaacaagtttacctcttccccaggggaaaaggtgttccaggtcaaagtgagcgcacctgaagaacaatttacgcgggtgggcgtgcaggtcctggaccgcaaagacggcagtttcatagttagataccgcatgtacgcctcctacaagaacttaaaagtagagatcaagtttcaggggcaacatgtcgctaaatcaccttatattttaaagggaccggtgtaccacgagaattgcgattgcccactgcaagactcagcagcctggctgagagagatgaattgtcctgaaacaatcgcccagatccaaagggaccttgcacatttcccagcggttgaccccgaaaagatagccgtggagattccgaaaagattcggacaacgccagtccctgtgccactataccctaaaagataataaagtgtatattaaaactcatggcgagcatgttgggtttcgcatctttatggacgctatcctcctctctctcacgcgtaaagtcaaaatgcctgatgtcgaactttttgttaatctgggcgactggcccctagagaaaaagaaaagcaacagtaacattcacccaatcttctcctggtgtggatctaccgatagtaaggatatcgttatgccaacttacgacctgacagatagcgtcctggagaccatgggaagagtttcattagatatgatgagcgtccaggcaaatacaggacccccctgggagtctaaaaatagtacagccgtttggcggggtagagactccagaaaggaacggctggagctggtcaagctctctcgcaaacaccctgaactgattgatgctgcatttaccaacttcttcttcttcaaacacgatgagaacctatatgggccaatcgtgaaacatattagctttttcgacttttttaagcacaaataccagatcaacatagatggcactgtcgccgcctacagactgccatacttgttggtcggggacagcgtcgtgctgaagcaggacagcatctattatgaacatttttataacgaactccaaccttggaaacactacattccagtcaaaagcaatctgagcgatctgctagaaaagctcaaatgggctaaggatcacgacgaggaagctaaaaaaatcgctaaggctggacaagaatttgcgcgcaacaacctgatgggtgacgatatattttgctattattttaagctgtttcaggagtacgccaacttgcaggtcagcgagccacagatcagggaaggcatgaaaagagtggagccccagacagaagacgacctgtttccctgcacctgtcaccgcaaaaaaactaaggacgaattgtag

SEQ ID NO: 121402 - DNA, 1065 bp, Artificial Sequence
  Description of Artificial Sequence: Synthetic coding sequence
atgtcagccggcggaggacgagctttcgcctggcaagtgttccctccaatgccgacctgtagagtttacggcacagtggcacatcaggatggccatcttctggtgcttggcggttgcggtagagccggactccccctggacactgccgagactctcgatatggcatctcacacatggctggctctggcaccactgcccaccgcgagggcaggggccgccgccgtcgtcctaggcaagcaggtactggtggtgggaggagtcgatgaggttcagagtcccgtggcggctgtagaagcctttctaatggatgaggggagatgggagagaagagctactctgcctcaggccgccatgggcgtagcaactgtggagcgtgatgggatggtgtacgcacttggaggtatgggcccagacacggctccccaggcgcaggtccgagtgtatgagccccgtcgcgattgctggctgtctttgccaagtatgcccactccatgttatggcgcaagcacctttcttcatgggaataaaatttacgtattaggcggccgccagggcaaactacctgtgaccgcctttgaggccttcgatctcgaggccaggacttggactaggcatccatccctcccctcacgccgcgcttttgcgggttgtgccatggctgaaggttccgtattcagcctcggtgggctgcagcaacccggcccacacaacttttactcacgtccccactttgtgaacactgttgaaatgtttgatctcgagcacggttcatggactaagctgccaaggagtctgaggatgagggataagcgagcagactttgttgtcggtagtctgggcggccacatcgtggccatcggtgggctcggtaatcaaccatgcccgctgggttctgtggaatcgtttagcctggcaagacgccggtgggaggctctcccagcgatgcctacagcaagatgcagctgctcttctctgcaggctggtccgcgactgtttgtcatcgggggggtcgctcaaggaccttcgcaggccgtcgaggcgctgtgtttgagggacggcgtttag

SEQ ID NO: 121403 - DNA, 417 bp, Artificial Sequence
  Description of Artificial Sequence: Synthetic coding sequence
atgttcgatttggagcacggttcttggacaaagctgccacgctccctgcggatgagggacaagcgggctgactttgtggtgggatcgttggggggccatatcgttgctatcggagggcttggcaatcagccatgtcccctcggcagcgtggaaagcttcagtctcgccaggagaagatgggaagctctccctgctatgcccacagcgcgatgtagctgcagcagtctgcaagcaggccctcgtttatttgtgatcggtggcgtcgcccagggccccagccaagcagttgaggcgctgtgcctgagggatggcgagggtctggtcggagcagtccactggagtagctccctgccggaggcagctatctctatggccccctttgccgctgaggacacccattgcggctccgtggggtag

SEQ ID NO: 121404 - DNA, 1821 bp, Artificial Sequence
  Description of Artificial Sequence: Synthetic coding sequence
atggattcccagagggaattggcggaggagttgcgcctttatcagtctaccttgcttcaggacggattgaaagacctgctcgacgagaagaagtttattgattgcacactgaaggcaggagataaaagccttccatgtcaccggctcattctaagcgcatgctctccatacttccgagagtacttcctgagcgaaatcgatgaggccaagaaaaaagaagttgtgttagacaacgtggatcctgccatcctggatttgataataaaatacctgtatagcgcttcgatcgacctaaatgacggcaacgttcaggacatttttgccctcgcttcaaggttccagattccttctgttttcactgtatgtgtgagctacctgcagaagcgactggcccccggcaattgtctggctatacttcgcctggggttactactcgattgcccccgactcgctatctccgcaagggagttcgtcagtgatcgattcgttcaaatttgcaaagaagaagactttatgcagctgagtccacaggagctcatcagtgtaatcagtaacgactcgctcaacgttgaaaaagaggaggcagttttcgaagccgttatgaagtgggtccgaaccgacaaagaaaacagagtcaagaacctgagtgaagtgtttgactgtatccggttccgcctgatgactgaaaaatacttcaaggatcacgtggagaaggacgacatcataaagagtaatcctgatctgcagaaaaagatcaaagtccttaaggacgccttcgcggggaagctgccggagccgtccaaaaacgctgccaagaccggggccggcgaagtcaatggagatgtgggggacgaggacttgctgcccggatatctgaatgacattcccagacatggaatgttcgtaaaagatctgatcttactcgtgaatgacacggctgctgtggcctacgatccaaccgaaaatgagtgttatcttacagcccttgctgaacagatccctcgaaatcattcctctatagtgacacagcagaatcagatctatgtggtgggcggtctatacgtggacgaagagaataaagatcaaccactccagagctacttcttccagttggattccattgcatccgagtgggtgggactgcccccactgccttccgctcggtgtctctttggtctgggggaggtcgatgataagatatatgttgtcgccggaaaggacttgcagactgaagcctccctggatagcgtgttgtgttatgacccagttgccgccaaatggaatgaggtgaaaaagcttccaatcaaggtgtatggccacaatgttatcagtcataaaggaatgatttattgccttggagggaaaacagacgacaagaagtgcaccaatcgagttttcatcttcaaccctaagaaaggggactggaaggatctcgccccaatgaagatcccacgcagcatgtttggcgtggctgttcacaagggaaagatcgtcatagcaggcggcgtgacagaagatggcctgtccgcgtctgtcgaggcattcgatctcacaactaacaagtgggacgtgatgactgaatttccccaggagcggtcatctattagtctggtaagtctcgctggatctttgtacgctatcggcggattcgcaatgatacagctcgaaagtaaggagtttgctccaacagaagtcaacgatatctggaagtatgaggatgacaagaaggagtgggccggtatgctcaaggagatccgatatgcatccggtgcttcatgtcttgcaacccgactcaacttattcaagctctcaaagctgtag

SEQ ID NO: 121405 - DNA, 1377 bp, Artificial Sequence
  Description of Artificial Sequence: Synthetic coding sequence
atggcccgagggccccagacactggtgcaggtgtgggtgggggggcagctttttcaggccgatcgcgcattgctggtggagcactgcgggttcttccggggtctcttcaggagcggcatgagggagaccagagcagccgaggtccgcctgggggtcctgtctgccggaggcttcagggccacacttcaagtactcaggggcgacaggccggcgcttgcagccgaagacgagctcctccaggcagtggagtgcgcggcttttctgcaagcaccggcccttgcgaggtttctggagcataatctcacctctgacaattgcgccctgctgtgtgacgctgcagccgcatttggcctaagagatgttttccactctgccgcactgtttatctgcgacggggagcgagaactcgcagccgagctggctctgcccgaagctcgcgcctatgttgccgctttgcggccaagctcttacgcggcagtcagcacccacacccctgcacctggttttctagaggacgcaagtcggacactgtgctacctggacgaggaggaagatgcatggcggacactggcagccctgcccctcgaagcctcaacattactcgcaggcgtggcaaccctgggcaacaaattgtacattgtcggaggcgttagaggggcgagcaaagaagtagtggagctcggattttgctatgacccagacgggggcacctggcacgagttcccatctccacaccagcctaggtatgacacggcactggccgggtttgatgggagactgtacgcaataggaggcgagtttcagagaactcccatttcgtccgttgaacgctatgaccctgccgccggttgttggtcatttgtggctgaccttccccagcctgcagccggggtgccttgtgcacaggcatgcggacgccttttcgtctgtctgtggcgcccagccgacacaactgctgttgtcgagtatgccgtgagaaccgatgcctggctgccagtggccgaactacggcgcccccaaagttatggacactgtatggtagctcaccgcgatagcctatatgtcgtacgcaacggtccttcagacgactttctgcactgcgcgattgattgcctcaacttagccaccggacagtggacggcgctcccaggccagttcgtgaactctaaaggcgcactcttcaccgccgttgttaggggtgataccgtctacaccgtaaaccgaatgttcactctgctctatgcaatcgaagggggcacctggcggctgctacgagagaaggcggggtttcccagacccggttctctccagactttcctcctgagactgccccctggtgcaccagggcccgtgacctctaccacagcggaactttag

SEQ ID NO: 121406 - DNA, 2247 bp, Artificial Sequence
  Description of Artificial Sequence: Synthetic coding sequence
atgtctggatctgggaggaaagacttcgacgtgaaacatatcctgcgtctccggtggaagctctttagccaccctagtccaagtacgggcgggcctgccggaggcggctgcttacaacaagacggcagcggatcatttgagcactggggtccttctcagagccgacttctcaaatcacaggaacgctccggggtcagcaccttctggaagaagccttccagttcctccagttcatcatcatcaccttcctctagctcctcttcattcaaccccctcaatggaactttattgcctgtggcgactcggctgcagcagggcgctccagggcaagggacccagcagccagcgcggaccctcttttatgtcgagagcctcgaggaggaggtggtacccgggatggattttcccggaccacacgaaaaaggccttgtgcttcaggagcttaaggtggaacctgacaactccagccaggcaactggggaaggctgtggccataggctgtctagcacaggacatagcatgaccccccagagcgacctggactccagctcctctgaggaattttatcaggcagtacatcacgccgagcagacctttaggaaaatggaatcttacctcaagcagcagcaactatgtgacgtgatcctgatcgtgggcaatcgcaagattcccgctcaccggttggtcctatccagcgtgagcgactatttcgctgcgatgttcactagcgatgtctgcgaggcaaagcaggaggagattaagatggaaggcatcgaccccaatgctctgtgggatctggtgcaatttgcctacacgggctgccttgagctcaaggaggacacaatcgagaatcttttagctgctgcttgtttactccagttgccccaggtggtcgaagtatgttgtcactttctgatgaagctgttacatccatcaaactgtctgggcatccgggccttcgccgacgcacaaggatgcatcgaactaatgaaagtcgcccactcttatacaatggaaaatattatggaagtaattaggaatcaggaatttctactcctgccggccgaagaactgcacaagctgcttgccagcgatgatgtgaatgtccctgatgaggaaacaatcttccacgcccttatgatgtgggtgaagtatgatatgcagtctaggtgtaatgacctcagtatgctcctagccttcattcgtctgcctctgcttcccccccagatactcgctgacctcgagaatcacgccctcttcaaaaatgacctcgagtgtcagaagttgattctcgaggcaatgaagtaccatctgttaccagagcgaagaaccttgatgcagtcgcctcgcactaagccacggaagtctaccgtcggaacgctgtatgccgtcggcggtatggataacaacaagggagccaccaccatcgagaagtacgacttgcggaccaacctgtggatccaggccggaatgatgaacggtcgcagactacagttcggggtggctgtaatcgacgacaaactgtttgtcatcggcggcagagatgggctgaaaaccctcaatactgtagaatgctacaatcccaaaaccaagacatggaccgtgctgcccccgatgtccactcaccggcacgggttaggggtgactgtgctcgagggccccatctacgccgtggggggccatgacggctggtcatacctcaacactgttgaacggtgggatccccagagtcagcagtggacgtttgtcgcttcgatgagcattgcacggagtactgttggagtcgctgcgcttaacggaaaactctattctgttggcgggcgggatggatcaagctgcctcagcagcatggagtattatgatcctcacaccaataagtggaatatgtgtgcccccatgtgtaagcgcagaggcggagtgggggtggccacctgcgacggcttcctgtatgccgtgggcggccatgatgcccccgccagtaatcactgtagccggctgttggactacgtggagcgctatgaccctaagaccgacacctggactatggtggctccactgagtatgccccgggacgctgttggagtgtgtctcctgggcgatagactgtacgccgtaggtggttatgatggccagacatatttgaataccatggaatcctacgacccacaaacgaacgaatggacccaaatggcctctctgaatatcggacgcgctggcgcatgcgttgttgttatcaagcagccctag

SEQ ID NO: 121407 - DNA, 1668 bp, Artificial Sequence
  Description of Artificial Sequence: Synthetic coding sequence
atggatttccctggacctcacgaaaagggattggtcctgcaggaactgaaggtagagcctgataactcctcccaggctactggcgaggggtgcggccatcggttagtgctctcctccgttagcgactacttcgctgctatgttcacatcagacgtgtgtgaggcaaaacaagaggaaattaagatggaagggatcgatcccaatgctctttgggacctggtgcagttcgcctacactggatgcttagaactgaaggaggacacaatcgaaaacctgctggcagcggcttgcctgctgcaactacctcaagtagttgaggtatgttgccacttcctcatgaaactcttgcatccttctaattgtctgggcattcgggctttcgccgacgcacagggttgtatagagctaatgaaagtcgcccacagttatactatggaaaacattatggaggtgattcgtaatcaggaatttctgctccttcccgcagaggagctgcacaaactgctcgcatccgatgacgttaatgtgcccgatgaagaaactatttttcatgccctcatgatgtgggtcaaatatgatatgcagtctcggtgtaacgacctgtccatgctgttggcgttcattcgacttcccctgctaccacctcaaatcctggccgatctcgaaaatcatgcattgttcaagaatgacctggagtgccaaaaattgatcctcgaggccatgaagtaccacctcctgccggagcggcgtaccctgatgcagtccccacggactaagcctcggaagagtaccgtgggcaccctgtacgccgttgggggcatggacaataataaaggggcgacaaccattgagaagtatgacctgcgtacgaacctgtggattcaggcaggaatgatgaatggcaggaggctccagttcggggtcgcagttatcgacgacaagctctttgtcatcggcggtcgagatggacttaaaaccttgaatactgtcgagtgctacaatccaaagaccaaaacctggacggtgcttcctccaatgtctactcaccgacacggactgggcgtcacagtactcgagggccccatttacgccgttggtggacatgatggatggtcgtacctgaataccgtggagcgctgggatccccagagccagcagtggactttcgtcgcatctatgtcaatcgccaggagcaccgttggcgtggccgcactgaacggaaagttgtactctgtggggggaagggacgggtcctcttgtctctccagcatggagtactatgacccccataccaataagtggaacatgtgtgcacccatgtgcaaaagacgtggcggtgtcggcgtggctacttgcgatggcttcctctatgcagttgggggccatgacgcgcccgcctccaaccactgcagtaggttactagattacgtggaaagatatgacccgaagacagacacgtggacaatggtggcccctctgagtatgcctcgagacgccgtgggagtttgccttctgggggaccgactgtacgccgtcggcggctatgatggacagacctatttgaataccatggagagctatgaccctcagactaacgagtggacacagatggcctccctcaatatcgggagagccggagcctgcgtggtcgtcatcaagcaaccctag

SEQ ID NO: 121408 - DNA, 1167 bp, Artificial Sequence
  Description of Artificial Sequence: Synthetic coding sequence
atgagcagaagcggagatcgcacttctacatttgacccaagccacagtgacaacctgttgcatgggctgaatctgctgtggaggaaacagctcttctgcgatgtcaccctgacagctcaagggcaacagttccactgtcacaaggctgtgctagccagttgcagccaatacttccgatcgctgttttcctctcatccgccactgggggggggagttggagggcaggatggactgggagcgcccaaggatcagcagcagccaccgcaacaacagcctagtcagcaacagcagccccccccccaggaagaaccaggcacaccgagttctagccccgacgacaaactgctcacatctccgagagccataaataacctcgtgttacagggctgctcgtcgatcgggctgagattagtgttagaatatttatacacagctaacgtcactctctcgctggatacagtcgaggaagtcctctccgttagcaagatactgcacataccccaggtgaccaaactatgtgtgcagtttctcaacgatcagatctcagtacagaactacaaacaggtatgtaagatcgccgccctccacggtttggaggagactaaaaagttggcaaacaaatacctggtggaagacgtcctcctcttgaattttgaagagatgcgggcgctgttagatagcctgccacccccggtagaaagtgagctcgcactttttcagatgtcagtgttgtggctggagcatgatagggagacgcgcatgcagtatgcaccagacctgatgaaacgtctgaggttcgctctaattccagctcccgagctcgttgagcgcgttcagtccgtggactttatgcgcacggatcccgtttgccagaaattgctgctggatgctatgaattatcatctgatgcccttccgtcagcattgtcgacagtcgttggcttcaagaatccgcagcaataagaaaatgttactgctggttggcgggctgccccctggccccgataggctgccttcgaacctcgttcagtattacgacgacgaaaaaaaaacgtggaaaatcttaacaattactggcccacacccaatctccgggaagcaggagtcagcgagtagcccagaatttcgcagacggaagactagggaatttagcaataatacaatgtag

SEQ ID NO: 121409 - DNA, 1887 bp, Artificial Sequence
  Description of Artificial Sequence: Synthetic coding sequence
atgtctagaagcggggatcgaacctccacctttgacccatcccattccgataacctactgcatgggcttaaccttctctggagaaaacaactgttttgtgatgtgactcttacggctcagggtcaacagtttcattgtcataaggcagtcttggcatcatgttcccagtacttccgctccttgttcagctcccaccctccacttggcggcggggtcggcgggcaggatggtttaggcgctcctaaggatcagcaacagccacctcaacagcagccatcgcaacaacaacaacctcctccgcaagaagaaccgggtacaccgagtagcagcccagacgacaagttgctgacctccccgcgggcgataaataatcttgtgttgcagggctgttcatccattggactgaggcttgtcctggaatatctgtacaccgcgaatgtcaccctttccttggacaccgtggaggaagttttgagtgtctcaaagatcctgcacataccgcaggtaaccaaactgtgtgtgcagttccttaacgatcagatttcagttcagaattacaagcaggtgtgcaagatcgctgcgctccacggcctcgaggaaaccaaaaagctggctaataagtatcttgtggaagatgtcttgctcctgaacttcgaagagatgcgcgctttactcgacagcctgccaccccctgtagaatcagagctcgccctattccagatgagcgtcctctggctggagcatgacagagagactcgaatgcagtacgccccagatctcatgaaacgcctgagattcgccttaatccctgctcccgaactggtggaaagagtacagagcgtggatttcatgcggactgatccagtatgccagaaacttcttttagacgccatgaattatcacctcatgccatttcggcagcattgcagacagagtcttgcctcgcggatccggagcaacaaaaagatgctgctcctggtgggggggttgccccccggacctgacaggttgcccagcaaccttgtccagtattatgacgacgagaaaaagacatggaagatcctcactataatgccatataacagtgcccatcactgtgttgtggaggtagagaatttcttatttgtcctgggaggcgaagatcagtggaacccgaatgggaagcattcgaccaacttcgtgtctcgttacgatccaagattcaatagttggatccagctcccacctatgcaagagagacgcgcgtccttttatgcttgcagactggataaacacctatacgtcattggtggtaggaatgaaacaggatatttatcaagcgtggagtgttacaatttggaaacaaatgaatggcggtatgtatctagtttgccacaaccccttgccgcacacgctggcgcagtacacaatggtaagatctacatctccggcggagtgcacaatggtgagtacgttccctggttgtattgctacgatccagtgatggatgtgtgggcccgcaagcaagatatgaatactaaacgcgccatccacactctcgcagtcatgaatgaccgcttgtacgctattgggggaaaccatctgaaagggttctcacatcttgacgtgatgttggtcgaatgttatgatcccaaaggggatcagtggaacatccttcagacgccaatcctggaaggccggtctggacccggatgtgcagtgctcgacgatagtatctatctggtgggaggatattcgtggtccatgggcgcgtacaagtcttctaccatttgctattgtcctgagaaagggacgtggacagagctggagggggacgtggctgaaccgctggccggtcctgcatgcgtcaccgtgatacttcctagctgcgttccctacaacaaatag

SEQ ID NO: 121410 - DNA, 1794 bp, Artificial Sequence
  Description of Artificial Sequence: Synthetic coding sequence
atggtttggctcgaggctcgtccccagatcctgtttgtgtgtactaagcaaggccatcagaaacccctggatagcaaagatgataatactgagaagcattgcccggttactgtgaacccttggcacatgaagaaggcttttaaggtaatgaatgagcttcgaagtcagaacctcctgtgcgacgtaactatcgtcgccgaggatatggaaatcagtgcccatcgggtggtgctcgcagcttgcagtccctatttccacgccatgtttacgggcgagatgtccgaatctagggccaaaagggtgcgcatcaaggaggtcgacggctggaccctaaggatgctgatcgattacgtttacactgctgaaatacaagtgactgaggaaaacgtacaggtgttgctgcctgctgccggccttcttcaactgcaggatgtcaaaaaaacttgttgcgagttcttggagtcccagctacatcctgtgaactgcctgggcattagggcgttcgctgatatgcacgcctgtacagacctgcttaataaggcaaacacttacgcggagcagcactttgcagatgtggtgctctccgaagagtttctgaaccttggaattgagcaggtatgttctctgatctctagcgacaagttaacaatcagcagtgaagagaaagtgtttgaggccgtgatcgcatgggtgaaccacgacaaggacgtgagacaggagttcatggcaaggctcatggaacacgtgcgcttgccgcttctccctcgagaatacttagtgcagagagtagaagaggaggcactggttaaaaactcctcagcctgtaaagactatcttattgaagcgatgaagtaccaccttctgcccaccgagcagcggatcctaatgaaatccgtgcgtacaaggcttagaaccccaatgaacctgccaaaactgatggtcgtggtgggcggccaggcaccgaaggctatacgtagtgtggagtgctatgatttcaaggaagagcgctggcaccaggtggctgagcttccaagtcgccgctgcagagctggcatggtgtacatggcgggtctcgtgttcgcagtgggaggtttcaacggatccctgcgggtgcggaccgtggatagttacgaccctgtgaaggaccagtggacttcagtggcaaatatgagggaccgacgctccacactgggtgcggctgtcctaaacgggctcctgtacgccgtggggggttttgatggcagtactgggcttagcagcgtagaggcatataacataaagtcaaacgaatggttccacgtggctcctatgaataccaggcgctcttccgtcggggtgggagtggtgggtggacttctgtacgctgtaggcggatatgatggcgctagcagacaatgtctttccactgttgaatgctataacgccaccacgaacgagtggacttacatcgccgagatgagcacacgtaggtccggtgctggcgtgggggtgctcaacaatctgttatacgctgtagggggccatgacggccccctcgtcagaaaatcagtagaagtgtatgatcctacaactaacgcatggagacaggtggctgacatgaatatgtgtcgccgaaatgcaggcgtctgcgcagtcaatggattgctctacgttgtcggcggcgatgacgggtcctgcaacctggcctccgtggagtactataatcccacaacagataagtggaccgtggtcagctcctgtatgagcaccggaagaagctacgccggggtaactgtcatcgacaaaccattatag

SEQ ID NO: 121411 - DNA, 2640 bp, Artificial Sequence
  Description of Artificial Sequence: Synthetic coding sequence
atgcgcttgcacctgctgctgctccttgcattgtgtggggcaggcactaccgccgctgaactcagttatagtctacgagggaactggagcatttgcaatgggaacggcagcctggagctgccaggtgctgtaccaggttgcgtccactctgccctctttcaacagggcttaatccaggacagctattaccgtttcaacgaccttaattatcggtgggtcagtcttgacaattggacctactccaaagaattcaaaatcccatttgagattagcaaatggcaaaaagttaatctgattctcgagggtgtggacaccgtgtcgaaaatcttgtttaacgaggtgaccataggtgaaactgataacatgttcaaccggtactccttcgatattaccaatgttgtcagagacgtaaactcaatcgagctgaggttccagtccgcagtgctctacgccgctcagcaatcaaaggctcatacccggtaccaagtgccgccagactgcccccctttagtccagaaaggcgagtgccatgtgaacttcgtgcggaaagaacagtgtagcttttcatgggactggggtccctctttccccacgcaaggtatctggaaggacgtgcggattgaagcttacaacatctgccacctgaactacttcactttctcacccatttatgataagagtgcgcaggaatggaacctagagattgaatccaccttcgatgtggtttcctccaagccagtggggggacaagtgattgtggcaattcctaagctccagacacagcagacttactcaattgagctccagcccggtaagagaatagttgaactgtttgtaaacatcagcaagaacataactgtggagacttggtggccacatggccatgggaatcaaaccggctacaacatgaccgttctgttcgagctggacgggggcctgaacatcgaaaagtccgccaaggtgtatttcaggacggtggaactcattgaagaacctattaaggggtctcccgggctgagcttctatttcaagattaacggcttcccgatttttctcaaaggaagtaattggatcccagctgactctttccaggatagggtgacgagcgagctgttacgccttctgctgcagtccgtggtggacgctaacatgaacacactgagagtgtggggcggggggatctatgagcaggatgaattctacgaactgtgtgacgagctcggaatcatggtatggcaggatttcatgtttgcttgcgcattatacccgacagatcagggctttctggactcggtgaccgcagaggtggcgtatcagatcaaaaggttgaagtcgcatcccagcataattatctggtccgggaataacgagaacgaagaggcactgatgatgaactggtatcacataagctttacagacaggcccatatatataaaggattacgttactctctacgtgaaaaacattcgggagttggtattagccggggacaaatcacggccattcatcacctcttccccaacaaatggcgcagaaaccgtggcagaagcctgggtgagtcagaatccgaattccaattattttggggacgtgcacttctacgattatatctccgactgctggaactggaaggtttttccaaaagccaggtttgcttctgaatacggctatcagtcctggccaagtttctctactttggagaaggtgtcatccactgaggactggagttttaactcaaaattttcactccacaggcagcaccatgagggcggcaacaagcaaatgctgtatcaggctggactccactttaagctgccccagagcaccgatccgctgcggacattcaaggacacaatctacctgactcaagtgatgcaagcacaatgcgttaagaccgagacagagttttaccgcaggtctcggagcgagatcgtggaccagcaaggtcacacgatgggagctctttactggcaactgaacgacatctggcaggccccctcatgggccagcctggagtatgggggtaaatggaagatgctgcattattttgcccagaatttttttgccccactgttgcccgttggtttcgagaacgagaacacattttacatctacggcgtgagcgatctgcactcagactatagcatgacactctcagttagagtgcacacctggagctccctcgagccggtctgttctcgggtaaccgaacgtttcgtgatgaaaggcggcgaggctgtgtgcctatacgaagaacctgtgagtgaactgcttcggcggtgcggcaactgcacccgggaaagctgtgtagtatctttttacctgagcgccgaccacgaattgctgtctcccaccaattaccacttcctgtccagccccaaggaggccgtgggcctgtgcaaagctcagatcacagcaattatttcccagcagggcgacatctttgtgttcgacctggaaacatctgcggtggctccattcgtatggcttgacgtcggctccatccccggaagattcagtgataatggattcctgatgaccgaaaagacacgaaccatactcttctacccttgggagccgactagcaagaacgagcttgaacagtctttccacgtgacttctttgacagacatctactag

SEQ ID NO: 121412 - DNA, 1518 bp, Artificial Sequence
  Description of Artificial Sequence: Synthetic coding sequence
atgagcgagtcaagagcaaagcgggtacggatcaaggaggtagacggctggacactgcggatgttaatcgactacgtgtacactgcagagatacaggtgacagaggaaaacgtccaggtgctccttccagccgctggcctgctgcagttacaggatgtgaagaagacttgttgtgaatttctggagtcacagttgcatcccgtcaattgtctgggcattcgggcatttgctgacatgcatgcatgtaccgacctgctgaacaaggccaatacatatgctgagcagcactttgcggatgtagtgctctcagaagagtttctgaatcttggaatcgaacaggtctgttccctgatttcaagcgataagctgactatctcatccgaagaaaaagtgttcgaggccgtgatagcatgggttaatcacgataaggacgtacgacaggagttcatggcaaggctgatggaacatgtgcggctccctcttctacctagagagtacctggtgcagcgcgtggaagaagaggctctggtgaaaaactcttccgcctgcaaggactacctcattgaggctatgaaatatcacttactgcccaccgaacagagaattctgatgaaaagcgtgagaacaagactgcggactccaatgaatctaccaaagctgatggtagtcgtcggcggccaggcgcctaaagccatcagaagcgtcgagtgctacgactttaaggaggagaggtggcatcaggtggccgaactgccctcacggagatgccgggcaggcatggtgtacatggctgggctggtttttgccgtgggcggattcaatgggtcactgcgcgtgcgtactgtcgactcctatgaccctgttaaggaccagtggacctctgtggctaatatgagggaccgccggagcactcttggtgccgccgtgctgaacgggctgctctacgctgtaggagggttcgacgggtctactggattgagctctgtggaagcatacaacattaagtctaatgagtggttccatgtagctcctatgaacacgcggagatcctcagtgggagtaggcgtcgtgggcggtctcctgtacgctgtcggaggctatgatggggcgtctcgtcaatgcctctctactgtggaatgctacaatgcaactacaaacgaatggacctacatcgccgagatgtccactcgacgttcaggtgccggagtcggcgtcctcaacaacctactgtatgctgtgggcggccatgatggccccctggtgaggaaaagcgtggaagtgtatgatcctactactaacgcctggaggcaagtggccgacatgaacatgtgtaggaggaatgcaggcgtgtgtgcagtgaatggactgctctatgttgttgggggtgacgacggatcttgcaatttggcatccgtcgagtattacaaccccactactgataaatggacagtcgtgtcatcttgtatgtctaccggtcgatcctatgctggcgttactgtcatcgataagccgctgtag

SEQ ID NO: 121413 - DNA, 1764 bp, Artificial Sequence
  Description of Artificial Sequence: Synthetic coding sequence
atggagggcgaatctgtgaaactgagtagccagacactgattcaggcaggcgacgacgaaaaaaaccagcgaaccattaccgtcaacccggcacacatgggtaaagcattcaaggtcatgaatgagcttcggtcaaagcaactgctgtgcgatgtgatgatcgttgctgaggatgtggagatcgaggctcacagagtggtgttggcagcttgttccccctacttctgtgccatgttcacaggcgatatgagtgagagtaaggccaagaagattgaaattaaggacgtcgacggccagacacttagtaaattgatcgattacatctataccgccgagattgaggttacagaggagaacgtacaggtcctcctgcctgcagcgtcattgctgcaactcatggacgtgaggcaaaattgctgcgattttttacaatctcagttgcatcccaccaattgcctcggaattcgcgcttttgcagacgtgcacacctgtaccgacctattacagcaagcaaacgcttacgctgagcaacacttcccagaggtcatgctgggggaagagttcctcagtttgagcctggaccaggtttgcagtctcatttcctccgacaaactgacagttagcagcgaggagaaagtcttcgaagctgtgatttcttggattaattatgaaaaggagacgcggctagaacacatggctaagttaatggaacacgtacgcctgccgctgttgccccgggactatctggtgcagactgtggaggaggaggcccttatcaagaataacaatacgtgtaaggatttcttaattgaggccatgaaatatcatttgctacctctggatcagaggctccttatcaaaaaccctcggaccaaacctcgcacccctgtatctcttcctaaagttatgatcgttgtgggaggtcaggcgcctaaggctatccgtagcgtggaatgctacgattttgaggaagacagatgggaccaaattgcagaattgccttcccgaaggtgtcgagcgggagtcgtatttatggccggacacgtatacgcagtaggcggctttaatggctcattacgcgtgaggactgttgacgtgtatgacggggtgaaggaccagtggacatccattgcatccatgcaagagcgccgcagcaccctcggggcagctgttctcaatgacctgctgtacgccgtaggcggtttcgacggttccacggggctcgcctcagtggaagcctactcttataagaccaacgaatggttttttgtggcgcctatgaacaccagaagaagctcagtgggcgtcggtgtcgtggagggaaaactgtacgcagttgggggttacgacggtgcctcgcggcagtgcctgtccactgtggaacagtacaatccagctactaatgagtggatatacgtggccgacatgtctacacgcagatcaggggctggtgtgggtgtcctctcagggcagctgtatgccaccggggggcacgatggacctctcgtcaggaagtccgtggaagtatacgaccccggcaccaatacttggaagcaggttgctgacatgaacatgtgtcgccgtaacgccggcgtctgtgctgtgaatggcctgttgtacgtggtcgggggagacgatggctcttgtaacttggcctcagttgagtactataatcccgtgaccgacaagtggactctcctgcctaccaatatgagcactggcagaagctacgccggagttgcagtcatccacaagagcctgtag

SEQ ID NO: 121414 - DNA, 906 bp, Artificial Sequence
  Description of Artificial Sequence: Synthetic coding sequence
atggagggagaatcagttaagttatcatcccagacactcattcaggccggagatgatgaaaagaatcagaggaccattaccgtaaaccctgcccacatgggtaaagccttcaaagtaatgaacgaattgaggtcgaagcaactgctgtgcgacgtaatgattgtggccgaggatgtggagatcgaggcccaccgggtggttctagccgcttgctccccctatttttgtgccatgttcaccggggatatgtccgagagcaaggcaaagaagattgagataaaggatgtagacggtcagaccttatctaagctgattgattacatttacactgccgaaattgaagttacggaagaaaacgtgcaggtcctcctgccagcagcttcattgcttcagctgatggacgttaggcagaattgctgcgacttccttcaatctcagctgcacccaactaactgccttggtattcgtgcatttgcagatgtccacacatgtaccgatttgttacaacaagctaacgcatatgccgaacagcacttccctgaagtgatgttaggcgaagagttcctgagtctgagtttagaccaggtgtgctccctgatctcatcggacaagctgaccgtttcttctgaggagaaggtttttgaagccgtgatttcttggatcaactacgagaaagagactaggcttgagcatatggccaagctgatggaacatgtacggttaccactgctgcctcgggactatctcgtgcaaactgtcgaggaggaggcattgataaaaaataataacacctgcaaggacttccttattgaagcaatgaagtaccaccttctgcccctggaccagagactgctgatcaagaacccaagaaccaaaccacgcactccagtctctctacctaaatag

SEQ ID NO: 121415 - DNA, 1518 bp, Artificial Sequence
  Description of Artificial Sequence: Synthetic coding sequence
atgtccgaatctaaagccaagaaaatcgaaattaaagacgtggatgggcagactctgagcaagctcatcgactatatctatactgccgagattgaagttaccgaagaaaatgtgcaggttttgctgccagcagcatctctccttcagttgatggatgtgcgacagaactgttgcgatttcctgcagtcacaactgcaccctaccaattgcctcggaataagggcatttgccgacgtgcatacatgcacagacctcctgcagcaagcgaacgcatacgctgagcagcatttccccgaggttatgctcggagaagagttcctgtcccttagcctcgaccaggtgtgctctctgattagcagtgataaattaaccgtgtcttcagaggagaaagtctttgaggcggttatctcatggataaattacgagaaagaaaccagactggagcatatggccaagctgatggagcacgtgaggcttcctctgttgccccgcgactaccttgttcagaccgtcgaggaagaggctctcattaagaacaacaatacttgtaaagacttcctgatcgaagcaatgaaataccacctgctgcctcttgatcagcgactcctcatcaagaatccaagaactaagcctagaacaccagtatccttgccgaaagttatgatcgtggtgggtggacaggccccaaaagctattcgttcagttgagtgttatgatttcgaggaagaccggtgggatcagatagccgaattaccctcccgccgatgccgcgccggggtggtgtttatggctggtcacgtgtatgcagtgggtggatttaatgggagcctgagggttcgcaccgtggatgtctatgacggcgtcaaggaccaatggaccagcattgcatccatgcaggagcgtcggagtaccctgggggccgccgtattaaacgatcttttatacgctgtgggtggcttcgacgggagcaccgggcttgcatctgtcgaagcttactcatataagaccaacgaatggttcttcgtggcgcctatgaacactcgtcggagtagcgtcggtgttggagtcgtggagggcaaactctacgctgtgggcgggtatgacggcgccagcaggcaatgcctcagcactgtagagcaatacaaccctgcaacaaacgagtggatctacgtagctgacatgtcaactcggcgttctggcgctggagtgggggtactgagcggccagctgtatgcaactggaggtcatgacgggccgctggtgagaaagtccgtcgaagtctacgatccgggcacaaacacctggaaacaagttgctgacatgaacatgtgccgaagaaatgccggggtttgtgcagtcaatggcctcttatacgtcgttgggggtgatgatggttcatgtaacctggcctctgtggagtattacaatcccgtgacagacaagtggactctgctacccactaacatgtcgaccggcaggtcatatgccggggtagccgttattcacaagtcactgtag

SEQ ID NO: 121416 - DNA, 603 bp, Artificial Sequence
  Description of Artificial Sequence: Synthetic coding sequence
atgtcccggtgctgtagtagacagccggcttgttgttctagttggatgttcggacgcactgctgtcacctcctgcagtctgagttgtataccacctattgcgtgggcctcggttcatctacaaatgtacacccctgcactcacattttgctcacggccaatgccaactcagcatttccctgaagtcatgctcggagaggagttcctgtccctgagtctagaccaggtatgtagtttgatcagtagcgataagttgacggtgagtagcgaagagaaagtttttgaagcagtcatttcctggattaattatgagaaagaaacaagacttgagcatatggccaagctcatggagcacgtgcgtctacctttgctccccagggactatttagtacagactgtggaggaagaagctctgatcaaaaataacaatacctgtaaggacttcctcatcgaagctatgaaataccacctcttgcccttagatcagcgcctcctaatcaaaaacccaaggacaaagcccagaaccccagtgagcctgccaaaagggcttgagtgtctggctgacagctgtactccgcaggtgggaatgatgggattatggtag

SEQ ID NO: 121417 - DNA, 1668 bp, Artificial Sequence
  Description of Artificial Sequence: Synthetic coding sequence
atgggaaaagcctttaaggtaatgaacgagctccggtctaaacaacttctctgtgatgtcatgattgtcgcagaggacgtggaaatcgaggcccaccgggtggttttagctgcctgtagcccttacttctgtgccatgtttactggcgacatgtccgaaagcaaggcaaagaagatcgagatcaaggacgtggacgggcagacactctctaaactgattgactacatttatacggccgaaatcgaggtgactgaggagaacgttcaggtgttgttgccggctgcttctctgttgcagctaatggatgtccgtcagaattgctgcgattttctccagagccagctccacccaacaaactgtctcggcatccgggcttttgccgatgtgcacacttgcaccgatttgttgcagcaagctaatgcctatgcagagcagcacttccccgaagtaatgctcggtgaagagttcctcagcctgtcactcgatcaagtttgtagtctgatttcgagtgataaactcactgtgtccagcgaggagaaagtattcgaggccgtaatcagctggataaactacgagaaagagacacggctggagcatatggctaaattgatggagcatgtacgcctcccacttttaccccgcgattaccttgttcaaactgtggaggaggaagctctgatcaaaaataacaatacctgcaaggattttctcatcgaggcgatgaaatatcacttgttacctttggaccagcgattgctcatcaaaaatcccaggaccaaaccacgcacacccgtttccctcccaaaagttatgattgtcgtaggaggacaggccccgaaggccatccggtctgtcgagtgttacgattttgaggaggacagatgggaccaaatcgctgaactgccctctcgaagatgcagagccggcgttgtgttcatggcgggacatgtgtacgctgtaggaggcttcaatggcagcttgcgggtaagaacagtcgatgtctatgacggagtgaaggaccagtggacatccattgcctccatgcaggaaagaaggtcaaccctgggagcggctgtgctcaacgatctcttatatgccgtgggtggattcgatgggagtaccggtctggccagtgtggaagcatatagctataaaaccaatgaatggttctttgtcgctccaatgaacacccgcagatccagtgtgggcgtcggcgtggttgagggtaaactgtatgcagtgggcggctatgatggggcctcccgtcagtgtctgagcacagtcgaacaatacaatcctgctaccaatgagtggatctacgtggcagacatgtccactaggagaagtggcgctggcgtcggtgtgctgtcaggccagctctacgccaccggcggtcacgacggccccttagttaggaagtccgtagaggtatacgacccaggaaccaatacgtggaagcaggtcgctgacatgaatatgtgcagacgcaacgccggggtatgcgccgtgaacggcctgctgtacgtggttggcggagacgatggctcttgcaatttggcctctgtcgaatattacaatcccgttacagataagtggaccctcctgccaaccaacatgagcacaggtcgctcctacgcgggcgttgccgtgatccacaagtccctgtag

SEQ ID NO: 121418 - DNA, 1905 bp, Artificial Sequence
  Description of Artificial Sequence: Synthetic coding sequence
atggctccaaagaaaaagattgtgaaaaaaaataagggagatataaatgaaatgactattatcgtagaagacagccccctgaacaaactgaacgcactgaacggacttttggaaggcgggaacggcctcagttgcatcagctcagagctgactgatgctagctacgggccgaacctgctagagggtctgtctaagatgcgacaggagaatttcctctgcgacctcgtgattggcaccaagactaaaagcttcgatgtgcacaagagtgtgatggcatcctgttccgagtacttctacaatatcttgaagaaggacccttccattcagagagtggacctgaatgacatatctccactgggactggccactgttattgcctacgcctatacgggaaagctcacactttcactctacacaatcggatccattatctcagccgccgtgtacctgcagatacacacacttgtcaagatgtgctcggacttcctcattcgggagatgagcgtggaaaactgcatgtacgtcgtgaacatcgctgaaacctacagcctgaaaaatgccaaggcggctgcccaaaaatttatcagggataactttctggaattcgcagagagtgaccaattcatgaaactgaccttcgaacagattaatgaattgcttattgatgatgatttacagctcccctcagaaattgtggccttccaaattgcaatgaaatggttagagttcgaccaaaagcgcgtgaaatacgccgccgacctactcagcaatatccggttcggcacgatctccgcgcaggatcttgtaaattatgtacagtccgtcccgagaatgatgcaagatgcagactgtcatagactgctggtcgatgcgatgaattatcatctgctaccttaccatcagaatacactgcaatctaggcggactaggatacgtggcggctgtcgtgtgttagtgaccgtggggggaagacccgggcttactgaaaagtcactttcccgtgatatactgtacagggacccagagaatggctggagcaaattgaccgagatgcccgccaaatcttttaatcagtgcgtggcagtaatggatggttttttatatgtggctgggggagaagaccagaacgatgctcgcaaccaggccaagcacgcagtgtccaacttctgtcgctacgaccctcggtttaacacgtggatacatcttgcctcaatgaaccagaaacggacacatttttcactatcagtttttaatgggttagtctatgctgcagggggacgtaatgccgagggctccctggcctcattagagtgctatgtgcccagcactaaccaatggcagcccaagacaccactagaggtagctcgctgctgccacgcctcggcagttgctgatggaagggtcttagtcactggggggtatatcgctaacgcctatagccggagcgtttgcgcgtatgaccccgctagtgattcctggcaggagctgcccaacctgtctactcctagaggttggcactgcgctgtgaccttgagtgacagagtctacgttatgggcggaagtcagctgggaccaagaggcgagagagtagatgtgctgactgtggagtgctactcccctgccacgggtcagtggtcctacgccgcccccctgcaagtgggggtgagcaccgctggagtctccgcccttcatggacgcgcctacctggtcggaggatggaacgaaggcgagaagaaatacaaaaagtgcattcagtgtttctcccctgagcttaacgagtggaccgaggacgatgagctcccagaagccacggtcggagtttcctgctgtaccctgtcaatgccaaacaatgtaaccagggaatctcgcgccagtagtgtgagctctgttccagtgtccatctag

SEQ ID NO: 121419 - DNA, 1905 bp, Artificial Sequence
  Description of Artificial Sequence: Synthetic coding sequence
atggcccctaagaagaaaattgtcaagaaaaacaagggggacatcaacgagatgactatcatagtcgaagacagccctctgaataaactcaacgcactgaatggcttactggaaggtgggaacggtctcagttgtatttcaagcgagctaactgacgcgtcttatggccctaatctgctagaaggcctgtccaaaatgaggcaagagaacttcctgtgtgaccttgtgatcggtacaaagacaaagtcattcgacgtacataaatccgtgatggcatcttgttcggaatacttctataacatcctaaagaaagatcctagtatacagagagtggacttgaacgatattagtcctttgggcctcgctacggtgattgcctatgcgtataccggaaaactgaccctctcactttacacaatcggcagcattattagtgctgccgtctacttacagatccacaccctcgtgaaaatgtgctcagattttcttatcagagagatgtctgtcgagaattgtatgtacgtggttaacattgccgaaacctattctctcaagaatgccaaggccgctgcccagaaatttatcagggacaactttctcgagtttgctgagtccgatcaattcatgaagctgacattcgaacaaattaacgaactactaattgacgatgatcttcagttgccttcagaaatcgtcgcttttcaaatcgcaatgaagtggctggaatttgaccaaaaaagagtgaaatacgcggccgatctcttgagtaacatcagatttggaacaatcagtgcccaagatctggtcaactacgtacagtccgtgcctcgaatgatgcaagacgcggactgccatagacttcttgttgacgcaatgaattaccacctcctgccctaccaccaaaacactcttcagtcgcgccggacccgcatccgtggaggttgccgcgtactggttactgttggcggccgacctggcttgacggagaaatccctgtcccgggacatcctctatcgcgatcccgaaaatggctggtctaagttgacagaaatgcccgctaaaagcttcaaccagtgtgtggcggttatggatggcttcctgtacgttgcgggaggcgaagaccagaatgatgcgcgcaatcaggctaagcatgcggtatcaaatttctgccgttacgaccctcgatttaacacttggatacacttggcatcaatgaaccagaagcgcacacacttctccctcagcgtcttcaacgggctggtgtacgccgccggtggccgaaatgctgaaggatccctcgcatcacttgagtgttacgtcccttcaaccaatcaatggcaacccaagacacccctagaggtggcgcgctgttgtcacgcctccgcagtagccgatggaagggtcctcgttactggtggatacattgccaatgcgtattcaagatccgtgtgtgcctacgatcctgccagcgacagttggcaggaactgccgaacctgagcactccaagaggctggcattgtgctgtgaccttgtccgatagagtgtatgtgatggggggctcccagctggggcccagaggcgaaagagtggatgtattaaccgtcgagtgctatagtcccgctactggccagtggtcgtatgctgcaccactccaagtgggagtttccacggcaggtgtatctgccctgcacggaagagcgtacttggtcggtggctggaacgagggggaaaaaaagtataagaaatgtattcagtgtttctcccctgaattgaatgagtggaccgaggatgatgaactgccagaggccaccgtgggcgtgtcatgctgtaccctctctatgccaaataatgtgactagggaatcccgcgcaagctcggtatcaagtgtgccagtcagcatttag

SEQ ID NO: 121420 - DNA, 2313 bp, Artificial Sequence
  Description of Artificial Sequence: Synthetic coding sequence
atgaacgttatttactttccacttcatatctttgttgtgtatagtcgggcctacacctccctggttcttgtggggtgcactaacctgtgcgctgtcttatttgccagatgtctggatgatcacttggtgtctctgagaatgtccggtagccgcaaagaatttgatgtgaaacagattctgaaaatccgctggcgctggttcggtcatcaggccagtagtcctaactcgactgtggatagtcagcagggcgagttctggaatagaggtcagactggagctaacggcggaaggaagttcctcgacccgtgcagcctgcagctgcctcttgcgtccattggataccgcaggtcatctcagctggactttcagaattcgccctcctggcctatggcctccacttcagaggtgccagcgtttgagttcacagcggaagactgtgggggcgctcattggctggatcgtcccgaagtcgatgacgggacctccgaggaagagaatgagtccgatagctcttcctgcagaacaagcaacagtagtcaaacactgagcagctgccacacaatggaaccttgcacctccgacgagtttttccaggccctcaaccacgccgagcagaccttcaaaaagatggagaattaccttagacataagcagctttgcgatgtgatcctggtggcaggtgaccgccggattccagcccaccgcctcgtgctgtcctcagtcagtgattattttgcagcgatgtttactaacgacgtacgggaggcgcgtcaggaagaaatcaaaatggaaggagtggaacccaactccctgtggtcgctaatccagtacgcctataccgggaggttggagttgaaggaggacaatattgagtgtttactaagcactgcctgtttgctgcaactttctcaagtggttgaggcctgttgtaaatttctcatgaaacaattacacccttcaaactgtcttggtatccgatccttcgcggatgcgcaggggtgtacagacctgcacaaggtggcacataattacactatggaacactttatggaggttattagaaaccaggaattcgttctgttacctgcctccgagatcgcaaagctactggcatccgacgacatgaatatccccaacgaagagacaattttgaatgcgctgttgacatgggtgagacacgatttggagcagcgaaggaaggacctgtccaaactgctggcatacatcaggctgcccctcctggctccccaatttctggccgacatggagaacaacgttctgttccgcgatgacatcgagtgtcaaaaactgattatggaagccatgaagtaccatctgctaccagagcgaagacctatgttgcagtctccaaggacaaagcccagaaagtcaacagtcggcacactttttgctgtgggaggcatggacagcacgaaaggcgcaaccagtattgaaaaatacgatcttagaaccaacatgtggacccctgtggccaacatgaacggccggcggctccagtttggtgtggccgtgttggatgacaagctgtatgtcgtgggtggacgggacggcctcaaaactttaaacaccgtcgagtgctacaaccccaaaacgaaaacatggtctgtgatgccccctatgtctactcaccgacatggccttggagttgccgtcctcgaaggaccgatgtatgctgtgggtggccatgatggatggtcatacttgaataccgtggaaaggtgggatccccaggcccggcagtggaactttgttgcgaccatgtcaacacctagaagtactgtgggggtggcggttctctctggaaagttgtatgccgtgggggggcgcgatggcagttcttgtctaaaatccgttgagtgtttcgatccgcatacgaacaagtggacactttgcgcacagatgtccaagcgaaggggcggggtgggcgtgacaacgtggaatggcctgctgtatgcaatcggagggcacgacgctcctgcctcaaacttaacctcacgactgtctgattgtgtggagcgctatgaccctaagacagacatgtggacagccgttgcgagtatgtcaatttcacgcgatgcggtgggcgtgtgcttgctcggtgataaactatatgccgtcgggggatatgatgggcaggcttacctgaacactgttgaggcatacgatccccagaccaacgaatggactcaggtgttctcccataccttcgaggacagcaaagatcatctcgtggcaatcaagcaaacaatttggagacagaactccctgtcggaagaatttcgctcccattag

SEQ ID NO: 121421 - DNA, 2274 bp, Artificial Sequence
  Description of Artificial Sequence: Synthetic coding sequence
atgaacgtgatctattttccgctgcacattttcgtggtgtactctcgagcgtatacgagtctggtgctcgtgggctgtactaacctttgcgccgtactgttcgctagatgcctggacgatcatttagttagtctccgtatgagcggtagccgcaaggaattcgatgtaaaacagattctgaaaatcagatggcgttggttcggacaccaggccagttcaccaaattctaccgtggattctcagcaaggggagttctggaacaggggacagaccggggccaacggaggacgtaaattcctagacccctgctccttgcagctgccgctggcctcgatagggtatcggaggtcttctcaactggattttcaaaacagtccttcatggccaatggcgagcacgagtgaagttccagcctttgagttcactgccgaggactgtggcggagcgcactggctggaccggcccgaggtggatgacggtacaagcgaggaggaaaacgaatccgactctagttcctgtcgaacctcaaactcctcgcagacacttagctcatgtcataccatggagccatgcacttcagatgagttcttccaagctctcaaccacgccgagcagactttcaagaagatggaaaattatttgagacataagcaactttgtgatgtaatcctcgtcgccggagacagacgcatcccagctcaccggttggtgctctcaagtgtctccgactacttcgctgccatgtttactaacgacgttcgcgaagcgagacaggaggaaattaaaatggagggcgtcgagcccaacagtttgtggtccctgattcagtatgcctacacaggccgtctcgagctgaaggaggacaatattgagtgtctgctgtccacagcctgtctgctccagctatcacaggttgtcgaggcttgttgcaagttccttatgaaacagctgcatcctagcaactgcttaggcattcggtctttcgctgacgcccagggatgcaccgacctgcacaaggttgcacacaactacacaatggagcattttatggaggtaattaggaatcaggaatttgtgctgcttccggcttccgaaattgcaaagctcctcgcctcagacgatatgaatattccaaacgaagaaacgatcttgaatgcactcctcacctgggtaagacatgacctggaacagcgtcgtaaagacctcagcaaactactggcctacatccggcttcccttactggcaccacaattcctggccgacatggagaataacgtactgttccgcgatgatatcgaatgccagaagctaattatggaggctatgaagtatcatctgctccccgagcgcagacctatgctgcaatcccctcggaccaaacccagaaagtctaccgtgggaaccctcttcgccgttggaggcatggacagcactaaaggcgccacaagtattgagaaatacgatctgaggaccaacatgtggacacccgttgcgaacatgaatgggcgtcggctgcagttcggtgtggcagtattggacgacaaactgtatgttgtaggaggccgtgatggcctgaagactttaaacacagtagagtgttataatccgaagacaaagacatggtccgtaatgcccccaatgagtactcaccgacacggtctgggagtcgccgtgctggaaggacctatgtacgcagtggggggacatgacggctggtcatacctgaataccgtcgagcgctgggacccgcaggcgagacaatggaattttgtggccacaatgagcacccctaggagcaccgtaggcgtcgccgttctctcgggaaagctgtacgccgttggaggacgggacggcagttcttgtcttaagagtgtggagtgctttgatcctcatacgaacaaatggactctgtgcgcacagatgagcaaaaggcggggcggggtcggcgtgactacatggaacggtcttttatacgcaattggggggcacgatgctcccgccagtaatttgacgtcccggttgtctgactgcgtggagaggtatgatcccaaaacagatatgtggactgctgtcgccagcatgtcgataagtcgcgatgcagtgggggtctgtctactcggagacaaactgtatgccgtgggaggctacgacggtcaggcctacctgaacactgtcgaagcttatgatccacagaccaacgaatggactcaggtctggcactcttgtttcattatcacgttgaccctgttcttgctgaagcaatttctgtggtag

SEQ ID NO: 121422 - DNA, 2268 bp, Artificial Sequence
  Description of Artificial Sequence: Synthetic coding sequence
atgaacgtgatctacttccctttgcacatctttgtagtctattcacgggcttatacttccctggtgttggtcgggtgtaccaatttatgcgcagttctgttcgcgcgctgtcttgatgaccacctagtctcgctccgtatgagcggcagccggaaggaattcgatgtcaagcaaatcctgaagattcgatggcgttggttcggtcatcaagcaagcagccccaactctacagtcgatagccagcagggagagttctggaaccgggggcagaccggggccaacggcgggcgcaagtttctcgacccctgtagcctgcagttgcctctcgccagtatcggttatcggcggagcagtcaactggatttccagaattctcctagctggcccatggcaagcaccagtgaagttcctgcattcgaatttaccgctgaggactgcggtggagcccattggctcgaccgcccagaggtggacgatggcaccagtgaggaggaaaatgaatctgactccagtagttgccgcacttcaaattcatctcagaccctttcatcatgccacactatggaaccatgtacctcagacgaattttttcaagctttgaatcacgctgaacaaaccttcaagaaaatggaaaactacctgaggcacaaacaactgtgcgacgtcattcttgtggcgggggatagacgaatccccgcgcatcgcctggtgctcagctccgtttcggactacttcgctgccatgtttaccaacgatgtccgggaggccaggcaggaggaaatcaagatggaaggggttgaaccaaacagtctgtggtctctgattcagtacgcatatacaggccggctcgagctgaaagaggataatatcgagtgcttattgtctacagcgtgccttctccagctcagccaggtcgtggaggcttgctgtaaatttttaatgaagcagctgcatcccagcaattgcctggggatcagatcttttgcagatgcccaaggatgtactgatctccacaaggtagctcacaactacacaatggagcattttatggaagtgatcaggaaccaggagttcgttcttctccctgcttctgaaatagcaaagctgctggcttcagacgacatgaacatccctaacgaagagaccattctcaacgctctgttaacttgggtgcggcacgacctggaacagaggaggaaagatttgagcaaacttttggcctacattagactgccgctcctcgctcctcagttcctcgccgatatggagaacaatgtgctgttcagggatgatatcgaatgccagaagttgattatggaggccatgaagtatcacttactgccagagcgccgcccgatgctacagagccccaggactaagccaaggaaaagcaccgtgggcaccctgtttgcggttggcgggatggactcaaccaaaggggctaccagtatagagaaatatgatctacggactaatatgtggacgcccgtcgctaacatgaacggtaggagactgcagttcggggtcgccgtgctggatgacaaactatacgtggtgggcggacgagacgggcttaagactctgaataccgtcgaatgctacaacccgaaaacaaaaacctggtcagtgatgcctccaatgagcactcatagacacgggctaggggtggcggtgctcgagggacctatgtacgcagtcggcggtcatgacggttggtcatatctgaacaccgtggagcggtgggatccacaggctaggcagtggaactttgtggctaccatgtctacacctcgatctacagtgggagtggccgtgttgtcaggcaagctctatgctgtgggagggagagatggatcgagctgtcttaagagtgtagaatgtttcgacccccatacaaacaagtggaccctgtgtgcgcagatgtcaaagcgccgtggcggcgtgggagtcacaacttggaatggactgttgtacgctattggaggccatgacgccccagctagcaatctgaccagtaggctctctgattgtgtggaaagatatgatccaaagacagatatgtggaccgccgtggcctcgatgtcaatttctcgagatgccgtgggagtctgccttctgggtgataaactgtatgctgtcggcgggtatgatgggcaggcatatctcaataccgtggaagcatatgaccctcagactaacgaatggacacaggtggctccgttgtgcctgggtcgtgccggtgcctgtgtggtaacagtcaaactgtag

SEQ ID NO: 121423 - DNA, 849 bp, Artificial Sequence
  Description of Artificial Sequence: Synthetic coding sequence
tagcggactaatatgtggacgcctgtggctaatatgaatggacgtcggctccagttcggtgtggctgttctggatgataaattgtacgtggtgggcggccgggatggcctgaaaaccttgaatactgtggaatgttataacccaaaaactaagacctggtccgtgatgcctccaatgtcgacccaccgccacggactgggtgtcgctgtgctagagggtcccatgtacgcagtgggaggccacgatggctggtcatatctgaataccgttgaacgctgggacccccaggctcggcagtggaatttcgttgcaaccatgtctacaccccggtcaaccgtgggcgtcgcggtactatcaggtaaactatatgctgtggggggaagagatggcagcagttgtctcaaaagcgtggaatgttttgacccccacaccaacaaatggaccttatgtgcacagatgagcaagaggagaggcggcgtcggggtcaccacttggaacggattactttacgcaattggtggccatgacgcccccgccagcaacctcacaagcaggttatcggactgtgtggagaggtatgaccctaagacagatatgtggactgctgttgctagcatgagtatttccagggatgctgtcggcgtttgcctgctgggtgataagctttatgccgttggcggctacgacggacaagcttatctcaatacagtcgaggcctacgacccccagacgaacgagtggacacaagttttttctcatacttttgaagacagcaaggatcacctggtggcgatcaaacagactatttggcgccaaaactcactgagtgaagaatttcgctctcactag

SEQ ID NO: 121424 - DNA, 2370 bp, Artificial Sequence
  Description of Artificial Sequence: Synthetic coding sequence
atgcgactgcctggacagggcctgggcgctcgggagggcccgagtatccccctgagttcccccgctcctgccccggccagccctgctccaccggcgtggccgccacggccggcagttacacacggtagattgcgcagccccacaaggcgcgcctataccagtttagtgctagtgggctgcacaaacctatgtgctgtgctcttcgcacgctgtttggatgatcacctcgtcagtctgagaatgtccggaagccgcaaagagttcgacgtcaagcagatcctgaagatccgctggagatggtttggacaccaagcgtcttctccaaattcaactgttgactcacagcagggggaattttggaatagaggccagaccggtgcaaacggcggaagaaaattcttagatccttgcagcttgcagctgcctctggcttccattggataccggcgtagctctcagctcgatttccagaattccccctcttggcccatggcctccactagcgaggtccctgcttttgagttcaccgccgaggattgtggcggtgcccactggctcgaccggccagaagtggacgacggcacaagcgaggaagaaaacgaaagtgacagctcaagttgtaggaccagcaactccagccagactctctcgagttgccatactatggaaccctgtactagcgacgagttttttcaagctttgaatcacgcagagcagaccttcaaaaaaatggaaaactatctgcggcacaaacagctatgtgatgttatactcgtagccggggaccgcagaataccagcgcacaggttagtgctttcctccgtgtctgactactttgctgccatgtttacaaatgatgtccgcgaagcccggcaggaagaaataaagatggaaggggtggaacccaacagtctgtggagcctgattcagtacgcatacactggccggttggaactgaaggaagacaacattgagtgcctcttgtctaccgcatgcctccttcaactgtctcaggtcgtcgaagcgtgttgcaaattcctcatgaagcaattgcaccccagcaactgcttaggtatcagatcatttgccgacgcccaaggatgcacagacctgcataaagtggcacataattacaccatggaacacttcatggaagtcattaggaatcaggaattcgtcttactgcctgcctcagaaattgcgaaactgctggcatccgacgatatgaatattccaaatgaagaaacgatcctcaacgctctgctgacctgggtgcggcacgacctggaacagcggaggaaggatcttagcaagctccttgcttacattagactgccgttactggctccacagtttctcgctgatatggagaacaacgtgctgttccgcgacgatattgaatgtcagaaactgattatggaagctatgaaatatcatctcctgccagagcgcagacctatgttgcagtcaccccgcaccaaaccccgaaagtccacggtgggcaccctgtttgccgtgggtgggatggatagcacaaaaggagctacatctatcgagaagtacgacctgagaacgaatatgtggacgccagtggccaatatgaacgggcggcgcctgcagttcggcgtagctgttcttgatgacaaactgtatgtggtcgggggacgtgacgggctgaaaacacttaatacggtggaatgctataaccccaagaccaagacttggtccgtgatgcctccgatgtccacacaccgtcacggattaggcgttgctgttcttgaaggccctatgtatgccgtgggaggccatgatgggtggagctacctcaataccgtagaacgctgggacccccaggcccgccagtggaattttgtcgccaccatgtctactccaagatccaccgtcggcgtcgctgttctgagtggcaagctatacgccgttggaggcagggatgggagtagttgcttaaagagcgtagaatgtttcgatcctcatactaacaagtggacactttgcgcccagatgtccaagcggcgaggcggcgtgggtgtaacaacatggaacggtctcctgtacgcaatcgggggtcacgatgccccagcttccaacttgacatctagattgagtgattgtgtggagcgctatgatccaaaaactgatatgtggaccgccgttgcctcaatgagtatatcaagagacgcggtcggagtctgtctcctgggggacaagttgtacgccgtgggcgggtatgacggtcaggcgtacctaaacacagttgaagcttacgatccacagaccaatgagtggactcaagtggccccgctttgtcttggtcgggctggagcttgtgtggtaacagtaaaactttag

SEQ ID NO: 121425 - DNA, 1050 bp, Artificial Sequence
  Description of Artificial Sequence: Synthetic coding sequence
aaaaagcacccctccacagtgatggtaccccaattcttggctgacatggagaataatgtgctttttagagatgatatcgagtgccagaaactgatcatggaggctatgaaatatcatctactgcctgagcgcagacctatgttacagagcccccggaccaaaccacggaagtccaccgtgggcaccctttttgcagtggggggaatggattcaactaagggcgctacatcgatcgagaaatacgaccttcgcactaacatgtggacacctgtagcaaatatgaatggacgccgtctgcagttcggggtggctgtgttggacgacaaactttatgtagtggggggacgcgacggcctgaagacgctaaacaccgtagaatgttataatcccaagacaaagacctggagcgtcatgccaccaatgagcacccaccgccatggtctgggcgtggccgtgctcgaagggcccatgtacgccgtgggaggtcatgacgggtggtcctatctcaatacagttgagcgatgggatccccaggcgaggcagtggaacttcgtggctaccatgtccactcctcggtctactgtcggtgtcgccgttctgtccgggaaactgtacgcggttggtggacgcgatggctcatcgtgccttaaaagcgtggaatgcttcgacccacatacgaataagtggacactgtgcgctcagatgtcaaagaggcggggcggtgtcggagtcacaacttggaatggtctcctatacgcgatcggcggccatgatgcccccgctagcaaccttacgagcagattatccgactgcgtggagcgatacgacccaaaaaccgacatgtggactgcggtggctagcatgtccatatccagagacgctgtgggcgtgtgcctattgggcgacaagctgtacgcagtaggtggatacgacggacaggcttacctgaacaccgtagaggcatatgaccctcagactaacgaatggacacaggtggctcctctatgtctaggcagagcgggcgcgtgtgtggttactgtgaagctgtag

SEQ ID NO: 121426 - DNA, 2130 bp, Artificial Sequence
  Description of Artificial Sequence: Synthetic coding sequence
atgtctggttcacgcaaagaattcgatgtgaaacagattctgaagatccgctggcggtggtttggtcaccaagcatctagcccaaatagcacagtagattcacagcagggggaattctggaaccgaggtcagacgggggccaatggcggtaggaaattccttgatccgtgctcgctgcagctcccactggcgtccattgggtacaggcgttcttctcaacttgacttccagaattctccatcttggccaatggcgtcaactagtgaagtgcccgcttttgagttcacagccgaagattgcggaggcgcccactggctggacagacctgaagtggacgatgggacttcagaagaggagaacgagtccgacagttctagctgtcgtacttccaattctagtcagaccctgagctcctgtcatacaatggaaccctgcacaagtgacgagttttttcaggctctgaatcacgcagaacaaacctttaaaaagatggagaattatctgcgccataagcagctgtgcgacgtgattctggtcgccggggaccgtcgcatacccgctcatagactagttttgagctcagtgagcgactattttgccgccatgttcactaacgacgtcagggaagcccggcaagaagagattaaaatggaaggagtcgaacccaactccctctggagcctgatccagtacgcctatacgggtcggcttgagctgaaagaggacaatatagagtgcttgttatccacagcatgcctgctgcagctttctcaggtcgttgaggcctgttgcaagttccttatgaaacagcttcatcccagcaactgcttgggtatccgctctttcgctgatgcccagggctgcactgaccttcacaaggtcgcccacaactacactatggaacacttcatggaggtgatacgcaatcaggagtttgtgcttctgcccgcgagcgaaatagctaaactcctggcatccgacgatatgaacattcccaacgaagagactattctcaatgctctgttgacatgggtgaggcacgacctggagcagcgccgcaaggacttaagcaagctgctggcctatattcgtttgccccttctagccccccagttccttgcggacatggaaaacaatgtcttgttccgtgatgatattgaatgccagaaactcatcatggaggccatgaagtatcacctcctccccgagagacggcccatgctgcaatcccctcgcacaaaacctagaaagagtacagtgggcaccctcttcgcggtgggcggaatggattccactaagggcgctacttccattgagaagtatgacctgcggaccaacatgtggacgcctgtcgccaacatgaacggacggcgtctccagttcggcgtcgctgtgttggatgacaagctttacgtggtgggcggaagagacggtctcaaaacgctcaatactgtcgagtgctataatcccaaaactaagacctggtctgtgatgccacctatgtccactcatcgccacggccttggcgtggcagtgctggaagggcctatgtacgccgtcggcgggcatgacggctggtcctacttaaacaccgtagaacgttgggaccctcaggcaagacagtggaattttgtcgccacaatgtcaacacctaggagcacggttggcgtggcagtgctatccggtaaactctacgcagtaggaggccgcgatggaagtagttgtctaaagagcgttgaatgttttgaccctcacactaacaaatggacactgtgtgcacagatgtcaaagagacgaggaggagtgggcgtgacgacatggaacggtttgctgtatgcaatcggagggcatgatgcccctgcatctaaccttacctcccggttgtccgactgcgtggagcgatacgacccgaagaccgatatgtggacagccgtggcttccatgagtatctctcgagacgctgtcggtgtgtgcctgttaggagacaaattatacgctgtcggaggttacgacgggcaagcctacttgaataccgtcgaagcctatgatccacagacgaacgaatggacacaagtggctccactgtgcctgggccgtgcgggcgcatgcgtggtcactgttaaactgtag

SEQ ID NO: 121427 - DNA, 2085 bp, Artificial Sequence
  Description of Artificial Sequence: Synthetic coding sequence
atgaatgtcatttatttccccttgcatatctttgtggtatactcccgtgcctacacatcactcgtcctagttggctgtaccaacttgtgcgctgttttgtttgcccgctgcctggatgaccatctcgtgtcactgaggatgagcggctcccgaaaggagtttgatgtcaaacagattttgaaaattcgctggagatggtttggacaccaagcatcttccccgaattccaccgtggattctcaacaaggcgaattttggaatagaggtcagaccggagctaacggggggcgaaagtttcttgatccttgctctttacaactgcctctcgcctcgatcggctacaggagatctagtcaactggactttcagaactcccctagttggccaatggcctctacgagcgaggtaccagctttcgaattcaccgccgaggactgcgggggcgcccattggcttgataggccggaagtcgacgacggcacatccgaagaggaaaacgagagcgattcctctagctgtcgactggtcctgagctccgtgtccgattatttcgctgccatgttcaccaacgacgtcagggaagcacggcaggaggaaattaagatggagggggttgaacctaacagcctctggagcctcattcagtatgcatatacagggcgactcgaattgaaggaggataacatcgaatgtttgctatctaccgcatgcctccttcagctatcccaagtcgttgaagcttgctgtaaattcttaatgaagcaactgcatccctctaattgccttggaatcaggtccttcgccgacgctcaaggctgcacagacctccacaaggtggctcacaattatacgatggaacatttcatggaggtaatccggaatcaggagtttgtgcttttgcccgcgagcgagattgccaagctgctggcctccgatgatatgaacatccctaacgaggagacaatcttgaatgctttacttacatgggtaagacatgacttagaacagaggcgcaaggatctctcaaagctgttggcgtatattcgcctgccactgttggccccccaatttctggccgacatggagaacaacgtgctgttcagggacgacatagagtgccagaagctcataatggaggcaatgaagtaccacctattacctgaacggcgccccatgttgcaaagccctcgcacaaaacctcgtaaatccacggttggtaccttgtttgccgtgggcggcatggacagtactaagggagcgacttctatcgaaaaatatgatctgagaaccaacatgtggacccccgtggccaacatgaacggcaggcggctccaatttggagtggccgtcttagatgataaactttacgtggtcggcggccgggatggcctgaagactctgaataccgtcgaatgctataacccaaagacgaagacatggtctgtcatgccaccaatgagcacacaccgccacgggctgggcgtggcagtgctggaggggcctatgtatgcagtgggtggacacgatggttggagctatttaaatacggtggagcgctgggatccacaggcccggcagtggaacttcgtcgcaaccatgtctaccccacgatcaacggtcggagtagccgtgctctccgggaagctctatgctgttggcggcagggatggaagtagttgcctgaaatccgttgagtgcttcgacccccataccaacaaatggacgctatgtgcacagatgagtaagagaaggggtggggttggtgtgaccacgtggaacggcctgctatacgccattggggggcacgatgcgcctgctagtaacctgaccagcagactttccgactgtgtggagagatacgatccaaaaactgacatgtggaccgcggtggccagtatgagtatcagcagggacgctgtcggggtttgcctgttgggcgataagttgtacgcggtaggcggctacgacggtcaagcctacctcaataccgtggaagcctacgacccacagaccaacgagtggacccaggtcgcaccactgtgtctggggcgggcaggtgcctgtgttgttacagtgaaactgtag

SEQ ID NO: 121428 - DNA, 1707 bp, Artificial Sequence
  Description of Artificial Sequence: Synthetic coding sequence
atggaaccgtgtacctccgatgaattcttccaggcccttaaccatgctgagcagacgttcaaaaagatggagaactacctacgtcacaagcagctgtgcgatgtaatcctggtggctggggaccgaaggattcccgcccaccggctcgtgctctcatctgttagcgattatttcgccgccatgttcacaaatgatgtgcgagaagccaggcaggaggagattaagatggagggagtcgagccaaactctttgtggtctctgatacagtacgcatatacaggacggctcgagctgaaagaagataatattgagtgtctgctgtcaacggcttgcctgctccagctgtcgcaggtcgtggaggcttgctgcaaattcctgatgaagcaactgcacccgagcaattgtctcggaattcgcagcttcgccgatgctcagggctgtacagaccttcataaggtggctcacaattacactatggaacacttcatggaagtgatcagaaaccaggagttcgtgttactgcctgcgtctgaaatcgccaagctgctagcgagtgatgacatgaatattcctaacgaagagactatcttgaacgccctgctcacctgggtgagacacgatctggagcagcgcaggaaagatctgtccaagctgctggcctatatccggctgcccctgttagccccgcaattcctggcagatatggagaataatgttcttttcagagatgatatcgaatgccagaagttaatcatggaagctatgaagtaccaccttcttcccgagcggaggcctatgctgcagtccccgcgcactaagccacgtaagagtaccgtggggacactttttgctgtgggagggatggattcaaccaagggggccactagtatcgaaaagtacgacctccggaccaatatgtggactccagtggccaacatgaacggccgaaggctacagttcggagtcgcagtactcgacgacaagctgtatgtcgtgggcgggagagatggactgaaaacactgaacactgtcgagtgctacaatcctaagaccaagacatggtccgttatgccgcctatgtccacacaccgccacggtcttggagtcgcagtgctagagggccctatgtacgcagtgggtggacatgatgggtggtcctacctgaacaccgtggaacggtgggatccacaggccagacaatggaacttcgtagctactatgtctacacctagaagcacggtaggtgtcgccgtcctgagcggtaagctctacgcggtcggcggccgggacgggtctagctgcctgaaatccgtggagtgcttcgatccacataccaataagtggaccctgtgtgcccagatgagcaagagaaggggtggcgttggcgtcaccacttggaacgggttactgtacgcaatcggggggcacgatgccccggcaagcaaccttacctcacgcctgagtgactgtgtcgaaaggtacgaccctaagacggatatgtggacagccgtcgcatcaatgtctatctcccgggatgccgtaggtgtttgtctcctcggcgataagctctatgctgtgggtggatacgatggccaggcttacctgaatacagtcgaagcttatgatccacagactaacgagtggactcaggtggcaccactgtgcttaggcagagccggcgcctgcgtagtgactgtgaaactgtag

SEQ ID NO: 121429 - DNA, 1866 bp, Artificial Sequence
  Description of Artificial Sequence: Synthetic coding sequence
atgttgatggcggggcagcggggagcttggaccatgggggacgtcgtggagaagtccctggaggggcccctggcaccctctactgacgagcccagtcagaaaaccggagatctggttgagatacttaacggagaaaaagtgaaatttgacgacgcaggcctgtctttgattttgcagaacgggctcgaaacgctacgcatggagaacgccctcacagatgtaatcctttgcgttgacatccaggagttctcttgtcatcgcgtggtgcttgccgccgcatccaactactttcgggctatgttctgcaacgatctgaaggagaaatatgaaaagcgtatcattattaaaggagtggatgctgaaacaatgcacacactgctcgactacacatacacttccaaggcgctcatcaccaagcagaacgttcagagggttctggaagcggctaaccttttccagttcctgcgaatggtggatgcctgtgctagctttctaactgaggcccttaaccccgaaaactgtgtgggaattctgcggttggccgacacacatagcttggattcccttaaaaagcaagtgcagagctatatcattcagaattttgtgcagattctgaactcagaggaattcctcgatctgcctgtggatacccttcaccatatcctgaagtccgacgatttgtacgtgaccgaagaggcacaggtatttgaaactgtgatgtcctgggtgcggcacaagccttccgagagactgtgtcttttgccttacgtgctagagaatgtgaggctcccgttgctcgatccctggtattttgtggagacagttgaggctgaccccctgatccgacaatgtcctgaggtgtttcccctgcttcaggaggcgcgcatgtatcacctgagcggaaatgagattatctccgaacgtaccaaaccccgcatgcatgagtttcaaagtgaagtctttatgatcatcggcggctgcaccaaggacgagcggttcgtcgcggaagtgacttgcctggaccccctgagacggtcgaggttagaggtggcaaagctccccctgacagagcacgaactggagtccgaaaacaagaagtgggtggagtttgcatgcgtgacgcttaagaatgaggtgtacattagcgggggaaaggagacacaacacgacgtttggaaatataattcttccattaataagtggatccagattgaatatctcaacatcggtagatggagacacaagatggtggtccttggggggaaggtatatgtgataggtgggtttgacggtctgcagagaataaataatgtggaaacatacgatcccttccacaactgctggtcagaggccgcccccctgctagtgcatgtgtctagttttgctgccacctcccataagaagaaactgtacgtgatcggcggcggtcctaacggaaagctggctacagacaaaacacagtgttacgatccatctaccaacaaatggtccttaaaggctgctatgcctgtcgaggctaagtgtattaatgcagtgtccttcagagatagaatatacgtggttggtggcgcaatgcgcgccctgtacgcttattctcccctggaggacagctggtgtctggtgacccagctctctcacgagagggctagctgtggcatagccccatgtaataaccgcttgtacattaccggcggccgtgacgagaaaaacgaagtgatcgctaccgtgttatgttgggatccggaggcacagaaactgaccgaagagtgcgtgctgcctcgcggcgttagccaccatggcagcgttaccatacggaaatcctacacacacatccgccgcatcgtgcctggggcggtcagtgtttag

SEQ ID NO: 121430 - DNA, 1695 bp, Artificial Sequence
  Description of Artificial Sequence: Synthetic coding sequence
atgctgggcggaacggattgcaggacatttctcacctcccatatcaacttgaaaaaaacattgtgcgatgtgatcttgatggttcaggagcgcaagattccggctcaccgagtggtgctggccgcagcgagccatttctttaacctgatgtttactacaaacatgctggagagcaagtcgtttgaagtggagctcaaggatgcagaaccagacatcatcgagcagttggtggagttcgcctacacggcgcgaatatccgtgaacagtaataacgtccagtccctgctcgatgctgccaatcaatatcaaatcgaacctgtgaagaagatgtgcgtggactttctgaaagagcaagtggacgcctcgaactgtctgggtattagcgtcttggcagagtgtttggactgccccgaattgaaggctacagccgacgacttcatccaccaacattttaccgaagtgtacaagaccgatgagttcctacagctggacgtgaagcgggttacacacctgttaaatcaagacacacttaccgttcgcgcagaagaccaggtctatgacgcagcagttagatggctgaagtacgatgaacctaaccgtcagcccttcatggtcgacattcttgcaaaggttcgcttcccgctgatttccaagaattttttgtcaaaaaccgtgcaagctgagcccttgatccaggataacccggaatgcctaaagatggttatctcagggatgaggtaccatttgctgagtcctgaggatcgggaggaattggttgatggaacccgccctcggcgcaagaagcacgactaccgcatagcgctctttggcggcagtcaaccccagtcgtgccgttacttcaaccctaaggattacagctggactgatattcggtgccccttcgaaaaaaggagagacgctgcgtgtgtgttttgggacaatgttgtgtatatattgggtggaagccagctctttcccatcaagaggatggattgttataacgtggtgaaagacagttggtattctaagctgggccctcccacacctcgcgactctctcgccgcttgtgctgccgagggaaagatatacacgagcggcggtagcgaggtcggcaacagcgctttatacctattcgagtgttatgacactcgaactgaatcctggcatactaaaccttccatgctcacacaacggtgtagtcacgggatggtggaagccaacggactcatttacgtgtgcgggggatccttaggtaacaatgtgtctggtcgggtgctgaactcctgtgaggtgtacgatcccgccaccgaaacttggaccgagctgtgcccaatgatagaggcacgaaaaaaccatggacttgtcttcgtaaaagacaaaatattcgcagtgggtgggcagaatggtctgggcggattggataacgtagaatactatgacattaagctaaacgaatggaagatggtgagtcctatgccatggaaaggtgtgactgtgaaatgtgcagctgtggggagcatagtctatgtcctcgccggcttccagggcgtcgggcgcctaggccacatactggaatacaatacagaaactgataagtgggttgcaaacagtaaggtacgggccttccctgtgacctcttgcctcatatgtgtggtggacacttgtggcgcgaatgaagaaacactggaaacgtag

SEQ ID NO: 121431 - DNA, 1761 bp, Artificial Sequence
  Description of Artificial Sequence: Synthetic coding sequence
atggctgccagtggagtcgaaaagagtagtaagaaaaagacggagaaaaaattagccgctcgagaggaggccaagctgctggccggctttatgggcgtgatgaacaatatgcgtaagcagaagacactctgcgatgtaatcctgatggtgcaggaacggaagatcccagcgcaccgcgtggttctggccgctgccagtcacttctttaatctgatgtttaccaccaatatgctggaatcgaaatcattcgaggtggagctcaaggatgcggaaccggatattatcgagcaactcgtcgagttcgcttacactgctcggataagcgtgaactccaataatgtacagagtctgctcgacgctgcgaatcaataccagattgagcctgtgaagaagatgtgcgttgactttctgaaagaacaggtcgacgcatccaactgcctgggcatttcggtcctcgccgagtgcctcgactgtcctgagctcaaagcaactgccgatgactttattcaccagcatttcacggaagtttacaagacagacgaatttttgcaacttgacgtgaaaagagtgactcatcttctgaaccaagatacactgaccgttagggcagaagaccaggtatacgatgcagccgttcgatggttgaagtacgacgagcccaatcgccagccattcatggttgatatcctggctaaggtccgatttccgctgatctcaaaaaatttcctgagtaagaccgtgcaggccgagcctttgattcaagacaatccagaatgtttaaaaatggttatcagtggtatgcgataccacctgctgtctcctgaggaccgagaagagctcgtggatggtactcgtccaagacggaaaaagcacgactacaggattgccttgttcggaggaagccagccacagtcttgccgttatttcaatccaaaggattattcttggaccgacattaggtgcccctttgaaaaacgccgggacgctgcctgtgtattttgggataatgtggtctatatactgggcggaagccaactgttccccattaaacgaatggactgttacaacgttgtcaaagacagttggtattcaaagcttggaccacctactcccagggattccctcgccgcctgtgccgcagagggcaaaatctacacatccgggggaagcgaggttggcaactccgctctctacctctttgaatgctacgatactaggacagaatcttggcacacgaaaccttctatgctaacccagaggtgttctcacgggatggtggaggccaacggcttgatttacgtgtgtggggggtcactggggaataacgtgtctggtagggtcttgaactcttgcgaggtttacgaccccgcaacggaaacttggacagagttgtgtccgatgatagaagcccgcaagaaccatggcctcgtgttcgtgaaggacaaaatctttgctgttgggggccagaatggcttgggagggctcgacaatgttgaatattacgacattaaattgaacgaatggaagatggtctcccccatgccctggaaaggtgttacagtgaaatgcgcggccgtcggaagtatagtttatgtgttggctgggtttcagggggtcgggaggctgggccacattttagagtacaacacagagacagataaatgggtcgccaattcaaaggtacgcgcgtttcccgttaccagttgcctgatatgtgttgtggacacttgcggggctaacgaggagacgcttgaaacatag

SEQ ID NO: 121432 - DNA, 1617 bp, Artificial Sequence
  Description of Artificial Sequence: Synthetic coding sequence
atggtacaggagcggaaaatccccgcacatcgagtagtgctggctgccgcatcccactttttcaacttaatgtttaccaccaacatgctggagtctaaaagcttcgaggtggaactgaaagatgccgagcccgatatcatcgaacagttagttgagttcgcatacacggcaaggatctcagtgaatagcaacaatgtgcagtctttattggatgctgcgaaccagtaccaaattgaacctgtaaaaaagatgtgcgtggattttctgaaggagcaggtggatgctagtaactgcttgggcatttctgtgctggccgagtgtctggattgcccagaactgaaagctaccgctgatgattttatacatcagcacttcactgaagtgtacaaaactgacgaattccttcagctcgatgtaaagcgggtgacccacctcctcaaccaagacaccctaacagtacgcgccgaggaccaagtgtatgacgcagcagtgcggtggctgaagtacgatgagcctaacaggcaacctttcatggtagatatcctcgcgaaagttagattcccccttatttcgaaaaacttcctgtcaaaaacagtgcaggctgagcccctgatccaggacaaccccgaatgcctgaaaatggtcatcagcggcatgcggtatcatttactaagtcccgaggaccgtgaggagcttgtcgatggcacccggccgagaagaaagaagcacgactacagaatagcgcttttcggcgggtcccagccacagtcctgccgttatttcaatcctaaggactattcctggactgacataagatgccccttcgaaaaaagacgcgatgcggcttgtgtcttttgggacaacgtggtttatatactcggcggctcccagctgttccccattaagagaatggactgctataatgtcgtgaaagacagctggtacagcaagctgggcccgccaactcccagagattctctggctgcttgcgccgcagaaggaaagatctacacaagcggggggagcgaggtggggaacagcgcactttacctgttcgagtgttacgatacaagaactgagtcatggcacacaaagccatctatgttgactcagagatgcagtcacggtatggtcgaagccaacggcctgatctatgtatgcggtggttccctcgggaataacgtctcaggcagagtactgaattcctgcgaggtctacgatccagccacagaaacatggaccgaactgtgtcccatgattgaagctagaaaaaaccacggtttagtattcgtcaaggataagatctttgctgtcggggggcagaacggtttgggaggcttagacaatgtggaatattatgacattaagctcaacgagtggaagatggtcagccccatgccctggaagggggtgacagttaagtgcgctgcagtgggctcaattgtctacgtactagcaggcttccagggcgtcgggcggctcgggcatatcctggaatataacaccgagacagacaagtgggtcgccaattcaaaggttagagcttttcccgtcacgagctgtctgatctgtgtggtcgacacgtgtggagcaaacgaggagacgttagagacatag

SEQ ID NO: 121433 - DNA, 1161 bp, Artificial Sequence
  Description of Artificial Sequence: Synthetic coding sequence
atggctgcctccggagtagagaagagcagcaagaaaaagactgagaagaagctggcagcgagagaggaggccaagcttctggccggatttatgggggtgatgaacaacatgaggaagcagaaaacgctgtgtgacgtcattctcatggtgcaggagcgaaagattccggctcatcgagtcgtgttggcagctgccagccactttttcaacttgatgttcacaacaaatatgctcgaatcgaaatctttcgaggtggagctcaaagatgccgagcccgacattattgaacagctattacactacaaatttttcaagatgaagaaccgcaaagacgggcgtgtgtctgttagctatgctatcctcatccagggtctcaaaatctacgagatctacagtacaaattttcccgaacacttcacggaggtgtacaaaacagacgaattcttgcaactggacgtaaagcgagtgacacatctgcttaaccaggacactctcaccgttcgcgcagaggatcaggtctatgatgccgccgtccgatggctgaagtacgatgagcctaacaggcaaccatttatggtagacatacttgcgaaagtccgcttccctctcatctctaagaacttcctgtcaaagactgtgcaggccgagccactcattcaagacaatccggagtgcctgaagatggtgatcagcggcatgcggtaccacctcctcagccccgaggatcgggaggagctcgtggacgggacgcgcccaaggcgcaaaaaacatgattacaggattgccctgttcggtggctctcagccccagtcttgtcgatacttcaacccaaaggattattcatggactgacatccgttgcccattcgaaaagcgacgcgacgccgcctgcgtgttttgggacaatgtagtgtatatcctcggaggatcccagctgttccccatcaagagaatggactgttataatgttgtgaaagacagttggtattctaaactgggaccacctactccacgggatagcctcgccgcctgcgccgcagaggggaaaatctatacctctggtggaagcgaagtgggtaacagcgccttgtatttattctgcctgatcccggtgaagtttatgatcctcccccaaaaacacggactgtcttgcgtgcaatag

SEQ ID NO: 121434 - DNA, 1284 bp, Artificial Sequence
  Description of Artificial Sequence: Synthetic coding sequence
atggccgccagcggcgtggaaaagtcttccaagaagaagacggaaaagaagctggccgctcgcgaggaggcaaagcttctggccggattcatgggcgtgatgaataacatgagaaagcagaagactctgtgtgatgtgattctcatggtgcaagagcggaaaatccctgcccacagggtcgtcttagctgccgctagccacttttttaacctcatgtttacaacgaacatgctggaatccaagaattttttgagcaagactgttcaggcagagccgttgatacaggacaaccccgagtgcctgaagatggtgatctccggcatgcgttatcatttactctccccagaagatagagaggagctcgtggacggtactaggccgcggcgaaagaagcacgactaccggattgctctgtttggcgggagccaacctcagagctgccggtacttcaaccccaaggattacagttggactgatataagatgtccattcgaaaaaagaagggacgccgcttgtgtattttgggacaatgtcgtgtacatcttgggcggcagtcagttattccccattaaacgtatggattgctataatgtggtcaaagattcttggtactctaagttgggccctccaacgccacgcgatagcttggccgcgtgtgctgcggagggtaagatttacacgtccggcggatcagaggtcgggaattccgctctttatctgttcgaatgctacgacacccggacagagagttggcatacaaagccatcaatgctcacccagcgttgctcccatggaatggttgaagctaatggtctgatttacgtctgtggcggcagtctcgggaataatgtgagcggcagggtcctgaacagttgtgaagtgtacgatcctgctactgagacttggaccgagctgtgtcctatgatagaagcacgaaaaaaccacggacttgtcttcgttaaggataaaattttcgctgtggggggtcaaaacggactagggggactagataatgtcgaatactacgacattaagctaaacgaatggaagatggtaagccccatgccctggaaaggcgtgaccgttaagtgtgcagctgtgggctctattgtctatgtacttgctgggttccagggggtgggacggttgggccacattctggagtataataccgagaccgataagtgggtagccaatagcaaggtacgggcattccccgtcacaagctgcctgatctgcgttgtggacacatgtggcgccaatgaggaaacccttgagacatag

SEQ ID NO: 121435 - DNA, 1533 bp, Artificial Sequence
  Description of Artificial Sequence: Synthetic coding sequence
atgttggagtctaaaagcttcgaagtcgaacttaaggatgcagagccggatatcattgaacagctcgttgaattcgcttataccgccaggatcagtgttaacagcaacaatgtgcagtcactgctggacgccgccaatcagtatcagattgaacctgttaaaaagatgtgtgtggacttcctgaaagagcaggttgatgctagcaactgccttggcatctctgttctggcggaatgcctcgattgtccagaactcaaggctactgctgatgatttcatccaccagcacttcactgaggtgtacaaaacagacgagttcttgcagttggatgtcaaaagggttacacatctgctgaaccaagataccctcactgtacgtgctgaggaccaagtttatgacgcggccgtaagatggctcaaatacgacgaacccaaccgccaaccatttatggttgatattcttgcaaaggttaggtttcctctaatctccaaaaattttctgagcaagaccgtacaggcagagccactgatacaggataatcctgagtgtctcaagatggtcatcagcggtatgagataccatctgctttctcccgaagaccgggaggaacttgtcgatggcacacgtccgcgtaggaaaaaacatgattatcggatcgccctgttcggtggaagtcagccgcagagctgtcgttacttcaacccaaaagattactcttggacagatatacgatgcccctttgagaaacgaagagacgccgcatgcgtgttctgggataacgtggtgtatatccttggaggtagccagctgtttccaatcaagcggatggattgttacaatgtcgtgaaagacagctggtacagcaaactaggacctcccacgccccgcgacagcttggccgcgtgtgccgctgaggggaagatttacacatccggggggagtgaggtgggcaactcggctctgtatctgtttgagtgttatgatacccggactgagtcctggcatactaagccaagtatgctgactcaaaggtgcagtcacggcatggtggaagctaatgggctcatctacgtttgcgggggttctctggggaacaatgtgagcggacgggtcttaaacagttgcgaagtgtacgatccagcaaccgagacctggacggagctttgcccgatgatcgaagcgcggaaaaatcatggtttagtctttgtgaaggacaaaatatttgccgtgggaggccaaaacgggttgggaggactggacaatgttgagtattacgatatcaagctgaacgaatggaagatggtttctcctatgccatggaaaggcgtgactgtcaaatgcgccgccgtgggtagtatcgtttatgtgctagccggctttcaaggcgttggcagattaggacatatcttagaatacaataccgaaaccgataaatgggttgcaaatagcaaagtgcgggcctttcctgtcactagctgtttgatctgcgtagtagacacgtgcggggcaaacgaagagacgctggaaacttag

SEQ ID NO: 121436 - DNA, 1086 bp, Artificial Sequence
  Description of Artificial Sequence: Synthetic coding sequence
atggtggatattttggcaaaagtccgattccctctgatatccaagaatttcctgtctaagactgtccaggccgagcccctcattcaggacaatcccgagtgcttaaagatggtcatcagcgggatgcgttaccacctgctctcacctgaagaccgagaagagctagtggatggtacccggccccgcagaaagaagcatgactaccgcattgccctctttggtggctctcagcctcagtcatgccggtacttcaatcctaaagactacagttggactgacattaggtgtccctttgagaaaaggagagatgcagcatgcgtcttctgggacaatgttgtatatatcctagggggcagccagttgtttccgattaagcggatggattgctacaacgtggtaaaagatagctggtactccaagctggggcctcccacacccagggactccctggctgcgtgcgccgcggaaggtaagatctatacctctggaggaagcgaggtgggaaactctgctctgtacctttttgaatgttatgataccaggaccgaaagctggcacactaaaccaagcatgctcacacagcggtgtagccacggcatggtggaagcaaatggtctcatctatgtctgtggcggctccttgggaaacaacgttagcggcagagttctcaattcgtgtgaggtgtacgacccggcgacagagacttggaccgaactttgtcctatgatagaagctaggaagaaccacggcctggtgttcgtgaaggacaaaattttcgccgttggcgggcagaacgggctgggcggccttgacaacgtagaatactatgacatcaagctgaatgagtggaagatggtgtcccccatgccctggaagggcgtgacggtgaagtgtgcagcagttggatcaatagtctatgtgttagccgggttccaaggcgtgggtaggctggggcatatactggaatacaataccgagactgataaatgggtcgctaatagcaaggtgagagccttccccgttacttcttgcctgatttgtgtcgtggacacatgcggggctaacgaggagacgctcgagacatag

SEQ ID NO: 121437 - DNA, 1695 bp, Artificial Sequence
  Description of Artificial Sequence: Synthetic coding sequence
atgctgggtggcacagactgccgaaccttcctcacgtctcacataaatttaaagaaaaccctttgcgatgtcattctgatggttcaggagagaaagattcccgcccatcgggttgttctggccgcagctagccatttctttaatttgatgttcacaaccaatatgttggagagcaaaagcttcgaagtcgagctgaaggacgccgagcccgatattatcgaacagctggttgaatttgcctacacagccagaatcagtgtaaattctaacaacgtgcagtccctgctggacgctgccaaccaatatcagatcgagcctgtgaaaaaaatgtgtgtggacttcctgaaagagcaggttgacgctagtaattgcctgggcatcagcgttctcgcggagtgcctggactgtccagagttgaaggcgacagctgatgattttatccatcagcacttcacagaggtgtataaaacggacgagtttctccagttggatgtgaagcgcgtcacacatttgctaaaccaggatactctgactgtgagggccgaagatcaggtgtacgatgccgcggtgcgctggctcaagtatgacgaacctaaccggcagcccttcatggttgatatcctggcaaaagttcggttccctctgatatccaaaaactttttaagtaagacagttcaagccgagcccctgattcaggacaatccagaatgcctcaaaatggtgatttccggtatgcggtatcatttactaagccctgaggacagagaggagcttgtcgacggtacaaggccccggagaaaaaagcacgactatcggatcgccctgttcggaggctcacaaccacagtcctgtagatattttaacccgaaggactatagttggacagatatcagatgcccctttgagaaaagacgtgatgcggcatgcgtgttctgggacaatgtggtctacattcttggtggttcacagctctttcccataaagcgcatggactgctataatgtagtaaaagattcttggtacagcaaactcggcccccccaccccacgggattcactggccgcttgcgcagcggagggaaaaatttacacatccggaggctctgaggtagggaactcggcactctatctgtttgaatgctacgacacgcgtactgagagctggcacacaaagcccagcatgctgacgcagcgttgtagtcatggaatggtggaggcaaatggcctcatctatgtgtgtggcggatcactggggaacaacgtttctgggagggtactcaatagttgtgaagtgtatgatccggccactgagacctggacagaactgtgtcccatgattgaagcacggaagaaccacgggcttgtgttcgtgaaggataaaattttcgctgtggggggccagaacgggctagggggacttgataatgtcgagtattacgacatcaaactgaacgaatggaagatggtatctcctatgccatggaagggtgttacagtgaaatgcgccgcagtaggtagtatcgtatatgtgttggctggcttccaaggggttggacgccttggtcatatcctcgagtacaacacagaaactgataaatgggtggctaactctaaagtgcgtgcatttcctgtgacctcttgcttgatctgtgtcgttgacacatgtggagctaacgaggaaaccctagaaacctag

SEQ ID NO: 121438 - DNA, 432 bp, Artificial Sequence
  Description of Artificial Sequence: Synthetic coding sequence
atgctgggaggcacagattgcaggacgttcctgacgagccatatcaatctgaaaaaaactctgtgtgacgtgatcttaatggtgcaggagcggaagattcccgcccatagggtggtgcttgccgccgcctcccacttctttaacttgatgtttaccaccaatatgttggaatctaaaagctttgaagtcgaactcaaagatgccgagccagatatcatcgagcagttagtggagttcgcgtacacagcacggatcagcgttaattctaataacgtgcagagcctcttggatgccgccaaccagtaccaaatcgagcccgtgaaaaaaatgtgtgtggactttctcaaagaacaggtggatgcgtccaactgcctgggaaaaaaataccagattcccgtggtttgcctcttctgcttcatcctttacttctag

SEQ ID NO: 121439 - DNA, 501 bp, Artificial Sequence
  Description of Artificial Sequence: Synthetic coding sequence
atggctgcgtccggagtggagaagtctagtaaaaaaaagaccgaaaagaagctcgcagcaagagaagaggccaagctactggccggtttcatgggcgtgatgaacaacatgcggaagcagaaaacactctgcgatgttatcctcatggttcaggagcggaagatccccgctcatcgcgtcgttctggccgcagcttcccatttctttaatcttatgtttacaaccaacatgttagaaagcaaaagctttgaggtggagctcaaggacgctgaacctgacattatcgaacagctagtggagttcgcatacaccgcaagaatatctgttaattccaacaacgtgcagtccttgctcgatgctgccaatcagtatcagattgaacccgtgaagaaaatgtgtgtggatttcttaaaggagcaggtagacgccagtaactgtctgggtgaagctgagaaggtggatcagtcactgcctgagtgcgggatgctgttcactgtttag

SEQ ID NO: 121440 - DNA, 1863 bp, Artificial Sequence
  Description of Artificial Sequence: Synthetic coding sequence
atggcatccgacagcatgtcatccaaacaggccaggaaccacatcacaaaggggaaacgccagcagcagcaccagcagataaaaaaccgttcaagcattagtgatggcgatggagaggactccttcatctttgaggcaaatgaggcttggaaagactttcacggatcccttttgaggttttacgaaaatggcgaattatgtgacgtgactctgaaggttgggagcaaactcatcagctgccacaagctggtgctggcttgtgtgattccctatttccgcgccatgttcctatccgagatggccgaagcaaagcagactctaatcgaaatcagggattttgacggggacgctatcgaagacctagtcaagttcgtgtatagctctcgtctgacccttactgtcgataatgtgcagccactgctttacgccgcttgcattctccaagttgaattggtcgcccgtgcgtgttgcgagtacatgaagctacattttcacccttctaattgtctggcagtgcgggccttcgctgagtcccacaatcgaattgacctgatggatatggcagatcagtacgcctgcgatcatttcaccgaggtggtcgagtgtgaggactttgtttctgtttcaccgcagcatctgcacaaactcctctcaagctccgacctgaacatagagaatgagaaacaggtgtacaatgctgccatcaagtggctgctggcgaaccctcagcaccacagtaagtggttggatgaaactctcgcgcaagtgcgtctccctctgcttccggtggatttcctaatgggggtggttgccaaagagcagatcgtgaaacagaatttgaagtgcagagatttgctcgacgaagcccgaaattatcacctgcacctctcatcaagggcggttcctgattttgaatattccattagaaccacaccaaggaagcacacagctggcgtactcttctgtgtggggggcaggggcggttccggggaccctttcaggtccatcgaatgttactccattaacaagaactcctggttttttgggcccgagatgaattcgaggaggcgccacgtaggcgtcatctcagtagagggaaaggtttatgcagtgggaggccacgacgggaacgaacacttgggcagcatggagatgtttgaccccctcacaaacaagtggatgatgaaagcctcaatgaacaccaagcgccgcgggatcgctctggcatccctgggcggacctatttacgccataggaggcctggatgataacacctgctttaacgatgtagagcggtacgatatcgaatcagatcagtggtccacggtggcccccatgaatactccacgagggggggtgggaagcgtggccttggtgaatcatgtatacgcagttggtgggaatgacggcatggcatccctgagcagcgttgaaagatacgatcctcacttggacaaatggatagaagtcaaagagatggggcagcggcgagctggtaatggggtttccaaattgcatggatgtctttatgtcgtgggaggtttcgatgacaattcccccctgtctagcgttgagcgctatgatccgcggtccaataaatgggattacgtggctgccttaacgactccacgagggggtgtgggaattgctaccgtgatgggcaaaatttttgcagtaggaggtcacaatggtaacgcctacctaaacacagtggaggctttcgatccagtgttaaacaggtgggagctcgttgggagtgttagtcactgccgagctggcgccggcgttgccgtgtgcagctgcctgacttcacagattagggacgtgggccatggaagtaacaacgttgtcgactgtatgtag

SEQ ID NO: 121441 - DNA, 1863 bp, Artificial Sequence
  Description of Artificial Sequence: Synthetic coding sequence
atggcgtctgacagcatgtcctcaaaacaggcacgcaaccatatcacaaagggtaaacggcagcagcagcatcaacagatcaagaacagatcatctatatcagacggggatggggaggactccttcatcttcgaagcgaatgaggcatggaaggactttcacggcagcctgctgagattttacgaaaatggggagctttgcgatgttacattgaaggtgggtagcaaactgatctcttgccataagttggtcctggcctgcgtcatcccgtacttcagagcaatgtttctgtcggaaatggcagaagcaaaacagacactcattgagattcgggacttcgatggggacgctatagaggatctcgttaagttcgtgtactcctcccgattgacccttacggtggacaacgtgcaaccgctgttatatgcagcttgtattctgcaggtggaattggtggcaagggcttgctgcgaatatatgaagttgcattttcacccctccaattgcctggcggtccgtgccttcgctgagagtcacaatcgaatagacttgatggacatggctgaccagtacgcttgcgatcattttacagaagtcgtggaatgcgaggacttcgtgtctgtgtccccccagcacctccacaagcttctttcctcttctgatctgaacatcgaaaatgagaagcaagtctataacgctgccatcaaatggctgctggcgaacccccagcaccacagcaaatggcttgacgagacactggcgcaggttagactgcctctgctgcccgtggattttctgatgggggtggttgccaaagaacagatcgtcaagcaaaatctcaaatgccgggatctcttagacgaggcccggaattatcatctgcatttgagtagtagggctgtgcctgacttcgagtacagcattaggactactccgagaaaacataccgctggagtgctgttttgtgtgggtgggcgaggaggttcaggggacccgttccgcagcatcgagtgctatagtattaacaagaatagttggttctttggtcccgagatgaattctcgacggaggcatgtcggtgtcatatctgtcgagggaaaggtgtatgccgtgggcggtcatgatggcaatgagcacctgggctccatggaaatgtttgacccgcttacaaataagtggatgatgaaagcctcaatgaacacaaaaagacggggcatcgccctcgccagcctgggagggcccatttacgcaataggcggcctggatgataacacatgtttcaatgatgtggagcggtacgatatcgagtctgaccagtggtcgaccgtggctccaatgaataccccccggggaggagtaggctcggtggcactggtgaaccacgtgtatgccgtgggaggtaacgacggcatggccagtctcagcagcgtggagaggtatgatccccatctggataaatggatcgaggtcaaggagatgggacaaaggcgagctggaaatggcgtgtcaaagctgcatggatgtttatacgtcgtgggaggatttgacgataattctcccctttcgtcagttgagagatatgacccaaggtctaataagtgggattatgttgctgctctgaccacacccagggggggagtgggcattgcaacagtcatgggcaaaatcttcgcagttggaggacataatggcaacgcctaccttaacaccgtggaagccttcgatcccgtgctaaatcgctgggaactggtcggctcagtgtcccactgccgagcaggcgccggcgtcgcggtgtgcagctgcctgacaagtcagattagagatgtcggacacggttccaacaacgtggtcgattgcatgtag

SEQ ID NO: 121442 - DNA, 810 bp, Artificial Sequence
  Description of Artificial Sequence: Synthetic coding sequence
atgaattctcgacggcgacatgtgggcgtcataagcgtggagggcaaggtatatgctgtgggcggacacgatggaaacgagcacctgggaagcatggaaatgtttgacccactgacaaataagtggatgatgaaggcaagtatgaacacgaagcgccgcggcatcgcactcgctagtctcggtggcccaatctatgctattggaggactcgatgataacacttgttttaacgacgtagaaaggtatgacatcgagagcgaccagtggtcaacagtggccccgatgaataccccccgcggcggggtggggtccgtggccctggtcaatcatgtgtacgcagtcgggggcaacgacggcatggctagcttgtccagtgtggagcgctatgatccacatttggataaatggatcgaagttaaagaaatggggcagcgcagagcaggtaacggtgtgtctaagctccatggttgtctgtatgtagtaggcggatttgacgacaattctcccttatcaagcgtcgagcgctatgacccacgcagcaataagtgggactatgtagctgccctcactaccccacggggcggtgtaggaatcgcaaccgtgatgggcaaaatttttgcggtggggggccataatggtaatgcctatctgaacactgtcgaggcattcgacccagtgctgaaccgttgggaattagtgggctcggtgtctcactgcagggcgggggctggcgttgctgtgtgttcctgcctcacctctcagatacgggacgtggggcacggctctaacaatgtggtagattgtatgtag

SEQ ID NO: 121443 - DNA, 1875 bp, Artificial Sequence
  Description of Artificial Sequence: Synthetic coding sequence
atgcagccagaccctcggccctccggagccggcgcctgctgtcgatttctgcctcttcagagccagtgtcccgagggagctggcgatgcggtgatgtatgctagcacggaatgtaaagcagaggtgacaccttctcagcacggcaaccgcacattcagctacacactagaagaccacacaaaacaggcattcggcattatgaacgagctgaggctgagccagcaactgtgcgacgtaaccttgcaagtgaagtatcaggacgccccggctgcccagttcatggctcacaaagtggtgttggctagctcgtctccagtcttcaaggctatgttcaccaatggcctgcgcgagcaagggatggaagtggtatcaattgaggggatacacccaaaagtgatggagcggcttatcgagttcgcttataccgccagtatttctatgggtgagaagtgcgtgttgcacgtgatgaatggagctgtgatgtatcagattgactcagtggtgagagcctgtagcgacttcctcgtgcagcagctcgatccctctaatgccattggaatcgcgaatttcgccgagcagatcggctgcgtggagctccaccaaagagctagagaatacatttacatgcattttggtgaggttgcaaaacaggaggaattcttcaacttgagccactgtcaattggtgaccttgatttcacgtgatgatctgaatgttagatgcgagagcgaggtctttcacgcctgcattaattgggtcaagtatgactgtgaacaaaggcgtttctacgtgcaggcgctgcttagggcagtacggtgtcacagcctcactccgaattttttacagatgcagctgcagaagtgcgaaatcctacagtccgattccagatgtaaagattacctggtgaaaatctttgaagagctcaccctccacaaacccacacaggtgatgccctgtcgtgcgcccaaagtcggacgactgatctacacagccggcggctactttagacaaagcctgtcctatttggaggcctacaacccttcagatggaacctggcttcggttggcggatctccaggtacctagatcgggcctggcagggtgcgtcgttggggggttactttatgcagtgggcgggagaaacaactcacccgacggaaatactgacagctcagctctggactgctacaatcccatgacgaatcagtggtccccatgcgctcctatgagcgtgcctcgcaatcgcataggggtgggggtgatcgatggacacatctatgccgttggagggtctcacggatgtatccaccataactctgtcgagcggtacgagcctgaaagagacgagtggcatcttgtagccccaatgcttactaggcgcataggagtgggagtggcggtattgaataggctgttatacgctgtgggcggattcgatggaacaaaccgtctgaattccgcggaatgctactatcctgagcgcaacgagtggaggatgatcaccgcgatgaacaccattaggtctggggccggggtctgcgtcctacacaattgcatttatgccgccggcggttacgacgggcaagaccagctgaactctgtggaacgatacgacgtagaaactgaaacatggacgtttgtcgcgcctatgaagcaccgcagaagtgccctggggatcacagtgcatcagggcaggatttatgttctgggcgggtatgacgggcacacattccttgacagtgtggaatgctatgaccctgacaccgacacgtggagtgaggtcactcgcatgacaagcgggaggtccggagtgggcgtagctgtaactatggaaccatgtagaaaacagatcgaccagcaaaactgtacttgctag

SEQ ID NO: 121444 - DNA, 1875 bp, Artificial Sequence
  Description of Artificial Sequence: Synthetic coding sequence
atgcagcctgacccaagaccatccggcgccggcgcctgctgccgttttctgcctctccaatcacaatgtcctgagggggctggtgatgctgtgatgtacgccagcactgagtgcaaagcggaagtaaccccgtcacagcatgggaatcgcactttttcatacactctggaggatcacacaaagcaagcattcggaattatgaatgagttgcgtctatcgcaacaactttgtgacgtgacactgcaagttaagtaccaggatgctccggccgcacaattcatggcccacaaggtcgttctcgctagttcaagcccagtctttaaagcaatgttcaccaatgggctgagagagcagggaatggaagtagtgtctatcgagggtatccatccaaaggtgatggagaggttgattgagtttgcatacacggccagcattagcatgggcgagaaatgcgtccttcacgtgatgaacggtgctgtaatgtatcagatcgattccgtcgtgagagcctgctctgacttcctcgttcagcagcttgacccttctaacgcaattgggattgcaaatttcgctgaacaaatcggttgtgttgagctccaccagagagcacgtgaatacatatatatgcattttggggaggtcgccaagcaggaggagtttttcaacctttctcactgtcagcttgtgacactgatttcacgagacgaccttaatgtgaggtgcgagtctgaggtgttccatgcctgcattaactgggtgaaatacgactgcgagcagcgtaggttctacgtccaggccttgctgcgtgctgtccggtgtcattcactaacgcccaatttcttgcaaatgcagctccagaaatgtgaaattcttcagagtgatagccgctgtaaggattatttggtgaagattttcgaggaacttacacttcataagccaacacaagtgatgccctgcagagcccctaaagtaggtcggcttatttacaccgcaggtgggtatttccgccagtccctgtcctacctggaggcttacaatccatccgacgggacctggctaaggctagctgatctgcaagttccgaggagcggtttagccggttgcgtcgtgggcggtctcctgtacgccgtcggtgggaggaacaactcacctgatggtaacaccgacagttccgcattggactgttacaatccaatgactaaccagtggtctccctgcgccccaatgagcgtacctcggaacaggatcggcgtcggagtgatcgacggacatatctatgcagtcggtgggagccacggatgtattcatcataactccgttgaacgttatgaaccagaacgggacgagtggcatctagtggcccctatgctcacacggcgcattggggtaggagtcgctgtactcaaccggttattatatgccgtgggagggtttgatggaacaaaccggctgaatagcgccgagtgctactaccccgaacgcaacgagtggcgtatgataacggcgatgaacaccatacggagtggcgctggagtttgcgttttacataactgcatctatgcagccggcggatacgatggccaggatcaactaaactccgtggaaagatatgacgtggaaaccgaaacctggacattcgtcgcgccgatgaagcaccggaggagtgctcttggtatcactgtccaccagggtagaatctacgtcctcgggggttacgatggccataccttcctggattcagttgaatgctacgacccggacaccgatacttggtccgaagtcacacgaatgacgagtggcagatcaggggttggtgtcgccgtgacaatggaaccttgccgaaagcagattgatcaacagaattgtacctgctag

SEQ ID NO: 121445 - DNA, 2199 bp, Artificial Sequence
  Description of Artificial Sequence: Synthetic coding sequence
atggaaggaggcgaccaaagcgaagaagagccacgggagcggagtcaggcagggggcatgggcaccctgtggtcacaagaatccacccctgaagagcgcctgcctgttgagggctcacgtccttgggctgtcgctcggagggtgctgaccgccatcttaatcctgggactgctcctttgtttcagcgttttgctcttttataacttccagaactgcggcccacggccttgcgaaacatccgtatgcctggacttaagagaccactaccttgccagtggaaacaccagtgtggcaccctgcaccgatttcttcagctttgcctgtgggcgggccaaagagactaataattcattccaagaactagccacaaaaaataagaatcgactccggcgcatcttagaggttcagaactcttggcacccagggagtggggaagaaaaggcctttcagttctacaactcttgcatggataccttggccatagaagctgcagggaccggccccctgcgtcaggtgattgaggagctcggcggatggcgaattagtggcaaatggacatcccttaattttaaccggactttgcggctgctgatgagtcagtacggccacttccccttcttccgcgcctatctcggacctcacccagcttcccctcacacacccgtgatccagatcgaccagcctgaatttgacgttcccctgaagcaggaccaagaacaaaaaatttacgcacagatattccgggagtatttgacctatctgaaccaactgggtacgcttctcggcggcgatcccagcaaggtccaggaacattcatcattgtcaatctccattactagccggctgttccagtttctcaggccgctagagcaacggcgtgcccagggcaaactgtttcaaatggtgacaatcgatcagcttaaggagatggccccagctatcgactggctgtcttgtctgcaggcgacatttacacctatgtccctgtctccctcccaaagcctggtcgtccatgacgtcgagtatctgaaaaatatgtcccagctcgtcgaggaaatgctactgaagcagcgggactttctgcagtctcatatgattctgggcctggtggtcacactgtcccctgctcttgattcccagttccaagaagcccgcagaaaactcagccagaagctccgggagctgaccgaacagccaccaatgcccgcccgtccacgctggatgaagtgtgtggaggaaacaggcacttttttcgaacctaccttggctgcattgttcgtccgcgaggcatttggcccgagcaccaggagtgcggcgatgaagctctttaccgcaatccgtgacgctcttatcaccaggcttcgcaatctcccatggatgaatgaagagacacaaaatatggcacaggataaggttgctcaattgcaagtcgaaatgggagcgagcgagtgggctctgaagccagagctggctaggcaggagtacaacgatatccagcttggctcttcgtttttgcagtccgtgctgagctgcgtacggtctctccgggctcggatagtgcagtcatttctccaaccccacccccaacatagatggaaggtgtccccttgggatgtgaacgcatattatagtgtttccgaccacgtggtggtatttccagcgggactgttgcagccaccattttttcacccagggtaccctagagccgtaaacttcggagccgcgggctcgattatggctcacgagttgttgcatatcttctatcagctgcttcttcccggagggtgtctggcgtgcgataatcacgccctccaggaagctcacttatgcctcaaaaggcattatgccgcgtttccactgcctagtcgaacttcctttaatgactccctcaccttcctcgagaacgccgccgacgtggggggcctggctatagcactgcaggcctactcaaagaggcttctgaggcaccacggcgaaacagtcctaccctccctcgacctctcgccacagcagatcttttttagatcctacgcccaggtgatgtgtcgaaaaccatctcctcaggattctcacgacacccacagtcctccacacctcagagtccatggacctctgtcgtcaactccagctttcgcccggtacttccgatgcgcccggggagctcttctcaaccctagtagccgttgtcaactctggtag

SEQ ID NO: 121446 - DNA, 1935 bp, Artificial Sequence
  Description of Artificial Sequence: Synthetic coding sequence
atgagccgccagttctctagcagaagtggctacaggagcggcggaggattttcatccggttccgccgggattatcaattatcagcggcggacgacgtcgtcctccacacggaggagcggcggcggcggaggacggttcagctcttgtggcggcgggggcggcagttttggagccggcgggggctttggatcaagaagcctggttaacctgggagggagcaaaagcatcagcatctctgtggcccgaggtggcggaagggggagcgggtttgggggagggtatggcggaggaggctttggcgggggaggatttggcggcggggggttcggcggtggcggaatcggggggggcggctttggcggctttggcagtggcgggggggggttcggcggcggtgggtttggcggaggcggctacgggggcgggtacggtccagtttgccccccaggtggcatacaagaagttactatcaaccagagcttgctgcaacctcttaatgtcgagatcgatccagagattcaaaaggttaaaagccgtgaaagagagcagatcaagtcgttaaacaaccaatttgccagctttattgataaggttcgattcctcgagcaacagaaccaggtcctacaaaccaaatgggagctccttcaacaggtggacacgagcacacgaactcataacttagagccctactttgagtcattcatcaataatttgcgcaggcgcgtcgaccaactcaagtcagaccagagtcgactagattcagaacttaaaaacatgcaggacatggtcgaggattaccgcaataagtacgaagacgagatcaacaaacgtactaatgccgagaacgagttcgtaacaatcaagaaggacgtggacggagcgtatatgactaaggtggatctccaggccaagctggacaatctgcaacaggagatcgactttctaactgctttataccaggccgaactgagccaaatgcaaacccagataagtgaaaccaacgtcatcctatctatggacaataatagaagcttagatctggacagcataatagccgaagtcaaagcccagtacgaggacatagcccaaaaatctaaggcagaagctgaaagtctctatcaatccaagtatgaagaactccagataactgctggcagacatggcgacagtgtcagaaactccaagattgagatctcggagctcaatcgcgtcatccagaggctaaggtcggaaattgacaatgtgaaaaagcagatctcaaatcttcagcagtcgatcagcgacgccgagcagcggggagaaaatgccctcaaagatgccaaaaacaaactgaatgacctcgaagatgcattgcagcaagctaaagaagacttggccagacttctcagagattaccaagaactgatgaacaccaagctggcgttggatctggaaatagcaacctacaggacactgctggagggggaggagtcacgaatgtccggcgaatgcgcaccaaacgtatctgtctccgtgtcaaccagccacacaaccatatctggcggaggctcccgcggggggggcggaggaggttatgggagcggtggttcttcatatggctccggcggtggcagttacggatccggcggaggcggaggtgggggacggggatcttacggcagcggcggctcgagttatgggagcggtggcggttcatacggctctggagggggcggagggggccatggaagctatggctccggaagttcaagcggtggctatcgcggagggtctggaggaggcggtgggggaagttcaggagggcgaggttctggtggcggctcaagtggcgggagtattgggggtaggggctcctcatcaggcggggtgaagtcatctggtggctcatcctctgtgaagttcgttagtactacgtatagcggcgtgactaggtag

SEQ ID NO: 121447 - DNA, 1755 bp, Artificial Sequence
  Description of Artificial Sequence: Synthetic coding sequence
atgtctgtgcgttactcttcctctaagcactattcctcgtcccgttcagggggtggaggaggcggagggggctgtggaggaggtggtggggtgagctcattgcggatatctagttcaaaaggtagcctgggcggcggcttttcttccggtggattctcaggcggtagttttagccgcggaagcagcggcgggggttgcttcggcggtagttctggaggatacggtggtctggggggatttggaggagggtcattccgaggctcttatgggagttcatcattcggagggtcctacggaggtatcttcggcggaggaagctttggggggggctctttcggcggggggtcattcggagggggaggctttggcggcggaggtttcgggggcggctttggtggaggcttcgggggagacggcgggctcctcagcggcaatgagaaagtaaccatgcagaacctcaacgacaggctggcgtcctacttggacaaggtccgtgctctcgaggagagtaattacgaactcgagggcaagattaaggaatggtatgagaagcatggcaacagtcatcagggcgagccaagagattattccaaatattacaaaacaatagacgacctgaagaaccagatactcaacctgactactgataacgcaaacatattactgcagatcgataacgcgcgcctcgccgccgatgacttcagactgaagtacgaaaacgaagtagcactgcgccaaagcgttgaagcagacattaacggtctgagaagagtactggacgagctgacactgaccaaagccgaccttgagatgcagatagagtctctgacagaggagctggcctaccttaagaagaaccacgaggaggaaatgaaggacctgcgcaacgtaagcactggagatgttaatgttgagatgaacgccgcccctggagtcgacctgactcagctgctgaataatatgcgttcacagtacgagcagctcgctgaacagaaccggaaagacgcagaagcatggttcaacgagaagagcaaagagttgaccaccgaaatcgacaacaatatagagcagatatcaagctacaaatcagaaataaccgagcttcggagaaatgtgcaagccttagagatcgagctgcagagccagctggccttaaaacagtcccttgaagcgtcgctggctgaaactgagggaaggtactgtgtgcaattgtcacagatacaggctcagatctctgccctggaagaacagcttcagcagatccgggctgaaactgagtgtcagaacacagagtaccagcaactacttgacatcaaaatcaggctggagaatgaaattcaaacgtaccgatcactgctggaaggcgaggggtccagcggaggggggggcaggggaggaggcagtttcggcggcggatatggcgggggcagcagcggaggggggagctccggcggcggccatgggggaggacacggcggcagttccggagggggttatggcggcggctcttcagggggcggttcatctggaggaggctacggcggcggtagctccagtggcgggcatggaggctcgagttcaggcgggtacgggggcggttcctctggaggcggtggcgggggttatggtggaggtagttccggcgggggctccagtagcggggggggatacggaggcggctccagctctggcggacataagagctcttcctcaggctcagtcggggagagcagctctaagggtcctaggtactag

SEQ ID NO: 121448 - DNA, 1485 bp, Artificial Sequence
  Description of Artificial Sequence: Synthetic coding sequence
atggaccttagtaacaacacaatgtccttgtccgttcggacacccggcctgagcaggagattatcctcacagtctgtcatcggtcggcctcggggaatgagtgcgtcgtcagtgggaagtgggtacggcggctccgctttcggatttggagcctcttgtggcggcggctttagcgctgcctctatgtttggctcatcttctggtttcggtggcggctcgggcagttccatggccggaggactgggtgcgggctacggacgcgcgctgggtggcggaagtttcggaggtttaggtatgggttttggcggctcaccggggggcggtagcttggggatcctgagcgggaacgatggagggcttctgagcgggtctgagaaagaaacgatgcagaacctcaacgacaggctagcgagctatcttgacaaagtgcgagccctagaagaagccaacaccgaactggaaaacaaaattcgggagtggtatgagactagaggtaccggcacagcggatgcttcacagagcgactacagcaaatactaccctcttatcgaggatctacggaataagattattagcgccagcatcggaaatgctcaattgctgctgcaaattgataatgccaggctggctgcagaagatttcaggatgaagtacgagaacgagctcgctctgaggcaaggggtcgaggctgatataaatggacttcggcgcgtcctcgacgaactgacactcacccgaaccgatctagaaatgcagatcgagtccttaaacgaagagctcgcctatatgaagaaaaatcacgaggacgaactacagagtttcagagtgggagggcctggggaggttagcgtggagatggacgctgcccctggagtggatttgacaagactgctcaatgatatgcgggcacaatatgaaacaatagctgaacagaatcggaaagatgccgaagcatggtttattgaaaagtcaggcgagctaagaaaggagatcagtactaacactgagcagctccaatcgagcaaatcagaagttacagacctccggcgcgcttttcagaacctggagatcgaacttcagagccagctggcgatgaagaagtctctggaggatagcctggcagaggcagaaggcgactactgcgctcaattgtctcaggtacagcagctgataagtaacctggaggctcagctccttcaggtgcgggccgatgcagaacggcagaacgtggaccatcagcgtctgttaaacgtgaaggctcggctggagctggagattgaaacctaccgaaggctgcttgacggggaggcccaaggtgatgggctggaagagtcactgtttgttaccgatagcaagagtcaagctcagagtactgactcctccaaggaccccacaaaaacaaggaaaatcaagaccgttgtgcaggagatggttaacggcgaggtggtttcttcacaggtccaggagattgaggaactgatgtag

SEQ ID NO: 121449 - DNA, 1068 bp, Artificial Sequence
  Description of Artificial Sequence: Synthetic coding sequence
atgtctctccggctgcagagctcatcagcttcctacgggggcggcttcggcgggggcagctgtcagctgggcggaggacgcggggtttccacttgctcaaccagattcgttagcggcgggagcgcaggaggctacgggggcggggtgtcatgtgggtttggaggaggggctggctctggttttggagggggactgggaggtggttttggagggggttttgccggtggttttgttgactttggagcatgcgacggtggactactgacagggaacgagaagattacaatgcagaatcttaacgacagactagccagctacttggaaaaagtgagggcactggaagaagcaaatgctgatctggaagtgaaaattagggattggcacttaaaacagtccccggcctccccagagcgagactactcaccttattacaagaccattgaggagcttcgtgataagatccttaccgccaccattgagaataaccgcgttatcttggaaatcgacaatgccaggctagcggctgatgacttcaggctgaagtacgagaatgaactggcactgcgccagagtgtggaagccgacattaatggtcttagacgagtgctggatgaattgacactaagcaagaccgatctcgagatgcagatagagtccttaaacgaggaactggcctacatgaagaagaaccatgaggaagaaatgaaggaattttctaatcaagttgtggggcaagtgaatgtcgagatggacgctaccccgggtattgatctgacccgcgtccttgctgaaatgcgagaacagtacgaggccatggccgaacgcaaccggcgggacgctgaagaatggtttcatactaagtctgcagaactcaataaggaggtgagtacaaatactgctatgatccagaccagtaagacagagataaccgaactaaggcggacgctacagggcctggagatagagctgcagtcccagctgtccatgaaggccggcttagaaaatactgccgccgatcctgggacccatcagcagcaccgtgggccagctgaaagagccccacagtag

SEQ ID NO: 121450 - DNA, 1377 bp, Artificial Sequence
  Description of Artificial Sequence: Synthetic coding sequence
atgtcgctgcggctgcaatcctctagcgcgtcttatggcgggggatttgggggggggtcatgccagctcggaggtggccgaggagtgtcaacttgtagtactaggtttgtgtctgggggatctgcaggcggatacgggggcggagtgtcgtgtggatttggtggcggcgccggatccggctttggaggcggctacggaggaggattaggaggcggttacgggggcggcctcggtgggggctttggaggagggttcgcaggtggatttgttgacttcggcgcgtgtgatggcgggttgctgacaggaaacgaaaagataactatgcagaacctgaacgaccggctagcctcctacctcgagaaagtgcgagccctggaagaagccaacgccgacctggaagttaagattcgcgactggcacctgaaacagagccccgcatcccctgagagagactacagtccctactataaaactatcgaagaactgcgagacaaaatcctcacagccacaattgaaaataatcgcgtgatccttgagatcgataacgcacgactggctgctgatgatttcaggctgaagtacgaaaacgaactggccctgcgccagtccgtagaagccgatatcaacggactacgacgagtgctggatgagctgactctttctaagaccgacttggagatgcagattgagtcgctgaacgaggaactggcttatatgaagaagaatcacgaagaggagatgaaggaattctctaatcaggtggtaggtcaggtcaatgtggagatggatgccactcccgggatcgaccttacaagagtgctcgctgagatgcgtgaacagtatgaagcaatggccgagagaaaccggagagacgcagaggaatggtttcacacaaagagtgctgagcttaacaaggaggtttccactaatacagcgatgatacagacatccaaaacggaaatcacagagctgcggaggacgctgcagggactggaaatcgagctacagtctcaactgagcatgaaggccgggctcgaaaacaccgtggcagagacagagtgtcgatatgctctccagctgcagcagatccagggtctgataagctcaatcgaggcccagctgtctgagctgagatccgagatggaatgccagaaccaggagtacaagatgctgttggacatcaagactaggctggaacaagaaattgcaacgtataggtccctcttggagggtcaggatgccaaaatgattgggttcccctcatccgctggctccgtttccccacggagtacaagcgttaccaccacgtcctccgccagtgtaaccactacgtccaacgcatctggccgtaggacaagtgacgtgagacgaccctag

SEQ ID NO: 121451 - DNA, 1263 bp, Artificial Sequence
  Description of Artificial Sequence: Synthetic coding sequence
atgtctttgagattacagtcaagttccgcatcttatggtggaggctttggtggcggatcctgccagctcgggggtgggagaggtgtgagcacatgcagcactaggttcgtgagtggtggcagtgccggcgggtacggcggcggggtaagctgtggatttgggggtggggccggaagcgggtttggcggtggatatggcggggggctgggaggaggatatggtgggggcctaggcggaggctttgggggcggattcgcagggggcttcgttgatttcggcgcatgtgacggaggtttgttgacgggaaacgagaagattaccatgcagaacctgaatgatcgactggcatcatatctggagaaggtcagagccttggaagaggccaatgcagaccttgaagtgaaaattagagactggcatctgaagcagagcccggcatcacccgagagagactactccccatattataagactatcgaagaactgagagataaaatcttgaccgccactattgaaaacaacagagtgatccttgaaatcgacaacgcccggctggctgctgacgacttccggttgaaatacgagaacgaactcgccttgcgccagtcagtagaggcagatatcaacggactgcggcgagtgcttgacgaacttacattgtcaaaaactgatctcgagatgcaaattgaatccctgaatgaggagctggcttacatgaagaaaaatcacgaagaagagatgaaggagttctccaatcaggtggtcggacaggttaatgtcgaaatggacgcaacacccgggatcgacctgaccagggtgctcgccgaaatgcgcgaacagtatgaagcaatggcggagcgcaacagaagagacgcagaagagtggtttcatacgaaaagcgcggaactgaacaaggaggtatctacaaacacggctatgattcaaactagcaagacagaaataaccgagctgaggagaactctgcagggcctcgagatagaactccagtcccagctcagcatgaaggccgggctcgagaacacagtggcggaaacggagtgcaggtatgctctccagttacagcagatccaggggcttatcagttctatagaggctcagctgtcagagctacgcagcgaaatggagtgccaaaaccaggaatataaaatgctcctggacatcaaaacccgtctggagcaagaaatcgctacatataggtctctcctcgagggccaggacgcaaagaagaggcagccaccttag

SEQ ID NO: 121452 - DNA, 1371 bp, Artificial Sequence
  Description of Artificial Sequence: Synthetic coding sequence
atgacgactacttttctgcaaacatcctcatccacgttcgggggcggcagcactcggggcggaagcttgctcgctgggggcggcggctttggcggcggatccctgtccggcggtggagggagtcgtagcatatcagccagctctgcccggtttgtgtcctccgggagcggaggagggtacgggggcggaatgcgcgtctgtggtttcgggggtggggccggcagcgtgttcgggggaggatttggcggcggagtgggaggcggattcggcgggggcttcggcggaggggatggagggctgctaagcgggaatgagaaaattacaatgcagaatctgaatgatcggctagcctcatacctcgataaagtgcgagcgttggaggaggctaacgccgaccttgaagtcaaaatccacgactggtaccagaaacaaacccctaccagccccgagtgcgattactcccaatattttaagaccatcgaagaactcagggacaaaatcatggccactaccatagataatagcagagtcattcttgagatagacaatgctagattagctgccgacgacttcagactgaaatacgagaacgagcttgcactaaggcaaggagttgaagctgacatcaatgggttgcgtcgagtcctggacgaacttactcttgcacggacagatctggagatgcaaatcgaagggcttaacgaggagctcgcttatctgaaaaagaaccatgaagaggaaatgaaggagttctcctcccaacttgcaggacaggttaatgtggaaatggatgcagccccgggagtcgacctgactagagtactggcggagatgagagaacaatacgaggccatggctgaaaagaatcggagagacgttgaagcatggtttttttcaaagacagaagagctgaataaagaagtggcttctaatactgagatgatacaaacttctaaaacagagatcacagatctgagaagaacaatgcaggaactggagattgagctgcaaagccagctctctatgaaggccggactggagaacagtcttgccgaaacagagtgcagatacgcaacccagctgcagcaaatccaggggcttatcggcgggctcgaggctcagttgagcgagctgagatgtgaaatggaggctcagaaccaggagtacaagatgctccttgatataaagacccggctggaacaggagatagcaacgtatagatccctcctggaaggtcaggacgctaagatggcagggatcgctatccgtgaagcctcctccgggggaggaggaagtagctcaaactttcacataaacgtggaggagagcgtagatggacaggtcgtgtcctcacacaagcgagaaatctag

SEQ ID NO: 121453 - DNA, 876 bp, Artificial Sequence
  Description of Artificial Sequence: Synthetic coding sequence
atgacagggacacgctctaggcctcagcccgcccagaatgcgaccaccgccaacaccagtagaccccttaagtcttcggggacacggtacgagaacgaactagctctccggcagggcgtagaagctgacattaatggtctccggagagtcctggatgagcttacactcgcccggacggacctagagatgcaaatcgagggacttaatgaagaactggcatatcttaaaaagaaccacgaggaagaaatgaaggaattctcgtctcagctagcaggccaagtgaatgtagagatggatgccgcgcccggcgttgaccttactcgcgtgctggccgagatgcgggagcaatatgaagccatggccgagaagaaccgacgcgacgtggaggcctggtttttttccaaaaccgaggaacttaataaggaagtcgcttccaacaccgagatgattcaaacatccaagacagagattacagacctgcggcgcaccatgcaggagctagagatcgagctgcagtctcaactgtccatgaaggccggtctcgagaactctctcgcagagacagagtgcagatacgccacccaactgcagcagattcagggcttaataggcggcctggaagcacagttgagcgaactgagatgcgagatggaggctcagaaccaggagtacaagatgctcttggacattaaaaccaggctcgaacaggagattgctacttaccggtctttattggagggacaggatgccaagatggcaggaatcgccatccgggaggcaagttccggcgggggaggctccagttccaactttcatatcaatgttgaagagagcgtggacggacaggtggtgtcgtcacacaaacgggagatctag

SEQ ID NO: 121454 - DNA, 1371 bp, Artificial Sequence
  Description of Artificial Sequence: Synthetic coding sequence
atgacgacaacatttctgcagacgagctcttcaacttttggagggggctctacgagaggagggagcctccttgcaggtggcggagggtttggaggcggaagtcttagtggtggaggagggtccagatcaattagtgcttcctcggcacgtttcgtgtcaagcggcagcggtggcggttatggtggagggatgagggtatgtggtttcggcggaggcgcaggcagcgtgttcggcggaggtttcgggggaggggttgggggtggttttggggggggcttcggaggcggagatggcggtctgctgagcggtaatgagaagattaccatgcaaaatctcaatgaccgcctggcttcgtatctggacaaggtgcgggcactagaagaggctaacgctgatttggaagtgaaaattcatgactggtatcagaagcaaacccctacgagccctgaatgcgactattcacaatattttaagaccatcgaagagctgcgtgacaagattatggctaccacaatcgacaactcacgggttatactggagatcgataacgctagactggctgccgatgatttccggcttaagtacgagaacgagctagctctccgccagggcgttgaggcagacattaatgggctacgccgggttcttgatgagctgacgctggcacgcactgatctggaaatgcagattgaagggcttaatgaggagctggcctatttaaaaaaaaaccacgaggaagagatgaaagagttttctagccagctcgcaggccaagttaacgtggaaatggacgccgccccgggcgtagacctgacccgtgtgctggcagaaatgcgcgaacaatatgaagccatggctgaaaaaaacagacgcgacgtggaagcctggtttttcagcaagaccgaagagctcaacaaagaggtggcctctaatacagagatgatccaaacttctaagaccgaaatcactgacctgagacgaacaatgcaggagttggaaattgaactacagtcccagctgtccatgaaggctggcctagagaatagcctggctgagacggaatgccgctacgccacacaattgcagcagattcagggccttatagggggactggaggctcagttgagcgaactgcgttgtgaaatggaggctcagaatcaagagtacaaaatgctactggatatcaaaaccaggctcgagcaggagattgccacataccgtagcctgttggagggccaggacgctaaaatggccggcatcgccattcgggaagcttcctcaggcggcggaggcagctccagtaatttccatattaatgtggaagaatccgtggacggtcaggtagtgtctagccacaaacgggagatctag

SEQ ID NO: 121455 - DNA, 756 bp, Artificial Sequence
  Description of Artificial Sequence: Synthetic coding sequence
atgactggtacacggtccaggccccagcctgctcaaaatgcaactacagctaacactagcaggcctctgaaaagctccggcactcgctatgaaaatgagctggccctgcgccagggggtggaggccgacattaacggacttaggagagtgttggatgaacttaccttggctcggactgatctcgagatgcagattgaaggtctgaatgaggaattagcctatctgaagaaaaatcacgaagaggagatgaaggagttcagcagccaactggccggtcaggtcaacgtagagatggacgctgctcctggagtggacctcactagggtcttagcggaaatgcgcgagcaatacgaagctatggcggagaagaatcgccgcgacgtggaggcatggttcttctctaaaacggaggagctaaataaggaagtagcctcaaatacagagatgatccagacatcaaagacagagattactgatcttaggaggaccatgcaggagctggagatcgagctgcaatcccagctaagcatgaaggccggtctagaaaactccctggccgagacggaatgccgatacgcaactcaattgcagcagattcaggggctcatagggggattggaggcgcagctgtccgagctgaggtgtgagatggaagcacaaaaccaggagtacaaaatgctcctggatatcaagacacgattagagcaggaaatcgccacctatcggtcgttgctggaaggccaggatgcaaaatag

SEQ ID NO: 121456 - DNA, 663 bp, Artificial Sequence
  Description of Artificial Sequence: Synthetic coding sequence
atgacgggcacgaggtcccgtccccaacccgcacagaatgcaactaccgcaaacacatctagacccttgaagagctcgggcacacgctacgaaaacgaactggctctacgtcagggagttgaggctgatatcaacggattacgacgcgtgcttgatgagctgactttagcgcgcacagacctggaaatgcagatcgaaggtctgaatgaggagcttgcatatctgaagaagaaccacgaggaagagatgaaggaattttcatcccagctcgcgggacaggtgaacgtggagatggatgctgcccccggcgtcgatctgacaagggtcctagccgagatgcgggagcagtatgaagccatggctgagaaaaaccgacgcgacgttgaagcttggtttttcagtaagacagaggaactgaacaaagaagtcgcgagtaacaccgaaatgatccagacctcaaaaaccgaaatcactgatctgagaaggaccatgcaggaactggagatcgagctccagtctcagctgagtatgaaagcaggcctcgagaacagcttagccgaaactgaatgccggtatgccacccagctgcagcagatacaagggttgatcggagggcttgaggcccagctctccgagctgcgttgcgaaatggaagcacagtag

SEQ ID NO: 121457 - DNA, 1422 bp, Artificial Sequence
  Description of Artificial Sequence: Synthetic coding sequence
atgaccacttgtagccgccagttcaccagtagcagcagcatgaaagggagctgtggaattggtggcggtatagggggtggatcaagcaggattagttccgtcctggccggaggtagttgccgtgctcctagcacttacgggggcggcctatcagtatcaagccggttctcttctggaggagcctgcggcttaggtggtggctatggcggcgggttctcgtcatcgagttccttcggtagtggatttggtgggggctatggaggcggccttggggcaggcttcggaggaggtcttggtgccggtttcggtggcgggtttgccggcggagatggccttcttgtggggtctgaaaaggtgactatgcagaacctgaacgatcggcttgcctcatatctcgacaaagtccgcgctctcgaagaggccaacgcggacctggaggtcaagatacgggactggtatcagcgacagaggccttctgagattaaagattattctccgtactttaaaactattgaagacctgcgcaataagattatcgctgctaccatcgagaatgcccagccaatcctgcagatcgataacgcgaggttagccgctgatgatttccgcactaagtatgaacacgaactggcccttcggcagactgtggaagcagacgtgaacggcctgaggcgcgtccttgacgagctcacactcgccaggacagacctcgagatgcagatcgagggcctgaaggaggaacttgcttacctacgtaagaatcacgaggaggagatgcttgctctgcggggccaaaccggaggcgatgtcaacgtggagatggacgcggctccgggagtggatctatcccgcatcctcaacgagatgcgcgaccagtatgaacagatggctgaaaaaaatcgaagagacgctgagacttggtttctgtccaaaactgaggagctcaataaggaggtggctagcaatagtgaattagtacaatcttcccgcagcgaggtaaccgaactgcgcagagtgctacagggcctcgagatcgagctccagtcgcagttgagcatgaaggcctccctggagaattccctggaagaaaccaaggggaggtactgcatgcaattgtctcagatccagggactaatcgggtcagtcgaagaacagctcgctcagcttcggtgtgaaatggagcagcaatctcaggagtatcagattctgttggacgtcaagactcgcctggaacaggagatagctacctatcgtagactgctagaaggcgaagacgcccatctctcttcccagcaggcgtcggggcagtcatacagcagcagggaagtcttcacatcttcctcgagtagttcctcccggcagaccagacccatcttgaaggagcagtcttcaagctccttctctcagggccagagctcatag

SEQ ID NO: 121458 - DNA, 1299 bp, Artificial Sequence
  Description of Artificial Sequence: Synthetic coding sequence
atgaccacttccatccggcagttcacctcgtcatcctccattaagggctcatctggactgggggggggctcaagccgtacctcttgcaggttatccggcgggctgggtgccggctcgtgtagacttggttcagctggcgggctcggaagtactctgggaggaagctcatattcaagctgctattcctttgggagtggtggcggctatgggtcctcattcgggggcgttgatggactgctcgccgggggagagaaagcgaccatgcagaacctgaacgacagactggcttcttatcttgataaagtcagagccctggaggaagctaacactgaactagaggtgaagattcgtgattggtatcagcggcaagctcctggccccgcccgagactactctcagtactacagaactatcgaggaactgcaaaataaaatccttaccgctaccgtggacaacgccaacatactcctgcagattgacaatgccaggctggctgctgatgattttaggaccaaattcgaaaccgagcaggcactcaggctgtctgtggaagcggatattaatggcctccgccgggtgcttgatgagctcaccctcgcgagagctgaccttgaaatgcaaatcgagaatctgaaggaggagcttgcctaccttaagaagaaccacgaagaagagatgaatgctctgagaggacaggtgggtggggaaattaacgttgagatggacgctgcccctggcgtcgacctgtcgagaattctcaacgaaatgagggatcagtacgaaaagatggctgaaaaaaatagaaaagacgccgaggactggtttttctccaaaacagaagagctgaaccgggaagtggcaacaaactcagaactagtgcagagtgggaaaagcgagatcagcgagttgcgtcgcactatgcaggcactggagatcgaactccagagccagctgtcaatgaaggcttcactggagggcaatttagctgagaccgagaaccgatactgtgtccagctgagtcagatccaaggattgatcgggagcgtagaggagcagttggctcagctgaggtgcgaaatggagcaacaaaaccaggagtacaagatcctcctggatgttaagacccggctggaacaggaaattgctacataccgccggctgctcgagggggaagacgctcatcttacacaatataagaaggaacctgtgactacgcgccaggtgagaactatcgtggaagaagtgcaggacggcaaagtgatctcaagcagagaacaagtgcaccaaacaacgcggtag

SEQ ID NO: 121459 - DNA, 1920 bp, Artificial Sequence
  Description of Artificial Sequence: Synthetic coding sequence
atgtcatgtcagatttcttgcaaaagccgcggaaggggaggcggaggcggggggtttagagggttctccagtggttcagctgtagtgagcgggggttcacgcagatcaacttcctccttctcttgcctctctaggcacggtgggggcggcggtggctttgggggaggtgggttcggctcccgttcactagtaggtctggggggtaccaagagcatcagtatttcggtcgcggggggtgggggcggcttcggagctgctgggggctttggagggcgaggtggcgggttcggaggcggatcctcattcggcggaggtagcggctttagtggaggaggcttcggtggggggggcttcggtggcggtcgctttggcgggttcggagggcctgggggggtcgggggtctgggaggtcctggggggtttggaccagggggatatcctggcggcatccacgaagtcagcgttaatcagtctttgttacaacccctgaatgttaaggtggatcctgaaattcagaatgttaaagcacaagagagggagcaaatcaagaccctgaacaataaatttgcttcttttattgataaggttaggttcctggaacagcagaaccaggttctgcaaactaaatgggagctgctgcagcagatgaacgtgggcactcgcccaattaacctggagcccatcttccagggctacatcgacagcctaaagcgctaccttgacgggctgactgcggaaaggacctcgcagaatagtgagttgaataacatgcaggatctggtggaagactataaaaaaaaatacgaggacgagatcaacaagaggacagcagctgagaatgattttgtcacgctgaagaaggacgtggacaatgcttatatgatcaaggtggagctgcagagtaaggtggacttgctaaatcaggagattgagttcctgaaagtcttgtatgatgcagagatcagtcagattcatcagtcagtgacagacaccaatgtcattctgagtatggataacagtcgcaacttggacttagactcaatcattgctgaggtgaaggcccagtatgaagaaatagcacagcgctcaaaggaagaagcagaagcgctatatcactcgaagtatgaggagctgcaggtaacagtgggaagacacggggactctctgaaagaaattaagatcgagatctccgagctcaatcgggtgatccaacgattgcaaggcgagattgctcacgtaaagaagcagtgtaagaatgtgcaggacgccatcgccgacgccgaacagcgaggcgaacatgctctgaaggacgccaggaacaagctaaacgatctcgaggaggccctccaacaagcaaaagaagaccttgctaggctgttgagggattatcaggaactgatgaatgtcaagctggcactcgatgtggagatcgccacatacagaaaactcctagagggcgaagagtgccggatgtccggtgacctgtcttccaacgtgacagtcagtgttactagcagtacaatctcttcgaacgtcgcatcaaaggccgcattcggcggcagcggaggccggggttctagcagcggtgggggctactcctccggcagcagctcctatggaagcggaggtaggcagtcaggaagtaggggaggctctggaggcggtgggagcatcagtggtgggggttacggatcgggcggcgggagcgggggacgctacggcagcggcggcggttccaagggcggttctatcagcggtggtggttacgggtcagggggcgggaagcactcttcgggaggtgggtctcgcggtggcagctctagtggaggtggctacggatccggaggcggcggaagtagcagtgtgaagggatcttcaggtgaggccttcggtagcagcgtgaccttttcctttcgatag

SEQ ID NO: 121460 - DNA, 1275 bp, Artificial Sequence
  Description of Artificial Sequence: Synthetic coding sequence
atggatttctctcggcgttcctttcataggtctctttcttcatctttacaggcccctgtagtatccacagttggaatgcaaagacttggtacaactccatcagtgtacggcggtgccgggggtcgcggtattaggatttccaacagcaggcacaccgtaaactatgggagcgatttaacaggcggtggtgacctgttcgttggaaatgaaaagatggctatgcagaatctgaatgacagactagcatcgtatttggagaaagtcagaaccttggaacagagcaatagcaaactagaggttcagataaagcagtggtacgagacaaacgccccaagggccggtagggattatagcgcgtactaccggcagatagaggagttgagaagccagatcaaagacgctcaactgcaaaacgctcgctgcgttctccagattgacaacgccaaactggcggccgaggattttcgactgaagtatgaaaccgagcgcgggatacgtctaacggtggaggcggatctccaaggccttaacaaagtgtttgacgatcttaccctgcataagaccgaccttgaaatccagattgaggagctgaacaaggacttggcactcctcaagaaggaacatcaggaggaagtcgatggtcttcacaaacacttgggaaacacagtgaacgtggaggttgatgcggctcccggcttgaatcttggcgtgattatgaacgaaatgcggcaaaagtatgaggttatggcccagaagaatttgcaggaggcgaaggaacagtttgagcggcagaccgcagtgctccaacaacaggtgaccgtgaatacagaggaactgaagggaactgaggtccagctaaccgaactgcggagaacttctcagagcctcgagatcgaacttcagtctcacctcagtatgaaggagtctctagagcatacgctggaggagacaaaggcccgctactcatcccaactcgcaaacctccaaagcctgctttcttccctagaagcccagctcatgcagattaggagcaatatggagcgtcagaacaacgagtatcatatattgctggacatcaagactcggttggagcaggaaattgcaacatatcgaagactgctggagggggaggatgtgaagactaccgagtatcaactgtcgaccctagaagaacgtgacattaagaagacgcgtaagataaagacagtagtccaggaagttgtagatgggaaagtcgtcagttccgaggtgaaggaggtcgaagagaacatctag

SEQ ID NO: 121461 - DNA, 1578 bp, Artificial Sequence
  Description of Artificial Sequence: Synthetic coding sequence
atgagttgttcgagcagagcctccagctcacgcgcaggaggcagcagctccgctagagtctctgccggcgggtctagtttctcttccgggagccgctgcgggcttggcggatcaagcgcccagggcttccggggaggagcttcctcttgcagtttgagcggcggaagttctggcgccttcggagggtccttcggaggaggtttcgggtcctgctctgttggaggtggcttcggcggtgcatcaggctccggcacggggttcggtggaggtagttcatttgggggggtatctggcttcggacgcggttctggtttctgcggatcctcgaggttttcaagcggcgctaccggtggcttttatagctatggcggcggcatgggcgggggagtgggggacggtggattatttagcggcggtgaaaagcagacaatgcagaatctgaatgaccgactggctaattatctggacaaagtacgggcactcgaggaggccaatactgacttagagaataagatcaaagaatggtatgacaagtatggaccagggtcaggtgacggaggaagcgggcgcgactatagcaagtattacagtatcatagaggacttaagaaaccagatcattgctgccactgtagaaaatgccgggattatattgcacattgacaatgcgagactggcagcagatgactttaggttgaagtatgaaaatgagctctgtttgagacagagtgtggaggcagatatcaatggactgcggaaagtgcttgacgacctgacgatgacaagatccgacctcgaaatgcagattgagtcatttactgaagagttagcatacctcagaaaaaaccatgaggaggaaatgaagaacatgcaaggctccagtggaggcgaggtaacggtcgagatgaatgccgcaccaggcaccgacctgactaaactactgaatgacatgcgggcccaatatgaagaactcgccgaacagaataggcgagaggcagaagagcgctttaataaacagtctgcatcgctgcaggcacagatatcaaccgacgcaggtgccgctacaagcgccaagaacgaaattacagaactaaagcgcacactgcaggccttggagattgaactacagtcccagctggcgatgaagtcaagtctggagggcaccctagcggacacagaggccggctatgttgcccaattaagcgagattcaaacccagattagcgcactggaggaagagatctgccagatttggggggagacaaaatgccagaacgccgaatacaagcagcttctagacataaaaaccagactggaggtggaaatcgagacctacagaaggctcttagatggcgaaggaggaggctcttcatttgccgaatttggagggcggaactcgggctccgtcaacatgggatctcgcgatctggtgtcgggcgacagtcgcagtggatcatgtagcggtcagggacgcgattcttctaaaacacgtgtgactaagaccattgtagaggaactggtggatggtaaagtggtgtcttctcaagtgtctagcatcagtgaggtaaaggtaaaatag

SEQ ID NO: 121462 - DNA, 1890 bp, Artificial Sequence
  Description of Artificial Sequence: Synthetic coding sequence
atgagccggcaagcctctaaaacctccggtggggggtcccagggatttagcggcaggtccgccgtggtgagtggcagctcacgaatgagctgcgtggcccactccggcggggctggcggtggtgcttacgggttcagatccggagctggggggtttggctcacgtagtctatataatctgggaggtaacaagtcaatcagcatctctgtcgccgccgggggatcacgagccgggggtttcggtggggggcgatcgtcctgcgccttcgcgggaggatacggcggagggtttgggagcggttacggggggggctttggcggtggattcggtggggggagaggcatgggaggtggttttggaggtgccggggggttcgggggcgccggaggcttcgggggagcgggagggttcggaggccctggagggtttggcgggagtggcggcttcggcggacctggaagcttgggctctccgggtggatttggaccaggcggattcccaggcgggattcaggaagtgactataaatcagtccctgctgcaaccactcaacgtcgagattgaccctcagatcggtcaggtgaaggcacaagaaagggagcagatcaaaactcttaataacaaattcgcaagcttcattgataaggtgcgatttctggaacaacagaataaggtactggagaccaagtggaacctgctgcaacagcaaggaacttcatccatcagcggcacaaataacctggaaccactgttcgaaaaccacatcaactatctgaggtcgtacctcgacaacatactcggggaacgggggcggctggatagcgagttaaaaaacatggaagacctggttgaggatttcaagaagaagtatgaggatgaaattaacaagcgcacggcagctgaaaacgaatttgtgactctaaaaaaggatgtagatagtgcatacatgaataaggtcgaactccaggcaaaggtggatgctttgatcgacgaaatcgatttcttgagaacactttatgatgccgaactgagtcagatgcagagtcacatctcagacaccagtgtcgtgctgtcaatggacaataacaggtctctggatctagacagcatcattgctgaagtaagggcccagtatgaggacatcgcacagcgatcgaaggctgaagcggaagccctgtatcagactaaattaggtgagctgcagacgaccgcgggtaggcatggcgatgatctgcgtaatactaagtctgagattatcgagctgaacagaatgatccagagactgcgcgccgagatcgagggcgtgaagaagcagaacgctaacctgcagacagccatcgccgaagcagagcagcatggggagatggcccttaaggatgccaatgccaaactgcaggagttgcaggccgcgttacaacaggccaaagatgacctggcccgtttgctgcgcgattatcaggaactaatgaatgtgaaactggccctggacgtcgaaatcgctacttacagaaagctgctggagggggaggaatacagccggatgagcggtgagtgtccatcagctgtctctatttctgtagttagttcttctaccacttccgcaagtgctgggggctatggcggcgggtacggcggagggatgggaggcggtctgggagggggattcagtgccgggggtggttccggctccggattcgggcggggaggcggtggaggcattggtggagggttcggcggagggagtagtggattcagcgggggcagcgggtttgggagtataagtggagcacgctacggggtcagtgggggaggattctcctcagcaagcaatcgcggcggctcgattaaattctcgcagtctagccagagcagccagcggtactcaaggtag

SEQ ID NO: 121463 - DNA, 1887 bp, Artificial Sequence
  Description of Artificial Sequence: Synthetic coding sequence
atgtccagacaggcgtctaagacatccggcggggggtcccagggcttttcggggcgctccgctgtggtgtccgggtcctctcgaatgtcctgtgtggctcatagtggcggggctgggggcggcgcatacgggttcaggagcggagctggcggatttggtagcaggtctttatataatctggggggcaataaatccattagcatctccgttgcagcaggcggatcaagagctgggggattcggaggcggacgttcgtcctgtgcctttgcaggcggctacggtggaggcttcggttctggctatggcggcggctttggaggcggatttggcggcggacgcggaatggggggtggattcggcggtgccggtggtttcggcggcgcaggtgggttcggtggtgccggcggcttcgggggccctggcggtttcggtggctctggaggctttggcggtcctggctctcttggctcccccggtgggttcggccctgggggattcccaggaggcatccaggaagtcaccatcaaccagtccctattacagccactgaatgttgagattgacccacaaattgggcaggtgaaagcacaggagagggaacagattaaaaccctcaataacaaatttgcaagcttcattgataaagtgagattcctagagcagcagaacaaggtgctggagacgaagtggaacctgttacagcagcagggcacatcttctattagtggtacaaacaacttggaaccgctgttcgagaatcacattaactatttaagatcatacctggataacatactgggtgaaagaggtcgactggactctgaactcaaaaacatggaagacctggtcgaggattttaaaaaaaagtacgaggatgaaataaacaagagaacagctgccgagaacgaattcgtgaccctgaagaaagatgtggactccgcttacatgaacaaagtggagcttcaagccaaggtcgacgcattgattgatgaaattgatttcctacggaccctatacgacgcagagctttctcagatgcaatcccatatcagtgatacttcagttgtcttgagcatggacaataacaggtcactcgacttggacagcatcatcgccgaagtgagagctcagtacgaggacattgctcagaggagcaaggccgaagcggaggccctttaccagaccaagttaggcgagctgcaaacgaccgctggtagacacggggatgatctccgaaacaccaaatcagagatcatagagctgaatagaatgattcagcgtctcagggcagagatagaaggcgtgaagaaacagaacgcaaatttgcagacagcgatagcagaagcagaacagcacggggagatggcactcaaagacgctaatgctaagttgcaagagttacaagctgcgctccagcaggcgaaggacgacttggctaggttactgcgggactatcaggagctgatgaatgtcaagcttgctctcgatgtggagatagccacgtataggaaattgctggaaggcgaggagtatagaatgtcaggcgaatgccccagcgcggtgagcatctctgttgtttcctccagcacaacttccgcaagcgcgggggggtatggcgggggatacggcggcggaatgggagggggattgggtggcgggttctcagccggaggcgggtccggaagtgggtttgggcgagggggtggaggagggattggcggcgggttcggcggtgggtcttctggcttcagtggagggagtggattcgggagtatttcaggcgcgaggtacggagtttccggcggaggtttttcatcggcaagcaaccggggggggtccatcaaattctctcagtccagtcagagttcccaaaggtattcccgctag

SEQ ID NO: 121464 - DNA, 1251 bp, Artificial Sequence
  Description of Artificial Sequence: Synthetic coding sequence
atgccttataacttctgtcttccctccctgagttgtcgaactagttgcagcagccggccatgtgtccctccttcatgccattcttgtactctgcctggcgcctgcaatattcccgccaatgtgtccaattgtaattggttctgtgaagggagctttaatggctccgagaaagagacaatgcagttcctgaatgataggctcgcttcttacctcgagaaagtcagacagcttgagcgcgataacgccgaattagaaaacctgattcgagaacgatcacagcagcaagagcctctgctgtgcccatcataccagagttattttaaaaccatcgaagagctccagcagaagatcctctgcaccaagtctgaaaatgcccgcctggttgtacagattgacaatgcgaagctggccgccgacgatttccgcactaagtatcagacagagctaagtctacgacagctggtggaatccgatatcaatgggctaaggagaatcctcgacgaactgacactgtgtaaatccgatctggaagcccaggtggaatccctgaaggaggagctgctttgcctaaagagcaaccatgagcaagaagtcaacaccttgcgatgccaactgggggatagactcaacgtcgaggttgatgctgcgcccactgtggatctgaacagggtcttaaacgaaacccgaagccaatatgaagctctggttgagactaaccgcagggaagtggagcagtggtttactactcagacagaagaactgaacaaacaagtggtatcctcaagcgagcagcttcagtcttaccaggccgaaattatcgaactgagacggaccgtaaacgccctggagatagagttacaggcccaacataatttgcgtgactctctggagaacacactcaccgaaagtgaagccaggtacagctctcaactgtctcaagttcagtcacttatcactaatgtagaatctcagctggctgaaatccgatccgatctggaaagacagaaccaagaatatcaagtgcttctggacgtgcgcgcccgcctagagtgcgaaatcaatacatataggagcctcttagaatcagaggattgcaatctgccgtccaatccttgcgctaccactaacgcgtgctccaagccgataggaccctgtctgagcaatccatgcaccagttgtgttcctccagccccttgtactccatgcgcgccaagacctagatgcgggccatgcaatagcttcgtgaggtag

SEQ ID NO: 121465 - DNA, 1674 bp, Artificial Sequence
  Description of Artificial Sequence: Synthetic coding sequence
atggtgagcaagctgactagtttgcagcaggaattgctgtctgctctgctctctagtggggtgaccaaggaagttcttgtgcaagctttggaggaattgttgccaagccctaatttcggggtcaagctggagacactgccgctctcaccaggctccggcgctgagccagatactaagcccgtgttccacaccctgacgaacggtcatgccaaggggcggctctcgggagatgaagggtcggaggacggcgatgattatgatacaccaccgatcctgaaggagctgcaggcactgaatacagaggaagccgctgaacagagggccgaggtagacaggatgcttagtgaggacccctggagagccgcgaaaatgatcaagggctatatgcagcagcacaacatacctcagcgcgaggtcgtggacgttactggactcaaccaatcccacctgtctcagcatttgaacaagggcactcccatgaagacccagaagcgcgcggctttatatacgtggtatgtgcggaaacagcgcgagattctgcggcaattcaatcagaccgttcagtcttcaggcaacatgacggataagtcttctcaagaccaactcctcttcctgtttccagagttctctcagcaatcccacggtcctgggcagagcgacgacgcgtgcagtgagcctaccaacaagaagatgcgtaggaatcgcttcaagtggggacccgcttcacaacagatcctttatcaggcctacgatcgccagaaaaaccccagtaaagaagagagagaggctctcgtggaagaatgcaaccgggccgagtgtcttcagaggggtgttagcccatccaaagcgcacggactgggctcaaacctggttactgaggtcagggtttataactggtttgcaaatcgtagaaaggaggaggctttccgtcagaaactcgcaatggacgcatattccagcaaccagacccactcattgaaccctctcctgtcccatgggagtccgcaccaccagccgtcttcctcccccccgaacaagttgagcggcgttagatattcccaacaggggaataatgaaatcaccagctctagtaccatcagccaccacggaaactcggcaatggtgaccagtcagagcgtgctacaacaggtgtcacctgctagtttagacccaggccacaaccttctgagccccgatggaaaaatgatcagtgtgagcggagggggattgcctccagtgagcacactgacgaacattcactcgttgagtcatcacaatcctcagcaatcccaaaacctcattatgactcccttaagcggggtaatggcgatcgcccaaagcctaaacacgtctcaggcccagtctgtgcctgtcatcaactccgttgcgggcagcctcgccgccctccagccggtgcaattcagtcagcaactgcacagcccccatcagcagccattaatgcagcagtcaccaggatcacacatggctcagcagccattcatggccgccgtgactcaacttcagaatagtcacatgtacgcccacaagcaggaacctccccagtacagtcacacgagcaggttccctagcgcgatggtggtgacagacacaagcagtatctccactcttacaaatatgtcctcaagtaagcagtgccccctgcaggcatggtag

SEQ ID NO: 121466 - DNA, 1215 bp, Artificial Sequence
  Description of Artificial Sequence: Synthetic coding sequence
atgtcatacagttgtgggcttccatcactctcctgtcgaacaagttgcagctccagaccctgcgtccccccctcctgtcatggctgcaccctgcccggtgcatgtaatatccctgccaatgtgtccaactgtaattggttttgtgaggggtcttttaatggatctgaaaaggagacaatgcaatttttgaacgacagactagcttcctaccttgaaaaggtccgacagctggagagagacaacgccgaactggagaacttaattagagagagatcccagcagcaggagcctctagtgtgtgcctcctaccagagctactttaagaccattgaagagctccagcagaagatcttgtgctcaaagagtgaaaatgctagattggtggtgcagatcgataacgcaaagttggcttcggatgactttaggacaaaatacgagactgaactaagtctgagacaattggtcgagtcagatatcaatggactgaggaggattctggacgaactgacactctgccgttccgacctggaggcacaagtggagagcctgaaggaagaattgctctgtttgaagcagaaccatgagcaggaagttaatacgctgcgctgtcaattaggcgataggctgaacgtggaggtcgacgccgctccgactgtggatttgaatcaagttctgaatgagacacgctctcagtacgaggcactggttgagacgaacagaagagaggtggaacaatggttcgctactcagaccgaggagttgaacaaacaggttgtgagcagctcagaacagctgcagtcctaccaggcagaaattatcgagctgcggagaaccgtgaatgcattggagatcgaactccaggctcaacacaacctgagagatagtctcgagaatactctgacagaaagtgaggcacgctattcatctcagctgtcacaggtacaacggctaattaccaatgtggaaagccagctggcagaaatacgatctgatttggaacgacagaatcaagaataccaggtcctgctcgatgtgcgtgctcgcctggaatgtgaaattaacacgtatcgaagcttgctagagtctgaggactgcaagttgccttccaacccgtgcgccaccacaaacgcctgtgacaaatcaactggaccgtgcatctcgaatccatgcggattgcgtgctaggtgcggaccctgcaatacctttggatactag

SEQ ID NO: 121467 - DNA, 1215 bp, Artificial Sequence
  Description of Artificial Sequence: Synthetic coding sequence
atgccatacaatttctgtctgcccagtctaagctgtcggacttcatgttccagccggccgtgtgtgccgccgagctgtcatggatataccctccctggcgcttgtaacatcccagctaacgtatcgaactgcaattggttctgtgaagggagcttcaacggtagcgagaaggagacaatgcaattcttgaatgacaggctggcctcctacctcgagaaagttcgccagctagagcgcgataatgcagaattggagaacctaatcagggaacggtcccagcagcaggaacctctgttgtgtccatcatatcagtcttatttcaagacaatcgaagagctgcagcagaagatcttgtgctccaagtcagaaaacgcgagactagtagtgcagatcgacaatgctaaactcgccgccgatgactttaggacaaagtatcagacagagcagagtttgagacaactcgtggagagtgatattaatagccttaggcgcattctggatgagctcacgttgtgcaggagtgatcttgaggcacagatggagtctctgaaggaggaactcttgtccctcaaacagaaccacgaacaagaggtgaatacgcttagatgtcagcttggggatcgattgaacgtcgaggtggacgctgctccagccgtcgatcttaaccaggtgcttaacgaaacaaggaaccaatacgaagccctggtcgagacaaacaggagagaggtggagcagtggtttgcaactcagactgaagagcttaacaaacaggtggtgtcgagttctgagcagcttcaatcttaccaggccgagataatcgagctcagacggacagtgaacgcactcgagatcgaattgcaggcgcagcacaatctgaggtactccttagaaaacaccctgacagaatccgaagctcgctactcatctcagctgagtcaggtgcagagtctcataaccaacgtggaatctcagcttgccgagattcggtcagatctggagcgacagaatcaggaatatcaggttctcctcgacgttcgggcccgcttggagtgtgagattaatacttaccggagtctgttggagtccgaggattgtaagcttccatctaatccctgcgcaacgactaatgcctgcgaaaagccaattggatcctgtgtgaccaatccctgcgggccccgctctcggtgcggcccctgcaacacatttggatactag

SEQ ID NO: 121468 - DNA, 1311 bp, Artificial Sequence
  Description of Artificial Sequence: Synthetic coding sequence
atgttgtatgccaagcctcccccaacaattaatggcattaaaggtctgcagcgaaaagagcgccttaaacctgcccatatccacctgcaacagctgacttgcttttctataacttgcagctctaccatgagctattcttgctgcctgccctctctggggtgcagaacaagttgcagtagtcgtccgtgcgtgccgccctcatgccacgggtacactcttccaggagcatgtaatatcccagcaaatgtcagtaactgcaactggttttgcgaagggtctttcaatggttcagaaaaggaaacaatgcagtttttgaacgatcgtctggcttcctacctggagaaggtgcgacagctggaaagagataatgcggagcttgaaaagctgatccaagagagatcccagcaacaggagccgctgctgtgtccctcttaccagtcctacttcaaaaccatcgaggagctgcaacagaaaattctctgtgctaaggccgagaatgcgcgactggtcgtcaatatcgacaacgctaagttagcctcagacgattttcgttccaaatatcagaccgagcagtcactcagactgctggtcgaatccgatatcaactctattcggcgaatactggatgagttgacactctgtaagtccgatctagagtcacaggtggaatcactccgggaggagctgatctgtctaaagaagaatcacgaagaggaagtcaataccctcaggtcgcagcttggagatagacttaatgtagaagtggacacagcgccaactgtggacctgaatcaagtgctcaacgagacacgcagtcaatacgaggcactggttgaaatcaaccgaagagaggtggaacaatggttcgccacacaaactgaggagctcaacaagcaagtggtttcaagctccgaacagcttcagtcctgtcaggccgagatcatcgagctgcgaaggacggtcaacgcacttgaaatcgagctacaagcccaacacaaccttagggacagtcttgagaataccctcactgagtccgaggcccactacagtagccagttgagtcaggtgcagagcctgattacgaatgtggagtcgcagttggctgagatccgctgcgatctagaacgccagaaccaggagtaccaggttttgcttgatgtacgcgcccgcctggagtgcgaaattaatacatacagatcactgttggaaagcgaagactgcaaattaccatgcaacccttgcgcgactactaatgccagcggaaactcgtgcggaccatgcgggacgagccaaaaggggtgctgcaactag

SEQ ID NO: 121469 - DNA, 1185 bp, Artificial Sequence
  Description of Artificial Sequence: Synthetic coding sequence
atgtcctattcttgttgcctgcccagccttggctgccgaaccagctgctcctcccggccttgcgtccctccgtcctgccacggatacactctgccaggcgcttgcaacatccccgctaacgttagcaactgtaattggttttgcgagggctcttttaacggcagcgaaaaagagacaatgcaattcctgaacgacaggttagctagctatctggaaaaagtcaggcagttagagagggacaacgccgagctggagaagctcattcaggaaagatcacaacagcaggaacctctgctgtgtccttcgtaccaatcttacttcaaaacaatcgaggaactgcagcagaagatactctgcgcaaaagcggagaacgcaaggctcgtggtgaacatcgacaatgctaagctagcatctgacgacttcaggtcgaaatatcagaccgagcaaagtctacggctgcttgtggaatccgacattaacagtattcggcgtatccttgacgagctgaccctgtgtaagagtgacttggaaagccaggttgagagtctgcgcgaagagctcatctgcctgaagaagaaccatgaggaagaggtaaatacactacggtcgcagctgggagaccggctcaatgtcgaagtggatactgcacctactgtggacctgaatcaggtacttaacgagacacgatctcaatacgaagcgttggtcgagattaaccgacgggaggtggagcaatggtttgctacccagaccgaagagcttaacaaacaggttgtttcttcaagtgaacagctgcagtcctgccaggccgagattattgagttgcggagaaccgtgaacgcactggagatcgagctgcaggcccagcataatctaagagattctctagagaatactctgactgagtcggaggcccattactctagtcagcttagccaggtgcagtcattgatcacaaatgtcgagagtcagctggctgagattcggtgcgacctcgaacgacagaaccaggaataccaggtgctacttgatgtgagggctagattagaatgcgagatcaatacgtaccgcagtttattagaaagtgaggattgcaaactgccctgcaatccttgcgcgacgacaaacgctagtggcaactcctgtgggccttgtgggacatctcagaaaggatgctgcaactag

SEQ ID NO: 121470 - DNA, 1278 bp, Artificial Sequence
  Description of Artificial Sequence: Synthetic coding sequence
atgtacagctcatctagttgtaaattaccatctctctctcctgtggcgagatctttcagcgcttgttcagtgggactggggaggtcatcttaccgagccacctcatgcctacccgcgctatgtctgcccgcgggcggttttgctacctcttatagcggggggggcggatggttcggcgagggcatcctaacaggaaacgagaaagagacaatgcaaagccttaatgaccggttagcagggtacctggaaaaagttcgacaactggagcaggagaacgcttcactcgaaagtaggataagagagtggtgcgaacaacaggtgccatatatgtgtcccgactatcagtcttacttcagaacaatagaggagctgcaaaagaagaccctgtgctccaaggcggaaaatgcgaggctcgtcgtggagatagacaatgcaaaactggccgctgatgattttagaacaaaatatgagacagaagtgtcacttagacagttagtggaaagcgacattaatggactgaggcggattttggatgatctgaccctatgtaaaagcgacttggaggcccaagtggagtcgctgaaggaggagctgctttgtttgaagaagaaccacgaagaggaggttaactctctacgctgccagctgggagaccgcctcaatgtggaggtggatgccgctccaccagtggatttgaatcgcgttttggaggaaatgagatgtcagtatgaaactctggtggagaacaaccgacgcgatgctgaggactggcttgacactcagagcgaggaactaaatcaacaggtggtgtctagctcagaacagttgcagagttgccaggccgagatcatcgagctgagacgaacagtgaacgcccttgagattgagctccaggctcaacactctatgcgggacgcccttgagtccactctagccgaaaccgaagccaggtattcaagccagctggcccagatgcaatgtatgatcaccaatgttgaggctcagctggccgaaatccgagctgatctcgagcgacagaaccaggagtatcaggtgctgctggatgtcagggcccgtctcgagtgcgaaatcaatacatatcgaggactactagaaagtgaggactcaaagttaccctgtaatccttgcgcccccgactattccccgtctaaatcatgtttgccttgcctaccagcggcgagttgcgggccgtccgcggccaggacaaactgttcgccccgacccatttgcgttccctgccccgggggccgcttttag

SEQ ID NO: 121471 - DNA, 1368 bp, Artificial Sequence
  Description of Artificial Sequence: Synthetic coding sequence
atggcttcaaagtgcttgaaagctggattctcaagcgggagcctgaaatctccaggtggcgccagcggcggctcaacccgcgtttctgcaatgtacagtagttctagctgtaagctaccaagcttgtccccagttgctagaagtttttctgcttgcagtgtaggtctgggacggtcttcatatagggcaacctcttgccttcccgctttgtgtctccccgcaggtggatttgctaccagctacagcgggggtggaggttggtttggtgagggcatcctgacgggaaacgaaaaggagacaatgcagagcttgaacgaccgactggctggatacctcgaaaaagtgcggcagctggagcaggagaacgcttctttagagtcaaggatacgtgagtggtgcgagcaacaagtcccgtatatgtgccccgactaccagagttacttccgtactattgaggaactgcagaaaaagacactctgctctaaagctgagaacgcacgcctggtcgtcgaaatcgacaacgctaaattggcagccgacgatttccgcaccaaatatgagactgaggtctctctaaggcagttagtcgagtctgacataaacggacttcgtcggatcctggatgacctgactctgtgcaaatccgatctcgaggcacaggtggagtcgctcaaagaggagctgttgtgtttgaagaagaatcacgaagaggaggtgaattcattgagatgccagttaggcgatcgcttgaacgtcgaagtggacgcggcgcctccagtagatttgaacagggtgttggaggagatgcggtgccagtatgaaaccctcgtggagaacaatcgaagggatgccgaagactggctcgatacccaaagcgaggaactgaaccaacaggttgtctcttcctcagagcagcttcagtcttgtcaggcggagattatcgaactgcgccggaccgtcaatgccttagagattgagctgcaggctcagcattcgatgagggacgcccttgagtctacactggccgaaacagaggcacgttattcctcacagctggcccagatgcagtgcatgattaccaacgttgaggcacagttagctgaaatcagagcagacctcgagcgacagaaccaggagtatcaggtgctgctggacgtccgtgctagattggagtgtgagataaatacatacagaggcctacttgaaagtgaggatagtaagctgccgtgcaatccgtgtgcacctgactacagtccaagtaaaagttgcctcccatgtctgccagccgccagctgtggcccgagtgcagctcgcaccaactgcagccctcgtcctatctgtgttccttgtccaggagggcgtttctag

SEQ ID NO: 121472 - DNA, 1404 bp, Artificial Sequence
  Description of Artificial Sequence: Synthetic coding sequence
atggccacacaaacctgtaccccgacattctcaacagggagcatcaagggcctctgtggcacggccggagggattagtcgcgttagctctataagaagcgtgggaagttgtagagtgccctccctggccggcgccgccgggtatattagctcagcccgcagtggcctgagcggactgggcagctgtctacccggaagttacctctcaagtgagtgccatactagtggttttgtcggatccggaggttggttctgtgaaggttcattcaatggatctgaaaaagaaaccatgcagttcttgaacgacagactggccaactacttggaaaaggtccgacagttggaaagagaaaatgccgagcttgagagcaggatccaggagtggtatgagttccaaatcccctatatatgtccggactatcagtcttacttcaagaccatcgaggattttcagcagaaaatcctgttgaccaagagcgaaaatgcacgcctcgtgctgcagatagacaatgcaaagctggccgcggacgatttccgaaccaaatatgagactgagctttctttgcggcaactggtggaggcagacatcaatggactgagaagaattctggacgaactcacactgtgcaaggcggatctggaagcccaagtagaatccctgaaagaggagttgatgtgtttgaagaaaaaccatgaggaggaggtgtccgtgctccgatgccagctgggtgaccggctgaatgtggaagtggacgctgctcctccagtcgatctcaataagatcctcgaggacatgcggtgccagtatgaagcattggtggaaaacaacaggcgcgatgtagaagcatggttcaatactcaaaccgaggaactgaatcaacaggtggtttcctcaagtgaacagctgcagtgttgccagaccgagattattgaactgaggagaacagttaatgctcttgaaattgaactacaggcgcagcatagtatgcggaacagtctcgaaagtacactggccgaaaccgaagcacgctatagctctcagcttgcacagatgcagtgtctcattagtaacgtggaggcacagttatcagaaattaggtgtgacttggaacgtcaaaaccaggaataccaggttctgcttgacgtgaaggccaggctcgagggcgagatcgccacttaccgacatctcctggagggcgaggactgcaaactgccccctcagccgtgtgccaccgcttgtaaacccgttatcagagtgcccagcgtacctcctgtcccctgtgtccctagcgtgccctgcacaccagcccctcaagtgggtacacagatcagaaccataactgaagaaattagggacgggaaagtcattagctccagggagcatgttcaatctcgccctctgtag

SEQ ID NO: 121473 - DNA, 1254 bp, Artificial Sequence
  Description of Artificial Sequence: Synthetic coding sequence
atgttgagatcaggtctgtccggccttggatcttgtctgcctggctcctacttgagcagcgagtgccatacgtccggctttgtcgggagtgggggttggttttgcgaaggcagctttaacgggtctgaaaaggaaactatgcagtttctgaacgatcgcttggctaactatttagagaaggtgaggcagttagagcgcgaaaacgccgagttagaaagcaggatccaagagtggtacgagtttcagataccgtatatttgtcctgattaccagtcctacttcaaaactatagaggactttcagcaaaaaattctcctcaccaagtcggagaatgcacgtctggttctccagattgataatgctaagctggccgctgacgacttcagaaccaagtacgagaccgagctgagtctccggcagttagtcgaagccgatattaacgggctgcgaagaattcttgacgaactcactctctgtaaggccgacctggaagcacaggtggagtccctcaaagaggagctgatgtgcctgaagaagaatcacgaggaggaggtgagcgtgctgaggtgtcagttgggcgacagactcaacgttgaggtcgacgccgcacctcccgttgacctgaataagatactggaggacatgcggtgccaatacgaggctcttgtggaaaataaccgacgcgatgtcgaagcgtggttcaacacgcagactgaagagctaaaccagcaggtagtttcttcatccgaacagttacagtgttgtcagaccgagattatcgaactacgtaggaccgttaatgcccttgaaattgaacttcaggcgcaacattccatgcggaactcactggagagcaccctggcggagaccgaagctagatatagctctcagctggcacaaatgcagtgtcttatttcaaatgtggaggctcagctttcagagatacgatgtgacctggaacggcagaaccaggagtatcaggtgctgcttgacgtgaaagcccggctcgaaggagaaatagccacgtatcgacaccttcttgagggcgaggattgtaaactcccgcctcagccctgtgcaacggcttgtaagcctgtaattagagttccatcagttcctccagtgccgtgtgttccgtctgtgccatgtaccccagccccccaggtgggtactcagattagaacaatcaccgaagagatccgagatgggaaggtgatttccagccgcgagcatgtacagtcgaggcctctgtag

SEQ ID NO: 121474 - DNA, 1200 bp, Artificial Sequence
  Description of Artificial Sequence: Synthetic coding sequence
atggctaggcggtttcaggaggaactggcggcctttctttttgagtatgacacgccacgaatggtcctggtccggaacaaaaaggtcggggtgatattcaggctgatccaactggtggtgctggtctatgtgattgggtgggttttcctctatgagaaagggtatcagacttctagtggacttatctcttctgttagtgttaaacttaaaggcctggccgtgacccagttgccagggcttggacctcaggtgtgggatgtagctgattacgtttttcctgcgcagggcgataactcttttgtggtgatgactaacttcatcgtcaccccaaagcagacacagggctactgcgccgaacacccagaagggggcatttgcaaagaggactccggctgcactcccgggaaggctaagaggaaggcccagggtataaggacaggaaagtgtgtggcctttaacgataccgtcaagacgtgcgaaattttcgggtggtgtccagtagaagtggacgacgatattccccgccccgctctcctgcgggaggccgaaaactttactctttttattaaaaactcaatcagttttcctaggtttaaagtgaatagacgcaacctggtggaagaggtcaacgctgctcacatgaagacctgtctgtttcacaaaaccttgcaccccttgtgcccggtgtttcagcttggttacgtcgtgcaggagtccggtcagaatttcagtacactagcggagaagggcggcgtggtcggtatcactatcgattggcactgcgatttggattggcacgtaagacattgccgtccaatctatgaatttcacggcctgtacgaggagaagaacctgtccccgggcttcaatttcaggttcgcccggcacttcgtagagaacggaaccaactaccgccacctcttcaaggtcttcgggatccgattcgacatcttggtggacggcaaggctggcaaatttgacattattccgaccatgactaccattggatccggaatcggtatatttggggtcgcaacagtgctctgtgacctcctgcttctgcatatactgcctaaaaggcactattacaagcaaaaaaaattcaagtatgccgaggacatgggacctggcgctgcagagagagatctggcagccacctcttctacactgggcttacaggagaacatgcgcacatcctag

SEQ ID NO: 121475 - DNA, 1371 bp, Artificial Sequence
  Description of Artificial Sequence: Synthetic coding sequence
atgacaagtagttactctagctccagctgtcccttgggctgtaccatggcccctggggcacgaaacgtgagtgtctctccaatcgatattgggtgtcagcccggcgccgaagcaaatatcgctccaatgtgcctgctggccaacgtcgctcatgcaaatagagtgagagtggggtcaacgccacttggacgacccagtctgtgcttacctcccacttgccacaccgcctgtcctctccccggcacatgtcatatccctggaaacatcggcatctgcggagcatatggggagaacactctgaacgggcatgagaaagaaaccatgcagtttctgaatgatcgccttgctaactatctcgagaaagtcagacaactcgagcaggagaatgcagagcttgaggcaaccctgcttgagagatctaagtgtcacgaatcaactgtctgtcctgactatcagtcttactttcatacaatcgaagagcttcagcagaaaatactttgctccaaagccgaaaatgcccgactgatcgtgcagatcgataatgccaaacttgccgccgacgacttccggatcaaattagaatctgaaaggagcctgcgccagctggtcgaggctgacaaatgtggaactcagaaactcctcgatgacgcaaccctagccaaggcagaccttgaagcacagcaggagtcactcaaagaggagcagcttagtttaaaatcgaaccacgaacaggaagttaaaattcttaggagccagctgggcgaaaagctgcgcatagagttagatattgagcccaccatcgatcttaatcgcgtcttgggagaaatgcgagcccagtacgaagctatgttagaaacaaaccgccaggacgttgagcagtggttccaggcacagagcgagggcatctctctccaggatatgagctgtagcgaggagctccaatgctgccagtcggagatcttggagttgcgatgcacggtcaatgcgctcgaggttgaacgccaggcccaacacaccttgaaggattgtttgcaaaatagtttgtgcgaggcagaggatcgctttggaacagaactggcccagatgcagtctctgatctcaaacgtggaagaacaactgtcagagattcgggcggacttggagcgacagaatcaggagtatcaggtgctccttgatgttaaaactcgcctcgaaaatgagattgccacttaccgcaacttgctggagtcagaggattgcaaactgccatgtaacccttgctctacaagtccttcttgtgtgaccgcaccctgcgccccaagaccaagttgtggcccttgcactacatgtggccctacctgtggcgcaagtaccacaggctcccgcttttag

SEQ ID NO: 121476 - DNA, 1785 bp, Artificial Sequence
  Description of Artificial Sequence: Synthetic coding sequence
atgacgtcagtgggagtgttttccgatatgcttaacggttgtggaaaagatgggctcgtgccacgggctaagcctcgagatgtaagcgatttcagtttgtacgcacctgccactaaaccatgctgtagcagaacctacaagcggcggcgactgcgggccccggcactgacaggactcggtcccgttacatctctgattgcaccctcgagtctgtctgccgccatgattgcccggcaacagtgtgtacgcggaggaccacgaggattcagttgcggctctgccatcgttggaggaggtaaaagaggcgcctttagctccgtctcgatgtcgggcggcgccggccgttgttccagcggcgggttcggctctcgctctctgtacaaccttcgggggaataaatccatatctatgtccgttgctgggagccgacagggcgcgtgctttgggggggctggcggcttcgggaccggcggattcggaggcggattcgggggcagttttagcggaaaaggtggccctggcttccccgtctgtccagccggcggaattcaggaggtgaccattaaccagtctttactgacgccacttcacgtggaaattgaccctgaaatccagaaggttcgcactgaagagagagagcagattaagctgcttaataataagttcgcgagctttatcgacaaagttcagtttcttgaacaacagaataaagttctggagactaagtggaatttgctccagcaacagaccactacaaccagttccaaaaacctcgagccactgttcgagacgtatctgtcggtactgagaaagcagctggatactctggggaatgacaagggtcggttgcagtcagaattgaaaacaatgcaagacagcgtggaagactttaaaactaaatatgaagaagaaattaacaaaaggaccgctgccgagaacgacttcgtggtgctgaagaaggatgtggatgctgcctacctgaacaaagttgaactggaagccaaagtggattctctaaacgatgagataaatttcctgaaggttttgtacgacgctgagctgtcacagatgcagacacacgtgagtgacacaagtgtcgttttatccatggataataaccgcaatcttgatcttgacagtatcattgcggaagtgcgcgcccaatatgaggaaatagcccagcggagtaaggctgaggccgaagcactctaccaaacaaaggtgcagcagctgcagatcagtgtggatcagcatggagacaacctcaagaatactaagtctgagattgcagagctaaacaggatgatacaaaggcttcgggccgagatagagaatatcaaaaagcaatgtcagaccctgcaggtgtctgtcgctgacgctgagcaaagaggagagaacgcgctgaaggatgcccatagcaaaagggtggagctcgaagccgcccttcagcaagcaaaagaggagttggctcgcatgttacgtgaataccaggaactgatgagtgttaagctcgctctcgacatcgaaatcgccacctaccggaagctgcttgagggagaagagtatcgaatgtccggcgagtgccagagtgctgtgtctatcagcgtggtctccggctcaaccagtacaggggggatctcaggcggacttggctccggctccggatttggcctcagctctgggttcgggtcgggctcgggctctggcttcggtttcggcggctctgtgtcggggagcagttccagcaagatcatttccacaacaacactaaacaaacgtcgttag

SEQ ID NO: 121477 - DNA, 1503 bp, Artificial Sequence
  Description of Artificial Sequence: Synthetic coding sequence
atgatagcccggcagcaatgtgttcggggcggcccgaggggcttctcgtgtggcagcgcaatagtcggaggtggtaaacgcggtgccttcagcagtgtgtctatgagtgggggcgccgggcgctgttcctccggcggtttcggttcaaaaggagcctgctttggaggagccggagggttcggcactggcgggttcggcggaggctttggggggagcttttcaggtaaaggggggcccggattccctgtatgccccgctggcggtatacaggaagtcaccatcaaccagtcacttttgacccccttacacgtggagattgatcccgagatccagaaagtccggacagaggagcgcgagcagatcaaactgctgaacaacaaattcgcctcatttattgacaaggtacagttccttgagcagcaaaataaagtcctggagactaaatggaatctcctgcaacagcaaacaaccaccactagttctaagaatttagagcctctgttcgagacctatttgagtgttctaaggaaacagttggacactctgggtaacgataagggcagactgcagtctgagctgaagaccatgcaggacagcgtggaggatttcaagaccaaatacgaggaggagatcaacaagcggaccgccgccgagaatgactttgtcgtgcttaagaaggacgtcgacgccgcttatctgaacaaggttgagctggaggcgaaggtcgactcactcaatgatgagattaattttcttaaggtactttacgatgccgaactgagtcagatgcaaacccacgtgtctgacaccagtgtggtactttctatggacaacaatcgcaacctggacctggattcaatcattgctgaggtaagggctcagtatgaggaaattgcgcagcgatctaaggctgaggccgaggccctgtaccaaacgaaggtccaacaactgcagatctccgttgatcagcacggcgacaacctcaagaatacaaaaagcgagatcgccgaactgaaccgcatgatacagcggctacgggcggaaatagaaaacataaagaagcagtgtcagacccttcaggtgagcgtggccgacgcggagcagcgtggagagaatgcacttaaagacgcccattccaagagggtcgaactggaggccgcacttcagcaggccaaggaggaacttgcccgcatgctacgtgagtaccaggagcttatgtctgtaaaattagccttggatatcgaaatcgctacctacagaaaactcctggagggagaagagtacagaatgagcggagagtgccagtccgccgtaagcatctctgtcgtcagtgggagtacctctactggtggcatcagcggaggactgggctcaggtagtggctttggcctgtctagtggcttcggctcaggatccgggtcaggcttcgggttcggaggctcagtgtccggcagctccagttcgaaaatcataagcacaactacactaaacaagcgacgctag

SEQ ID NO: 121478 - DNA, 1563 bp, Artificial Sequence
  Description of Artificial Sequence: Synthetic coding sequence
atgatcgcccgccagcagtgcgtacgcggtggcccccgaggcttttcttgtggatctgccatcgttggcggcggcaaaaggggcgcttttagttccgtcagtatgtccggaggcgccgggaggtgctccagcggaggattcggctcacgctccttatacaatctcagaggcaacaagtctatatccatgtccgtggctggttctcgccaaggagcgtgctttggcggagctggtggattcggcaccggaggttttgggggtggcttcgggggttcattttcaggcaaggggggtccaggttttcccgtttgtcctgccggcggcatccaggaagtgactattaatcagagcctgctgaccccactccacgtggaaattgatcccgagattcaaaaagtgcgcacggaagagcgagaacagattaaattactgaataacaagttcgccagttttatcgacaaagtccagtttctagagcagcagaataaggtgctcgagactaaatggaatctactccagcagcagacaacaaccacctcctctaaaaacctggagccactatttgaaacctacctgagtgtgctcagaaagcagctggacacactggggaatgacaaagggagactacagtccgagctgaagactatgcaggacagtgtggaagattttaaaacaaaatatgaagaggaaattaacaaaagaactgccgccgagaatgacttcgtcgttttgaaaaaggacgttgatgctgcatatctaaacaaagtggagctggaggccaaggtggattccctgaatgatgagatcaacttcctgaaggtgctgtatgatgctgaactttctcagatgcagacccatgtgagcgacacaagcgtggtcctttctatggataacaaccggaatttggatctggacagtattattgccgaggtgagggcacagtacgaagaaattgcccagcgctccaaggcagaagctgaggctctgtaccaaaccaaggtacagcagttgcagattagcgtggaccagcacggggataacttgaaaaacacaaaaagtgagatcgcagagctgaacaggatgatacaacgcttgcgcgccgagattgagaacattaagaagcagtgtcagacactgcaggtctccgtggcagatgccgagcagcgcggtgaaaatgccctgaaggatgctcattccaagcgtgtcgaacttgaagccgccctgcaacaggctaaggaggagttggccaggatgctgagggagtatcaagaactgatgtcagtcaaactggctctagatattgaaatagctacctatagaaaactcctggagggagaggagtaccggatgtctggcgagtgtcagagcgccgtgagtattagcgtcgtcagcgggtccacctctacaggcggcatttccggaggcctggggagcggatctggcttcggactgagtagcgggttcgggagtggaagcggatccggcttcggctttggagggtctgtttcagggtcttctagttcaaagatcattagcactacaacccttaataagaggagatag

SEQ ID NO: 121479 - DNA, 1695 bp, Artificial Sequence
  Description of Artificial Sequence: Synthetic coding sequence
atggcaagcacgagcacaactatacggtctcattcctcatcccgaaggggcttttcagcaaactccgctcggttacccggggtcagtaggtctggctttagttcagtgtccgttagtcgctcacgcggctccggtggcctcgggggggcttgcggtggcgcaggattcggctcccggagcctctatgggctgggcgggtctaaacgaatctctatcggaggagggtcttgcgctatttccggaggctacggctctcgcgccggcggaagctacggttttgggggggcaggttctggatttggattcggaggcggtgccggaattggcttcggcctggggggaggggcaggacttgccggggggtttggcggcccaggctttcctgtgtgccctcctgggggtatccaagaagtgacagttaaccagtccctgctgaccccgctcaatctgcagattgacccaacgatacaacgtgtacgggcagaagagagagagcaaatcaagactctcaataacaaatttgctagcttcattgacaaggtgcggtttctcgagcaacaaaacaaggtcctggaaacaaaatggaccctgctccaggagcagggcaccaagacagtgcgacagaacttggaaccactgtttgaacagtatataaacaatttaaggcgccagctggattcaatcgtcggggaaagaggaagactggacagcgaacttagagggatgcaggatctcgtcgaggacttcaaaaacaaatacgaggacgaaatcaacaaacgaaccgccgctgagaacgaattcgtgacactcaaaaaagacgtcgacgcggcttacatgaataaagtggagctgcaggctaaggccgatactctgacagacgagattaatttcctccgggcactatacgatgcagaattgagccaaatgcagacacatatctccgacaccagcgtagtcctgtctatggataacaacagaaatctggacctcgatagcatcatcgccgaggtgaaagcccaatacgaggaaatcgcacaacgcagccgggctgaggccgaaagttggtaccaaacaaaatatgaggagctgcaggtgacggctggaagacacggagacgaccttaggaacacaaagcaggagatagcagaaatcaacagaatgatccagcggttacggagcgagattgatcacgtgaagaagcagtgcgctaatctgcaggctgcaattgctgatgcagaacagcgaggcgagatggctttgaaagacgcgaagaacaagcttgagggcctggaagatgcactccagaaagccaaacaagacctggcccggcttctgaaggagtaccaggagctgatgaacgtgaagttagctctcgatgtagaaatcgctacctatagaaaacttctggagggcgaggaatgcagactgaacggggaaggagtgggtcaagtaaacatttccgtcgtccagtctaccgtgagcagtggctacggcggagccagcggcgtgggaagcggtctcggactaggcggtgggtcaagctattcctatggatccgggctcggcgtcggtggtggattctccagctctagcgggagagctatcggcggaggcttatcgagtgttggtggtgggagtagcaccataaaatatactacaactagctcttcctcaagaaagagctacaagcactag

SEQ ID NO: 121480 - DNA, 1563 bp, Artificial Sequence
  Description of Artificial Sequence: Synthetic coding sequence
atggcctctacatccaccaccattaggagccacagtggcagtcgttccctgtacgggttagggggaagcaagaggatatccatcggagggggcagttgcgccatatctggcggctatggcagcagagcagggggtagctatggattcgggggagccggctccgggttcgggttcgggggtggcgctggcatcggcttcggactgggcggaggtgcagggctggctggcggatttggagggcctggatttcctgtgtgtccccctggcggaattcaagaagttacagtgaatcagtccctcttaacacctctcaatctccagatcgaccctaccatccagagggttagagccgaggagagagagcagatcaaaacgctgaacaacaaattcgcatccttcatagataaagtcagatttcttgaacagcagaacaaggtgctggagacaaagtggacgctgttgcaggaacaagggacgaaaaccgtgcgacagaacctcgagccgcttttcgagcagtacattaataacctgaggagacaactcgattctattgtgggcgagagaggaaggctggacagtgagctgagaggtatgcaagatctggttgaggacttcaagaacaaatacgaggacgaaataaataagaggacagcagctgagaatgagtttgtcactttaaaaaaggacgttgacgcagcctatatgaataaagtggagctgcaggcaaaggccgacaccctaactgacgaaattaactttcttagggcgctgtatgacgcagaactgtcccaaatgcagacacacattagcgacactagcgtcgtgctctccatggataataatcggaacctcgacctcgactctatcatcgcagaggtgaaagcacagtatgaggagattgcccagcgttcccgcgcagaagccgaaagctggtatcaaaccaaatacgaggagctgcaggttacagcaggtaggcacggcgatgatctgcgcaatactaagcaggaaatcgctgaaatcaataggatgattcagagattgagaagcgaaattgaccacgtcaaaaagcagtgcgcaaacctgcaggctgcaatcgcagatgccgaacaaagaggagagatggccttgaaagacgctaaaaacaagttagagggtctcgaggacgcccttcaaaaagccaaacaggatctcgcaagactgttaaaagagtatcaggaattaatgaacgtgaagcttgctttagacgttgagatcgctacttatagaaaactattagagggcgaagaatgtcggctcaacggggagggggtgggtcaggttaatatcagcgtcgtgcagtcgactgtgtctagtggctacgggggggccagtggtgtaggctctggactggggctgggcggaggatccagttattcctacggctccggacttggcgtcggcggaggcttctccagtagcagtggtcgagctattggaggcggcctctccagcgtgggaggcggaagcagcacgattaaatataccacgacatcatccagtagccgcaagagttacaagcattag

SEQ ID NO: 121481 - DNA, 1695 bp, Artificial Sequence
  Description of Artificial Sequence: Synthetic coding sequence
atggcatcaacttccaccaccattagaagtcactcctcctctcgccgcgggttctccgcaaatagtgcccgactgcccggagtgagcaggtctgggttcagcagtatcagcgtctctaggagccgcggctcaggcggactaggcggtgcctgcggcggagctgggtttgggagccgatccctttatgggctcgggggaagcaaaagaatttcaatcggaggaggaagttgtgccatctccgggggatacggatctcgcgccggcggaagttacggcttcggcggagcaggatctggctttggatttggaggaggagctgggattggttttggactgggaggcggcgctggccttgcaggcggttttgggggacctggatttcccgtgtgccctccaggcggaattcaggaagtgacagtaaatcaatctctccttacccctctcaacctccagatagaccccgccatacagcgggtccgcgcagaggagcgtgagcagattaagaccttgaataacaagtttgcttcctttattgacaaggttcgattcctggagcagcagaataaggtgttagacactaaatggacacttcttcaagaacaaggaaccaagactgttcggcagaatcttgaacctttatttgaacagtacattaacaacctgcgacgtcagctggacaacattgtgggtgagcggggccgtttggactctgagctgaggaatatgcaagatttggtagaggaccttaagaacaaatacgaggatgaaattaacaagagaacagctgccgaaaatgaattcgtgaccctcaagaaggatgtcgatgcagcctacatgaataaggtggagctgcaggccaaggctgacaccctgacagacgagatcaacttccttcgcgccttgtatgacgcggagctctcccagatgcagacacatataagcgacacctccgtggtgctgagtatggataataatagaaacttggacctggatagcatcatcgcggaagtgaaggctcagtatgaggaaatcgcccagaggtcccgagctgaggccgagagttggtatcaaacaaagtatgaagaactccagattaccgcggggaggcatggggacgacctccggaacacaaaacaagagatcgcagaaattaatagaatgattcagaggctccggagcgagattgatcacgttaagaaacagtgtgccaatttacaggctgcaattgcagacgccgaacagcgtggggaaatggctctcaaggacgctaaaaataaattggagggcctggaggatgcactgcagaaagctaagcaggatctggctcgtcttctaaaggaatatcaggaactcatgaatgtgaagctggcccttgacgttgaaattgccacatatcgcaagctgcttgaaggcgaagagtgcaggctgaacggggaaggtgtcggtcaggtcaatatctccgtggtacagtcgacagtttcctcagggtatggcggcgctagtggtgtgggttctggcttaggactcggcggcggaagtagttactcctacggtagcggactgggcgtgggaggaggcttctctagttcctcaggcagggcgaccggtggtgggctcagttctgtgggggggggttcctccactatcaaatatacaacgacatcctcatctagccgtaaatcttataagcattag

SEQ ID NO: 121482 - DNA, 1575 bp, Artificial Sequence
  Description of Artificial Sequence: Synthetic coding sequence
atggccagtacctcaacaaccatccgaagtcattcatcctctcggcgcggattttcagcaaattccgcccgtttacctggggtcagcagatcaggattctcttcaatctccgtgtcgcgtagtcgggggagcggaggcctcggtggagcctgtggcggagccggcttcgggtctcggtctctgtatgggcttggcgggtccaagaggattagtatcggcggggggtcctgtgccattagcggggggtacggaagcagggcaggcggaagttatggattcgggggggcaggctccgggtttggcttcggaggtggcgccggaatcggattcggactggggggcggagcaggcctggctggcggattcgggggccctggatttccagtctgcccacctggagggattcaggaggtaacggtgaaccagtctctgttgacccccctgaacctgcaaatcgaccctgcaatccagagagtgcgggcagaggagcgggagcaaatcaaaacactgaataacaaatttgcttccttcatcgacaaggtgcgcttcctggaacaacagaacaaagtgctggacactaaatggacccttttacaagaacagggcacgaagaccgtgagacagaacctcgaacctctgtttgagcagtacatcaataacttgcgaagacagctggataacatagtgggcgaaagagggaggctggactctgagcttagaaatatgcaagatctggtcgaggatctcaagaataaagatgaaatcaactttctgcgggctctctatgatgcggaactatcccaaatgcagacgcacattagtgataccagtgtggtccttagtatggacaacaaccggaaccttgaccttgactccatcattgcggaggtgaaagctcagtacgaagagatcgcccaaagaagccgtgccgaagcagaaagttggtatcaaactaagtacgaggagctgcagattactgccgggcgtcatggggatgacctgcgcaataccaagcaggagatcgcagagatcaacagaatgattcaaagactccgaagcgagatcgatcacgttaaaaaacagtgcgctaatctgcaagccgccatagccgacgccgaacagagaggcgagatggccctgaaggatgccaagaacaaactagaagggctggaggacgccttgcagaaagccaaacaagacctggcacggcttctaaaggagtaccaagagctcatgaacgttaagctcgctcttgatgttgaaattgcaacgtatcgcaagctgttggagggtgaggaatgcagactgaatggggagggcgtaggccaggtgaacatctctgtcgtacagtctacagttagctccggttatggaggcgcctccggtgtaggaagcggccttgggctgggaggggggagcagttatagctatggctcaggactgggggttggcggtgggttctcgagtagcagcggcagagcaaccggcggcggcctatccagcgtgggcggcggctcatcaactatcaaatacaccacaacgtccagctccagtagaaagtcttataagcattag

SEQ ID NO: 121483 - DNA, 1695 bp, Artificial Sequence
  Description of Artificial Sequence: Synthetic coding sequence
atggccagcacctctacgaccataagatcacacagctcatctaggaggggatttagtgccaattcagcccgcctccctggagtatcccgtagtgggttttcctctatttctgtgtctaggtcaaggggctctggcggtcttggtggcgcgtgcggaggtgccggcttcggctctcgcagcctgtatgggcttggcgggtcaaaacgaatatccatcggaggcggatcatgtgccattagtggtgggtacggctctagggcgggaggctcctacggcttcggcggcgccgggagcgggttcggcttcgggggcggagctggaattggattcggcctgggaggcggggctggtctggctggtggctttggcggaccaggattcccggtgtgccctccaggaggtatccaggaggtaaccgtaaaccagagtctgctcactcccctcaatctgcagatcgatcccgcaattcagagggtccgtgcagaagaaagagaacagattaagacactgaacaataagttcgcaagctttattgacaaggtcagattccttgaacaacaaaacaaggtcctcgacacgaagtggaccctcctccaggaacaaggaaccaaaactgtgcgacagaacttagagccactgtttgagcagtatatcaacaaccttagaagacagttggatagcattgtgggtgagcgaggaagactcgactccgagctccggaatatgcaggatctggtcgaggatctgaaaaacaagtacgaggatgaaatcaacaaacgaacagccgccgaaaatgaatttgtcacgcttaagaaggatgtggatgcagcatatatgaataaagtggagctacaggccaaagctgacaccctgactgacgagataaacttcctcagggctctgtacgatgctgaattgtcccaaatgcagactcacatctcagatacaagtgtggtcctctctatggataacaatcgtaacttagatctcgattcaatcattgccgaggttaaagctcagtatgaagaaattgcacaaagaagtcgagccgaagcagagagctggtatcagacaaagtacgaagagcttcaggtcacagccgggcggcatggtgacgacctgcgaaatacaaaacaggagattgccgagattaatagaatgatacaaaggttgcgatcagaaattgatcacgtgaagaagcagtgcgcatccttacaggcggcgatcgccgacgctgagcagcggggagaaatggccctgaaagacgctaaaaataagctggaggggctggaggatgctctgcagaaggccaaacaagacctcgcaagactgttaaaggagtatcaggagttgatgaatgtcaaactggccttggacgtcgagatagctacttaccgaaagcttttagaaggggaagagtgtcgactgaacggagaaggtgtgggacaggtgaatgtctctgtcgtccagtcgaccatcagttcaggatacgggggcgcatctggagtggggagcgggcttggtctgggtgggggaagtagctactcttacggctcaggtctgggtatcggtggtggtttttcgagctccagcggcagagcaatcggcggcgggctctcctcagttggcggcgggtcctccacgatcaagtatactactacttccagctcctctcgaaaatcttacaagcattag

SEQ ID NO: 121484 - DNA, 1650 bp, Artificial Sequence
  Description of Artificial Sequence: Synthetic coding sequence
atggccagcaccagcacaaccattcgctctcacagttcgtctaggagcgggttcagtagcatctctgtgtccagatcccgcggcagcggcgggctgggcggggcatgtggcggggccggttttggctctcgcagcctctacgggctgggcggctccaagaggatctcaatcggcggcggaagctgtgccattagtgggggttatggcagccgagccggcggtagctatggtttcggaggggccgggagtggatttgggtttggagggggtgcgggaatcggatttggcctcggcggtggagccggtttagcgggtggcttcggagggcctggattcccagtgtgtccgcctgggggaatacaggaagtgactgtgaatcaaagtctcttaacgcccttgaacctgcaaatcgatcctgccattcagagagtgagagccgaagaacgcgaacagattaagacattaaataataagtttgccagcttcatcgataaagtgcgcttccttgaacagcaaaataaagtgctggatacaaagtggaccttattgcaggagcaaggaactaaaaccgtccgccagaatttagagcccctgttcgagcaatatataaataacctgaggcgccagctggatagtatcgtcggtgagcggggccgtctcgactctgagctgcgcaacatgcaagacctggtggaggacttaaaaaacaagtacgaggatgagattaataaacgaaccgccgctgagaacgaatttgtcacgctgaagaaggacgtggacgctgcttacatgaacaaggtggagctgcaagctaaggctgacacactcactgacgaaattaattttttgcgggccctctacgacgcagagcttagtcagatgcagacacatattagtgatacatctgtggtcctgagcatggataacaaccgcaaccttgatcttgactcgatcatagccgaagtcaaagcacagtacgaggaaattgctcagaggtcaagagcagaagccgaatcctggtaccagacaaagtacgaggagctccaggtgactgccggccgccatggcgacgacctcaggaatacgaaacaagaaatcgccgagattaaccgtatgatacaaagactaaggtccgagatcgaccacgtaaagaagcaatgcgcttcacttcaggccgccatcgccgatgcagagcaaaggggcgagatggcactgaaagatgccaaaaacaaattggagggcctcgaggacgcgttgcaaaaagccaagcaggacttagcaagactgctaaaagaatatcaggagctgatgaacgttaagctggccttggacgtggaaattgctacataccgaaagctattggaaggggaggagtgccgacttaacggcgaaggcgttgggcaggtgaacgtttcggttgtgcaaagtaccatctcctccggttacggcggcgcatcaggagtcggttccggactgggcttgggaggaggctccagctatagttacggctctggcctggggattggcggcggcttttccagtagctcaggaagggctattggagggggacttagctccgtcggcggaggttccagcacgattaaatataccactactagttcaagcagtcggaaatcctataaacattag

SEQ ID NO: 121485 - DNA, 1572 bp, Artificial Sequence
  Description of Artificial Sequence: Synthetic coding sequence
atgtctcggcagttcacatgcaagagcggagccgctgcaaaaggaggattcagcgggtgctcagccgtactgtcgggcgggtcatcatcctccttcagggctggatcaaaggggcttagtgggggctttggctcaaggtcactttattcactcgggggggtccgatccctgaatgttgcgtccggcagcggtaaaagcggagggtacgggttcggcagaggcagagcctctggttttgccgggagcatgttcggtagcgtggcactaggtcccgtgtgtccaacagtttgtccacctggcgggattcaccaggtgactgtgaacgagtccctactggccccccttaatgtcgaactcgaccctgagatccaaaaggtgagagcccaggaacgagagcagataaaggctctgaataacaagttcgctagtttcatcgataaagtacgatttctagaacagcagaaccaagtgctcgagactaagtgggaactgttacagcagcttgacctgaacaattgcaagaataatcttgaacctatactggaaggatatatctcaaacctccggaagcaactggagacgctttcaggggatcgggtaaggctcgactccgaactgcggaacgtgagggatgtggttgaggactataagaaacgctacgaggaagagatcaacaagaggacggctgccgaaaatgaattcgtgctgcttaagaaagatgtcgatgcggcttacgccaataaagttgaactgcaggccaaggtggaatcaatggatcaagagatcaagttcttcaggtgtctgttcgaggctgagatcacacagatccagagccatattagcgacatgtctgtcattctgtctatggacaataaccgcaacctagatcttgattccattatagatgaagtgcgcacgcagtatgaggaaatcgcgctgaagtcaaaagccgaggctgaggcgctgtaccagactaagttccaggaactccagttggccgccgggcgtcacggcgatgacctcaagaataccaaaaatgagatatcagagctgactcggctgattcagcggatccggtctgaaattgaaaatgtaaagaagcaggcatccaacctggagacagccattgctgacgcggaacagcggggcgataacgcgctcaaggatgctagggcaaagctggacgaactggaaggcgctctgcaccaggcgaaagaagagctcgctaggatgttgagagaataccaagaacttatgtctctgaagctcgcccttgatatggagatagccacataccggaagttactcgaatcagaagaatgcagaatgagtggcgaatttcccagtcctgttagcataagcatcatctcctccacaagtggcggaagtgtctatggtttccggccttccatggtatccggcggctatgttgctaacagttccaattgtatttcaggagtgtgttcagtgcgaggcggcgagggccggtcccgcgggtcagcaaatgactacaaggatacgctcggaaagggtagctctctcagcgccccctctaaaaaaacatcgcggtag

SEQ ID NO: 121486 - DNA, 1536 bp, Artificial Sequence
  Description of Artificial Sequence: Synthetic coding sequence
atgagtcggcagttgacccactttcctcgaggagagcgcctgggattcagcggatgtagcgctgtgctttcgggcgggattggctctagctccgccagcttccgagccagggtgaaaggttctgctagctttggttcaaagagtttgtcctgccttggggggtctagatcacttgccctgagcgctgcggccaggaggggggggggcaggcttggcggattcgttggaaccgctttcggatctgcaggcctgggacctaagtgccccagcgtgtgtccacctggtggcattccacaagttacggtgaacaagtctctgcttgcaccccttaacgtggagatggatcctgagatccagcgggtgcgggcacaggagagggaacagatcaaagctctgaacaacaagttcgcatcctttatagataaagtcaggttccttgaacaacagaatcaggtactggaaactaagtggaacctgcttcagcaactggacctcaataactgccggaagaacctggagcctatttacgagggatatatcagtaatctgcagaaacagttagagatgctgagtggagatggcgtgaggctggactctgagcttcggaatatgcaggacctggtcgaggattacaaaaaacggtatgaggtggaaataaacaggaggactgctgctgagaatgaatttgttgttcttaaaaaggacgtcgacgccgcctatatgaacaaggtggagctgcaggcaaaagtggactcactaaccgatgagatcaagttcttcaaatgcctgtatgagggtgaaattacgcaaattcagagccacatctccgatacctcaatagtgctcagtatggataacaatcgggacctggatttagacagcatcatcgcagaagtccgggcccagtatgaggaaattgctcttaaaagtaaggccgaggctgaaacactgtaccagaccaaaatacaggagctgcaggtcacggctgggcaacacggggacgacttgaagttaaccaaggccgagatctctgaactaaataggctcatacagagaatcagatcggaaatcggaaacgtgaagaaacagtgcgcggatctggaaacagcgatcgcagatgccgaacagcgaggtgactgcgcactgaaagatgctcgcgcgaagttggacgaactcgagggagctctgcaccaggccaaagaagaattggcccgtatgctgagagagtaccaggaactcgtgtccctgaagcttgcgttagacatggagattgccacttatcgtaagcttctggagtcagaggagtgtagaatgtctggggaatatccgaatagtgtttccatcagtgtcatatctagtacaaacgccggggcaggcggcgcagggtttagcatgggtttcggtgccagctcttcttactcttataaaaccgcggcagccgacgtaaaaacaaaggggtcttgcggctcggaacttaaggaccccctggccaagacttctggcagcagttgtgctaccaagaaagcatccagatag

SEQ ID NO: 121487 - DNA, 1410 bp, Artificial Sequence
  Description of Artificial Sequence: Synthetic coding sequence
atgtcccgtcagttgacgcactttccacgcggtgagcgcctcggtttctccgggtgtagcgctgtcctgtctggaggcattggttcttccagcgcttcattcagagcacgggtcaagggctctgcgtctttcggatccaaaagtctctcatgcctcggtggcagtcggtctttggccctaagcgccgctgctcgaaggggcgggggccgccttggaggatttgtgggaaccgcatttggctctgcaggcctgggccctaaatgcccgtctgtatgcccaccgggagggattcctcaagtgactgtgaacaagtccctcctggcccccctcaacgtcgaaatggacccagagatccagagagtgcgcgcccaagagcgtgaacagattaaagcattgaacaataaatttgcctccttcatcgataaagtgcgcttcctggagcaacagaaccaagttttagaaacaaagtggaatctcctacaacagctggatctcaacaattgtcgtaagaacctggaaccaatctatgaagggtacatcagtaatcttcaaaaacagctggaaatgctgtctggtgacggtgttcggctggactctgaactcagaaacatgcaggacctggtcgaagactataaaaagaggtacgaggtggagatcaatcgacggaccgccgccgagaacgagtttgttgtgctcaagaaagacgttgacgccgcttacatgaacaaggtggagctgcaggccaaggtagactccttgaccgatgagatcaaatttttcaagtgcttgtacgagggagagattactcagatccagtctcacataagcgatacttccatcgtactttctatggacaataatagggatctagacttggatagcatcatagctgaagtcagagcacaatatgaagagatcgctttgaagagtaaggctgaagcggagaccctctatcagacaaaatgcgcagacctggaaactgctattgctgatgcggaacagcgcggcgactgtgcactcaaggacgctcgggcaaagctcgatgagctggaaggagccctgcatcaggccaaggaggagctggcaaggatgctccgggagtatcaggaattggtctctttaaaactcgcactagatatggaaatcgctacatataggaaactgttggagtccgaagaatgccgtatgtctggagagtatccaaattccgtctctatttctgttatctcatccacaaacgctggtgctggtggggcaggcttttctatgggcttcggagcttctagcagctactcctacaaaaccgccgccgcagacgtaaaaactaaagggagctgcggctccgagctgaaggatcccctcgccaaaacgtccggtagcagctgtgccacgaaaaaggcttctcgctag

SEQ ID NO: 121488 - DNA, 972 bp, Artificial Sequence
  Description of Artificial Sequence: Synthetic coding sequence
atgctgtctggggacggcgtaagactggacagcgaactgagaaatatgcaggatctggtagaagattacaaaaaaagatatgaggtcgagattaacagacgcactgccgcagaaaatgagttcgtcgtccttaaaaaggacgttgacgctgcgtatatgaataaggtggagctccaggcaaaggtggatagcctgacagacgagataaagttctttaagtgtctttacgagggcgaaattacgcagattcagtcccatatcagcgacacgtccattgtgctgtccatggacaacaaccgcgacttggaccttgactcaatcatagcagaggttcgggctcagtatgaagagatcgcgcttaaatccaaagctgaggccgaaactctctaccagacgaagatacaggagcttcaagtgacagctggacaacacggggatgatttaaaactgaccaaagccgagatctcagagttaaatcgactcattcaacggattagatctgagatcggtaacgtcaagaagcagtgcgccgatctggagaccgctatcgcagacgccgagcagaggggagactgcgctctcaaggatgcacgcgctaaattggatgagctggagggggcactccaccaggccaaagaagaactggcccgtatgctccgagaataccaggaactcgtgagtcttaagctggcattagacatggaaatcgccacctaccgcaagctgcttgagagtgaagagtgcagaatgtcaggagagtaccccaactcagtctctattagcgttatatcaagtaccaacgcaggcgctggtggcgccggattctccatgggttttggcgcctcctctagttactcgtacaaaacagccgcagcagatgtgaaaaccaagggatcttgtgggagcgagctgaaagaccccttggcaaaaacaagcgggtcttcctgcgcaacaaaaaaagccagcaggtag

SEQ ID NO: 121489 - DNA, 1536 bp, Artificial Sequence
  Description of Artificial Sequence: Synthetic coding sequence
atgtcccgtcagctgacgcacttccctaggggagaaagactgggctttagtggatgttccgccgtattatcgggaggcattggctcatcttcagctagctttcgggccagagtaaagggatcggcaagcttcgggtcaaagtccctatcctgtttaggggggagccgttctcttgctctgagcgctgcggcccgtcgtggtggagggaggctcggcggattcgtgggaaccgcattcggcagcgccggactcgggcccaagtgtccctcggtctgtccgccaggggggatcccacaggtgactgttaacaagtctctgcttgcccctttgaatgtcgagatggaccccgaaattcaaagggtaagagctcaggaacgagagcagatcaaggctctcaataataagtttgcgtccttcatcgataaagtgcggtttcttgagcagcagaatcaagtgctcgagactaaatggaacctcctccagcagctggacctgaacaactgccggaagaatttggagccaatttatgagggctatataagtaacctgcagaaacaactcgagatgttgtcgggggacggagtccgacttgactcagaactgcgcaacatgcaggatttggtggaagattacaaaaaaaggtatgaggtggagatcaacagaagaactgctgcagagaacgagtttgtggttctcaagaaagacgtggatgctgcatatatgaataaggttgagcttcaggccaaggtcgactcactgaccgacgagatcaagttttttaaatgcctttatgaaggggaaatcacgcagatacaatcccacatcagcgacacaagcatcgtgctgtctatggataacaatcgcgatctcgatcttgacagtattatcgcagaagtgcgggcacagtacgaagagattgcactgaaaagcaaagcagaagcagagactctatatcagactaagattcaggagctgcaggtgacagcaggccagcacggtgatgatcttaaactgaccaaggcagagatctctgaacttaatcggctgattcagaggattcgctcggagataggcaatgtgaaaaaacagtgtgccgacctggaaaccgcaatcgcagacgctgagcagagaggcgactgcgcactgaaagacgcccgggccaagctggatgaactcgagggcgccttgcaccaagccaaagaggaactcgccagaatgctgagagagtaccaggagctggtgagcctgaaactggccttagacatggagattgcaacttaccgaaaactgctcgagtcagaagagtgtcgcatgagcggtgaataccctaattcagtgtcaattagtgtaatctcctccaccaacgccggggccggcggggccggattttcgatgggatttggcgcctcctcctcctacagctataaaaccgcagccgcagatgtcaagactaagggaagctgcggttccgagctgaaagacccactcgccaaaactagcgggtcttcctgtgctaccaagaaggcaagccgttag

SEQ ID NO: 121490 - DNA, 1623 bp, Artificial Sequence
  Description of Artificial Sequence: Synthetic coding sequence
atgagtcgccagtttacttataagagcggcgccgccgctaaaggagggtttagcggctgctcagccgtgttgtctggtggcagctctagttcatatcgcgctggcgggaagggactgtcagggggcttcagtagtcggagcctttatagcttgggaggagcacgatctatctcctttaacgtcgcaagcggctcaggctgggctggtggttatggcttcggaagggggagggcgtctggatttgctggttccatgttcgggtcggtcgctctgggaagtgtttgcccctcactctgccctcctggcgggatccatcaagttacaattaataagagcctgctggccccactgaatgtggaactggaccccgaaattcagaaggtacgagcccaggagcgcgagcagatcaaggtcttgaacaataagttcgcctcttttattgacaaagtgcgttttcttgaacagcaaaaccaggtcctggaaacaaagtgggagttgctgcaacaactcgatctgaataactgtaagaacaatttggagcccattctggaggggtacatctcgaatctgcgcaagcagctggagactctatccggggatagggtgagactcgactccgagctgaggtctgttcgagaagttgtagaagattacaaaaagcggtatgaagaggagattaacaagcggactacagccgaaaatgaattcgtagtacttaagaaggacgtggacgctgcttatacaagcaaggtggagttacaagctaaggttgacgctctggacggggagattaaattttttaagtgcttgtacgagggggaaacagcacagatacaatcccatatttctgacacttctataattctctcgatggacaacaaccggaatctcgacctggactcaatcatcgctgaggtccgggcccagtacgaggagatagcccgaaaaagcaaggctgaagcagaggcattgtaccagaccaagtttcaggaattgcagctggctgcggggagacatggagacgacctgaagcataccaagaatgagattagcgagctgaccaggttgatacagaggctgagaagcgaaattgagtcagtgaagaagcagtgtgccaatctggagactgccatagcagatgcggaacagcgaggggactgtgctcttaaggatgcccgtgccaaactggacgagctggaaggagcgcttcagcaagcaaaagaggagctggcacgaatgttaagagaataccaggaacttctgagcgtgaaactgagtctcgacattgagattgctacgtaccggaaattgctggaaggagaggaatgccggatgtcaggtgaatataccaacagtgtgtccatatccgtcatcaactcgtcgatggcaggcatggccgggacaggtgctggctttggcttctctaacgcagggacctatggctattggccatcttccgtgtcagggggctattctatgcttccaggcggctgcgttacagggagcgggaactgtagcccaagaggagaagccaggacacggctggggagtgcatctgagtttagggattcccaaggcaagactctggccttgagcagtccaacgaaaaagactatgcgatag

SEQ ID NO: 121491 - DNA, 1590 bp, Artificial Sequence
  Description of Artificial Sequence: Synthetic coding sequence
atgtctaggcagttaaacattaaatcttcaggtgataaagggaattttagcgttcactctgccgtggtgccaaggaaggctgtaggctcactggcttcttattgtgccgccggtagaggagccggggcagggttcggttccagaagcctgtactccctcggcgggaatcgcagaatttcattcaacgtcgcaggtgggggagtccgagctggcgggtacgggttccgccctgggagcggatatggcggcggcagggcatccggcttcgcagggagtatgtttggatctgttgcacttggccccgcgtgtctgtctgtctgtcctcctggcggtattcaccaggtgaccgtgaacaagtctctgttagctcctttgaacgtagagctggatcctgagatccagaaggtaagagcccaggaaagggaacagatcaaggtacttaatgacaagttcgcctctttcatcgacaaggtgcgctttttagagcagcagaatcaagttctggaaactaaatgggaactgttacagcagctggacctgaacaactgcaaaaagaacttggaaccaattctcgaaggttatatctctaaccttagaaagcaactcgagacgctgtcgggagacagggttaggctagattctgaactgagatctatgagggacctggtggaagattacaagaagcgctacgaggtagagatcaatcgaaggacaaccgctgagaacgaatttgtggtgttgaagaaagatgctgacgccgcctacgccgtgaaggttgaactacaggccaaagtggatagtttagacaaagaaatcaaattcctgaaatgcctctacgacgctgagatcgctcagatccagacgcatgccagcgaaacatctgtgattctgtctatggacaacaatcgcgacttagatctggactctatcatcgcagaagtgcgcatgcactacgaggagattgctctaaagtctaaggctgaggccgaagccctctaccagaccaagatccaagaactgcagctcgcggcatcaagacacggggacgacctaaagcatacccgttcagagatggtggaattgaacaggctcattcaacgcatacgctgtgaaataggaaacgtcaagaaacagagagctagcctggagacggccatcgccgacgctgaacagaggggggacaatgcccttaaggacgcccaagctaagctggacgagctggagggggctctgcaccaggccaaagaggaactcgcccggatgctgcgggagtaccaggaactgatgtccctcaagctcgccctcgacatggaaatcgcgacttatcgaaagctgctggaaggcgaagagtgccgtatgtctggcgagaatcccagcagtgtttcaatttccgttatctccagcagcagctattcttaccatcacccttcctccgccggcgtcgacttgggggcctctgctgtggcaggatcctctggttccacacaaagcgggcagaccaagactacagaggcaaggggtggcgacctcaaggatacacagggcaagagtacaccggcttccatacccgctcgcaaggccaccaggtag

SEQ ID NO: 121492 - DNA, 1656 bp, Artificial Sequence
  Description of Artificial Sequence: Synthetic coding sequence
atgtcccggcaaagtagtattacctttcaaagtggcagccgtaggggttttagtaccacatcagcgatcacaccagcagctggaaggtctagattctcttcggtgagcgtcgcacgtagcgctgctggctcgggaggactggggagaattagttcagccggggccagcttcgggagtcgctccttgtacaacctgggaggcgccaagcgcgtgtcaatcaatggctgtggaagttcttgtcggagcggctttggtggtagggcgtctaacagatttggggtgaattctgggttcggctacggcggcggcgtaggaggcggattctccgggcccagtttccccgtgtgtccccccgggggcatccaggaggttactgttaatcagtccttgctgacacccctgcatctgcagatcgatcccacaatccagagagtacgggcagaggaacgcgaacagattaaaacgctaaataacaaatttgcatctttcatcgataaagtgaggttcctggaacagcagaataaagtcctcgagaccaagtgggcactgcttcaggagcaggggagccggacggtcagacagaatctcgaacctttattcgattcatatacctctgagctcagacggcagctggagtccatcaccactgagcgagggcggctcgaagccgaattacgaaacatgcaagatgttgttgaggacttcaaagtccgatacgaggatgagatcaacaaacgcaccgccgccgaaaatgaattcgtcgccctcaaaaaagacgtggacgccgcatatatgaacaaggtggaacttgaagctaaggtcaaatcccttcctgaagagatcaattttatacactccgtgttcgatgctgaattgagccagctgcagacccaggtcggtgatacttctgttgtactttctatggacaataacaggaatttagatctcgacagcatcatagctgaggttaaagctcagtatgaagacatcgccaaccggtctagagcagaggccgagtcatggtatcagactaaatatgaggagctgcaggtgaccgcagggcggcatggggacgacctgcggaataccaaacaggaaatcagtgaaatgaataggatgatccagcgcctgcgtgccgagattgactctgtcaagaagcagtgtagtagcctccagactgcgatagctgacgctgagcagcggggagaactcgccttaaaagacgcgcgagccaaacttgtagacctggaagaggccctgcaaaaggccaagcaggatatggctagactgcttagggaatatcaggagctgatgaacatcaagctcgcccttgacgtagaaatcgcaacttaccgcaaactgcttgaaggtgaagaatgtaggctctctggcgaaggagtttctccagtcaacatctcagtggtaacttccacgctgagtagtggttacggttctggatccagcatcggaggaggcaacctgggtctgggagggggaagtggatactcatttacaacatccggcggccacagccttggcgccggcctgggcggctccggttttagtgccacgtctaatcgaggactgggagggtccggctcctctgtgaaattcgtgagcaccaccagcagttcacagaaatcgtacacacattag

SEQ ID NO: 121493 - DNA, 1737 bp, Artificial Sequence
  Description of Artificial Sequence: Synthetic coding sequence
atgtctcatcagttctcttcccagtctgccttctcttccatgagccggcgggtgtactccaccagtagctccgccggctccgggggcggatctcccgcagtgggcagtgtgtgctacgctaggggaagatgcgggggcggcggctacggaatccacgggcgagggtttggcagccgaagcctttacaacctgggagggagtcgtagcatctccattaaccttatgggacggtcaacttctggattctgccaggggggaggggttgggggcttcgggggcggccgcgggtttggtgtggggtctaccggggccgggggcttcggtggaggcgggttcggtggtgccggctttggcacatccaactttggcttaggcggattcggcccctattgtcccccggggggcattcaggaggtgacaattaatcaatccctcctggagccgctgcatctggaggtggatcccgaaatccagagaataaagacacaggaacgcgaacagatcatggtgctcaacaataagttcgccagctttatcgataaggtccggttcctggagcagcagaaccaagtcctgcagaccaaatgggagctcctgcagcaagttaacactagcactggcacaaataacctggaaccgcttctcgaaaattacatcggtgacctgagacgccaggtggacctactatctgcagagcagatgaggcagaacgccgaggtgaggagcatgcaggacgtagtggaagattataaatctaaatatgaagatgagatcaataaaagaacaggcagtgagaacgattttgtcgtgctgaaaaaggatgtggatgcagcttacgtgtccaaagtggatctggaatcccgggtcgatacactgacgggggaggtgaatttcctgaagtacctattcctaaccgagctctcacaggtacagacacatatctctgatacgaatgttattctgtcaatggacaataatcggtcgctcgatttagactccataatagacgctgtgcgtactcagtacgagctcattgcccagagatccaaggatgaagctgaggccctctaccagacaaagtaccaggagctccagatcacagctgggcggcacggtgatgacctcaaaaacagcaaaatggaaattgccgaattaaaccggaccgtgcagcgcctgcaagcggaaatcagtaacgtaaagaaacagattgagcagatgcagtctctgatctcagacgccgaggagaggggcgagcaggcgctgcaggatgcttggcagaagctgcaggatttggaagaagctcttcagcagagcaaggaggagcttgcccgactgctccgcgactaccaagccatgttgggagtcaaactgagcctcgacgtggagatcgctacatacaggcagctgttggaaggcgaagagtcacgtatgagtggcgagttgcagtcccatgtcagcatctctgtccagaatagccaagtctctgtgaatggtggcgcgggcggcggaggctcatacggatctggggggtacggcggtgggtctggaggtggatacggtggtggaaggtcttacagaggtgggggcgccagaggacgaagtgggggcgggtacggtagtggatgtggcggcggcgggggttcgtatggcggcagcggccgaagtgggcggggaagtagtagagtgcagattatccagacatccactaatactagtcatcggcgcattctcgaatag

SEQ ID NO: 121494 - DNA, 1038 bp, Artificial Sequence
  Description of Artificial Sequence: Synthetic coding sequence
atgaggcagaacgccgaggtgcgctccatgcaggacgtggtggaagattataagtctaagtacgaagatgaaatcaacaagcgaacagggagtgagaatgatttcgtggttttgaagaaggacgtcgatgctgcctacgtatccaaggtggacctagagtctcgcgtcgacacactgacaggggaggtgaactttcttaagtacctgttcttaactgaactgagtcaagtgcagactcacatctctgacaccaacgtgatcctgtccatggataacaatcgcagcttggatctggattctataatagatgccgtgcggacccagtacgagctgatcgcccagcggagtaaggacgaagcagaagccctataccagactaagtaccaggagctccaaattactgctggccgacatggcgatgaccttaagaactctaagatggagatagctgaactgaaccggactgttcagcggttgcaggctgagatcagcaacgtcaaaaaacagatagaacagatgcaatcgctgatctctgatgccgaggagcgcggcgagcaggccctacaagacgcgtggcaaaaattgcaagacctggaggaagcgctccagcagtctaaggaggaactcgcccgcttacttagagattatcaagcaatgctaggcgtcaaattgtccctcgatgtggagatcgccacataccgtcagctcctggagggagaagaatcacggatgagcggggagttacagtctcacgtatccataagtgtgcagaattcacaagtttcggtcaatggtggggccggcggaggaggatcctacgggtcagggggttatggaggcggtagcgggggcggctatggtgggggaaggtcatatagaggcggtggggcccgcggcagaagtggcggtgggtacggtagcggctgtggcggcgggggagggtcttatgggggaagcggccggtccggcagagggtctagccgtgttcagattatccagacttcaaccaacaccagccataggaggatcctcgaatag

SEQ ID NO: 121495 - DNA, 1563 bp, Artificial Sequence
  Description of Artificial Sequence: Synthetic coding sequence
atgtctttgagtccttgtagggcccagcgggggttttccgccaggtccgcctgttctgcgcggtccaggggccgcagtagaggcggtttctcatccaggggcggcttcagttccaggtctctgaactcatttggcgggtgcctggagggctcccgcgggagtacatgggggagtggtggacggctgggggtcagattcggcgaatggtccggaggacccggcctgtctttatgtccccccgggggaattcaggaagttaccattaaccaaaacttgcttacacccctgaagattgagattgacccccaatttcaggtcgtgcggacacaggagacgcaggaaattcgcacgctgaataatcagttcgcctccttcattgataaggttagatttcttgagcagcaaaacaaggtcctggaaacaaagtggcacctgctgcagcagcagggactttctgggagccagcagggcttggagcctgtgtttgaagcctgccttgatcagctgcgcaaacaactggagcagttacaaggcgaaaggggagccttggacgcagaactgaaggcttgcagggaccaagaagaggaatataagtctaagtatgaagaagaggcacatagaagagccacactagagaacgatttcgtagtgctgaaaaaggacgtagatggggtattcctgtcaaaaatggaacttgagggcaagctggaagcacttcgggagtacttatactttctcaaacacctcaatgaggaagagctcggccagctccaaactcaagcctcagacacctcagtggtgctcagcatggacaataacagatacttggactttagctctatcatcactgaagtgcgagctaggtatgaagagatcgcgagatcatccaaggccgaggcagaggcactctaccagacaaagtaccaagagttacaggtgtccgcccaactgcatggcgacagaatgcaagaaacaaaagtacaaatcagccaactgcaccaggagatccagcggctgcaatcgcaaacagaaaatctcaagaaacaaaacgcttcgctgcaagctgcgatcaccgacgctgaacagagaggcgaactcgccctgaaggacgctcaggccaaggtcgacgagctggaggccgcactgcgcatggctaaacagaacttggctcgcttgctgtgcgagtatcaggagctgacaagcacaaaattatcattagatgttgaaatagcaacatacagaagactgttggaaggggaggaatgtaggatgagtggtgaatgcacctctcaggtgacaatttcatccgttgggggctctgccgttatgtctggcggcgtcggaggcggccttggaagcacctgtggcctaggctctgggaaaggatctcccgggagctgttgcacctcaatcgtcaccggcggcagtaatatcatcctgggttccggaaaagatccagtgcttgactcttgttccgtcagtggtagcagcgctggtagtagctgccataccatcctgaagaaaacagttgagagtagtctgaagacatcgataacctattag

SEQ ID NO: 121496 - DNA, 1233 bp, Artificial Sequence
  Description of Artificial Sequence: Synthetic coding sequence
atggaaggccacgaggctagtcccgcacaggtcgggcagggggacaggggaaaggtccgctttttagagcagcaaaataaggtcctcgaaacaaagtggcatttactgcagcagcaggggttgagtgggtcccagcaggggctggaacctgtgtttgaggcatgtctcgatcagcttcgcaagcaacttgaacagctgcagggcgagcgaggagcccttgacgctgaactcaaggcttgcagagatcaggaagaggagtacaagtctaaatacgaagaggaggcccacaggagagccaccctggaaaatgattttgtggtccttaaaaaggatgtcgatggagtgttcctgtctaaaatggagttggaaggtaagcttgaggccctcagggagtacctgtactttttgaagcacctgaatgaagaagagttgggtcagctccagacacaagccagcgatactagcgtggtgctgagtatggataataacaggtacctggacttctctagcattattaccgaggttcgggccagatacgaggagatcgctcggagttctaaagccgaggctgaagccctttaccagaccaagtaccaagaactgcaggtgagtgcccagctacatggggacaggatgcaggaaactaaggttcagatatctcagctacatcaagagatacagcggttacaatctcagaccgaaaacctcaaaaagcaaaatgcctcactgcaagctgctatcacagacgctgaacaacggggagaactagctcttaaagacgcccaagctaaagtagacgaactcgaggccgcccttcggatggccaaacaaaacctcgctagacttttgtgcgagtatcaggaattgacgagtacaaaactgagcctggatgtggagatcgcaacatatcgccggcttctggaaggagaggaatgtcggatgagcggagagtgtaccagtcaggtgaccatttctagtgttggaggatccgcagtgatgtctggtggagtgggcggagggctcggatctacatgcggtcttggcagcggcaagggctcacccgggagctgttgcaccagtatagtcaccggaggatccaatattatcctgggaagtggaaaggaccctgtcttggatagctgttccgttagtggatcctccgccggatcttcctgtcacacaatcctcaagaaaaccgtggagtcctccctgaagacaagtatcacttattag

SEQ ID NO: 121497 - DNA, 876 bp, Artificial Sequence
  Description of Artificial Sequence: Synthetic coding sequence
atggagctggagggaaaacttgaagcactgagagagtatttgtattttcttaaacatctgaacgaggaggaactgggacagttgcagacgcaggcctctgatacgtcagtagtactgtccatggacaacaatcgatatctggacttttctagcatcatcactgaggtgcgggctcgctacgaagaaattgcccgttccagtaaagctgaggctgaggcactttatcaaaccaaatatcaggagctacaggtgtctgcgcagctacacggcgacagaatgcaagagaccaaggtgcaaatatcacaactgcatcaggagatacagcggctgcaatctcagaccgaaaatctcaagaaacagaacgcatctcttcaggccgccatcactgatgccgaacagaggggagaactggcccttaaggacgcacaggccaaagtcgatgaattggaggcggcccttaggatggcaaaacagaatctggcacgcttgctgtgtgaataccaggagttgacctctaccaaactgtctcttgacgtggaaatcgctacgtacagaaggctgctggaaggtgaagaatgtagaatgtcaggcgagtgtacgagccaagtgactatcagttcagtgggtgggtctgccgtgatgtccgggggtgttggcgggggactgggctcaacttgtggcctgggctccggaaagggcagccccggctcatgttgcacctccattgtcacgggaggttccaatattattctggggagcggtaaggatcccgtccttgattcttgctctgtgtccgggtcctccgcaggctcctcatgccacacaatcctaaagaagacagtcgagagctcactaaagactagcattacatattag

SEQ ID NO: 121498 - DNA, 1608 bp, Artificial Sequence
  Description of Artificial Sequence: Synthetic coding sequence
atgagatctagcgtcagccggcagacctacagcaccaaaggaggtttctcatccaactccgcttcaggaggtagtgggagccaggcgaggacttcgttctctagcgtaaccgtgtcgcggtcaagcggctctggcggaggagcacactgcggaccaggcacaggcggatttgggagccgaagcctgtacaacctaggcgggcataaatctatatcagtgtctgtggccggaggggctttgctgggccgggcgctgggagggtttggttttggctccagagccttcatgggccagggagcaggcaggcaaaccttcggtccagcctgtccgccaggtggcatccaagaagtcactgtcaaccaaagtttgttgaccccattacatgtagaaatagaccctgagatccaacgcgtgaggactcaggaaagagagcagatcaagacactgaacaataagtttgccagctttattgataaggtgaggtttctggagcaacagaataaggtgcttgaaaccaaatgggctcttctgcaagaacagggccaaaatttgggcgtaaccagaaacaacctggagcccttatttgaagcctatctaggatctatgcgatccacacttgaccggcttcaaagcgaacgggggaggctggattctgaacttagaaacgtgcaggatctggttgaggactttaagaacaagtacgaggacgaaattaacaagcacaccgccgctgagaatgaattcgtagttttaaagaaggatgtggatgcggcctacatgggtcggatggacctgcatggcaaagtgggaactcttacacaggaaattgatttcttgcagcagctttacgagatggaactgtcacaggtccagactcatgtcagcaataccaacgtggtcttgagcatggataacaaccgcaacctggacctggactctatcatcgctgaagttaaagcacagtacgagctgattgcgcagagaagccgagccgaggctgaggcttggtatcagacaaagtacgaggaattgcaggtgactgctgggaaacacggagacaacctgagggatacaaagaatgaaattgcagaactgactcggaccatccagcgcctacagggggaggctgatgcagccaaaaagcagtgccagcaactccagaccgctatcgccgaagccgaacagcgcggcgagctggccctgaaagatgcgcaaaaaaaattgggtgatctggacgtggccctccatcaagccaaggaggatctgacccggctgttacgcgactatcaagaactgatgaacgtcaaactggctttagatgtggaaatcgcaacatatagaaagctgctggagagcgaagaaagccggatgagcggcgagtgtccctccgctgttagtatttcggtgacaggtaatagcactaccgtctgtggagggggagcggcaagcttcggcggcggaatctcacttggaggatccggcggtgctaccaaaggaggtttcagcaccaatgtggggtacagtaccgtcaaaggaggacccgtctccgctggaacctccatactacgcaagaccacaaccgtaaaaacctcctcacagcgctactag

SEQ ID NO: 121499 - DNA, 1269 bp, Artificial Sequence
  Description of Artificial Sequence: Synthetic coding sequence
atggcttgtcgctcttgtgtggtgggtttctcctcattgtcttcctgcgaagtcactcccgtggggagtccccgccccggaactagcggctgggacagctgtagggctccaggcccgggattttccagtcgctcgttgactggttgttggagcgccggcacgatctccaaagtcaccgtgaaccctggactgttggtgcccctcgacgtgaagctcgaccctgcggtccaacaactcaagaatcaagaaaaggaggaaatgaaggccctaaatgataagtttgcctcacttatcggcaaagttcaagcccttgagcaaagaaatcagctgttggagaccagatggtccttcctgcaaggccaagatagtgcgatcttcgaccttggacacttgtacgaagagtatcagggaagactccaggaggagctccgaaaggtgtctcaagaacgggggcaactagaggcaaatctgctgcaagtcctcgagaaagtcgaagaattcaggatccgctacgaagacgagatcagtaaacggacggatatggagtttaccttcgtgcagcttaaaaaggacttggacgctgagtgtctgcaccgcaccgagctcgagacaaaattaaagtccctggagagttttgtggagcttatgaagacaatatacgaacaggaattgaaagatttagccgcacaggtcaaggatgttagcgttacagtggggatggactcccggtgccatatagatctgagcggaatcgtggaggaggtcaaggcacaatatgatgccgttgcagcacggtcgctggaggaggccgaggcctactcacggagtcagctcgaggaacaggccgcacggtccgccgaatatggtagcagtttacagtcatccaggagcgaaattgcagatcttaacgtgcgaatccagaaactgcgcagccagatcctctcagtgaagtcgcactgtctcaaactggaggagaatatcaaaacagctgaggagcaaggcgaactagcttttcaggatgccaagacaaagctggcccagttagaagccgctttgcagcaggctaaacaggatatggctcgccagctccggaagtaccaggaactgatgaatgtaaaactggccctcgatatcgaaatagcgacttacagaaagcttgtggaaggggaggaagggcgaatggatagtccctcggctacagtggtctcggccgtgcagagccgctgcaagaccgcaccctctctgccctacccactctgttccctgtag

SEQ ID NO: 121500 - DNA, 1359 bp, Artificial Sequence
  Description of Artificial Sequence: Synthetic coding sequence
atggcgtgtcggtcctgtgtggtgggcttttcgagtctgagttcatgcgaggtcacgcctgtcgggagccctaggcccggaacatcaggctgggactcgtgtagggcgcctggtcctggtttctcaagtcggtcattgactggctgttggtcagcagggactatcagtaaggtgaccgtgaatccaggcctcctggtaccactggatgtcaaacttgaccccgcagtgcaacaactcaaaaaccaagagaaggaggagatgaaggcactgaatgataaattcgccagcctcattggcaaggttcaggctctggaacagagaaaccagctcctggagacaagatggagtttcctgcagggccaagattccgcaatcttcgatctaggacacctgtacgaagagtaccaaggtcgtttacaggaagagctgcgcaaagtgtcccaggagaggggccagcttgaggctaatttgctacaggttctggaaaaggtggaggagttcaggatccggtacgaggatgagatctctaagcggaccgatatggagtttacgtttgtgcagctgaaaaaggacctggacgccgaatgtcttcatcgtactgaactagagacaaagcttaagagcttagaatcgtttgtggagctcatgaagactatctatgaacaggagctgaaagacctcgccgcccaagtcaaagacgtgagtgtgaccgtggggatggactcccgatgccacatcgatctctctggcatcgtggaagaggtaaaggcacagtacgatgccgtcgctgcccgctctcttgaggaggccgaagcgtacagccggagccagcttgaggagcaggccgctaggagcgccgagtacgggtcctctctacagagctctcggtccgaaatcgccgacttgaacgtgcggattcagaaactgcgctcgcagattctgagcgtgaaaagccactgtctgaagctcgaggagaacatcaaaaccgccgaggagcagggtgaattggccttccaagatgccaagactaagctggcccagttggaggccgccctacagcaagcaaagcaagatatggcacgacaactcagaaagtaccaggagctgatgaacgtgaaactggctttggatattgagattgcaacctacaggaaactggtggagggcgaggagggccgcatggatagcccgtccgccactgtagtgagtgccgtccaatctagatgtaagacagcagcctcaagatctggcctctcaaaggcgccgagcagaaaaaaaaagggttccaaggggcccgttattaaaatcacagagatgtccgaaaagtacttctcacaggagtccgaagtatccgagtag

SEQ ID NO: 121501 - DNA, 1518 bp, Artificial Sequence
  Description of Artificial Sequence: Synthetic coding sequence
atgacatgcgggagtggctttgggggacgggcatttagctgcatctcagcatgcgggccccgccccggcagatgttgtataacggccgccccctataggggtatttcatgctacagaggcttgactggcggcttcgggtcccactcagtatgtggaggatttagagccggctcttgcggaaggtccttcggatatcggtcaggcggcgtgtgtggcccatcacccccctgcatcacgacagtatcagtaaatgagtctctgctgactcccctcaatttagaaattgatccaaatgcacagtgtgtgaagcaggaggagaaagagcagatcaaatccctaaacagcagatttgccgcatttatagacaaggtaaggttccttgaacagcagaataaactgttagaaactaagttgcagttctatcagaaccgagagtgctgccagtcaaacctggagcccttgtttgaagggtatatcgaaacactgaggagagaggcagagtgcgtggaagcggattcagggcgtctggcatccgaactcaatcacgtgcaagaggtactcgaggggtataaaaaaaagtacgaagaagaggttagtctgcgcgccactgcggagaatgagttcgtagctctcaaaaaggatgtggactgtgcttacctgaggaaaagtgaccttgaggctaatgtcgaggcgctgatccaggaaatcgacttccttagaagattatacgaagaggagatcctgatcttgcaaagccacatttccgacactagtgtcgtcgtgaaactcgacaattctcgggatttaaatatggactgtattatcgccgaaatcaaggcgcagtacgatgatatagtcacgaggtcgagagccgaagcagaaagttggtaccgtagcaaatgtgaagaaatgaaagccacggtcattcggcatggggagacgttaaggcgtactaaggaggaaatcaacgagttgaatagaatgatacaacgtctgacagcagaagtggaaaatgccaaatgtcagaacagcaagttggaagccgcagtggcacaatcagagcagcagggcgaggctgccctgtccgacgccagatgtaaactggctgagcttgagggagcattgcaaaaagccaaacaggacatggcctgccttatccgggagtatcaagaggttatgaacagcaagcttggcttggacattgagatcgcaacgtatagacgcttgctcgaaggcgaggaacaaaggctatgcgagggaatcggagccgtcaacgtgtgtgtgagctccagccgtggaggagttgtttgtggcgacctgtgtgtgagtggaagccggccggtcacagggagtgtgtgctcagctccctgtaacgggaacgtcgccgtgtcaacaggtctgtgtgcaccatgtggccagctgaatactacctgtggaggaggatcgtgtggggtcgggagttgtggtattagcagtctgggagtggggagttgtggctcttcttgcaggaaatgctag

SEQ ID NO: 121502 - DNA, 1455 bp, Artificial Sequence
  Description of Artificial Sequence: Synthetic coding sequence
atgacctgtggaagcggttttggaggccgtgctttcagctgcatcagtgcttgtgggcctcgtccaggaaggtgttgcataaccgcagcaccctatcgcggcatttcttgctacagaggcttgaccggcgggttcggaagtcattccgtgtgcggcggattcagagcggggagctgtggcaggtcattcggttaccggtccgggggcgtgtgcgggcctagccccccatgtataacgaccgtgtcagtaaatgaatcactgctgacccccttgaatctggagatagaccccaatgcacagtgtgtcaagcaagaggagaaagaacagattaaatctttgaattcacgcttcgcggcctttatcgacaaggtccgcttcctcgagcaacagaacaagctgcttgaaactaaactgcagttttaccagaacagggaatgctgtcaatcgaatctggagcctctgttcgagggatacatcgagaccctccggagggaggctgaatgtgtcgaggcagatagtggccggctggcttcagaactgaaccacgtgcaggaggtcctcgaaggctacaaaaaaaagtacgaggaagaagtaagcctcagagcgaccgccgagaacgagttcgtcgccctaaagaaggatgtggattgcgcctacctaaggaagtcagatttggaagcgaacgtggaagcattgattcaggaaatcgattttctcaggagactgtacgaagaagagattctgatcttacagagtcatatatccgatactagtgtggttgttaagctggataactcgagggacctcaatatggactgtatcattgctgaaatcaaagctcagtatgacgatatcgtgaccaggagccgggccgaggcagaatcttggtacagaagcaagtgcgaggagatgaaagcaacagtgataagacacggcgaaacccttagacgaacaaaagaggagataaacgagctgaatcggatgattcagagacttacagcggaggtcgagaacgcaaaatgtcaaaactctaagttggaagcagccgtagcccagagtgagcagcaaggagaagctgctctttctgacgcgcgttgcaagctcgcagagcttgagggcgcgctccagaaggcaaaacaggacatggcctgcctcatcagggaatatcaagaggttatgaacagtaaattgggtttggacatcgagattgctacttacagacggcttcttgagggcgaggagcaaaggctctgcgaaggtataggtgccgtgaatgtgtgcgtcagcagtagccggggcggcgtcgtgtgcggcgacttgtgcgtgtcaggctcccggccagtgacagggagtgtgtgcagcgcgccttgtaatggcaacgtggcagtttcgaccggcctatgcgccccctgcgggcaagtaggttcttgcgggagctcatgtaggaagtgttag

SEQ ID NO: 121503 - DNA, 1482 bp, Artificial Sequence
  Description of Artificial Sequence: Synthetic coding sequence
atgacatgtggattcaactcgatcggttgcggattccgcccaggaaatttctcctgcgttagtgcttgcggacctcgtccttcccggtgctgtatcaccgccgccccataccgcggcataagttgttaccgtggtttaaccggcggtttcggatcacatagcgtatgcggagggttccgtgctggcagttgtggacggagttttggatatcgaagtgggggggtctgcggtccgtcaccgccatgtattactaccgtatccgttaatgagtctctgttgacgcccctgaatctggaaatcgacccaaacgctcagtgcgttaagcaggaagaaaaagaacagatcaaatcactgaatagcagattcgccgccttcattgataaggtgcgattcctggaacagcagaacaaacttcttgagacaaaactccagttttaccagaacagagagtgttgtcagtcaaacctcgagcccctattcgccggctacattgagacactgcgcagggaggccgaatgcgtggaggctgactccggaaggctcgccagcgaattgaaccacgtccaggaagtactggagggttataaaaaaaaatacgaggaggaggtggcgttgagagcgaccgcagaaaacgagttcgtggcactcaagaaggacgtggattgtgcctatttaaggaaatccgatcttgaggccaatgtggaagccctcattcaggagatagattttctgaggcgcctctacgaagaggagatcaggatccttcagagtcacatcagcgacacatccgtggtggtcaagctcgataattctagggacttaaacatggattgcatcgtggctgaaattaaagcccaatacgatgacattgcaacacgctcacgtgccgaggctgagtcctggtacagatccaagtgcgaggaaatgaaggctacagtcatacgccacggggagactctgaggagaaccaaggaagaaataaacgaactaaatcgtatgatccagcgcttgacagctgaggtggagaacgccaagtgtcagaacagcaaattggaggcagctgtggcacagtcagagcagcagggagaggccgccctgtcagacgctaggtgcaaactagctgagttagagggggccctccagaaagcaaaacaggacatggcctgcctgatccgggagtatcaggaagtgatgaatagcaaactgggcctggacattgagatcgcgacctaccgtcgcctattggagggggaagaacagaggctctgcgaaggagttgaggccgtgaacgtctgcgtatcctcttcaagagggggcgttgtatgcggcgacttgtgtgtctccggcagtcgaccagtcaccgggagtgtctgttctgcaccatgcaatggtaatctcgttgtgtctactggactgtgcaagccctgtggacagctgaatactacatgtggcggggggtcatgcggtcaggggaggcactag

SEQ ID NO: 121504 - DNA, 1524 bp, Artificial Sequence
  Description of Artificial Sequence: Synthetic coding sequence
atgagttgcaggtcctaccgcatttccagcggctgcggagtgacccggaacttttcatcttgctcagccgttgcgccaaaaactgggaacaggtgttgtatcagcgccgccccatacagaggcgtgagttgttatcgtggtctgaccggctttggttcccggtccctatgtaatctggggagctgtggtccgagaatcgcggtaggcggcttccgagcaggatcatgcgggaggagcttcggataccgttccgggggcgtctgcgggccctccccaccatgcattacgactgtgagcgtcaatgagtccctcttgacacccttgaaccttgagatcgaccccaatgcccaatgtgtgaagcaggaggagaaggagcagattaagtccttgaattcgcgcttcgcagcgttcatcgacaaagtgcgcttccttgagcagcaaaacaaactactggagacgaagtggcagttttaccagaaccagcgatgttgcgagtctaatctcgagcctctcttctcagggtacatagagacgctgcgcagggaagctgaatgtgttgaggcagatagtgggagactggcatctgagctgaaccacgtgcaggaagtgctggagggttacaaaaagaaatatgaagaggaagtcgctttgagggctaccgccgagaatgagttcgtggtgctgaaaaaagacgtagattgtgcctacctccggaaaagcgacctggaagctaatgtggaggcattagttgaggaaagctcctttttgagaagattgtacgaggaggaaattagggtgctgcaagcccatatatcagacactagcgtcattgtcaagatggacaattccagagacctgaacatggattgtatcatagccgaaataaaagcgcagtacgacgatgtcgcctcaagatcccgcgcggaagccgaatcttggtaccgatctaaatgcgaagagatgaaagccaccgtgataagacatggggaaacgcttaggaggaccaaagaggagatcaacgaattgaaccgcatgattcagcgcctgacggccgaaatcgagaacgctaaatgccagcgcgctaagctcgaggcagcagtggctgaggccgaacagcaaggagaggcggctttgtctgatgctagatgcaaactcgcggagctagaaggagcattgcagaaggctaagcaggatatggcctgcctcctgaaagagtaccaggaagtgatgaatagcaagttagggcttgatatcgagatcgctacctaccgccgcctgctggagggcgaggagcatcgactctgcgaaggcgtgggtagcgtcaatgtgtgtgtgtccagcagtcgcggcggcgtgtcatgcggcggactaagctactccacaactcccgggcggcagatcaccagcggtccctccgcgatagggggcagtataacagtggttgctccagatagctgcgcaccctgccagccaagaagcagctctttcagctgcgggtccagcaggtcggtccggttcgcgtag

SEQ ID NO: 121505 - DNA, 888 bp, Artificial Sequence
  Description of Artificial Sequence: Synthetic coding sequence
atggtgttcaaggtgcaattcttaagttctcggccctcacttagtcacactcaggacgtggactgtgcctacttgcgcaaaagcgatctagaggctaacgtcgaagcccttgtcgaggagtcttcttttctgaggagattatacgaggaagagatccgcgtcctgcaagcccatattagtgatacttccgttattgtcaagatggacaatagcagagatcttaatatggattgcattatagccgagattaaagcacagtacgacgatgttgcctcacgctctagggccgaggcagagtcgtggtatcggtcaaagtgcgaggaaatgaaggccaccgtgataagacacggcgagaccctgaggcgaaccaaggaggagatcaatgagctaaatcgtatgatccagaggctcacagcggaaattgaaaacgccaagtgccagagggcaaagctcgaggctgcagttgcggaagctgagcagcaaggcgaggccgctctttctgacgctaggtgcaagcttgcagaactcgagggggcacttcagaaggcaaagcaggatatggcctgtctgctcaaagagtaccaggaagtcatgaactccaagttaggtctggacatcgagattgctacatacagacgattgcttgagggggaggaacaccgcctatgtgagggcgtggggagtgtgaatgtgtgcgttagcagttccagaggcggagtcagctgtgggggtctgtcctactcaacaaccccaggccggcagataacatcaggccctagcgccattgggggctctatcaccgtggttgcacccgactcatgtgctccctgccaaccaagatcatctagctttagctgcggatccagtagaagcgtgcggtttgcttag

SEQ ID NO: 121506 - DNA, 1461 bp, Artificial Sequence
  Description of Artificial Sequence: Synthetic coding sequence
atgacgtgcggtagctactgtggtgggagagccttctcttgtatttcagcttgtggccccagacccggcaggtgttgcatcaccgccgccccttatagagggatttcctgttacaggggactgacaggcggctttggatcccattctgtgtgtggtggattcagggctgggtcttgtggtaggtctttcggatacagatcaggaggagtgtgcgggccctctcccccatgtatcactacagtatctgtgaatgaatcactgctgacacctctaaatctcgagattgatcccaatgcacagtgcgtgaaacaggaagagaaagagcagataaaaagccttaactctcggtttgctgcatttatcgataaggtccgctttcttgagcaacagaacaagttacttgagacaaagctgcagttctaccagaaccgggaatgctgtcagtctaacctggagcccctgtttgaggggtacatagagacccttcgtagagaagccgagtgcgtggaggctgattccggcagattagcgtcagagctaaatcacgtccaggaagtgctggagggctataagaagaaatacgaagaagaggtgtctctgagagcaacagcggaaaacgaattcgtcgcactcaaaaaggacgttgactgcgcttatctgcgtaaatccgatctcgaagctaatgtcgaggcactcatccaggaaatcgatttcctgagaagactgtacgaagaggagatcagagttctccagtcacacatctccgataccagcgtggtggtgaagctggataacagtcgggacctgaacatggattgtattatcgcagagattaaggcccagtacgacgatattgtaactcgatcgcgggccgaggcggaaagctggtatcgcagcaagtgtgaagagatgaaggctactgtgatacggcacggagaaaccttgaggcgaaccaaagaagagattaacgagttgaaccggatgatccaacgtctcacggccgaggtggagaacgctaagtgtcagaactcaaagctcgaggctgccgtagcccagtccgaacaacagggtgaggccgccctgtctgatgcccggtgtaaactggccgaactggagggcgcgctgcagaaggctaagcaggacatggcatgcctgattagagagtatcaagaggttatgaatagtaaactgggcctggatatagagatcgcaacttatagaagactacttgagggagaggaacaaaggctgtgtgagggcgtgggatccgtaaacgtgtgtgtgagtagtagtcgaggcggggtcgtgtgtggagacctgtgtgccagtactactgcccccgtggtatccacccgtgtttcgtctgtgccctccaacagtaatgtcgtggtggggacaaccaatgcctgcgcaccaagtgctagggtgggtgtgtgcggtggatcttgtaaaagatgctag

SEQ ID NO: 121507 - DNA, 1872 bp, Artificial Sequence
  Description of Artificial Sequence: Synthetic coding sequence
atgtcatgtcgccagtttagctcttcttaccttagcagatccggcggcggggggggcggaggtctcggaagcgggggctctatcagaagtagttattctcgattcagcagttccggcggtggcgggggtggcggtcgcttctcctccagctctggatatgggggcggaagttctagggtatgtgggcggggcggcggggggtcttttggctatagttacggggggggctcagggggtggctttagtgcaagctcgcttggcgggggattcgggggaggttccagagggttcgggggggcctccggaggtggatatagtagctccggtggctttggcgggggtttcggcggtggaagcggaggagggtttggtggtgggtatggctccgggttcggcgggtttggcggcttcggtggaggagccggcggaggggatggaggcatcctgactgcaaacgaaaagtcaacaatgcaagagttaaactcgcgacttgccagttatctggataaggtgcaagccctcgaagaagcgaataacgatctcgaaaataaaattcaggactggtatgacaaaaagggccccgctgccattcagaagaactactcaccatattataataccattgacgatctgaaggatcagatcgtggacctaacagtgggcaataataagacactgcttgatatagataatactagaatgacattggacgatttccgcattaaatttgagatggagcaaaatctccggcaaggggtcgatgccgacatcaatggtctcagacaagtgctggacaacttaacaatggagaaaagtgacctggagatgcagtacgagactcttcaggaagagcttatggcattgaagaaaaaccacaaggaagagatgagtcagctcactggacagaacagcggtgatgtaaatgtggaaattaacgtcgctccgggcaaggatctaactaagacattgaatgacatgaggcaggaatatgaacaacttatcgcaaagaacagaaaggacatagagaaccagtacgaaacccagattacccagattgagcatgaggtctcctccagtgggcaggaagtgcagagcagtgcaaaagaggttacacagctgcggcacggtgtgcaagaactggaaattgagttacaatcccagttaagtaagaaggctgcccttgagaagagcttggaagacactaagaatcgctattgtggacagctccaaatgattcaggagcaaatttccaatctggaggcccaaatcacagacgtgaggcaggaaatagaatgtcaaaatcaggaatattcgctgctgttgtcaatcaaaatgcggctcgagaaagagattgagacctatcataacctgttagaaggcggacaggaagactttgagtctagcggcgccggcaagataggacttggtggacgagggggaagcggaggaagctacggtagagggtccaggggggggtctggcggcagttacggtggtggtggctctggcggcggctacggcgggggatccggcagcaggggagggagtggcggtagttacgggggaggctctgggagcggcgggggctcgggaggaggctacggaggagggtcaggtgggggacattccgggggatccggtggcggccatagtggtgggtctggcggcaattatgggggcggatcaggaagtggtggcgggtcaggcggaggatatggtggcggatcaggatcccgcggtggcagtggagggtcccatgggggaggaagcggttttgggggcgagtccggcggatcgtacgggggcggcgaggaagcaagcgggagcggggggggatacggaggcgggtctggtaaaagcagccacagttag

SEQ ID NO: 121508 - DNA, 534 bp, Artificial Sequence
  Description of Artificial Sequence: Synthetic coding sequence
atggcatgttgtcaaacttcattttgcggcttcccgtcttgtagcacatctggaacttgtggatcctcatgctgtcagccatcctgttgcgagacttcttcatgccaacctcggtgctgcgagactagctgttgccagccaagttgttgtcaaacttctttctgtggattcccatccttcagtacaggcggcacttgcgattcctcttgctgtcaaccgagctgctgcgaaactagctgctgtcagccttcttgctaccagactagtagctgtggtacagggtgcggaatcgggggaggtatcgggtatggacaggagggcagttcgggggctgtgtctacaagaatccgatggtgtcggccagactgccgcgtggaaggaacttgccttccaccctgctgcgttgtgtcatgtaccccaccctcctgctgtcagctgcatcacgccgaggcaagctgttgccgcccatcttactgcggccaaagttgctgtcgccccgtttgctgctgttactgtagcgagccgacatgttag

SEQ ID NO: 121509 - DNA, 504 bp, Artificial Sequence
  Description of Artificial Sequence: Synthetic coding sequence
atggcttgctgccagacttctttctgtgggttcccttcatgcagcacgtcaggaacatgcgggtcttcttgttgtcagcctaggtgttgtgaaactagctgctgccagccctcttgctgccagactagcttctgcgggtttccctctttctcgacaggaggcacttgtgattcaagctgttgtcaacctagttgttgtgaaaccagctgctgtcaaccatcgtgttatcagacctcttcctgcggtaccggctgtgggatcggaggcggcatcggttacggtcaggaggggtctagcggcgcggtttccacaagaatcaggtggtgtcggcccgactgccgcgtcgagggcacctgcctgcccccttgttgtgtggtgtcctgtacacccccctcctgttgtcagctccaccatgctgaagctagctgttgccggccttcttactgcggacaatcatgctgccgccctgtgtgttgctgttattgctctgagcccacatgttag

SEQ ID NO: 121510 - DNA, 492 bp, Artificial Sequence
  Description of Artificial Sequence: Synthetic coding sequence
atgtccttcaactgctccactagaaattgcagttcccgccccattggaggacgatgcatcgtccccgtcgcacaagtcactaccacatcgacgacagacgccgattgtttaggagggatttgtcttccgtcttcttttcagactggctcatggctcctggaccattgccaggaaacatgctgcgaacctacagcctgtcagcctacatgttacagacgaacctcatgtgtcagtaatccctgtcaagtcacttgcagccgccaaactacctgtatctctaatccttgttccaccacctactctagacccctcactttcgtctcatccggttgtcagcctttggggggcatcagctcagtgtgccagcctgtgggaggcataagcactgtatgtcagccagtcggaggcgtcagcactgtgtgtcagccagcttgcggcgtgtcaagaacataccagcagagttgcgtgtcatcatgcaggaggacgtgttag

SEQ ID NO: 121511 - DNA, 504 bp, Artificial Sequence
  Description of Artificial Sequence: Synthetic coding sequence
atgacctgctgccagacctccttttgtggctacccttcttgctcgacatcaggtacctgtgggtccagctgctgtcagccaagttgctgcgaaacatcatgctgccagccctcttgttgtcagaccagtttctgcggattcccaagtttcagcactagcggtacctgcagttcttcctgctgccaacccagctgctgcgaaacatcttgttgtcagccttcctgctgtcaaaccagtagctgtggcacagggtgtggtattggtggtggtattggttacgggcaggaaggaagctctggagcggtcagcacgcgtatccggtggtgtcgtccagactgtcgagtggagggcacctgcttgccgccttgttgcgtagtctcatgtacccctccaacttgttgccagcttcatcacgcagaagcctcctgttgtagaccaagctactgcgggcagagttgttgccgtccagtctgttgttgctatagctgtgagccaacctgttag

SEQ ID NO: 121512 - DNA, 366 bp, Artificial Sequence
  Description of Artificial Sequence: Synthetic coding sequence
atggcttcctgttctaccagcgggacatgcggctcttcctgttgccaacccagctgttgtgaaaccagttgctgtcagcccagctgctgtcaaacatctagttgcggcaccgggtgtgggattggtggtggaattggctacggacaggagggttcaggtggaagtgtgtcaacccgtatccgctggtgtcacccggattgtcacgtggaaggcacttgcctgccgccttgctaccttgtcagttgcacccccccaagctgctgccagttacatcacgctgaggcctcctgctgccggccctcgtactgtgggcaatcttgctgcaggcccgcctgctgttgccactgttgtgagccgacgtgctag

SEQ ID NO: 121513 - DNA, 837 bp, Artificial Sequence
  Description of Artificial Sequence: Synthetic coding sequence
atgggctgctgtggatgtagtgggggttgcggttccagctgcgggggttgcggctcgggatgcggcggatgtgggtctgggtgtggaggctgcgggtctggatgtggtggttccggctccagttgttgtgtcccagtctgctgttgtaagcctgtgtgttgtagagtacctacatgtagctgctcatcgtgcgggaagggcggttgcggctcatccggtggatctaaaggcggatgcgggagttgcggagggtgcaaaggcggttgcggatcttgcggtggaagcaaagggggatgcgggagctgtggcggcagtaaaggcggctgcggctcatgcgggggcagtaagggcggctgcgggtcaggttgtggcggctgcgggtcctcatgctgcgtgcctgtatgctgctgtaaacccatgtgttgctgtgtgccggcctgttcttgctcatcttgcgggaaaggaggttgcggaagttgtggctgttccaaaggagcctgcggcagctgcggcgggtccaaaggcggttgcggcagctgtggagggtgcaagggggggtgtggttcatgcggtggaagtaaaggaggttgcggatcaggctgcggaggttgtgggtccggctgcggggttccagtttgttgctgtagttgctcatcttgtggtagctgtgcaggctcaaagggcggctgcggctcttcctgctcccagtgttcttgctgcaaaccttgctgttgcagcagcggatgcgggtcatcatgctgccagagttcctgctgtaaaccgtgctgtagccaaagctcatgctgcgtacctgtttgttgccagtgcaaaatatag

SEQ ID NO: 121514 - DNA, 510 bp, Artificial Sequence
  Description of Artificial Sequence: Synthetic coding sequence
atgggctgttgcggctgtagcgggggatgcggcagctcttgcgggggctgcgattcctcctgcggctcatgcggtagcggatgcaggggctgcgggccgagttgttgtgctccagtgtactgctgcaagcccgtttgctgttgcgtcccagcttgctcatgttcttcctgcggcaagcggggatgtggctcctgtggaggaagtaaaggtggttgcgggagttgcggatgttcccaatgtagctgctgtaagccctgctgctgctccagcggctgcggtagctcctgctgtcaatgttcatgttgcaagccatactgcagtcagtgctcatgttgcaaaccatgttgctctagttccgggaggggaagcagctgttgccaatcgtcctgctgcaaaccatgctgtagctcttccggctgcggctcctcctgttgtcaaagcagttgctgtaagccttgctgcagccagagccggtgttgcgtgccggtctgttatcagtgtaaaatctag

SEQ ID NO: 121515 - DNA, 1740 bp, Artificial Sequence
  Description of Artificial Sequence: Synthetic coding sequence
atgtgcgatcagcagcagatccagtgccgattacctttgcagcagtgctgcgtcaaagggcccagcttctgctcgtcccagtccccctttgcccagtcccaggtggtggtacaggctccttgtgagatgcagatagttgactgtcccgcatcctgccctgtacaggtctgccaagtgtctgaccaagcgccctgccagagccagaccacccaggtgaaatgtcagtcaaaaacaaaacaggtaaagggtcaggcacaatgccagtccaagacaacgcaggttaagggtcaggcagcgagccagtctcagacatcgtccgtgcagtcacaggccccatgccagtctgaggtatcctacgtgcagtgcgaagccagtcaacctgtgcagacatgcttcgtggagtgcgcacccgtctgctatacagagacctgttacgtggaatgccccgtgcagaactatgtgccgtgcccggccccacagccagttcaaatgtatcgaggccgcccagcggtctgccagccacaaggcagattctctacacaatgtcagtatcaaggaagctactcatcgtgcggaccacagttccagtcaagggccacgtgcaataactacactccccagtttcagctgcgtccatcttatagcagttgcttcccccagtataggtcaaggacttcattctccccgtgtgttccacagtgtcagacacaaggatcatacggatccttcactgaacagcatcgcagtagatccacatcaagatgcctccctcccccacgtaggctgcagctgtttccccgaagttgctccccccctagaaggtttgagccatgtagttccagttacctgccgttaagaccctccgaaggctttcctaattactgcacaccacctaggcgtagcgagcccatatataatagccgctgtcctcgaagaccaatttccagttgctcccagcgtagaggaccaaagtgtcgcatagaaatcagctctccatgctgcccacgacaggtgcccccccagcgctgccctgtggaaatccctcctatcaggcggcgcagccagtcatgcggccctcaaccttcttggggcgcctcatgtcctgagcttcggccgcatgtggaaccacgacctctaccctcattctgtccacccaggaggctggatcagtgtcccgagagcccactgcaaagatgcccccctccagcaccacggccgcgattaagacccgagccatgcatatccttggaacctcgaccacgccccctgcctcgtcagctcagtgaaccctgcctctacccagaacccttgcctgcactcaggcccaccccaagacctgtgcccctgccacggccaggccagtgtgaaatccccgagccccggccctgtctgcagccttgtgagcaccccgaaccctgtcctcgcccagagcctatccccctgcccgcaccatgtcccagcccggaaccatgtcgagaaacctggcggagtcctagcccatgctggggcccaaatcctgtgccttacccgggggaccttggttgccacgagagctctcctcatagactcgatacagaagccccctactgcggcccaagtagctacaatcaagggcaggaatccggagccgggtgtggacctggcgacgtatttcccgagcggagagggcaggacggccacggcgatcaggggaatgcctttgccggggtaaaaggagaggccaagtcagcctatttctag

SEQ ID NO: 121516 - DNA, 1059 bp, Artificial Sequence
  Description of Artificial Sequence: Synthetic coding sequence
atggctggcactatctgtttcattatgtgggtcctgttcatcacagacacagtgtggtccaggtccgtcaggcaagtgtacgaagtccatgactcggatgactggacgatccatgactttgagtgtcccatggagtgcttctgtcctccaagctttccaaccgctctttactgtgaaaaccgcggcctgaaggagatacccgccattccatctagaatatggtacctatacctgcagaataacttaatcgaaacgatcccggagaagccattcgagaacgctacacagctgcggtggatcaatctgaataagaacaagatcacaaattacggtatcgagaaaggagccctgtcccagctaaagaaactgctctttctgttcctggaggataacgaactggaggaggtgccatcccccttgcctcggtcattagaacaactacagttagctagaaacaaagtctcccgcattccacagggaacgttttcaaacttggaaaatctgacgcttctcgaccttcagaataacaagctcgtcgataacgcctttcagcgcgatactttcaaagggctcaagaacctcatgcagctgaatatggccaaaaacgcactgagaaacatgcccccgcgcctaccggctaacactatgcagctgtttctcgacaacaactccatcgaaggtattccggaaaattactttaatgtcattcctaaagtggcgtttttgcgtctgaaccacaacaaattaagcgacgagggactgccttcacggggtttcgacgtcagctccatcctcgacctccagctgagccataaccagctgaccaaggtccctcggatctccgcacatcttcaacatttgcatttggatcataataagattaagagtgttaacgtgtctgtaatttgtccgtcccccagtatgctgcccgctgaacgcgattcattctcctatgggccgcatcttcgctatctgagactcgatgggaacgagattaagcctccaatcccaatggcactgatgacctgcttcagactactgcaggcggttattatttag

SEQ ID NO: 121517 - DNA, 897 bp, Artificial Sequence
  Description of Artificial Sequence: Synthetic coding sequence
atggaagagaaacagatcctctgcgtgggccttgtcgtgctcgatgtaatctctcttgtcgacaaatacccgaaggaagatagcgaaattcgctgcctgagccagcgctggcagcgcgggggcaacgccagtaatagttgcaccgtcctgagtttgctgggagcgccgtgcgctttcatgggcagcatggccccaggacacgtggcagatttcctggtggcggattttaggcggaggggagtcgacgtgagtcaggtcgcatggcagagtaagggggacacacccagctcttgttgtatcataaacaattccaacggcaacaggacgatcgtgctgcatgacacgtccctgcccgatgtgagcgcgacagactttgagaaagtggacctgacacagtttaaatggatccacattgaaggcagaaacgcgagtgaacaggtcaagatgttgcagcgcatcgatgctcacaacacacgacagccccctgaacagaaaatccgagtctcggtggaggtagaaaagcccagggaggaactctttcagctgtttggctacggggatgttgtgttcgtatcgaaagatgtcgccaagcatctgggcttccagtcagccgaagaagcactgcgtggcctgtatgggcgtgtgaggaaaggcgcggtgctcgtttgtgcttgggctgaggaaggcgccgatgcattaggtccagacggcaagctgctccacagcgatgcctttcccccccctagagtggtcgacaccctgggagctggagatacatttaacgcatcagtaattttcagcctgagccagggcagatcggtccaggaggctctgaggttcggatgtcaggtggctggaaagaaatgcgggctgcaagggttcgacggcattgtctag

SEQ ID NO: 121518 - DNA, 897 bp, Artificial Sequence
  Description of Artificial Sequence: Synthetic coding sequence
atggaggaaaaacagatcttgtgtgtcggcttggtggtgctggacgtgatcagcttagtggacaaataccccaaggaagactcagaaattcggtgcctctcacagcgatggcaacgtgggggcaacgcttcgaatagctgcaccgtgctgtctctcctgggcgccccctgcgctttcatgggtagcatggcacctggtcacgtggccgattttgtcctggatgacttgcggcgatacagcgtagacctaagatacactgtattccaaactacagggagcgttccaatcgccactgtcatcatcaacgaagcatccggctcaagaaccattctctactatgaccgttcgctccccgacgtttcggccacagatttcgaaaaggtggatttgacccagtttaagtggattcacatcgaggggcgcaatgcgtcagagcaggtgaagatgctgcagagaatagacgcacacaatacgagacaacccccagagcagaaaatccgagtgtcagtggaagtggagaaacctagggaggaactgtttcagctgttcgggtacggtgacgtcgtgtttgtgagcaaagacgtagcaaaacatctgggcttccaaagcgctgaagaggccctgcgagggctgtatggccgtgtacgtaaaggtgctgtgctcgtatgtgcttgggcagaggagggtgccgacgcccttggacctgacggcaagctcctacattcggatgcgttcccgccacctagagtggttgatacgttaggtgccggagatacgttcaatgcctccgtcatattttctttatctcaaggcaggtccgttcaggaagcactcagattcggttgtcaagttgccggaaagaagtgcggcctgcagggcttcgatggcattgtttag

SEQ ID NO: 121519 - DNA, 1041 bp, Artificial Sequence
  Description of Artificial Sequence: Synthetic coding sequence
atggaggagaaatacctgcccgagttgatggccgaaaaggattctcttgatccttcgttcacacatgctttgcgccttgtgaaccaagaaattgaaaagtttcagaaaggggaaggcaaagacgaggaaaagtacatcgatgtcgtcataaacaaaaatatgaaactgggccagaaggttctcattcccgtaaaacagttccccaagtttaattttgtgggtaagctgctgggcccccgcgggaattctctcaaaaggctgcaggaggagactctcaccaagatgtcaatcctgggaaagggcagtatgcgagacaaagctaaagaggaggagttacggaagtctggagaagcaaaatattttcatctgaatgacgaccttcacgtactcattgaggtgttcgctcccccagctgaagcatacgcacgcatgggccatgctctggaggaaatcaaaaagttcctcattccagattacaacgatgagatccgacaggctcagttacaggagttgacatacctcaacggaggctcggagaacgccgacgtcccagtggttcgcggcaaacctaccctgagaacccgcggcgtgcccgcacctgccattacacgtgggcgcggcggggtcactgcacgcccagtgggcgttgtggtcccacgaggcacccctacccctaggggcgtgctatccactcgtgggcctgtttcgcgcggtcggggactactaactccaagggccagaggagtacccccgacaggctatcgccctccccccccaccgcccactcaagaaacttacggtgaatacgattatgatgacggctatggaaccgcctacgacgagcagtcttacgatagctatgataactcgtactctaccccggctcagtccggggcggattattacgactatgggcacggcctgagcgaggagacctacgattcctacgggcaggaagaatggaccaattccaggcacaaggcaccctctgccagaacagcaaagggcgtctatcgcgaccagccgtacggcaggtactag

SEQ ID NO: 121520 - DNA, 495 bp, Artificial Sequence
  Description of Artificial Sequence: Synthetic coding sequence
atggacatgggaacatcagcccttagtaagaagccctggtggacacttccccagaacttccacgcacccatggttttccatatggaggaagatcaggaggagctgatattcggtcacggagatacatacttacgatgtatcgaggttcactctcatactctaatccagctggaatcctggttcaccgccaccggtcagacccgcgtgacagtggttggaccccaccgggcgagacaatggttacttcacatgttctgctgcgtcgggtcgcaggattcttaccaccacgcccggggattggagatgctggagcgtgtgaggtctcaacctctgacgaatgacgacttggtgacttcaattagcgttccaccctacacaggcgaccttagtttggccccccggatttccgggacagtctgcctctcagtcccacagccctctccctatcaggtgatcggctgtagcggctttcacctgtcaagcttatacccatag

SEQ ID NO: 121521 - DNA, 714 bp, Artificial Sequence
  Description of Artificial Sequence: Synthetic coding sequence
atgttgtctgcgtttcagcgccttttcagagtgctgtttgtcatcgagactgtgagtgaatacggggtccttatctttatatacggctggccgtttctgcaaactctcgccatgctgctcattggcaccgtctcatttcatctctggatcagacgaaaccgggaacgaaattcacgaagcggaaagacccgctgtcgaagcaagcgttcggagcagtcaatggacatgggtacaagtgcccttagcaaaaaaccatggtggacattgccacagaatttccatgctccaatggtttttcacatggaagaagatcaagaagagctgatcttcggccacggcgatacatatctacgctgtatcgaagtgcactcgcacacccttatccaactggagtcgtggtttacagcaaccggccagacacgggttaccgtggtcggaccccaccgggccaggcagtggctgctgcacatgttctgctgcgtggggtctcaagactcataccaccacgctagagggctggagatgctggagcgagtgaggtcccagccactaaccaatgacgatctagtaacctccatttctgtgcctccctacactggagatctgtcactggccccgaggatttcaggcacagtgtgcctctcagtcccacagccctccccatatcaggtcataggatgctctggctttcatctttcctctttgtacccctag

SEQ ID NO: 121522 - DNA, 297 bp, Artificial Sequence
  Description of Artificial Sequence: Synthetic coding sequence
atggatatgggaaccagcgccctcagtaaaaaaccttggtggacactgccacagaattttcatgcccccatggtattccacatggaggaggatcaagaggaattgatttttgggcatggggatacgtatctccgatgcatcgaagtgcacagtcacactttaatccagctagagtcctggtttaccgccaccggccagactagagtcacagtcgtcggaccccaccgcgccaggcaatggctcctgcacatgttttgttgtgtcggctctcaggatagttaccaccatgcacgctag

SEQ ID NO: 121523 - DNA, 2133 bp, Artificial Sequence
  Description of Artificial Sequence: Synthetic coding sequence
atgtccgattacagcacaggcggcccgccgccaggccctccaccacctgccgggggagggggaggcgctgggggcgcggggggaggacctccaccagggcccccgggggccggggatagagggggaggtggaccaggcggaggaggccctggcggcgggtccgccgggggaccttcccagccaccgggcgggggtgggccaggtatcagaaaagatgcctttgcggacgctgtgcagcgcgcacggcagattgccgctaagatcgggggtgacgccgccactaccgtgaacaacagcacaccggactttggtttcggagggcaaaagcgccaactggaggacggcgaccagcccgagagtaaaaaactggccagtcagggggactccattagctcacaactggggccaatccaccctcctccgcgcacttccatgactgaggaatatagagtgcccgatggcatggtcgggctgataatcgggcgagggggtgagcaaataaacaagattcagcaggatagtggttgtaaagttcagatcagtccagatagtggaggtttacctgaaagaagtgtgtccctgactggagctcccgagtccgtgcagaaggccaagatgatgctggatgacattgtgtcccgtggccgcgggggcccacccggccagttccacgataacgctaacggaggccaaaatggaacggttcaggaaatcatgattcctgcaggtaaggctggcctcgtcataggaaagggaggggaaacaatcaagcagctccaagaacgagctggtgtgaaaatgattctcattcaggatggatctcaaaataccaacgtcgataagcccctgcgtataatcggagatccttataaggtgcagcaggcatgtgagatggtgatggatatccttcgcgagcgagaccaaggcggctttggcgatcgaaacgaatatgggtctcgcattggcggtgggattgatgtgcccgtccctcgtcatagcgtgggagttgtgattggacggtccggagaaatgattaaaaagatacagaacgacgccggcgtgcgaatccagtttaagcaagacgacggaacgggaccagagaaaattgcacatattatgggcccaccagataggtgcgagcacgctgcgagaatcatcaatgatctattacaaagtctgcgctccgggcctccagggccgccgggaggacctgggatgccccctggcggacgtggccgggggcgcggacagggtaactgggggccacctgggggggaaatgaccttctctatccccacccacaagtgtggattggtcattggaaggggcggggaaaacgtcaaagccatcaaccagcagacaggcgcattcgtggaaattagccgccagctgccacccaacggcgaccccaactttaagttatttattatccgagggtcaccacagcagatcgaccacgctaaacaactcatcgaagagaagatcgaagggcctctttgtcccgtgggccccggacccgggggacctggcccagccggacctatgggaccgtttaatcctggaccatttaaccaggggccacctggcgccccaccccatgctggaggcccgccaccacaccagtacccgccacaaggatggggcaatacctacccacaatggcagccacccgccccgcatgatccgtccaaggccgcggctgccgcagctgaccccaacgcagcatgggcggcatattattcgcactactatcagcaacccccaggtccggtgcctggacctgcgcctgctccggccgctccccccgcccagggtgagcccccacagcctcctcccacgggccagagtgactataccaaggcctgggaggagtactacaagaaaatcggccagcagccgcagcaacctggtgccccgccacaacaggactatacgaaggcatgggaggagtactacaagaaacaggcccaagtcgctacagggggggggcccggtgctccacctggcttcctcgcgccgcccacagtttttcagcccctactctcttccgctctagcccagcttccccggccaagacctagccccctcccggggctggtgtgttgtctgttcatttgttcccgaggcgactag

SEQ ID NO: 121524 - DNA, 2136 bp, Artificial Sequence
  Description of Artificial Sequence: Synthetic coding sequence
atgtcggactacagcaccggagggccaccacccgggcccccccctcccgccggcggcggcggcggtgccggaggtgctggtggaggtccacctcccggccctcctggtgccggtgaccgagggggtgggggaccagggggaggcggacccggggggggtagcgccgggggaccttcccagcccccagggggggggggtccaggcatcagaaaggatgccttcgccgatgcggtgcagcgggctcggcagatcgccgcaaagataggcggcgacgccgccacgacggtgaacaacagcacgcctgactttggatttggcggtcagaaacgtcagcttgaggacggcgaccaacccgagtctaaaaagttggcatctcagggggactcaatcagcagccaactggggcctatccaccctccaccacgtaccagtatgaccgaggaatacagggtgcctgatggaatggtcggcttgattatcggccgaggcggtgagcagataaataaaattcagcaggattctggttgtaaagtgcagatctcccctgattctggaggtttacccgagcggtcagtttcactgacgggagcgcccgaaagcgtgcagaaggcgaaaatgatgcttgatgacatcgtcagcagggggagaggtggtccgccagggcaatttcatgataacgccaacggcggccagaatggcacagtccaggagattatgatcccggccgggaaggccggtttggtgattggtaaaggcggggaaactatcaagcagctgcaggaacgtgctggggtcaagatgatcctgatccaagacggttcccagaatacaaacgtggataagccactgagaatcatcggggatccgtacaaggtgcagcaggcctgtgaaatggtgatggacatcctgcgcgagcgggatcagggtggtttcggggaccggaacgagtacggttctagaattgggggcggaattgacgtgcctgtcccgagacactccgtgggcgtggtcattgggcgaagcggcgagatgattaagaagatacaaaatgacgcaggtgttcgcatccagttcaagcaggatgacggcactggcccggaaaaaatcgcccacataatggggccaccagaccggtgcgaacatgcggcccgcatcatcaatgatcttctgcaaagcctccggtccggaccacccggtcccccgggcggaccagggatgccccccggtggccgcgggaggggacgcggtcagggtaactggggacctcctggcggagaaatgacattttctattccaactcataagtgtggcctcgtgataggacgcggaggagaaaacgtgaaagctattaatcagcagaccggagcattcgttgagataagccggcagttgcccccaaacggtgatcctaacttcaagctcttcataatcaggggaagtcctcagcagatagaccacgctaaacagcttattgaggagaaaattgaaggacctctgtgtcccgtgggcccaggaccaggcggaccaggccccgcagggcctatggggccttttaaccccggaccgtttaatcagggccctccaggcgccccgccccacgcaggaggacctccaccccatcagtatccccctcaggggtggggaaacacctatccgcagtggcaaccacccgccccacacgatccgagtaaggcagctgctgccgctgctgaccctaatgccgcttgggctgcctactatagtcattactatcagcagcccccaggccccgtgccgggacctgcccccgcacctgccgctcccccagcccagggagagcccccccaacctccaccgaccggacaatcggattacacaaaggcgtgggaagaatactacaagaagatcggacagcaacctcagcagcctggagcacccccacaacaggactacaccaaagcctgggaagagtactacaagaaacaggcgcaggtcgcaacaggtggaggacccggtgctccaccaggtagccagcccgactacagtgccgcttgggccgaatattaccggcaacaagcagcgtattatggacagacccccggccccggaggtccacagcccccgcccacccagcaaggtcagcagcaggcccagtag

SEQ ID NO: 121525 - DNA, 1095 bp, Artificial Sequence
  Description of Artificial Sequence: Synthetic coding sequence
atgtctgattacagtcccgggggtggtagcgcaggaggaccttctcagccacctggggggggcggaccaggcatacggaaagacgctttcgctgacgccgtccagagagcccgacagattgccgcgaagattggcggtgatgctgctactacggtcaacaatagtacacctgactttggattcggtgggcaaaaacgccaattggaggatggagaccaaccagaatccaaaaagctggcttcgcagggagatagcatctcttctcaactgggaccaattcaccctcccccacgcacctctatgacggaggagtacagagttccagacggcatggtcggactgatcatcgggcgcggcggcgagcagatcaataaaatacagcaggattctggatgcaaagtgcagatatctcccgactccggaggactgccggaaaggtcggtgtcactgacgggcgcacccgaaagcgtccagaaggcaaagatgatgctcgatgatattgtctctaggggacgaggcggtcctcccggccaattccatgacaatgcaaacggaggacaaaatggcacggtgcaggaaatcatgatccccgctgggaaagcagggctggtgatcggaaaaggtggcgaaactatcaaacagctgcaggagagagctggcgtcaagatgatcttgatacaggatggcagccaaaatactaacgttgataaaccattgagaattataggtgacccttataaagtacagcaggcatgcgaaatggttatggatattcttcgcgaacgggaccaaggggggttcggtgataggaatgagtatggcagccgtatcggcggaggcatagatgtgccagtaccacgccacagcgtgggcgtggtcattggtcgtagtggagaaatgattaagaagatccagaacgatgctggtgtccgcatccagtttaagcaagacgacggcacaggccccgagaaaattgcccacattatgggtccaccagatcggtgcgaacacgctgcccgcatcatcaatgatcctagtagctccagctttctactgcccacacctggccacaggcccagttgtctctccgggtag

SEQ ID NO: 121526 - DNA, 255 bp, Artificial Sequence
  Description of Artificial Sequence: Synthetic coding sequence
atggatgatgatgcggcgccacgcgtggaaggcgttcctgtggcggtgcacaagcacgctctccatgacgggctgcgtcaagtggcaggacctggagccgcagccgctcacctgccaagatggccaccgcctcaacttgccgcttcccgtcgggaggcacccccgctgtctcaaagaccccatcgaacccagggcgcagggagccctcccgagactaacgaaaagctgaccaatcctcaggtaaaggaaaaatag

SEQ ID NO: 121527 - DNA, 822 bp, Artificial Sequence
  Description of Artificial Sequence: Synthetic coding sequence
atgtctatgtctccaaccgtcattattctagcctgccttggctttttcctcgatcagtcagtgtgggcccacgtgggcgggcaggataagcccttttgttctgcctggcctagtgctgtcgttccccaaggcggccatgtaacactgcgctgtcattaccgtcgggggttcaatatctttacgttgtacaaaaaagatggggtccctgtcccggaactgtacaacaggattttctggaattcctttcttattagccctgtgacccccgcgcacgccggtacctacaggtgccgcggcttccatccgcactcacctaccgaatggagtgctcctagcaaccctttagtcataatggtaacgggcctctacgaaaagccttcgttgacagcccgtccaggccctaccgtgagagccggggagaatgtgaccctctcatgctcatcccagtccagcttcgacatttatcatctgtctagggaaggcgaggcccacgaacttcgtcttccagcagttccttcaataaacggcacatttcaagcagacttcccccttggtccagccactcacggtgagacgtacagatgtttcggatcattccatggctcgccttatgagtggagtgatcctagtgaccccctgcccgtgtctgtgactgggaacccaagctcaagctggcctagtccaactgaaccctcttttaagacaggcatcgctcgtcaccttcatgccgtgattcgatactcggtggccatcatcctgttcacgatcctacctttttttttacttcaccggtggtgttcgaaaaagaagatgctgctatag

SEQ ID NO: 121528 - DNA, 1269 bp, Artificial Sequence
  Description of Artificial Sequence: Synthetic coding sequence
atgggaggccaagataagcctttcctgtctgcctggccatccgcagttgttccaagaggcggccacgtcacattgagatgccactaccggcaccggttcaacaattttatgctgtataaggaggaccggatccatattccaatctttcatgggcgaatcttccaggaatccttcaacatgtctccagtgaccaccgcccatgctgggaattatacttgccgtggatctcacccccactcacccacgggctggtcagcacctagcaatcctgtcgttatcatggtgaccgggaatcatcggaagccgtctttgctagctcatcctggccccctcgtgaaaagcggagaacgcgtgatccttcaatgttggtctgatataatgttcgagcatttctttctgcacaaggagggtatcagtaaggatccaagtcgcttggtggggcagattcacgatggagtcagcaaggcaaattttagcattggacccatgatgttggcactggctggtacgtaccggtgctacggctctgtgacacacaccccctatcagttgagcgccccatctgacccgctggatattgttgtgaccggcccctatgagaagccatctctctccgcccaacccggacccaaggtgcaagcaggagagtcagtcactctcagctgtagttcgcgatccagctatgacatgtaccacctgagccgtgagggcggagcccacgagaggcgtcttcccgcagtcagaaaggtaaaccggacgttccaggcagactttccattaggacctgcaacccatgggggcacatataggtgttttggcagttttcggcactccccctatgagtggtccgatccctctgatccgctgttggtctctgtgaccggcaatccctccagttcttggcccagcccaacagagccatcgtccaaaagtgggaatccacgtcacctacatattctcataggaacctccgtagtcattatattattcatcctgctcttattcttcctgcttcacctctggtgctctaataaaaagaatgctgcagtgatggaccaagagccggcgggtaaccggactgccaatagtgaagattccgatgagcaggatcctgaggaggttacgtacgctcagctcgaccattgtgtatttactcagcgcaagatcactcggccgagtcagagacccaaaacccctcccaccgataccattttgtacacagaactgcctaacgcaaagccacggagcaaggtcgtgtcgtgtccttag

SEQ ID NO: 121529 - DNA, 1050 bp, Artificial Sequence
  Description of Artificial Sequence: Synthetic coding sequence
atgtctttaatggtcgtgtctatggcctgcgttggactgttccttgtgcaacgtgccggccctcacatgggcaaccacagaaagccatcgttgttggcccatcccgggcccctggtgaagtcaggcgaacgagtgatcttgcagtgttggtccgatatcatgtttgagcacttttttctgcacaaagaaggcatcagcaaagatcccagtaggctggttggtcaaatccatgatggtgtgagcaaggcaaacttctctattggcccgatgatgcttgccttagctggaacgtaccgctgttatggcagtgtgactcacactccctatcagttgagtgctccatctgatcccctcgacatcgtggtaaccggcccctacgaaaaacctagcctctcagcgcagcctggaccaaaggtgcaggctggtgagtccgtgacactgagctgctcctcccgaagtagctatgatatgtaccacctttcacgcgaagggggggcacacgaacgtagactgcctgccgtgcggaaggtgaaccggacattccaggccgatttccccctgggccccgccactcatgggggtacctaccgatgcttcggatcattccgacatagtccctacgagtggtctgacccatcagaccccctattggtgagtgtgacaggaaaccccagcagttcttggccctctccaaccgaaccctcttctaagtccggtaaccctaggcacctgcacattctgattggcacttccgtcgtcatcatcctgtttatcctgctcttgttctttcttctgcatttatggtgtagcaataagaaaaacgccgcagttatggatcaggagccagccggaaatcgaaccgctaattcagaggactccgacgaacaagatcccgaggaggtaacctacgctcagttagatcattgtgtcttcacccagaggaaaatcacacgcccttcacaacggccaaaaaccccacctactgatacaattctttatacagagctgccgaacgccaagccaaggtctaaggtggtgagctgtccatag

SEQ ID NO: 121530 - DNA, 1335 bp, Artificial Sequence
  Description of Artificial Sequence: Synthetic coding sequence
atgagcctaatggtggtgagcatggcttgtgtcggtctgtttttggtgcaacgggctggcccacacatgggtgggcaagataagccttttctgtcagcgtggcccagcgctgtggtaccaagggggggccacgtgactctacggtgtcactatagacatcgctttaataatttcatgctctacaaagaggaccgtatccacattcccatattccatggccggatctttcaagagagttttaacatgtccccagtaaccacggcgcacgcaggtaactatacatgtaggggatctcacccacacagcccgactggttggtctgctccgagcaaccccgtcgtgatcatggtgaccggaaatcatcgaaagccatctctcttggcgcaccccggccccttggtgaagtctggcgagcgggtgatcctccagtgttggtccgacattatgtttgagcacttttttctgcataaagaaggcatctccaaggatccgagtaggcttgtcggacaaatccacgacggggtctctaaggccaatttttctataggcccaatgatgctcgccctggcaggcacctacaggtgctacggttctgtgacacacaccccttatcagctgagcgcacccagcgaccccttggacatcgtcgttaccgggccttacgagaaaccctctttaagcgcccagccagggcctaaggtccaggcgggagaatctgtcacactgtcctgtagctcacggtcctcttatgacatgtaccaccttagcagggaaggcggagcacacgagcgacgactgcccgccgtgcgtaaagtcaacaggacttttcaggccgacttccctcttggtcccgctacccacggcggcacttatagatgctttggctcatttcgccattctccctacgagtggtccgaccccagcgaccccttgctggtcagtgttacggggaacccaagcagcagctggccatcccctacagaaccaagctcaaagtccggcaatccaaggcacctgcacattcttattggcactagcgttgttataatcctctttatcttactcctgtttttcctgttacatctgtggtgtagcaacaagaaaaatgctgccgttatggatcaggaacctgcgggaaatagaaccgctaactccgaggactctgacgaacaagaccctgaggaggtcacttatgcacagctggaccattgtgtattcacacagagaaaaataactagaccctcccaaaggccaaaaacccctccaacggacaccatcctctataccgagcttcccaatgccaagcccaggtccaaggtcgtgagctgcccctag

SEQ ID NO: 121531 - DNA, 1368 bp, Artificial Sequence
  Description of Artificial Sequence: Synthetic coding sequence
atgagcctgatggttgtgtcaatggcctgtgtcggactgtttctcgttcagcgcgccgggccccacatgggcggtcaagacaagccttttctttcggcatggcctagtgctgtggtgccgcgggggggccacgtgacgctgagatgccattatagacacaggtttaataatttcatgctctacaaagaggacaggatccatatcccaatcttccacgggagaatctttcaggaaagctttaacatgagccctgttactaccgcccacgctgggaactacacctgcagagggtctcatccacactcaccaaccggctggtcagcaccatccaatcccgtggttataatggtaactggcaaccataggaagccttctcttctcgcccaccctggacccttggtaaagtcaggcgagcgagtcattctgcagtgttggtccgatataatgtttgaacattttttcttacacaaagaaggaatatctaaggacccctctcgtctggtgggccaaatccatgatggggtcagcaaggccaacttcagtattggacctatgatgttggctctcgcagggacatatcgatgttacgggtctgtaacacacacaccatatcagctgagcgccccttcggatcctttagatatcgtcgtcaccggcccttacgagaagcccagcctaagtgcccaacctggtcccaaggttcaggccggtgagtccgttaccctctcgtgctcctcaaggtcatcatacgatatgtatcatttaagtagggaagggggcgcccatgaacggagactaccagccgttcggaaagtgaaccgcacctttcaggctgattttcccctgggacctgctacccacggcggaacataccgatgttttggcagctttcggcattctccctacgaatggagcgacccttctgaccccctgctagtgtctgtgaccggcaacccaagctcctcttggccctctcctactgaaccctcctccaagtccggcatttgccgacatctacacgtcctcattgggacatccgtcgttattttcttgttcatcctgttactgttctttttactctaccggtggtgtagtaataagaaaaatgccgccgtgatggaccaagaaccagccggggaccgaacagtgaataggcaggacagcgacgagcaggacccccaggaagtgacctatgcccagctggaccactgtgtgttcatccagcggaagattagccgtccgagtcaacgacccaagacgccccttaccgacacttctgtgtacacagagttgcccaatgcagagccccgatctaaggtggtgagttgtccacgggcaccgcaatccggtctcgaaggcgtgttctag

SEQ ID NO: 121532 - DNA, 1335 bp, Artificial Sequence
  Description of Artificial Sequence: Synthetic coding sequence
atgagtctgatggtggtcagcatggcctgcgttgggttgtttctggtccagcgcgcagggccgcatatgggcggacaggacaagccttttctgagcgcctggccgtcagcagtcgtgccaaggggaggccatgtgacccttaggtgtcactacagacatcgcttcaataacttcatgctgtataaggaggaccggatccacatcccaatattccatgggcgcatttttcaggagagcttcaatatgagcccggtcacgactgctcatgctgggaactacacttgccgagggtctcatccgcacagtcctactggatggtccgctccaagcaatccagttgtgattatggtgacaggaaatcacagaaagccaagtctgttagcccaccccggccccctggtaaaaagcggtgagcgcgttattctccagtgctggtcagatatcatgttcgagcactttttcttgcataaggaaggtatttcgaaggatccctcccggctagtcggacagatacatgacggagtcagcaaggcaaacttctcaatcggccctatgatgctggctcttgccggcacctatcggtgttatggctctgtgacccatactccataccagctctctgcgccgtcggacccccttgatatcgtggttacaggtccgtatgagaaaccatctctgagcgctcaacccgggcccaaagtgcaggccggcgagtccgtgacactgtcatgctcttcacgtagctcttatgacatgtatcacctatcaagagagggcggagctcatgaacggaggctgcctgccgtacgtaaggtaaaccggacattccaagcggatttcccactgggccctgcgacccatggaggcacctatagatgctttggtagtttcagacactccccctatgagtggtctgatccgtctgatcctctgcttgtaagtgtgacaggtaacccatcatcatcttggccctccccgacagagcccagctctaagagtggcaacccacgccatctccacatccttatcgggactagcgtggtgattatcctgttcatcttattactctttttcctgttgcatctgtggtgttcaaataaaaagaatgcggcggtgatggatcaggagccagctggcaatagaacggcaaacagtgaggactctgatgaacaggatccagaagaggtgacttacgcacagcttgaccattgcgtgtttacccaacgtaagatcacccggcctagccagagaccaaaaacccctccgactgatacaatcctgtacaccgagcttccaaacgccaagcctcgaagcaaagttgtgtcctgcccgtag

SEQ ID NO: 121533 - DNA, 1284 bp, Artificial Sequence
  Description of Artificial Sequence: Synthetic coding sequence
atgtctttgatggtcgtctcaatggcctgcgtcggtctgttcctggtgcaacgcgctggcccccatatgggaggtcaggacaaaccctttctgtccgcctggccatcagccgtggtgccccgcggcggacacgtcacgctgcggtgtcattaccgacaccgctttaacaatttcatgctgtacaaggaagataggatacatatccctatcttccacggtcgtatcttccaggaatctttcaacatgtcccccgtcaccacagctcacgcgggaaattacacgtgtagggggtcacatcctcattctcccaccgggtggagtgcccctagtaaccctgtcgtgattatggtaaccggcaaccatcggaagccatcattgctggcgcatccagggccactggtcaaaagtggggaacgtgtcattctccagtgttggtcagatataatgtttgagcattttttcttacacaaggaaggaatttcgaaagacccatccagactggtgggacagatacacgacggggtcagtaaagctaatttttctattggtccgatgatgctggcactggcgggaacgtaccgctgttacggaagtgtgacccacacaccctatcagctttcagccccaagcgaccccctggatatagtggtaaccggtccatatgagaagccgagcctatcagcacaacctggtccgaaggtgcaggctggcgagtctgtcaccctctcctgcagttccaggtctagctacgatatgtaccatttgagccgcgagggtggcgcccacgaacggagactgccggccgtaaggaaggtcaaccggactttccaggccgatttcccgcttggtcccgcgacacatggcgggacttatcggtgcttcggctcctttcgccactcaccttatgaatggagtgacccaagcgacccccttctcgtttccgtgaccggtaatcccaggcacctccacattctgataggcacttctgtagtgattattctgttcattctgcttctttttttcctgctgcatttatggtgtagtaacaagaaaaacgccgctgtgatggaccaggaaccagctggcaacagaacagcaaactcagaggactcagatgagcaggaccctgaagaggtcacctatgctcagttggaccactgtgttttcactcagaggaaaattacacgcccttcccagcgccctaaaactccaccaaccgacacaattctgtacactgagttgccgaacgcgaaaccacgctcaaaagtcgtgtcttgtccatag

SEQ ID NO: 121534 - DNA, 1368 bp, Artificial Sequence
  Description of Artificial Sequence: Synthetic coding sequence
atgtctctgactgtggtcagcatggcttgtgtgggcttcttcctccttcaaggtgcctggcctctgatggggggccaagacaaacctttcttatcagctcgcccatctacggtcgtgccgagagggggacatgtcgctctccagtgccattaccgcagaggctttaataatttcatgctgtacaaggaggataggtcccacgtgcctattttccacgggaggatcttccaggaatccttcatcatgggacccgtcaccccagcccatgcagggacgtatcggtgtcgggggtccagacctcattcccttactggctggagcgccccctccaatccccttgtgattatggtaacggggaaccaccgaaagccatccctcctggcccacccaggccccctgcttaaatctggtgagacggtgatactgcagtgctggagtgacgtaatgttcgagcacttctttcttcaccgcgaaggcatctcagaagacccttcccgtttggtggggcagattcacgacggcgtgtccaaagccaatttctctatcggacccctcatgcccgtgctagcaggcacttaccggtgctacggatctgtgcctcattccccctatcagttgtccgctccctccgatccacttgatatcgtgatcactgggctctacgagaaaccatcgctgagcgcccagcccgggccaacagtgcaagctggggaaaacgtaacactatcatgctctagctggagttcgtatgatatctaccacctgtccagagagggagaggcgcacgagcgacggctgcgcgctgtgccaaaagtgaacagaaccttccaggccgatttccctctcgggccggccactcatgggggcacataccggtgtttcggttcatttcgggcgcttccttgtgtgtggagtaattcaagcgatcctctgctggttagtgtgactggcaaccccagctcctcctggccctcacctacagagccgtcctccaaatcgggaatttgccggcacctccacgttctgattggtacctccgtagtcatctttctgtttattctgctgctcttcttcctgctgtaccggtggtgttccaataaaaagaacgccgcagtcatggatcaagagcctgctggcgaccgcacagtgaatcgccaggattctgacgagcaagacccacaggaggttacatatgcacagctggaccattgcgtgttcattcaacgtaaaatctcccgcccctctcagcgacctaagacacccctaaccgacacttccgtttataccgaactgccgaacgccgagcctcgaagcaaggtggtctcctgcccgagagccccacagtctggacttgaaggtgttttttag

SEQ ID NO: 121535 - DNA, 1047 bp, Artificial Sequence
  Description of Artificial Sequence: Synthetic coding sequence
atgagcctgatggtagtgtccatggcctgcgtggggttttttcttctgcagggggcgtggcctcacgagggagtacataggaagccttcactcctcgcccaccccggccgcttggtaaagtcagaagagactgtgatattacagtgttggtcggacgtccggttcgagcacttcctgttacacagggaagggaagtttaaggatactctgcacctgattggtgagcaccatgatggggtgtcaaaagccaatttctctattggccccatgatgcaggatttggccggtacatatcgctgctatggcagtgtgacccacagcccataccagctatctgcgcccagtgatcccctggatattgtaatcactggcttgtatgagaagcctagtctttccgcacagccaggcccgaccgtgcttgctggggaaagcgttaccctgtcctgttcgtctcgcagcagctatgatatgtatcatttgagtcgcgaaggtgaggcccatgaatgtcggttctcggccggcccaaaagtgaatggtacattccaggcggatttccctttggggcctgccactcatggtggaacctatagatgcttcgggtcttttagggatagcccctatgaatggagcaactctagcgatccactgcttgtgtccgtgacaggaaacccatccaacagttggccatctccaacagaacccagctctaaaactggcaaccctcggcatctccatatactcattggcacttccgtggtcataatcttgttcatcttgctgttcttcctattgcaccgatggtgttcgaacaaaaagaacgcagctgtgatggaccaggaaagtgccggcaatcgtaccgctaattcagaggactcagacgagcaggatccacaggaagtaacatacacccagcttaaccactgtgtgttcacacagaggaaaatcacccgccctagtcagcggccaaagactccccccacagatattatagtgtatacagaattgcccaacgccgagtccagatccaaagtggtctcatgcccatag

SEQ ID NO: 121536 - DNA, 1128 bp, Artificial Sequence
  Description of Artificial Sequence: Synthetic coding sequence
atgtccctcatggtggtatccatggcttgcgtgggttttttcttgctccaaggcgcttggccgcatgaagggggccaggacaaacccctcttaagcgcgtggccaagcgctgttgtgcccagggggggacatgtaacccttctatgcaggtctcgactgggcttcactattttcagcctctacaaagaagatggtgtgccagtgccggagctctataataaaatcttctggaaaagcattttgatgggcccggttacacctgcgcatgcgggaacataccgctgtcgcgggtcccacccgcgcagtcctatcgagtggagtgcccctagtaaccccctcgtgattgtggttaccgggttgtttggcaaaccaagcttgtcagcgcaaccgggccccacagttcgaactggagaaaatgtcacgctgtcatgcagcagcagaagctccttcgatatgtatcatctgagtcgtgagggccgtgcgcacgaaccaagactgcctgcagttccatcagtcaacgggaccttccaggccgattttcctctggggcctgcaacgcacggtggaacctacacctgcttcggatcccttcacgatagtccctatgaatggtccgacccgagcgacccccttctcgttagcgtcacaggtaactcctcctccagttcttcatctcctactgaacccagctccaaaaccggcatacggagacaccttcacattctgatcggtaccagcgttgccatcatcttgttcatcatcttgttttttttcctcctccattgttgctgcagcaacaagaaaaatgcagctgtgatggatcaagagcctgcaggagatcggaccgtcaacagggaagattctgatgaccaggacccccaggaagtgacctacgcccagttggaccactgcgttttcactcaaaccaaaattaccagcccaagccagcgccccaaaactccacctactgacacaaccatgtatatggagctacctaatgctaagccaagatcattaagccccgcccacaagcatcatagccaggccctgaggggaagctcgcgagagaccaccgcactgtctcagaatcgcgtcgccagttcccacgtgccagccgcaggaatttag

SEQ ID NO: 121537 - DNA, 1128 bp, Artificial Sequence
  Description of Artificial Sequence: Synthetic coding sequence
atgtctctgatggtgatcagtatggcctgcgtcggtttctttctgctgcagggcgcatggactcacgagggcgggcaagataagcctttactgtcggcttggccctctgctgtcgttccccgtggcggacacgtgaccttattgtgccgcagtagactgggcttcactatttttagcctctataaggaggacggcgtccccgtgcccgagctgtataataagatattctggaagagtatcctgatgggccctgtgacacccgctcacgcaggcacataccgatgtcgcggatctcacccacgctctcccattgagtggagtgcgccttccaacccactggtcatagttgtaacgggcctttttggaaaaccctctctctcagctcaaccaggacctacagtcagaacaggcgaaaatgtgaccctcagttgctcgagtcgttctagcttcgatatgtaccacctgtcgagagaaggccgggcacacgagcctcgtctcccagccgtacccagcgtgaatggcacttttcaagccgattttcctctcggccccgctacacatgggggaacgtacacatgctttggctccctccatgatagcccgtatgagtggtccgatccttcggacccccttctggtctcggtgaccggaaattcctcatcgagtagcagttcgccgacagagccaagtagtaaaaccggaatcagacggcacctacacattttgataggtactagtgtagcaatcatcctgtttataatcctgtttttctttcttttgcactgttgttgctcaaataaaaaaaatgccgctgtaatggaccaagagcctgctggcgaccgcacggtgaacagggaagattcagacgatcaggaccctcaggaagtgacatacgcccagcttgaccattgtgtgttcacccaaaccaaaattacttctccgtctcagaggccaaaaacccctcctacagataccactatgtatatggaactcccgaatgccaagccccgtagtctctcaccagcacacaaacatcattctcaagccctgcgcggctcgtctcgtgagactacagcgctcagtcagaatagggtcgccagttctcatgtgccagccgccggtatctag

SEQ ID NO: 121538 - DNA, 1164 bp, Artificial Sequence
  Description of Artificial Sequence: Synthetic coding sequence
atgtctttaatggtcgtctcaatggcatgtgtgggcttattcctggtgcagagggcaggacctcatatgggcggccaggacaagccgtttttgtcggcatggccaagtgctgtagtcccccggggtggacacgtgaccttgaggtgtcattaccgccataggttcaataatttcatgctgtacaaagaagacagaatccacgtgcctatttttcacgggaggatttttcaagagggatttaacatgagtcctgtcaccacagcccacgcagggaactatacatgtcgggggtcacacccccacagtccgacgggctggtccgccccttccaatccgatggtgatcatggtcacggggaatcaccgtaaacccagtctgctcgcccaccctggtccactggtcaaaagtggagaacgcgtcatccttcagtgctggagcgacatcatgttcgagcacttcttcttgcataaggagtggatcagtaaggacccgtcccgcctcgtcggtcaaattcatgatggcgtgtcgaaagcaaactttagcatcgggtctatgatgagagctctggcgggcacctatcgatgctacggttctgtcactcacaccccttaccagctcagtgcaccctcagacccacttgacattgtggttacaggtctttatgagaaaccaagcctctccgctcaaccagggccaaaggttcaggccggcgagtccgtcacactcagttgttcaagccgttcctcatatgatatgtaccacctgtcccgcgaggggggagcacatgagagaaggttaccggctgttcggaaggtcaacaggaccttccaagctgatttccctctgggaccggccacccatggcgggacctataggtgcttcggtagttttcgccactccccttacgagtggagcgaccccagtgatccgctgctggtctccgttactggcaacccttcaagctcatggccgagccccaccgagccttcttccaagtcgggaaacctgcggcacctgcatattctgatcggcacctctgtggtgaaaattcccttcacgatcctcctcttctttctgttgcaccggtggtgcagcaacaagaagaacgccgctgttatggaccaagagcctgcagggaatcggtcagaacagcgcggcttctag

SEQ ID NO: 121539 - DNA, 1149 bp, Artificial Sequence
  Description of Artificial Sequence: Synthetic coding sequence
atgctgctcatggtcgtgtcaatggcctgtgtcgggctatttctagtccagcgcgcagggccgcatatgggaggccaagacaaaccttttctgagcgcttggccgagcgcagtggtccccagaggcggtcacgttaccttaaggtgtcactaccgccacagatttaacaattttatgctgtacaaagaggatcgaatacacgtgcccatctttcatgggagaatcttccaagaaggctttaatatgtccccagttactaccgcacacgcaggcaattatacatgcagaggctcacatcctcatagccccacgggatggtcggcgccttcgaatccgatggtgattatggtcactggaaatcatcgcaagcccagcttgttagcccacccaggtccactggtcaagtccggagaacgcgttatcctgcaatgttggtctgacataatgttcgagcattttttcttacataaggaatggatatccaaagatccatctcgactggtgggccaaatccacgacggtgtcagcaaggcaaatttttcaataggaagcatgatgcgggccctagcaggcacatatcggtgttacggatctgtgactcacacaccctatcagttatcagctccgtcagatccactggatattgtcgtaacaggcctctacgagaaaccttctctctcagcccaacccgggcccaaggttcaggccggggaatcggttactctctcatgctcatccagatcttcgtatgacatgtatcacctgtctcgagagggcggggcccacgagagacgtctgcccgccgtgagaaaggtgaacagaacttttcaagctgattttccgcttggtcctgcaacccacggcggcacgtacagatgtttcggatccttccgccatagcccgtatgagtggtcagacccgtctgatccgttattggtgtccgttacagggaacccctcttcaagttggccgtctccaacggagccgagtagcaagtccggaaatctccgccatttacatatactgatcggaacgtctgttgtcaaaattcccttcacaattctgttattctttcttctgcatagatggtgctccaacaagaaaaagtgctgctgcaacggcccacgtgcctgcagggaacagaagtag

SEQ ID NO: 121540 - DNA, 1194 bp, Artificial Sequence
  Description of Artificial Sequence: Synthetic coding sequence
atgtctctgatggtggtcagtatggcatgtgttggattcttcctggatcagagcgtctgggcacatgtgggaggtcaggacaagcccttttgctcggcatggccatcagctgtagtgccccagggcggtcacgtgactttaagatgtcattgcagaagagggtttaatatcttcaccctttacaaaaaggacggggtgcccgtccccgaactctataacagaatcttctggaacagctttcttatctcaccagtgacacctgcccatgccggcacatatcgatgtcgcggttttcatccccacagcccgaccgagtggtctgcaccttctaaccctctggttattatggttaccgggctctacgagaaaccctcactcaccgctcgccctggtcccaccgtccgtgcgggcgagaacgttacgctgagttgttccagccagtctagcttcgacatttatcatttatcgagagaaggtgaggcccacgaattgagactgccagctgttccctctatcaacggcacatttcaggctgattttcctctgggtcctgctacccatggagaaacttacaggtgcttcggatcatttcatggatccccatatgagtggagcgaccctagtgacccactgcctgtgtcggtgaccggaaatcctagctcttcctggccttcccctacggagccatctttcaagaccggtatagccaggcatctccacgccgtgattagatacagtgtggcaattattctgttcacaattcttccgttctttctactgcaccgctggtgctccaaaaagaaggttagcctgaccaagcagcggcctgagaactcgggcccatgcgctgaggcggggtgggagcacgcggatgccgccgtcatgaaccaagaacctgcaggccacaggactgtgaatcgagaggattctgacgagcaggatcctcaagaggtgacatacgcacagctggaccactgtatctttacccagagaaagatcacaggcccttctcagcggtcaaagcgtccctccaccgacacgtccgtgtgcatcgagctccccaatgctgaaccgagggcgctcagtccagcacatgaacaccactcccaggcattgatggggagttcccgggagacaaccgcactgagtcagacgcaacttgcctcttccaatgtacctgccgccggaatatag

SEQ ID NO: 121541 - DNA, 1029 bp, Artificial Sequence
  Description of Artificial Sequence: Synthetic coding sequence
atgtccatgagccccaccgtgatcatattagcgtgcctgggattcttcctagaccaaagtgtgtgggcccacgtcggcggccaggacaagcctttttgctcagcttggccctccgccgtcgtacctcagggcgggcatgttacgctacgatgccactgcaggagaggattcaatatctttacgctatacaaaaaagatggcgtgccagtccccgaactgtataacaggatcttttggaattccttcctaataagccccgtaacccctgcacacgctgggacctataggtgccgggggtttcacccacattcacctactgaatggtccgccccctctaatcccctcgttattatggtgacagggctgtacgaaaagccttccctcacggcccgtccgggaccaaccgtgcgcgccggggagaacgtgacgctctcatgtagtagtcagtctagtttcgacatctaccatctttctcgcgaaggggaggctcatgaactgcggctacccgccgtccctagtatcaatggaactttccaggcagatttccccctcggacctgctacgcacggcgagacttatcgttgtttcggttccttccacgggtcaccctatgagtggtcagacccctctgatccgttgcccgtttccgtgacagggaacccctcatcgtcctggccatcccccaccgaacctagctttaagacggacgctgccgtcatgaatcaggaacctgcaggacatcgtaccgtgaacagagaggactccgatgagcaggaccctcaggaagttacttatgcgcaattagatcattgtatttttacgcagcgcaaaattactgggccgagccaaagatcgaaacgcccgtccaccgacacttccgtgtgtatcgagctcccaaatgccgaaccccgggcattgagtccagcccacgaacatcactctcaagctctgatgggatccagcagagagaccacggccttgtcacagactcagctcgcatcatctaatgtcccggctgccgggatttag

SEQ ID NO: 121542 - DNA, 1083 bp, Artificial Sequence
  Description of Artificial Sequence: Synthetic coding sequence
atgtcgatgagtccaaccgtgattattctggcatgtttgggatttttccttgatcagtcagtatgggctcacgtaggagggcaggataaaccattttgttcagcttggccctcggccgtggtgcctcaagggggacacgtcacactcagatgtcactgcaggagaggattcaacatttttactctgtacaagaaggatggggttcccgtgcccgaactgtacaacagaatattttggaattccttcctgatcagcccagtgacaccagcacacgccggaacctacaggtgcaggggcttccatcctcattcaccaacagaatggagcgccccttctaatccacttgttatcatggtgactggactgtatgagaagcccagcctcacggccagaccaggacctacagtgagggctggggaaaacgtcaccctatcttgctcatctcagtcctccttcgacatctatcacttgtccagagagggtgaggctcatgagctgaggctgccggccgtgccatccatcaatggcacctttcaggctgattttccattaggacctgccacccatggcgaaacctaccgatgcttcgggagctttcatggatcgccatacgaatggtctgatccaagtgaccctcttcctgtgtcggtgacaggaatagccaggcatctccatgccgtgatacggtacagcgtagcaataatcttgtttacaatcctcccattctttctgctgcatagatggtgctcaaagaagaagaatgcagccgtgatgaatcaggagccagcgggacatcgcactgttaatcgggaagattctgacgagcaggacccccaggaagtgacctacgcgcagctggaccactgtattttcacccagaggaaaataacgggaccatctcagaggagtaagcgcccaagcacggatacctctgtctgcatcgagttgcccaacgccgagccccgcgccctctcacccgcccacgaacaccatagtcaagcccttatggggagttctcgagagaccaccgctctgtctcaaacccagctggcttccagcaatgtgcctgccgcagggatctag

SEQ ID NO: 121543 - DNA, 1134 bp, Artificial Sequence
  Description of Artificial Sequence: Synthetic coding sequence
atgtccatgagtcccacagtcattatccttgcatgccttggatttttccttgatcagagcgtctgggctcacgttgggggccaggataagcctttttgctctgcctggccgtccgccgttgtccctcagggcggccacgtcacattgcggtgtcattgtagaagaggatttaacatcttcactctgtataagaaggacggtgttcccgtaccagagctgtataaccggatcttttggaacagcttcctcatctctccagtgacccccgctcacgccggcacttataggtgcagaggctttcacccccattctcccactgagtggtctgctccctccaaccctctggtcatcatggtgactggactgtacgaaaagccatctttgaccgcccgtcctgggcccacagtgcgtgcgggagagaacgtcacactgagttgtagttcacagagttcattcgacatctaccatctttctcgcgaaggggaggctcacgagctgcgcttgcctgcagtgccatctattaacgggaccttccaggctgactttcctctgggtccggctacccacggggagacctataggtgctttggctccttccacgggagcccgtacgagtggagcgatccctctgatccgctgcccgtctcggtcacagggaacccatcctcgagttggccctctccgaccgagccatcattcaaaaccggaatcgcacgacatcttcacgcagtcataaggtattcagtggctattatcctctttactatcctgccattttttctacttcatcgctggtgtagtaagaaaaaaaatgcggccgttatgaatcaggagcccgctggacacagaaccgttaaccgtgaagactctgacgagcaggatcctcaggaggttacttacgctcaactcgatcactgtatcttcactcaaagaaagattacaggaccgtctcagcggtcaaaaaggccaagcaccgacaccagcgtctgtatcgaacttccaaacgctgagcctcgcgctctttcccctgctcacgaacaccactctcaggctttgatggggagtagccgagagaccacggcactgtcccagacccagctggctagtagcaatgtgccagccgctgggatctag

SEQ ID NO: 121544 - DNA, 1233 bp, Artificial Sequence
  Description of Artificial Sequence: Synthetic coding sequence
atgagccttatggtcgttagtatggcctgtgtgggcttcttcctgctagagggcccatggccacatgtcggcggccaggataagccctttctcagcgcctggcctgggactgttgtgtctgaaggccagcatgtgaccctgcagtgccgttccagattgggattcaacgagttttcactctctaaggaggatgggatgccggtgcctgaattatacaacagaattttccgtaactctttcctgatgggcccagtgaccccggcacacgcaggaacatatcggtgttgtagttcccacccgcattctcctactggctggtcagctccatcaaatcccgtggtcataatggtgacgggggtgcaccgcaaacctagcctcctagcacaccccggaccactcgtcaaatctggagaaacggtgattctacagtgttggagtgatgtgcgctttgagagattcctgctgcacagagagggcatcaccgaagaccctcttcgtctcattggacagctgcacgacgccgggtctcaggttaactattctatgggcccaatgacgcctgcccttgcgggtacatacagatgtttcgggtctgttacacatttgccttatgaactgagcgctccctctgacccacttgacattgtcgtggtcgggttgtatgggaaaccatccctttccgctcagccaggtcccacggtccaggctggcgagaacgtcaccctgagttgctccagccgttcgctgtttgacatctaccatctgagcagggaggctgaggcaggggaactacgactgactgcggtgctaagagtaaatggtacattccaagcgaatttccctctgggccctgttactcatgggggcaattaccgctgctttggatcattccgcgctcttcctcatgcctggtcggatccttctgaccccctgccagttagcgtgactggcaactcacgctacctccacgccctcataggaacatcagtggtcataatacctttcgcaatattgctcttcttccttctgcacagatggtgtgcaaataaaaaaaacgcagtggttatggaccaggagccggcgggcaatcgcaccgttaatagggaggatagcgatgagcaggatcctcaggaggtgacttacgcccagctcaatcattgcgtcttcacccagcgcaagattacacgaccgtcccagagaccaaagaccccacctacagatacatccgtatag

SEQ ID NO: 121545 - DNA, 1047 bp, Artificial Sequence
  Description of Artificial Sequence: Synthetic coding sequence
atgagtctactggtagtgtcaatggcatgcgtcgggttttttctcctccagggagcttggccacatgagggggtgcatcggaaacccagcttactggcacacccaggcagacttgtcaaatctgaagagacagttattctgcagtgctggtccgatgtgatgtttgagcacttcttgttgcacagagagggaatgtttaacgatacactccggctgatcggagagcaccacgatggagtctctaaggctaattttagtattagcagaatgactcaggatctcgcgggtacatacagatgttacggcagcgtcacccacagcccttatcaggtgagtgctccatctgaccccctcgatattgtcattattggactgtatgagaagccatcccttagcgcacagctcggtcccactgtgctcgctggggaaaatgtcaccttatcctgtagctcccggagtagctacgatatgtaccatttaagccgggagggggaggcacacgaacgtagactgccagctggtcctaaagttaatggtacttttcaggccgacttccctctcggtccagccacccacggaggcacatacagatgcttcggcagttttcacgacagcccctacgaatggagcaagtcaagcgacccactcttggtgtctgtaaccggcaatcccagtaatagctggccttcaccaaccgagccctcctctaaaaccggcaatccccgccatctacatatcctgattggcacatcagtggtgataatactgttcatactgttgttctttctcctgcatcggtggtgtagcaacaaaaaaaatgccgcggtgatggaccaggagtccgctgggaatagaactgcgaactccgaagatagtgacgaacaggatccgcaggaagtgacgtatacccaactgaaccattgcgtgtttacacagcgtaagattacccgcccttcccagagaccaaagacaccccccaccgacatcattgtctacactgagctcccaaatgccgagtccaggagtaaggtggtgtcatgcccctag

SEQ ID NO: 121546 - DNA, 1026 bp, Artificial Sequence
  Description of Artificial Sequence: Synthetic coding sequence
atgagtctgatggttgtgtccatggtgtgcgtgggcttcttcctactgcagggagcatggcctcatgaaggcgtacaccgaaaacccagcttattagcccatcctggaccattagttaagagtgaggaaaccgtcattttgcagtgctggagcgacgtgcgctttcagcattttcttctgcacagagagggtaagtttaaggacactttacacttaataggcgagcaccatgatggcgtgagcaaggcaaactttagcatcggtccaatgatgcaggatttggcgggcacatacaggtgctacggatccgtaacgcacagtccttatcaactgtctgcccctagcgatcccctcgacattgtaatcactggcctgtacgaaaagccttccctgtctgcccagccaggtccgacggttttggccggggaatccgtgacgctctcttgctcctcccgctcgtcatatgacatgtaccatctcagtagagaaggcgaggctcacgaaaggcgctttagtgctgggccgaaggtgaacgggacattccaggctgattttccactcggccctgccacccacggggggacttaccggtgcttcggcagttttcgcgactcaccttatgagtggtccaactcatctgatcccctcctggtgtcagtgacaggtaatccctccaattcctggccttctcccaccgagccttcatctgaaaccggaaacccgaggcacttacatgtcttgattgggactagtgtcgtgatcatcctgttcattcttctgctgttcttcctcctgcaccgttggtgttgtaacaagaaaaatgccgtggtcatggatcaagaaccagcgggcaataggaccgtcaaccgcgaagattcggatgaacaagacccccaagaagtgacctatgcgcagctgaaccactgtgtattcacccaacgtaagatcaccaggccatctcagaggcccaagactccgccgaccgacatcattgtttatactgaattgcccaatgctgagccttag

SEQ ID NO: 121547 - DNA, 1047 bp, Artificial Sequence
  Description of Artificial Sequence: Synthetic coding sequence
atgtctttgatggtggtatcaatggtgtgtgtgggattttttctgcttcagggggcttggccccacgagggggtacaccggaaaccaagcctcctcgcacacccaggccctctggtaaaatcagaggagactgtgattctgcagtgttggtcagacgtacgattccaacacttcctactacacagggaggggaaatttaaggatactttgcatctaattggggaacatcatgacggtgtcagcaaggcaaatttttcgatcggcccaatgatgcaagacctggccggtacgtacagatgttacgggagcgtgacacactccccttaccagctctcagccccctctgatcccctagacattgtaattacaggcttgtatgagaagcccagtttgagtgcccagccgggacctaccgtactggccggcgaatctgttacgctgtcttgcagcagcagatcaagctacgatatgtatcatctgagtcgggagggcgaggcgcacgagcgcaggtttagtgcaggaccgaaagttaacggaacattccaggcagacttcccattggggcccgcaactcacggaggaacgtaccgctgtttcggcagtttccgggattccccgtatgaatggagtaactcatcagacccactgctcgtgtcggttaccgggaacccttccaacagctggccttcaccaaccgaaccctcatccaagaccggaaacccaagacatctgcacattttaattggcacaagtgtcgtaatcatcctgtttatcctgttgtttttccttttacaccgttggtgctcaaataaaaagaacgctgccgtgatggatcaggagagcgccggaaataggactgcgaactcagaggatagtgatgagcaggacccacaggaagtaacatatacccagctgaaccactgtgtgttcacacagcgcaaaatcactaggccttcacaaagaccaaagactccacccactgacattattgtttataccgaactgcccaacgctgagagcaggtccaaggtggttagttgtccatag

SEQ ID NO: 121548 - DNA, 1029 bp, Artificial Sequence
  Description of Artificial Sequence: Synthetic coding sequence
atgagtatgagccccactgtgataatcctcgcctgcctcggcttctttcttgatcagtctgtctgggcccacgtaggtgggcaggacaagcccttttgctctgcttggccctcagccgtggtgcctcaaggaggacacgtgaccttgcgctgccattacaggaggggttttaacatcttcacattgtacaagaaggacggagtgcctgtgcctgaactgtataaccggattttctggaatagtttcttgatttctcccgtgaccccggcacatgctggcacataccggtgtcgtggctttcatccgcacagccccaccgagtggagtgccccttctaatcccttggtcatcatggttaccgggctatacgaaaaaccctccctaaccgctcgcccaggtccaaccgtaagggccggcgagaatgtgaccctgtcttgctcctcccagtcaagcttcgacatctaccacctctcaagggaaggcgaggcacacgagctccgtctgcctgcagtcccgagtattaacggaacctttcaggccgacttccccttaggaccggccacacacggggaaacctacaggtgctttggatctttccacggttctccttatgaatggtccgatcctagtgacccccttcccgtgagtgtgacagggaaccctagttcaagctggccctcccctacagaaccttcctttaagacagacgcagccgtgatgaaccaggaacctgcaggccatcgcacggtaaaccgagaggacagtgacgaacaggacccccaagaggtcacatacgcccagctggaccactgcatttttacgcagaggaaaattacaggaccatctcagaggtcgaagcgcccctccactgacacttccgtctgcatcgagctcccaaatgcggagccccgcgccctgtccccggctcacgagcaccacagccaggcattgatgggctctagcagagaaacgaccgcactgagccagacacagctggcatcctccaacgtcccggccgctggaatatag

SEQ ID NO: 121549 - DNA, 978 bp, Artificial Sequence
  Description of Artificial Sequence: Synthetic coding sequence
atgtctatgtctcccacagtcattatcttagcctgcctcgggtttttcttagatcagtcggtgtgggctcatgttggagggcaagataaacccttttgttccgcctggccatcagcggtcgtaccacagggaggacacgtgactctccgctgtcactacaggcggggctttaacatctttactctgtacaagaaggacggcgtcccagtaccagaactttacaaccgcatcttttggaattccttcctgatctctcccgtgaccccagcccacgcaggcacctacagatgccgcggctttcacccccattctccgaccgagtggagcgccccatccaatccgcttgttattatggttaccggcctgtacgaaaagccttccttaacggcacgtcccggtcctactgtgcgcgctggggaaaacgtgactctcagttgcagttcacagtcatccttcgacatctaccatctgagtcgcgaaggcgaggctcatgaattacgcctcccagccgttcccagcatcaatggcacctttcaggccgattttccccttggtcctgcaacgcatggcgaaacttataggtgcttcggctcgtttcatggctcaccctatgaatggtccgacccgtctgatcccctccccgtctctgtcaccgacgcggccgttatgaatcaggagcccgcaggtcacaggacggttaacagagaggatagcgacgagcaggacccccaggaggtcacttacgcccagctggaccattgcatcttcacccagaggaaaatcacgggcccatcccaaaggagcaagagaccaagcaccgatacatcggtctgtatcgagctgcctaatgctgaaccccgcgccctgtctcccgcgcatgagcaccactctcaagcacttatgggatcgtccagggaaacgaccgccctcagtcagacacaactggcgtcttccaacgttccagcggccggcatttag

SEQ ID NO: 121550 - DNA, 1194 bp, Artificial Sequence
  Description of Artificial Sequence: Synthetic coding sequence
atgtcacttatggtggttagcatggcttgtgtgggctttttcctagaccagtcagtttgggcccacgtgggaggacaagataagccattttgctccgcatggccctctgctgttgtgccgcaggggggacacgttactttaagatgccactatagacgtggattcaatatatttactttgtacaagaaggatggcgttcccgtgcctgaactttacaataggatcttctggaacagcttcctcattagtcccgtgaccccagcccacgcaggcacttatagatgccggggattccatcctcattctcctaccgagtggagcgccccctccaacccccttgttatcatggtgacaggcttatacgagaagccgagtttgacagcccgcccagggccaacggtaagagcgggtgagaacgtcacactatcctgtagctcccaaagtagcttcgacatctatcatttatctagagagggtgaagcccacgagttgcgacttccagcggtgcccagcataaatggcacttttcaggctgacttccctctgggacccgcaactcatggtgaaacgtatagatgttttgggagtttccacggaagcccatacgagtggtcggatcctagtgaccctctgcctgtctccgtgactggaaacccttctagctcttggccctcacccactgagccatcattcaaaactggcatagcgagacacctgcacgctgtgatccgatactcagtggccatcatcctgtttacaatactcccattcttcttattgcatcggtggtgtagcaaaaaaaaggtatcactgaccaagcagcgaccagagaacagtggcccctgcgcagaggccggatgggagcatgctgatgccgcagtgatgaaccaagagcccgccggtcaccgtactgtaaatcgggaagacagcgacgagcaagatcctcaagaggttacctatgctcaattggaccattgcatattcacccaaaggaagataaccggtccttcccaacgcagtaaacggccttcaactgacacaagcgtgtgtatcgagctgcctaacgcggagcctagggccttgagtcctgctcacgagcatcatagtcaggcactcatgggatcttcaagagaaacaacagctctttcacaaacccaattggctagctcgaacgtgcccgcagcagggatctag

SEQ ID NO: 121551 - DNA, 693 bp, Artificial Sequence
  Description of Artificial Sequence: Synthetic coding sequence
atgtccatgtccccaacagtgatcattctagcctgcctcgggtttttccttgatcaaagcgtttgggctcacgtggggttgtatgagaagcctagtctgaccgcccgtcctggccccacggttcgcgccggggagaatgtgaccctttcatgctcgagtcagtcatcctttgacatctatcacctgagccgcgagggcgaagcccacgaactgaggctgcccgccgtgcctagcataaatgggaccttccaggctgattttcccctcggccccgccactcacggcgagacttatagatgctttggaagtttccacggctccccatatgaatggagcgacccttccgaccccctccccgtgtcggtgacagacgcagccgttatgaaccaagagccggcggggcatcgcactgtgaatcgagaagattcagatgaacaagacccccaggaggtgacatatgctcaattagaccattgtatttttactcagaggaaaattacaggaccatcccagaggtcaaagcgcccgtccacagatacttcggtgtgcattgagttgcctaatgctgagccccgcgctctttccccagcacacgagcaccattcccaggccctgatgggcagcagccgagaaaccacggctctgtcacagacacagcttgcctcaagtaacgtgcctgcagctggaatctag

SEQ ID NO: 121552 - DNA, 762 bp, Artificial Sequence
  Description of Artificial Sequence: Synthetic coding sequence
atgagctgcacgattgaaaaggccttggctgatgcaaaagcgttggtggagcggctgagagaccatgatgacgccgctgagagcctgattgaacagaccaccgccctgaacaaacgagtcgaagccatgaagcaatatcaggaagaaattcaggaactgaatgaagttgcccgacatcgaccacgatctacactcgtgatgggcatccaacaggagaatcggcagattcgggaactccaacaggagaataaggagctaaggacctctcttgaagaacatcaatccgctctagaactcattatgtcaaaataccgtgaacagatgttcaggttgctgatggcctccaagaaggatgaccccggcatcatcatgaagctgaaggagcagcacagtaaaattgacatggtgcacaggaataagtccgaagggttttttctggatgcctcgaggcacattctagaggccccccaacacggcttggaaaggcgccacctggaagccaaccagaatgagctgcaagcccacgttgaccagataaccgaaatggccgcggtcatgagaaaagccattgagattgatgaacagcagggatgcaaagagcaggagcgcatcttccagttagaacaggagaacaaaggtcttcgagagattttgcagattacccgcgaaagcttcctcaacctgaggaaggacgatgccagcgagtcaacgtccctctccgctctggtgaccaacagtgacttatcattgagaaagagctag

SEQ ID NO: 121553 - DNA, 648 bp, Artificial Sequence
  Description of Artificial Sequence: Synthetic coding sequence
atggataatcagggcgtcatctatagtgacctgaacttgcctccaaacccaaaaaggcagcagcggaagcccaaaggcaataagaactcaattctcgccacggaacaggagatcacatacgctgagttgaatcttcaaaaggcctctcaggattttcaggggaacgataagacttatcactgcaaagatctgccttccgccccagagaagctcatagtaggcatcctggggataatctgtttgatattaatggcctctgtggtgacaatcgtggtcatcccttctagacattgcgggcattgccctgaagaatggatcacttactcaaattcatgttactatattggaaaagaaagaagaacttgggaggaaagcttgttggcttgcaccagtaagaattcctccctcctgagtatcgacaacgaagaggagatgaagtttctctctatcattagcccttcctcttggattggggtgttccggaactcatctcaccacccatgggtcactatgaatggcctggccttcaagcatgaaattaaggattccgataatgctgaattgaattgtgcagtcttgcaggtcaatagactcaagtctgcccagtgcggttcctcgatcatctaccactgcaagcacaaactgtag

SEQ ID NO: 121554 - DNA, 702 bp, Artificial Sequence
  Description of Artificial Sequence: Synthetic coding sequence
atggataaccagggtgtcatttattctgacctgaacctgcctccaaatcccaagcgacagcagaggaagcccaaaggcaacaagaattccattttggccacagagcaagaaatcacatatgcagaacttaacttacaaaaggctagccaggactttcaggggaatgataaaacataccattgtaaggatttgccaagcgcccctgagaagcttattgtcggcattcttggcattatttgtctgatactgatggcgagtgttgtgacgattgtggtcattccatcaacattaattcagcgccataacaacagctcacttaacaccagaacacaaaaggcacggcattgtgggcactgccctgaggaatggattacctactcaaacagttgctactatatcggaaaagaaaggcgcacatgggaggaatcactcctggcatgcacgtccaaaaattcgtccttactcagcatcgacaacgaggaggagatgaagtttctgtccatcatctccccctcatcgtggatcggtgttttccgcaattccagccatcacccctgggtaacaatgaacggacttgctttcaagcacgagataaaggactcggataatgccgaattaaattgcgccgtcttgcaggtcaatagactgaagtctgcccaatgtggaagttccatcatctatcactgtaagcataaactctag

SEQ ID NO: 121555 - DNA, 648 bp, Artificial Sequence
  Description of Artificial Sequence: Synthetic coding sequence
atggataaccagggggttatttacagcgacctgaatttgcctcccaacccgaagagacagcaaaggaaaccaaaggggaataaaaactctatcctggccacggagcaggagatcacatacgctgagctaaatctgcaaaaagcaagccaagacttccaggggaacgacaagacatatcactgtaaggatttgccctcagcccctgagaagctgatcgttggcatactcggcataatttgcctcatcctgatggcgagcgtcgtgacaatcgttgtcatacccagcaggcactgtggacactgcccggaggaatggatcacctatagcaacagttgctattacattgggaaggagaggcgaacttgggaggaaagcctgctcgcatgtactagcaagaactcctctcttctcagcatagacaatgaggaagaaatgaagtttctgagcatcatcagccctagtagctggatcggcgtgtttcgcaatagctctcaccacccttgggtgaccatgaacggcttagctttcaagcacgagattaaagatagcgacaacgccgagctgaactgcgccgttctgcaggtaaaccgcctcaaatctgcccagtgcgggagttctataatctaccactgtaagcataaactatag

SEQ ID NO: 121556 - DNA, 702 bp, Artificial Sequence
  Description of Artificial Sequence: Synthetic coding sequence
atggacaatcagggtgtgatttactccgacctgaacctgccccctaatcctaagcgccaacagaggaaacccaaaggtaacaagaatagtattttggcgacagagcaagaaataacatacgctgagttgaatttacagaaagccagccaagatttccaggggaacgacaaaacttaccattgcaaagacttgccttccgcccctgagaagctaatagtgggtatactggggattatctgtttgatcttaatggcaagcgttgtgaccatcgtagttatccccagtactctaatccagagacacaacaatagttcccttaacacaagaacgcagaaagccaggcattgtggccattgccccgaagaatggatcacttatagtaattcatgctattacatcggcaaagaacggcgaacatgggaagaatctctgctggcctgtacttccaaaaattcgagtctgctctcaatagataacgaggaggaaatgaaatttctttccataataagcccctcatcctggatcggagtgtttcgaaacagcagtcatcacccatgggtcactatgaacggcctggcttttaagcacgagataaaggacagcgacaatgccgagctaaattgcgcagttttacaagtaaatcgactgaaatcagcacagtgtgggagctccatcatttaccactgtaaacataaactgtag

SEQ ID NO: 121557 - DNA, 696 bp, Artificial Sequence
  Description of Artificial Sequence: Synthetic coding sequence
atgaacaagcagcgtgggacattcagcgaggtgagcctggctcaggacccgaagaggcagcagaggaagcctaaaggcaacaaatcctccatcagtgggaccgaacaggaaatctttcaggtcgaattaaacttgcagaatcctagtttgaaccatcaggggatcgataaaatctacgattgtcaaggacttttgccaccccctgagaaactaaccgctgaggtcctggggatcatctgcattgttcttatggctacagtactcaaaacaatcgtgttgattccattccttgaacaaaacaactccagccctaataccagaacccagaagacgcgccactgtggccattgtccggaggaatggattacttactcgaatagttgctattatatcggcaaagaacggagaacgtgggaagagagcctgctggcctgcacatccaagaactccagcttactttccatcgataatgaagaagagatgaaattcctcgcttcaattctcccctctagctggataggggtatttcggaattcctctcaccacccctgggtgaccattaatggacttgcctttaagcacaagattaaggactctgacaacgcggagttaaactgcgctgttcttcaggttaatcgcctcaagagcgcccaatgtggctcatctatgatttatcactgcaaacacaaactgtag

SEQ ID NO: 121558 - DNA, 696 bp, Artificial Sequence
  Description of Artificial Sequence: Synthetic coding sequence
atgaataagcagagaggtactttctcagaagtcagtcttgctcaagaccccaagcggcagcaaagaaaacccaaaggaaacaagtcctccatcagcgggaccgagcaggagatctttcaggtggagctcaaccttcaaaatccttctttaaaccaccagggaatcgataaaatttatgactgccaggggctgctgccacctcccgaaaaactgacagctgaagtcctaggcataatctgcatcgttctcatggccactgtgctgaagaccatcgtcctgatccccttccttgagcagaacaacttctcccccaacactagaacccagaaagcccgccattgtggacactgtcctgaagagtggatcacttattcaaatagttgctattacataggaaaagagaggcgcacttgggaggaatctctccttgcatgtacatccaagaacagtagccttttaagcattgacaacgaagaggagatgaagttcttagcctctatattgccctcctcttggattggcgtgttccgcaacagctcacatcatccctgggtgacaatcaatggccttgcatttaagcataaaatcaaagacagcgacaacgcagagttaaattgcgccgtcctccaagttaataggctgaagagcgctcagtgcggcagtagcatgatttatcactgtaagcacaaactctag

SEQ ID NO: 121559 - DNA, 375 bp, Artificial Sequence
  Description of Artificial Sequence: Synthetic coding sequence
atgattccaacgcggcactgcggtcactgtcccgaggaatggataacctacagtaacagttgctattatattggaaaggaaagaaggacatgggaggagagcctcctggcatgtaccagtaaaaatagttcattgttgagtatagataatgaggaagagatgaaattcttagcttctatactgccttcttcttggatcggtgtttttagaaactcaagtcatcacccctgggttaccattaatggtctcgcatttaagcataagatcaaagacagcgacaacgccgaattgaattgcgctgttcttcaagtcaatcggctaaagtctgctcagtgtggcagcagcatgatctatcactgtaaacataagttatag

SEQ ID NO: 121560 - DNA, 774 bp, Artificial Sequence
  Description of Artificial Sequence: Synthetic coding sequence
atgtctaagcaacgtggcaccttcagcgaggtaagcctggcccaggatcccaagtggcagcaaagaaagcccaagggtaacaaaagtagcatttccggcacagaacaagagatcttccaggtggagctcaatcttcagaacgcttcattgaaccaccaggggatagataaaatttacgactgccagggcctgctccctccacctgaaaaattgactgccgaagtgttaggcattatatgtatcgtcttaatggctactgtcttgaagacgattgtcctgattcctttcctggaacagaacaacagctcccccaatgcacgcacacagaaagcacggcactgtggccactgtccagaagaatggattacgtattcaaattcctgttactacatagggaaggagcgccgtacttgggaggagagcttacaggcatgcgcatcaaaaaacagtagcagcttactctgcattgataacgaggaggaaatgaagtttctagctagcatccttccttccagctggattggcgtgttcagaaattcttcccaccacccctgggtgactattaatggactggcattcaaacatgaaataaaagattccgaccatgccgagcggaattgcgctatgctccacgtgcggggcctcattagtgatcagtgcggttcgagcaggatcatcgtcagcatttccttcaggattaaggctcttgagctcgctgtgcatcagataaagttttacatctgctctaaccggaatgatatcatgatcgcctag

SEQ ID NO: 121561 - DNA, 723 bp, Artificial Sequence
  Description of Artificial Sequence: Synthetic coding sequence
atgagtaagcagcgagggactttttccgaagtgtctctggcccaggacccgaaatggcaacaaaggaagccaaaaggaaataagagctctatctctgggacagagcaggaaatcttccaggtggaactgaatctgcaaaacgctagtctcaaccaccagggcatcgataagatttatgactgccagggcctcctgcctccccctgagaagctgacagccgaagtcttggggattatatgcatcgtgctaatggcgacagtgctgaagacgattgtcttgatcccctttctagagcagaacaattcctccccaaatacaaggacccagaagacccgacactgcggccattgccctgaagagtggatcacttattccaactcctgttactacatcgggaaagagcgaaggacttgggaagagtccttacaggcttgcgcgagtaagaatagcagctctcttctctgtattgacaacgaagaagagatgaaattcctcgcatctatcctgccgtccagttggatcggcgttttcagaaactcgtcacatcacccctgggttaccataaatgggcttgctttcaagcacgagataaaggactcagatcacgctgaaagaaattgtgcaatgctgcatgttaggggcctgatttccgaccagtgtggttcctcaagaattatcaggcggggattcatcatgctgacacgcttggtgttaaactcttag

SEQ ID NO: 121562 - DNA, 723 bp, Artificial Sequence
  Description of Artificial Sequence: Synthetic coding sequence
atgagcaaacagagagggactttctctgaggtgtcattggcccaggatccgaaatggcagcagaggaagcctaagggaaataagtctagcatcagtggaaccgagcaggaaatatttcaggtagaactgaacctgcagaatgcaagcctcaatcatcaggggatcgacaagatctacgactgtcaaggattgctgcccccacctgagaagcttacggccgaggtgttgggcatcatatgtatcgtgcttatggctaccgttctgaagaccattgtactcatcccatttctggaacagaacaattctagtcccaatgcacgtacccagaaagcccgccactgtggtcattgtcccgaggagtggatcacatactccaacagctgttactacatcggaaaggagaggcgcacatgggaggagtccttgcaggcctgtgcttccaagaattcgagctctctcctgtgcattgataatgaagaggagatgaagtttctcgctagtattctgccgtcatcgtggatcggcgtgtttcggaactcctcacaccatccctgggtcactattaacggcctggccttcaaacatgagatcaaggacagtgatcatgctgaacgtaactgtgcgatgttgcacgtcagggggctgatatccgaccagtgcggaagcagccggattatcaggagaggctttattatgctcactcgcctggtactgaatagctag

SEQ ID NO: 121563 - DNA, 477 bp, Artificial Sequence
  Description of Artificial Sequence: Synthetic coding sequence
atgaataagcagagaggaacatactctgaggtgagcctggcacaagaccctaagagacagcagcgtaagctgaaggggaataaaataagtatctcaggcaccaagcaggagatattccaagttgaacttaatctgcagaatgcctcttccgatcatcaaggcaacgataagacctatcattgtaaggggcttctgcccccacccgagaaattgacagccgaagtgcttggtattatctgtatcgtgctgatggctactgtgcttaagaccatcgtactgatcccatgtatcggtgttctcgaacagaataacttctccctcaaccgccgcatgcagaaggcccgacactgcgggcactgccccgaagagtggattacctattcaaactcctgttactacattggcaaggagcgtcggacctgggaggaacgcgtgtgctggcctgtgttgagaaggaccttgatctgcttcctgtag

SEQ ID NO: 121564 - DNA, 540 bp, Artificial Sequence
  Description of Artificial Sequence: Synthetic coding sequence
atggcggtctttaagaccactctgtggcgattgatatcaggcaccctaggcataatctgtctaagccttatgtccacccttggtattctgctcaaaaacagctttaccaagctgtcaatcgaaccagcatttaccccgggacccaatatcgaactgcagaaggactccgattgctgctcttgccaggagaagtgggttgggtataggtgcaattgctatttcatctccagcgagcagaagacctggaatgagtctcggcacctttgtgccagccaaaaaagttccttactgcagctgcagaacaccgacgaactggatttcatgagcagttctcaacagttctactggatcgggctgagttatagtgaggagcacactgcctggctctgggagaatggcagcgctttatcccaatatctgttccccagttttgaaacattcaacacaaagaattgcattgcctataatccaaatggcaacgcacttgatgaaagttgtgaagataagaaccgatatatttgtaagcagcagctcatctag

SEQ ID NO: 121565 - DNA, 447 bp, Artificial Sequence
  Description of Artificial Sequence: Synthetic coding sequence
atggctgcattcacaaaactgtcaatcgagccagcatttacaccaggacctaacatcgagcttcagaaggactcagactgctgttcctgccaagagaaatgggtaggctaccgatgtaactgctactttatctcaagcgagcagaaaacctggaatgagtctagacacttatgcgccagtcagaaatctagcctgctgcagctccagaacactgacgaactggattttatgagctcttcccaacaattctactggatcggtcttagctacagtgaagagcacacagcttggctgtgggagaatggttcagctttatcgcagtatctgtttccatctttcgagaccttcaacactaaaaactgtatcgcttacaaccctaatggtaacgcactggacgagagctgtgaggacaaaaatagatatatatgcaagcagcagctcatctag

SEQ ID NO: 121566 - DNA, 540 bp, Artificial Sequence
  Description of Artificial Sequence: Synthetic coding sequence
atggctgtgtttaaaaccaccttgtggaggcttatttctggcacactggggattatatgcctaagtctgatgtctacacttggaatcttgcttaagaatagtttcaccaaattgtctatcgagcccgcatttaccccaggccctaacatcgagctgcagaaagattccgactgttgctcgtgccaagaaaagtgggttggctacagatgcaactgctatttcatcagctccgaacagaagacatggaatgaatcccgtcacttgtgcgctagtcagaagagcagtctgttacaactccagaacactgatgaacttgactttatgtcttcctcacagcaattttactggatagggctgtcctattcagaagaacataccgcctggctgtgggagaacggctctgctttgtcccagtatctctttccctcatttgagacttttaacacgaaaaactgcattgcctacaatcccaatgggaacgcactggatgaaagctgtgaagataagaatagatacatttgtaaacagcagctgatttag

SEQ ID NO: 121567 - DNA, 543 bp, Artificial Sequence
  Description of Artificial Sequence: Synthetic coding sequence
atggccgtgtttaaaactacgctgtggcgtttgatctccggcaccctggggatcatctgcctgtctctaatgagtaccctcggcatccttctgaagaacagcttcactaagctgtccattgagccagcattcactcctggccctaatatcgaactgcagaaggacagtgactgctgttcgtgccaggagaaatgggttggctacagatgtaactgctattttatctcttccgagcagaagacatggaatgaaagcagacatctttgcgccagtcagaagagtagcttacttcaactgcagaacaccgacgagctgcaagacttcatgtcctcctcacaacagttttactggattggcctgagctacagcgaggagcacacagcatggttgtgggaaaacggcagtgcactgagtcaatacctgtttccaagcttcgagacttttaacaccaaaaactgtatcgcttataatccaaacggaaacgcgcttgatgagtcttgtgaggacaagaacaggtacatctgcaaacagcagctcatttag

SEQ ID NO: 121568 - DNA, 156 bp, Artificial Sequence
  Description of Artificial Sequence: Synthetic coding sequence
agcgcactgtcccagtacctgtttccttcttttgaaaccttcaatacaaagaattgtattgcatataatccaaacgggaatgcgttagatgagtcatgtgaggataagaaccggtacatttacaaagtgctcctgtgttgccctggttggtcttag

SEQ ID NO: 121569 - DNA, 420 bp, Artificial Sequence
  Description of Artificial Sequence: Synthetic coding sequence
atggctgcatttaccaaactgagtatagagcctgcatttacccctggacctaacattgagcttcaaaaagatagcgattgctgcagttgccaggaaaaatgggtaggctatcgatgtaactgctacttcatcagcagcgagcaaaagacatggaatgaatcacgccatctgtgcgcaagtcaaaaatctagtctgctccaactgcagaacaccgacgaactggatttcatgtccagttctcagcagttttattggatcggactgtcctatagcgaggagcatactgcatggctgtgggagaatggctccgccctttctcagtacctctttccttcattcgaaacgtttaatacgaagaattgcattgcttacaatcctaacggtaacgccttagatgagtcttgtgaggacaaaaattag

SEQ ID NO: 121570 - DNA, 699 bp, Artificial Sequence
  Description of Artificial Sequence: Synthetic coding sequence
atgcaagatgaggaaagatacatgactctgaacgtgcagtcaaaaaagagatccagcgctcaaacatcccagctcacattcaaggactattccgttaccttacactggtacaagattctgctgggcatttcagggactgtgaacggtatactcaccctgacattgatttctctgatcctgctggtatcacagggtgtactgctgaagtgccagaagggctcctgtagcaatgccacgcagtatgaagacacaggcgatctgaaggtcaacaacggtaccaggcgtaatatttcaaacaaagacttatgtgcgtcccgatctgcagaccagaccgtgctatgccagagtgagtggctgaaatatcagggaaagtgttgctactggttcagcaatgagatgaaaagctggtctgactcctacgtgtactgcctcgagcgaaagagccatctgctcatcatacacgatcagttagaaatggcctttattcagaagaacctgcgacagttgaattacgtgtggataggcttaaacttcacttctctgaagatgacctggacctgggtagatggctctcctatcgactcaaagattttttttatcaaggggccagcgaaagaaaacagttgcgcagctatcaaggagagcaaaatcttttctgagacatgttctagcgtgtttaagtggatttgccaatactag

SEQ ID NO: 121571 - DNA, 549 bp, Artificial Sequence
  Description of Artificial Sequence: Synthetic coding sequence
atgcaggacgaagagcgttatatgaccctgaatgtgcaatccaaaaaacgtagctcagcccagacctcacagctgacttttaaggactactccgtgacactccattggtataagattctcctcgggatttctgggaccgtcaacgggatacttacgctcactctgataagtctgattttgctagttctgtgccagtcagagtggttaaaatatcaagggaagtgttgctattggttctcgaatgagatgaagtcctggtccgattcctatgtctactgtctggaaagaaaatcacacctcctgattatccatgatcagctggagatggcatttatccagaagaacctgaggcagctcaactacgtgtggatcggactgaatttcactagcctgaaaatgacctggacatgggtggacgggtcgccaattgactcaaaaatattcttcattaagggcccagctaaagaaaactcttgcgcggcaataaaagaaagtaaaatttttagtgagacatgcagtagcgtttttaagtggatttgccagtattag

SEQ ID NO: 121572 - DNA, 195 bp, Artificial Sequence
  Description of Artificial Sequence: Synthetic coding sequence
atgcaagatgaagagcggtatatgaccctaaacgtgcagtccaaaaagaggagcagcgcacagaccagccagctcaccttcaaagactattctgtaaccctgcactggtataagatactgctgggcatttcaggcactgtaaatggaatcctgactttaactctgatttcgctgattctgctcgactcttcttag

SEQ ID NO: 121573 - DNA, 588 bp, Artificial Sequence
  Description of Artificial Sequence: Synthetic coding sequence
atgacagatagcgtgatctacagcatgctcgagctgccaacagccacccaggcccagaacgattacggcccacaacagaagtcttcatctagtaggccgtcttgctcttgcctcgtagccatcgccctaggcctgcttaccgcagttctgctgtctgtgttgttataccaatggatcctgtgccaggggagcaattactccacatgtgcaagttgcccctcttgccctgacagatggatgaagtatggcaatcattgctactacttttcagtcgaggagaaagattggaacagttcactggagttttgcctcgcccgcgacagccacctactagtgatcactgacaaccaggagatgtctctgctgcaggtgttcctcagcgaggctttttgttggataggactacggaataatagcggttggcggtgggaagacggcagtcccctcaactttagccgtattagttccaacagttttgtgcaaacatgcggcgcaataaacaagaacggacttcaggccagctcttgcgaggtacccttgcactgggtttgtaagaagtgtccttttgccgatcaggccctgttttag

SEQ ID NO: 121574 - DNA, 570 bp, Artificial Sequence
  Description of Artificial Sequence: Synthetic coding sequence
atgaccgattctgttatatattcgatgctggaactccccacagctacacaggcccagaacgattacgggccacagcaaaaatcttcaagctcacggccgtcttgttcctgccttgtggcaatagccctggggttgttgaccgcagtacttctgtccgtgctgctgtatcagtggatcctatgtcaagggtccaattattccacatgcgcttcttgcccaagctgcccggatcggtggatgaagtatggaaaccattgttactatttcagcgtcgaagaaaaagattggaattcatccctggaattctgtttggctagggattcacacctactcgtaataactgacaatcaagagatgtccttgttgcaggtctttctctcagaggccttttgctggatagggctgcgcaataactccggctggcgctgggaagacgggagccccttaaatttctcacgcatatctagcaatagctttgtccagacctgcggggccataaataagaacggcctgcaggcctctagttgcgaagtgccactacattgggtgtgcaaaaaggttagactctag

SEQ ID NO: 121575 - DNA, 651 bp, Artificial Sequence
  Description of Artificial Sequence: Synthetic coding sequence
atgggctggatcagaggccgaagaagccgccatagttgggagatgagcgagttccataattataacctcgatctaaaaaagtcagatttcagcactcgctggcagaaacagcgctgccccgttgtgaaatcaaagtgtagagagaatgcaagccctttcttcttttgctgcttcatcgccgtggctatgggaatccgcttcattatcatggtgactatctggagcgcagtgttcttaaattccctttttaatcaggaggttcaaatcccccttacagagagttactgtggcccctgtcctaagaactggatttgctacaagaacaactgttaccagttcttcgatgagtcaaaaaactggtatgagtcccaggcgtcatgtatgagccagaatgctagcttgttaaaggtctattccaaagaagaccaggatcttctgaaattagtcaaatcataccactggatgggtctcgtacacattcctacgaatgggagctggcagtgggaggacgggtctatcttatcgcctaatctgcttactatcatagaaatgcagaagggcgactgcgccctatacgccagctccttcaaggggtacatagagaattgcagtacacccaacacatacatctgtatgcaacggaccgtgtag

SEQ ID NO: 121576 - DNA, 243 bp, Artificial Sequence
  Description of Artificial Sequence: Synthetic coding sequence
atgggatggatacgcggtaggagatcacggcattcatgggaaatgagcgaattccacaattacaatctggacctcaagaagagcgacttctcaactagatggcagaagcagcggtgtccggtagtaaaatccaagtgtcgcgagaacgcctcacccttcttcttttgttgtttcattgcggtcgccatgggaatcaggtttattattatggtgacaatctggagtgccgtgtttctaaactag

SEQ ID NO: 121577 - DNA, 651 bp, Artificial Sequence
  Description of Artificial Sequence: Synthetic coding sequence
atgggatggattagggggagacgctctaggcactcatgggagatgtctgagttccataattataacctggatcttaaaaaatcagattttagcaccagatggcagaaacagcgctgtcccgtcgttaaatctaagtgccgcgagaacgcctcccccttcttcttttgttgttttatagctgtggcaatgggaatacgctttatcataatggtgaccatctggtctgctgtctttctgaactctctgtttaaccaggaggtccagataccactgaccgagagctattgtggcccatgccctaagaactggatctgctacaagaataattgttatcagtttttcgacgagagtaaaaactggtacgagtcccaggcctcgtgcatgtcacagaacgccagcctccttaaggtgtactctaaggaggatcaagacctgttaaaactcgtgaagagttatcattggatggggctcgttcacatcccaaccaacggatcctggcagtgggaggatgggtctatcctgtcccccaatctgctgacgatcatcgaaatgcagaagggcgactgcgccctgtacgcatcttccttcaaaggctatattgagaattgttcgactccaaacacttatatctgtatgcagcggacagtttag

SEQ ID NO: 121578 - DNA, 537 bp, Artificial Sequence
  Description of Artificial Sequence: Synthetic coding sequence
atggaccggcctggacctggctcggcgcgccccggcaggactgtgcacgtgtggggctatagagttgaatggaaggttcggaacggaaggaagttgcagccgagcgaatgggccggccggggagatctgggtggcttcaaacgccgctggaaagacacaagagcgacggtgggcaccactttccgccggcgatcccgcgtgagcctggtcggggaattgtccaagttccccctgcctagcgattctagcgggggaaagagttcaagtagcttcgcccgaggagccctcgcctggtgtaggcagaggaatccgaaccctagctgtgccgcagcagaaaccggggctcgaacatctcttcccaaagagagatgtcggggatggagattagggaactggttacataaacaccctcaccccaacacatgccctaggctgccagcatgctggttgccaccgatcctgaccgagaggggcgaacgcgttccgaagcttgtcccgctgctggcctgttacccgaagtctaagccaaaagactag

SEQ ID NO: 121579 - DNA, 1902 bp, Artificial Sequence
  Description of Artificial Sequence: Synthetic coding sequence
atgcttcgcatgcgcgttcccgcactgctggtgctgctgttttgctttcgggggcgcgctgggccatccccgcatttcctacagcagcccgaggatctggtcgtgctgctgggcgaggaagctcggttgccctgcgcacttggcgcttattggggtctggtacagtggacaaagagtggcctggcattggggggccaacgagatctcccaggatggtcccgttactggatatcgggcaatgcggctaacggccagcacgaccttcacatccggccagtcgagcttgaagacgaggcttcttacgagtgtcaggccacacaggcaggcctccgcagccgtccagcacagcttcacgttctggtaccacctgaggcacctcaggtactcggcggtccaagcgtgagtttggttgccggggtgcctgccaacctcacatgccgcagccgtggagacgctcgacctacacccgagctactgtggttcagagatggggtgctcttggacggagctacgttccaccagacccttcttaaagagggcacacctggaagcgtggaaagcactctgaccctgaccccttttagccacgatgacggcgcaacctttgtgtgccgcgcacgctcccaggccctgcctacagggagagacacggcgataacacttagccttcagtaccctcccgaagtgactctatccgctagccctcacactgtccaagaaggcgagaaggtaatctttctgtgccaggccaccgctcaaccccccgtgactgggtaccgctgggcaaaaggaggctcgcccgtacttggcgcgcggggacctcgtctggaggtcgtggccgacgcatcttttctcacagaacctgtgtcttgcgaggtgtccaacgctgtgggcagcgctaatagatctaccgccctggatgtcctatttgggcctatcctacaagctaaacccgaaccagtttcggtcgacgtcggagaggacgcatccttctcctgtgcgtggcgcggcaaccccttgcctcgagtcacctggaccagacgaggaggggctcaagtgctaggatccggtgccactctaagacttccaagcgttggaccggaggacgccggtgattacgtgtgtcgcgctgaagccggactttcgggcttgagggggggggctgctgaagccagactgaccgtgaacgccccacccgtggtcactgcactgcacagcgcccctgcgttcctcagggggccagctcgactccagtgtttagtgttcgcgagtcctgctcctgatgcagtggtctggtcctgggatgaaggcttcctcgaagcaggaagccagggcaggtttctggtggaaaccttcccagcacccgagtcaaggggcggcttaggcccagggcttatatcagtcttgcacatttccggaactcaggagtcagacttcagcagatccttcaattgctcagccagaaaccgcctgggggaaggcggggcacaggcctctttaggtcgccgtgatctattgcccaccgtgcgcattgtagcaggagtggccgcagcgacaacaaccctcttgatggttattactggcgtggccctttgttgctggcgccactccaaggctagtgcttccttcagcgagcagaagaatcttatgcggattccaggatcctcagatgggtcctcctcacggggacccgaagaggaggagacagggagtcgggaagatcgcggcccaattgtccataccgaccacagcgaccttgtgctggaggagaaaggcaccctggagaccaaagatcctaccaatggctactacaaggtgcgtggtgtcagcccaccggcaagccccgactccagagtgacctcattccagtggaagtccccaggtatttccaatctgccctag

SEQ ID NO: 121580 - DNA, 660 bp, Artificial Sequence
  Description of Artificial Sequence: Synthetic coding sequence
atgctcaggatgcgcgtgccagcccttctcgttcttctgttctgttttagagggagggcaggaccaagtccccattttctgcagcaaccagaggatttagttgtcctcctcggtgagggaggcgcgcaggccagtctcggtagaagagcctccgcttctttcagtgaacagaagaacttgatgagaattccggggtcaagcgacggctcgtcctctagaggcccagaggaagaagagacagggtctcgggaagatcgggggcccattgtccacactgatcacagcgacttggtcctggaagaaaaagggaccctagagaccaaggaccccaccaacggctattataaagtcaggggggtgtccgtgagccttagtctgggagaggcccctggaggtggccttttccttcctcctcccagtcctctgggccccccaggaacccctacattttacgattttaaccctcatctgggaatggtgcctccttgccgcctgtacagggcaagggccggttaccttactactccccatcctcgggctttcacctcctatatcaagcctacatcctttggaccccctgacctcgcacccggcactccccctttcccctatgccgccttccccacaccttcccaccctcgactgcaaactcacgtgtag

SEQ ID NO: 121581 - DNA, 2067 bp, Artificial Sequence
  Description of Artificial Sequence: Synthetic coding sequence
atgctccgcatgcgggttcctgccttgttagttttgctcttctgttttagagggcgagcgggcccctctccccattttctgcagcagcccgaggatttagtcgttttgcttggggaagaagctcgactaccatgcgctctaggtgcatactggggactggtgcagtggacgaagtcgggcctagctctcggaggacaacgggacctgcccggatggagtagatactggatctccggtaatgcagccaacggacaacatgatctacacatccgacctgtggagttagaggacgaagcttcttacgagtgccaggcaacacaggctggactacggtcaagacctgcccagttacatgtgctggtgcctcccgaggccccacaggtgctgggcggaccaagtgtttcattggtcgctggggtccccgcaaatctgacctgcagatctcggggagatgcccggccaaccccggaactgctctggtttcgggacggcgtgctattggatggggcaactttccaccagacactgctcaaggaaggtacacctggttctgtagagtctactctcacactgcctacaggacgtgataccgctatcacgctcagcttacagtacccccctgaggtgaccctgagtgcaagccctcataccgttcaagagggagaaaaagtaattttcttgtgccaggccaccgctcagccacccgtgaccgggtataggtgggctaagggcggcagcccagtgctgggagcccggggcccccggttggaggtcgttgcagacgccagctttctgacggagccagtctcatgcgaagtgagtaacgctgtgggatccgccaacagaagcaccgctctggacgttctcttcgggccgattttacaagccaaacccgaacctgttagtgtggatgtcggggaggacgcaagcttctcctgcgcttggagaggaaaccctctcccgagggtgacctggaccagacgcggcggcgctcaagtcctcggcagcggagcaaccctgagacttccgtcagttggccccgaagacgccggggactatgtgtgtcgagccgaggccggattatcgggcctgagaggcggggccgccgaggcccgactaacggttaacgccccccccgttgtgacagccctgcactcggcccccgcctttcttagggggccagcccggcttcagtgcttggtattcgcgtcgcctgccccggacgcagtggtgtggtcgtgggatgagggattcttggaagctgggtctcaggggcgcttcttagtggagaccttcccggctcctgaatcccgaggcggtctcggccctgggctcataagtgttctgcacatatccggaacccaggaaagcgatttttctagatcctttaattgctcagcccgaaatcggcttggcgagggcggcgcccaggcctctcttggaaggcgcgatcttctgcccacagtgaggatagtggccggagtggccgctgcgaccacaacactattgatggtaattacgggcgtcgcactgtgttgctggaggcactccaaggcatctgctagtttcagcgaacaaaaaaatctcatgcgcatcccaggaagctcggacggctcaagcagtagggggcctgaggaggaagaaacaggcagcagagaagatcgggggccaatagtgcacacagatcactctgatttagtactggaggagaaagggactctggagacgaaggatcccactaacggttactacaaagtgcgtggcgtttctgtgagcttaagtcttggtgaggcgcccgggggggggctctttttacctccaccctctcccctaggcccgccagggaccccaaccttctacgattttaatccgcacctgggtatggtgccaccctgtcgtctgtacagagcgagagcaggttatctgacaaccccccatccccgtgctttcactagctatatcaaacctacttccttcggcccgccagacctggcaccaggaacgccaccattcccttacgcagcttttccaacaccttcccaccctaggctgcagactcatgtttag

SEQ ID NO: 121582 - DNA, 1752 bp, Artificial Sequence
  Description of Artificial Sequence: Synthetic coding sequence
atgcttagaatgcgagtcccggcgttgcttgtgcttctgttctgttttagaggccgggctggatggtcacggtactggataagcggcaatgccgccaatggccagcatgacctgcacatcaggccagtcgagctagaggatgaggcgagttacgagtgccaagccacacaagcgggactgaggagtcggcccgcccaactacacgtactggtgccaccggaggcaccacaggtgctaggcggcccctctgtatctctagttgcaggggtgcccgctaacctaacctgccgatcccggggtgacgctcgccctacaccagaactgttgtggttcagagatggtgtcctgctggacggggctacattccatcaaacactgctcaaagaaggaactccggggtctgtcgaaagtactttaacattgaccccattctctcacgatgatggagctacattcgtatgtcgtgctcgctcccaggccctacctaccgggagggacactgccatcactctaagcctgcagtatcccccagaggtgacactgtcggcatccccacacacggtgcaggagggggagaaggtcatttttctttgtcaggcaacggcacagccccccgttacaggctatagatgggccaagggcgggagtccggttctgggggcaaggggcccacgtctggaggttgtggcagatgccagcttcctcactgagccagttagctgcgaagtcagtaatgcggtgggaagtgcgaaccggtctaccgccctcgatgtattgttcgggccaatactgcaagcaaagcccgaacctgtgagtgtggacgtaggcgaagatgctagcttctcttgtgcttggcgggggaaccctctgccccgggtaacttggacccggcgaggcggagcccaagtcctcgggtcaggtgccaccctgcggctcccttcggtggggccagaggacgccggcgactacgtctgtagggccgaggccggactgagcggcctgagaggaggtgcggctgaggctcgcctcaccgttaatgcacctccggtggtcactgccctgcactcggcccctgcatttctaagaggcccagcccgccttcagtgtctcgtatttgcctcccctgcccctgacgccgtcgtgtggtcttgggacgagggattcttagaggccggaagtcagggaagattcctcgtagagacattccccgcaccagaaagcagaggcggtttggggcccggacttatatcggtcctacacatttctgggacacaggaatctgatttctccagatcattcaactgcagcgcacggaatcgcctgggggaggggggggcgcaagccagccttggccgacgtgatcttctcccaacagtgaggatcgtcgccggcgtggcggccgctaccaccaccctcctgatggtgattactggtgtagccctgtgttgttggagacattccaaggcctcagcttcattttctgagcagaagaacttaatgcggattccgggaagtagtgacggttcgtcctctcgcggcccagaggaagaagagaccgggagcagggaagatcgaggacctatcgtgcacacagaccattctgacttggtcctagaagaaaaaggtacactggagacgaaggatcctaccaacggttactacaaggtccgcggagttagtcctcccgcatcccccgactctcgcgtgaccagctttcagtggaagagccctggcatctctaatctgccatag

SEQ ID NO: 121583 - DNA, 2127 bp, Artificial Sequence
  Description of Artificial Sequence: Synthetic coding sequence
atgctcagaatgcgagtgccggccctgctggtgctgctcttttgtttccgaggccgagccggcccttccccacactttttgcagcaacccgaggacctggtcgtactgctgggagaagaagcccgcctgccttgcgcccttggtgcttactggggtcttgtgcaatggaccaaaagtggacttgctcttggcgggcagcgggatctgcccggatggtcacggtattggatctctggaaatgcggccaacggacaacacgacctgcatataaggcctgtcgaacttgaggacgaggcctcttatgagtgtcaagccacccaggcggggctgcgctcacgtcccgcgcagttgcacgtgctggtgccacccgaggctccacaggttttgggcggccccagcgtaagtcttgtcgccggtgtgccagcaaacctgacatgtaggtcccgcggagatgcccgtcctaccccggaactcctatggtttagggacggagtcctgctggatggagctactttccaccaaaccctgctgaaagaaggaaccccaggatcagttgaaagcacactcacacttacccctttctcacatgacgacggagctacatttgtgtgtcgtgcccgctcccaggccttgcccaccggaagggacactgccataaccctgtctctgcagtacccgcccgaggtgaccctgagtgcatcacctcataccgtgcaagagggcgaaaaagtgattttcctctgtcaggctactgcacagcctccagtgaccggatatcggtgggcaaagggcggcagtcctgtgctcggtgctcgagggccacggttggaggtggttgcagatgcctctttccttacagagcccgtgagttgcgaagtatcaaatgccgtggggtctgcaaacagatccacagcgctggatgtcttgtttgggccaattctccaggccaagcctgagcccgtgtccgtagatgttggggaagacgcatcgttcagctgtgcatggcgcggtaatccactgccacgggtgacctggacccggcgcggcggagcccaagtgcttggtagtggagcaaccctgcgcctccctagcgtggggccggaggatgcgggcgattacgtgtgtcgggcggaagctggactttccggactccgggggggagccgctgaagctagactgaccgtcaacgcgccaccagtggttaccgccctgcactccgctcccgccttccttaggggacccgcaagacttcagtgcctggtgtttgcatctcccgcacccgacgcagtggtatggtcatgggatgagggcttccttgaggctggttctcagggcaggtttttggtcgaaacgtttccagctcctgaatcgcgcggggggctgggacctggattgatcagcgttctgcacatttctggcacgcaagaatccgacttttctagaagctttaactgctccgcaagaaatcggttgggcgagggtggggcccaggcttctctgggtcggagagaccttttgcctactgtccggatcgtggcaggggtggctgctgccacaactactctgttaatggtgatcacaggggtggcgctttgctgctggcggcactctaaggcttctgccagcttctccgaacaaaagaatctaatgcggatcccagggagctctgacggatccagcagtcgtggtccagaggaggaggagaccggtagccgagaggataggggacccatcgtccataccgaccattccgacttggtgctggaagaaaagggcactttagaaaccaaagatccaaccaacggttactacaaggtccggggggtttctgtaagcctgtcactaggcgaagcaccagggggcggcctgtttctgccaccacctagccctctcggccctcccggaacccctacattttatgacttcaatccacacctcggaatggtgccaccatgccgcctgtatagagccagagccgggtatctgacaacaccacacccccgggccttcacgtcgtacatcaaacctacaagcttcggaccgcctgatctggctcccggcacaccccctttcccctatgctgccttcccaaccccttcacacccaagactgcagacacacgtttag

SEQ ID NO: 121584 - DNA, 738 bp, Artificial Sequence
  Description of Artificial Sequence: Synthetic coding sequence
atggctgtcataataggtgttgccgtcggcgcaggggtagccttcctcgtgctgatggctactattgtggccttttgctgtgccagatcccaacggaatcttaagggcgtggttagtgcaaaaaatgatatcagggtggaaatcgtccacaaggagcccgcatctggtagagagggggaggagcattcgaccatcaagcagctcatgatggaccgcggagagtttcaacaggactcggtgctgaagcagctggaagtgctcaaggaagaagagaaagaattccagaatctgaaggatccaacaaatgggtactattcggtgaatacctttaaggagcaccacagcacgcccaccatcagtctgtccagttgtcaacctgacctacgccctgcaggcaagcaacgcgtacccaccggtatgagctttacaaatatctacagtaccctgtcaggccagggccgcctgtatgattacgggcaaagattcgtgttggggatgggtagcagttctatagagctgtgcgaacgagagttccaaaggggtagcctcagcgactcaagctcattccttgatacgcaatgcgatagctcagtgagcagcagtggtaagcaggacgggtacgtgcagttcgataaggcgagcaaagcaagcgcttctagcagtcatcatagtcagtcctcatcgcagaacagcgacccctcacgcccgttgcagcgaaggatgcagacccatgtgtag

SEQ ID NO: 121585 - DNA, 2337 bp, Artificial Sequence
  Description of Artificial Sequence: Synthetic coding sequence
atgaagccctttcagctagacctactgttcgtctgcttctttctgttctcgcaagaactgggactgcaaaagaggggttgctgcctagtgcttgggtacatggcaaaggataagtttcgcagaatgaacgaaggtcaagtgtattcattctctcaacaacctcaggaccaggtggtggtctcgggccagcctgtcacactcctgtgtgcgataccggagtatgatgggtttgtcctctggataaaagatggcctcgcactgggcgtcgggcgggacctgtcaagttaccctcagtatctcgtggtgggaaatcacctctctggcgagcaccatctgaagattctgcgggctgaacttcaagacgacgctgtatatgaatgtcaggccatccaggccgcaatccgttcacggcctgcaaggctcacagtactggtcccccccgacgaccccgtcattctgggcggacctgtaatttctcttcgggccggggatccgctgaatctcacctgtcacgctgacaacgctaagcctgccgcctcaatcatctggcttcgcaagggcgaggtaataaacggcgcaacatattccaagacactgctgcgcgacgggaaacgagagtccattgtgtccaccctgtttatcagccccggggacgtcgagaacgggcagtctatcgtatgtcgggcaacaaacaaggccatccctggggggaaagaaacatccgtgaccattgacattcagcatcctcctttggtgaacttatcagtagaaccccagcctgttctggaagacaatgttgttacattccattgctccgctaaagcaaacccggccgtgacccagtataggtgggcaaagagaggtcaaatcattaaagaggcctcgggtgaagtttaccgcacgaccgtcgattatacctactttagtgagcccgtgagctgtgaagtgacaaacgcattaggcagtaccaacctcagcagaacggttgatgtatacttcgggccaagaatgacaaccgagccacagtcactcttagttgacctaggaagcgatgcaatctttagctgcgcatggacggggaacccttctctgacaatagtgtggatgaaacgggggagcggggtcgttctaagcaacgagaagaccttaacgctcaagtcagtcagacaggaagacgcgggcaagtatgtgtgcagggccgtggtcccgagggtaggagctggcgaacgcgaggtgaccctgacagtcaatggtcctcctatcatttccagcacccaaacccaacatgcactacatggtgagaagggccagattaaatgcttcatccggtctacccctccacccgacaggatcgcgtggtcctggaaggagaatgtgctggagtcaggtacatcagggagatatacagtggagactatttccactgaggaaggggttatctcaaccctgaccatttcgaacatcgtgagggccgatttccaaactatttataattgcacggcatggaattctttcggttccgacactgagatcatccggttaaaagaacagggctcagagatgaaatctggggccggactcgaggcagagagtgtgcccatggctgtaatcattggcgttgctgttggcgctggggtcgcatttcttgtgctaatggctactatcgtggccttctgctgcgctcgaagtcagcgcaatttaaaaggcgtagtgtccgctaaaaacgacattagagtcgagatagtgcacaaagagccagcatccggaagagagggcgaggagcatagcactattaagcaattaatgatggacagaggggaattccagcaagactctgttctcaaacagctggaggttctgaaagaggaagagaaggaatttcagaaccttaaagaccccaccaacggctactacagcgtaaatacattcaaggaacatcacagcaccccaacgatttccctgtcgagctgccaacctgacttaaggccggcagggaagcaaagagtgccaactggaatgagtttcacaaacatctactcaaccctatctgggcaggggcgcctctacgattatggtcaacgattcgtgctaggtatgggatcctcgagcatcgaattgtgcgaaagagaattccagaggggatctctctccgattcatcctccttcctggacacccaatgcgatagttccgtctcttccagtgggaaacaggacggttatgtgcaatttgacaaagcatccaaagcctccgcttcatcttcccaccactcgcaatcatccagtcagaattctgaccctagccggcctttgcagagacgtatgcaaacccatgtgtag

SEQ ID NO: 121586 - DNA, 1803 bp, Artificial Sequence
  Description of Artificial Sequence: Synthetic coding sequence
atgaaacccttccagttagacctcttatttgtttgcttttttctgttttcacaggaactggggttgcaaaagcgcggctgctgtctcgtactggggtatatggctaaagataaatttagacggatgaacgaagggcaggtgtacagcttctcacagcagccacaggaccaggtggtcgttagcgggcagccagtgacactgctgtgcgcaatccccgagtacgatgggttcgtgctgtggattaaggatggcttagccctcggagtcggacgagacctgagctcttacccgcagtacctcgtagtgggaaatcacctgtcaggagagcaccacctgaaaatcctgagggccgaactgcaggacgacgctgtctacgagtgccaggccatccaggcagccatccgcagcaggccagccagactgactgtcttggtgcctcccgatgaccccgtgattctgggtggtcccgtgattagcttgagggccggggaccctctaaatctgacttgccacgccgataatgccaagcccgcagcaagtatcatatggttaaggaaaggcgaagtgatcaacggggcaacgtattccaaaaccctgttaagagacggtaagcgagaatctatagtgagtacactgtttatttcccctggcgacgtcgaaaacggacagagcattgtctgtcgggctactaacaaggccatcccaggcggcaaggagacgagcgtaactatcgatatccagcaccctcctttggtgaatctgagcgtggaaccccagcccgtgctggaagacaatgtggttactttccattgcagtgccaaagcgaatcccgctgtcacccagtacaggtgggccaagcgcggtcagatcatcaaagaggccagcggcgaggtgtataggactacagttgattatacttatttcagcgagccagtgtcgtgtgaggtgaccaatgccctcggctcaacgaatctgtcacgaacggtagatgtgtatttcggaccccgcatgacaacagagcctcagtcactgctcgtagatcttggtagtgacgccattttttcttgtgcttggaccggaaacccttcacttaccattgtgtggatgaagcgaggctcaggggtggtgttatctaacgaaaagacccttacactgaaatcagtcaggcaggaagatgccggcaagtatgtatgtagagctgtggtgccccgagtcggtgcgggtgagcgagaagttactctgactgtaaatggaccgcctattatcagttcaacccaaacacagcatgcactccatggagaaaaaggccagattaagtgtttcatacgcagtacacccccaccagaccgcattgcctggagctggaaggagaacgtgctggaatccggaacttcaggacgatacaccgtggaaactatctccaccgaagaaggagtgatatccacactgacgatttctaatatcgttagagctgattttcagaccatctataactgcaccgcctggaattctttcggatcggatacagagatcattagactgaaggaacagggaagcgagatgaaatcaggcgccggccttgaggccgagtccgtacccatggccgtcattataggggtagctgtaggtgctggtgtggcattcctcgtgttaatggccacaatagtagccttttgctgtgcacgctcgcagcgtagcacaggggggcgatcaggcataagtggccgcggcaccgagaagaaggctcgactccgcctgccaagacgggcctcgaagcaggaatgcaatgaacagggctcctag

SEQ ID NO: 121587 - DNA, 2301 bp, Artificial Sequence
  Description of Artificial Sequence: Synthetic coding sequence
atgaaaccgtttcagctggacctcttatttgtgtgtttctttctcttcagccaggaactgggactccaaaaacggggctgttgtcttgtgctagggtacatggcaaaggataaatttcgacgaatgaacgaaggacaggtctacagcttttctcagcaaccacaggatcaagtagtcgttagcggccagccagttaccctcctctgtgctatccctgagtatgacggcttcgtgctgtggattaaagacggcctggctctgggcgtgggacgtgacctgtcttcttatccgcaatacttagtcgtggggaatcatctatctggcgagcaccatctcaagatcctgcgtgccgagctgcaggacgacgcagtgtacgaatgccaagccattcaggcagccattagatcgcgccccgctcgactgactgtgctggttcctcccgacgaccccgtgatactgggcgggcctgttatctccttacgggcaggagatccgctcaatctcacctgtcatgccgataacgccaaaccggctgccagtatcatctggctgcggaagggtgaggtgatcaacggcgccacttactcgaagaccctgcttagagacgggaaacgcgagagtatcgtatccaccttatttatcagtccaggggatgtggaaaatggtcagagcatagtctgccgtgcgacaaacaaagctatccctggcggcaaggagacaagcgtgaccatcgatatccaacatcccccccttgtgaatctttcggtcgaaccccagcccgttctcgaggataatgttgtgactttccactgttcagcaaaagccaatcctgccgtgacgcaatacaggtgggcaaagagggggcagattattaaagaggcctctggcgaagtatataggactaccgtggactacacctactttagcgagcctgtgagctgcgaggtgacgaacgctttgggatcaactaatctctcaaggacagtggacgtctatttcggtccacggatgaccactgaaccccagagcctgctagttgatctgggttctgacgccatcttctcgtgtgcctggacaggaaatccaagtttgactatcgtgtggatgaaaagaggttctggcgtggtgctgagtaatgagaaaaccttgaccctaaaatctgtaagacaggaggatgcaggcaaatatgtgtgcagggcggtggtgccccgagtgggagcaggagaaagggaggttactcttactgtgaacggaccccctatcatttcaagcactcagacacagcatgcacttcatggagaaaaaggacagatcaagtgttttatccgctccacacccccgcctgacaggattgcctggtcatggaaggaaaacgtattggaatcaggcacatccggacggtacaccgtggagaccatctccactgaggagggcgtcatctcaacgttgacgattagcaatattgtgagagcagattttcaaactatctacaactgtacggcatggaacagctttggatcagacacagaaatcattcgcctcaaggaacaggaaagcgttccaatggcggttattattggagttgctgtaggggctggcgtcgctttcttggtgttgatggcaacgatagtcgccttctgttgcgctaggtctcaaaggaacttaaaaggagtggtctccgccaagaacgatatacgcgtcgaaatcgtccacaaagagcccgcctccggacgtgaaggagaagagcatagtaccatcaagcagctgatgatggacaggggggaattccagcaggacagcgtgctgaagcaacttgaagtcttgaaggaggaggaaaaagaattccagaatcttaaagacccgaccaacggatactactccgtgaacacgttcaaagagcaccactcaaccccaacaatcagtctgtccagctgtcagccagaccttcgtccagctggaaagcagagggtgcccacagggatgtccttcactaacatttattctacactctccggccaggggaggctctatgattatggtcagcggtttgtgctcgggatgggctcaagctctattgagctgtgcgagagagaattccagcggggcagcctgtctgactcatccagcttcttagatactcaatgtgattccagtgtgtcctcctcgggcaaacaggacggttatgtgcagttcgacaaagcttccaaggccagcgccagctccagtcaccactcccaatcaagcagccaaaactcagacccctcacgccccttgcagaggagaatgcagacgcatgtgtag

SEQ ID NO: 121588 - DNA, 1182 bp, Artificial Sequence
  Description of Artificial Sequence: Synthetic coding sequence
atgggtaaaagtgacttcttaacacctaaggccattgctaatagaattaaatcaaaaggtttgcaaaagctcagatggtactgtcaaatgtgtcagaagcagtgtagagacgagaacggctttaaatgccattgtatgagcgagagccatcagcgccagctgctgctcgcctcagaaaacccccagcagttcatggattacttcagtgaggagttccgtaacgatttcctggagttgttgcgacgccggtttggaacgaagcgtgtgcacaacaacatcgtttacaacgagtatatctctcaccgggaacatatccatatgaacgcgacccagtgggaaacccttacagattttacaaaatggctcgggcgggagggactgtgcaaggtggatgagactcctaaagggtggtatatccagtacatcgacagggacccagaaacaattcgcaggcaactggaactagaaaagaaaaaaaaacaggacctggacgacgaggaaaagaccgctaagttcatcgaagagcaggtgaggagggggttagagggcaaagagcaggaggtgccaacctttacggagttgagccgcgagaatgatgaggagaaagtgacattcaatctgtcaaagggagcgtgtagttcatccggcgccacatcaagcaagtcctccacgctgggcccgtctgcgcttaaaaccatcgggtccagcgcttctgtgaagcggaaagagtcaagtcaatcttccacacaatctaaggagaagaagaaaaagaagagtgccctggacgagattatggagatcgaagaagaaaagaagcggactgctcgaactgattactggctgcagccagagattatagtgaaaataattacgaaaaagttgggagaaaaataccacaagaaaaaagccatcgtcaaggaagtgatcgacaaatacaccgccgtggttaagatgatcgattccggcgataagcttaaactggatcaaactcacctggaaactgtgatccctgccccgggcaaacgtattttagttctcaatggcgggtatagaggaaatgagggaaccttggagtcaataaatgagaaaacctttagcgccacgatcgtgatagaaacagggcctcttaaaggtagacgtgtcgaaggaatccagtatgaagacataagcaaactggcctag

SEQ ID NO: 121589 - DNA, 1125 bp, Artificial Sequence
  Description of Artificial Sequence: Synthetic coding sequence
atgggtaagagtgacttccttacacctaaggccatcgccaatagaattaagtccaagggtttgcagaagttgaggtggtactgtcaaatgtgccagaaacagtgtagggacgagaacggattcaaatgccattgcatgagtgaatcacatcagagacagctgttgctggcaagcgagaacccacagcagtttatggactacttctctgaagagtttagaaacgacttccttgagctgctcaggaggcgtttcgggacgaaaagagtccacaacaatattgtctacaacgagtatatctctcatcgcgaacatattcatatgaatgctactcagtgggaaaccctgactgattttactaaatggttggggagggagggattgtgtaaggtcgatgagaccccaaaagggtggtatattcaatacatagacagggaccctgagaccattcgacggcaactggagctggaaaaaaagaaaaagcaggacttggatgacgaagagaagaccgccaagttcattgaagaacaggtacggcgcgggctggagggcaaggagcaggaggtcccaacatttacagagctttctagagagaacgatgaggaaaaagtgactttcaatctctcaaagggcgcctgctctagcagtggagctacatcttcaaaaagttctacgctcgggccatccgccctcaagaccatcggttcgagcgcctcagttaagagaaaggaatcaagccagagtagcacgcagagtaaggaaaaaaagaagaagaagagcgccctagatgagatcatggaaattgaggaggaaaaaaagagaaccgctaggactgactactggctccagcccgaaatcatcgtcaaaatcatcaccaagaagctaggggagaagtaccataaaaagaaggccatcgtcaaggaagtgatcgataaatataccgccgtcgtcaagatgatcgatagcggagataaactgaaactcgatcaaacccatctggagactgtaattcccgcccccggtaaacgaattctagtacttaatggaggctaccgaggcaatgaagggacattagagtccatcaatgagaaaacctttagcgccacaattgtgatcgagaccgtgtag

SEQ ID NO: 121590 - DNA, 867 bp, Artificial Sequence
  Description of Artificial Sequence: Synthetic coding sequence
atgaacgcgactcaatgggagaccctcaccgactttacaaagtggttaggccgagagggcctgtgtaaggtcgacgaaactcctaaaggctggtatatccagtacattgacagagatcccgaaaccatccgacggcagttagaactggagaaaaagaaaaaacaggacctcgatgatgaagagaagacggctaagtttattgaagagcaagtgcgtaggggattggagggaaaagagcaagaagtgcccacttttacggaattgtcccgtgagaatgatgaggagaaggttacatttaacttatcaaagggcgcgtgctcatcctcaggggcaacctcatccaagtccagcactctggggcccagcgctctgaaaaccatcggaagttccgcgtccgtaaaacgcaaggaatcctcccagagttcaacccaatctaaggagaaaaaaaaaaagaagagcgctctggatgagatcatggagattgaggaggaaaaaaaacggacagcccgcacggactactggctgcagcccgaaattatcgtgaagatcattaccaaaaaactaggcgagaagtatcacaagaagaaagccattgtgaaagaagtcatagacaagtacactgcggtcgtgaagatgattgatagcggggacaaactcaagttagatcaaacacatctggaaacagtaattccggcgcctgggaagagaatactcgtgctcaatggcgggtacagaggtaatgagggtaccttagaatccattaacgagaagacattctcagctacaattgtaatcgagacagtgtcacttttcacccagagacagaaattccagaacgccctgaagatgtgccactcttttttttag

SEQ ID NO: 121591 - DNA, 2361 bp, Artificial Sequence
  Description of Artificial Sequence: Synthetic coding sequence
atgaatgaggcaaaggtgaaagagacactgcgacggtgcggcgcgtccggggacgagtgtggccggttgcaatatgcgctgacctgtctccgcaaggttacagggctcggcggggagcacaaagaagactcatcgtggagctccctggatgctaggcgggaatccggctctggtcccagtactgacacactgtctgcagcctcactgccgtggccccctgggtcctctcaactcgggcgagcaggaaactcggctcaaggtcccagaagtatatctgtctccgcactaccagcatccgactcaccaacccccagcttttctgagggcctgagcgacacgtgcatcccgctgcacgcctctggccgcctgaccccaagggccctgcattcctttatcacaccccctacgaccccccaactgaggcggcatacaaaattgaaaccccctagaacacccccacccccatctcgtaaggtttttcagctcctgccatcgtttccaacgctgacccgaagcaagtcccatgaatcccagctcggcaatcgtattgacgacgtatctagtatgcggtttgatttgagccatggaagtccacagatggtccgccgtgatatagggcttagtgtgacacatagatttagtactaaatcctggctttctcaggtgtgtcatgtctgccaaaagtcaatgatcttcggtgtgaaatgtaagcattgtagactgaagtgtcacaacaagtgtacaaaagaggcccccgcttgtagaatctcttttctgccgttgaccagactgagacggacggagtcggttccttctgatatcaataaccctgtggacagggccgccgaacctcactttggcaccctgcccaaggctctgaccaaaaaagaacatcccccagcgatgaaccacctggactcgtcatcaaacccttcttcgaccacctcgtctactccatcttcgccagcgccattcccgacaagttccaatccctcttctgctacaactccaccaaaccctagcccaggccagagggactctcgctttaacttccctgctgcttatttcatccaccatcgccagcagttcattttccccgtgcccagcgccggccattgttggaagtgcctcctcattgccgagagcctgaaagaaaatgcctttaatatttccgctttcgcgcatgccgcacccttaccagaagcagccgacgggacgcgtctcgacgatcagccaaaggccgacgtgttggaggcccatgaagctgaggcggaagagcccgaggcgggaaagagtgaggccgaggacgacgaggacgaagtggatgatttgccctcaagcaggcgaccttggagggggcctatttctagaaaggctagccaaaccagcgtctatttgcaggagtgggacatcccctttgagcaagtagagctgggtgagcctattggccagggaagatggggtagagtacatagaggcaggtggcacggagaggtggcaatacgcttactcgagatggacggccataaccaggatcatctaaaactgtttaagaaggaagtcatgaactaccggcagaccaggcacgagaacgttgtattatttatgggggcatgcatgaacccaccccatctggccattattactagtttttgtaagggccgtactctccacagttttgtcagagatcctaagacttcccttgacatcaataagacgaggcagatcgcccaagagatcataaaggggatgggctatctacacgctaaggggatcgtgcataaggacctaaaaagcaagaacgtgttttatgacaatggtaaagttgtaatcactgactttggcctctttggtatatctggggtcgtgagggagggacgtcgcgagaatcagctgaagttatcccatgactggctgtgctatcttgctcccgaaatcgtgagggaaatgacacctgggaaggatgaggaccaacttccctttagtaaggccgccgatgtttatgctttcggcaccgtttggtatgaactgcaggcaagggactggccgttaaagaaccaagcagcagaggctagcatctggcagattggatcaggtgagggcatgaagcgggtcctgacgtcagtctccctcggcaaagaagtaagtgagatcttgtctgcatgttgggcgttcgatctgcaggagcgcccttctttttcattgctcatggacatgctcgaaaaattgccaaagcttaaccgcagactgtctcaccccggccacttctggaaatctgcagacataaatagctcaaaggtcgtgccacgctttgagcgtttcggactgggcgtgctggaatcttctaatcccaagatgtag

SEQ ID NO: 121592 - DNA, 2772 bp, Artificial Sequence
  Description of Artificial Sequence: Synthetic coding sequence
atggatagggccgcgttgcgtgccgcagcaatgggagaaaagaaggagggtggaggaggcggagacgctgccgccgctgaaggaggcgccggtgcggcagcctctcgggcactccagcagtgcggccagctgcagaagctgatcgacatttctataggaagtctgcgtggcctgcgcacaaaatgcgcagtgtctaacgacttaacacagcaggagatcaggacacttgaggcgaaactcgttcgctacatttgcaaacagcgccagtgtaagttgagcgtggccccaggtgagagaacacccgagctgaactcctatccacgttttagtgactggctttacaccttcaatgtacgccctgaagttgtgcaagagatcccccgggacctgaccctggacgcactgctcgaaatgaacgaggccaaggtcaaggagacccttaggcgctgtggagctagtggcgatgagtgcgggagacttcagtacgccctgacgtgcctcagaaaggtgacagggctcgggggtgaacacaaggaagacagcagctggtcttccctggatgccagacgagagagcgggtctggcccatctacagatactctttcggctgcttccttaccttggccgccaggatcaagccaacttgggagggccggaaattccgcacaaggaccaaggtcaatctccgtgtccgccctgcctgcatctgacagtcccaccccatcgttttcggagggcctcagtgatacttgcattcctctacatgccagtgggcggttgactccaagggcacttcatagttttattacaccccctactacgccccagctgagaagacataccaagctgaagcctcctaggacacccccaccaccctcacgcaaggtgtttcagctgctgccttctttcccaactttgaccaggtcgaagtcccacgagagccagctaggcaataggattgacgatgtttcctcaatgcggttcgatctcagccacggaagcccacagatggtgagacgggatataggccttagcgtgacccaccgattcagcacgaaatcttggctttcccaagtgtgccatgtgtgccaaaagtctatgatttttggggttaaatgcaaacattgcaggttaaaatgccacaacaagtgcacaaaggaggcacctgcatgtcgcatcagttttttgcccttgaccaggctaaggcggacagagagcgttcctagcgacatcaacaacccggtcgaccgggctgccgagcctcatttcggaacactccccaaggccctgacaaagaaagagcacccacctgcaatgaaccatctggatagttccagcaatccaagctctacaacttcgagcacaccctcctctccggccccttttccaacttcgtccaatccttcctctgcaaccactccgcctaacccaagcccagggcaacgtgattccagatttaacttccccgctgcctatttcattcatcaccggcaacagttcatctttcctgtcccgtccgctggccattgttggaaatgtttgcttatagctgaatcactcaaagaaaacgctttcaacatttctgcctttgcccacgccgcgccactgccagaggcggcagacggaacgaggctcgatgaccagcccaaggccgacgtgctggaggcgcatgaggccgaggcagaagaacccgaggccgggaagtcagaggctgaagatgatgaagacgaggtggacgatttaccgtccagtaggcggccctggcgtgggccaatttctagaaaggcatcacagacatcagtctatttgcaggaatgggacatccctttcgaacaggtggaactcggagaaccaatagggcaagggagatggggtagggtccaccgagggagatggcatggcgaggtggcaattcggctgttagagatggatgggcacaatcaagaccatctgaaactgttcaagaaggaagtgatgaattatcggcagacacgtcacgaaaacgttgtcctttttatgggcgcttgcatgaacccacctcacctggctatcattacctcattctgcaagggcagaactctgcactcttttgtgcgcgatccgaagacatctctggacatcaataagactcgccagattgcacaggagataatcaagggaatgggatatctccacgctaagggcatcgtacacaaggacctcaaatccaagaatgtattttatgataacggcaaggtggttataacggacttcggccttttcgggatcagtggcgtggtaagagaaggacgaagggagaatcaattgaagcttagccacgactggctctgttatcttgctcctgagatagtgagggagatgactcccggcaaagacgaagatcaattgccattcagcaaagccgccgacgtctacgcattcggaactgtatggtatgaacttcaagcgagagactggcctctgaagaaccaggcagctgaagcatcaatttggcagatcgggtccggtgagggtatgaaacgcgttctaacttcggttagcctcggaaaagaggtgtcggagatattgtcagcctgctgggcatttgacttacaggagcgcccaagcttttccctgcttatggatatgttggagaagttgcctaagcttaacagaaggctatcacaccctggacatttttggaaaagtgccgacattaactcttcaaaggttgtcccaagatttgaacgattcggactgggagttctcgagtcaagtaaccccaagatgtag

SEQ ID NO: 121593 - DNA, 2289 bp, Artificial Sequence
  Description of Artificial Sequence: Synthetic coding sequence
atgaacgaggctaaagtcaaggagaccctaagaagatgtggagctagtggcgacgagtgcggtagactgcagtacgcactaacctgcctgcgcaaggtgaccggcctgggcggggaacacaaagaggacagctcatggtcaagtctagatgcccggagagagagcgggagtggaccaagtactgacaccttatcagccgcatccctgccttggccacccgggagctcccagctaggccgtgctggaaattccgcacaagggccacggtccatttcagtaagtgctttgcccgccagcgatagtcctactcccagcttctccgagggcctgtctgatacttgcatccccctacacgccagtggccgcctgactccaagggctctccactccttcatcactcctcccacaacaccgcagcttcggcggcatacaaagctgaaaccgcctcgaacccccccccctcctagtcgaaaagtgtttcagctcttgcctagttttccaacgttgactcgatcgaagtcgcatgagagccagctggggaataggatcgatgacgtgtcctctatgcggttcgacttgtctcacggatctccccaaatggtcaggcgcgacatcggcctctctgtgacgcaccgctttagcactaagtcctggctcagccaggtatgccacgtttgtcagaagtctatgatatttggcgtgaagtgcaaacactgcagactgaagtgtcacaataagtgtaccaaggaagctccggcatgtcggattagttttctccccctgacccggctgaggcgcaccgaatctgttccatcggatattaacaatccggtcgacagggccgcagagccacacttcggtaccttacccaaggcgcttacaaagaaggaacacccacctgcgatgaatcacctcgactcctctagcaacccttcctccacaactagttcgaccccttccagtcctgcaccgttccccacttcatccaatccaagctccgcaacgacccccccgaacccttctcccgggcagcgggatagcagatttaattttcccgctgcttatttcatacatcataggcagcagtttatatttccagtcccttctgcagggcattgctggaaatgtcttctgatcgctgagtctctcaaagaaaacgcttttaatatcagtgcatttgcgcacgccgcgcccctcccggaggcagccgatggaacccggctggatgaccaacccaaagcggacgtcctcgaagctcatgaggctgaggccgaggagcccgaggctgggaagagcgaggcagaggatgatgaagacgaggtagatgaccttcccagcagccgacgaccgtggagaggtccgatttccaggaaagcgtctcaaacaagtgtatatctgcaagagtgggacataccctttgaacaagtggagctgggtgagcctataggtcagggtcggtggggaagagtccaccgcggacgctggcacggtgaggtcgcaattcggctcctcgagatggatggacacaaccaggaccacctaaaattgtttaagaaagaagtgatgaattatcggcaaactagacacgaaaatgtcgtgttattcatgggagcttgtatgaatccaccacacttagcgatcatcacctcattttgcaagggtcgaacattacattctttcgtcagagatcccaagacctcactggacatcaacaagacaaggcaaattgcccaggagatcataaaaggtatgggatatttgcacgccaaaggtatcgtacataaggacctgaagagcaagaacgtgttctacgataacggaaaagtcgtgatcaccgacttcggactttttggaatttccggggtggtgcgtgaaggtcggagggagaaccagctgaagctttcccacgactggctgtgttacctggcacccgaaatagtgagggaaatgacacctgggaaggacgaagaccaactgcctttctcaaaggcggccgacgtgtatgcattcggaacagtgtggtacgaacttcaagcccgagactggccactcaagaatcaggcggctgaggccagtatctggcagatcggctctggggagggcatgaaaagagtgttaaccagtgtctcactgggtaaggaggtgtcagaaattcttagtgcctgctgggcctttgacctccaggagcgaccttctttctccctcttgatggatatgctggaaaaactgccgaaactcaatcgtcgattgagccaccctgggcacttttggaaatctgcggagctgtag

SEQ ID NO: 121594 - DNA, 375 bp, Artificial Sequence
  Description of Artificial Sequence: Synthetic coding sequence
atgcaggcagacctggaaatacccagggatctgacgctggatgctctcctggagatgaatgaggccaaggtgaaagaaactctgcgacgctgtggcgcgtccggcgacgagtgcggcagactccagtacgctctcacctgcctcagaaaagtgactggtcttggcacatgggggctgccacccagccccttgcccggcctcgtgcctctcgggctgtggccctcgctttggtgggtgatggaaaggggcaagagaggacccgggttcctcggccagcccgggaaggcccgggtcggctgctcccagcctcccgagaaactgtcccagggaccccaggggtccgggtcgtggtgggtttggccgggcagaatttag

SEQ ID NO: 121595 - DNA, 1842 bp, Artificial Sequence
  Description of Artificial Sequence: Synthetic coding sequence
tgacactcattcatcactccaccaaccacacctcaactcagacggcatactaagttaaagcctcccagaaccccaccacctccatccagaaaagtgttccagctgctaccatctttccctacgctgactaggtccaaatcacacgagagtcagctcgggaatagaattgacgacgtctcttctatgagattcgacctaagccacggctctccgcagatggtccggcgcgatatcggcctgtctgtgacacatagattttctaccaagtcctggttatcacaggtgtgtcacgtgtgtcagaaaagcatgatttttggagtcaagtgcaagcactgcagactgaagtgtcacaacaagtgtacaaaggaggcccctgcctgcagaatcagctttctgcctctgacacggctgcgtcggactgagtcagtccctagcgacataaacaacccagtggaccgagctgcagaaccccacttcggaacactaccaaaggcgctcaccaagaaggaacacccacctgccatgaatcatctggactctagcagtaatccctcatcaacaacttccagtaccccatcatccccggcacctttccccacctcttccaatcctagctcagccactactcctcctaacccatctcccgggcagcgtgacagcaggttcaactttcctgcagcttattttatccatcaccgtcagcagtttattttccccgatatctccgcctttgctcatgcggcccccctgcctgaagcagcagacggtaccagactggatgatcagcccaaggcggatgtcctcgaggcccacgaagccgaggccgaggaacccgaagcaggaaagtccgaagctgaggacgatgaggacgaggtggatgatttgccatccagcaggcggccctggcggggccctatttcgaggaaggcaagccagacctcagtataccttcaggagtgggatattccatttgagcaagtagaactgggagagcctatcgggcaaggcaggtggggccgggtgcatcgcggccgatggcacggtgaggtagccataaggttgctcgaaatggacggacataaccaggatcacctgaaactctttaagaaggaggtgatgaattatagacagacacgacatgagaacgtggtgttgttcatgggagcttgcatgaatccccctcatctagccatcatcacctcattctgtaagggaaggacattgcacagttttgtgcgcgatcccaagactagcctcgatatcaacaagaccagacagatagcccaagaaattataaagggtatgggttatctccatgctaaaggcatcgtgcataaagacctgaaaagtaaaaacgtcttctacgacaatggcaaagtagtgattactgattttggcttgtttgggatttctggagtggtgcgggaaggacgtcgcgaaaatcagctgaagctttcccacgactggctctgttatctggctcctgagatcgtgagggagatgacgccaggaaaagatgaggaccagctgccattctcgaaagcagccgacgtgtacgctttcggaacagtctggtatgagctgcaggcgagggactggcccttgaagaatcaggccgccgaggcctccatatggcagatcggcagcggggagggtatgaaaagagttttgacttcagtcagcctggggaaagaggtttccgagatccttagtgcatgctgggcttttgacctgcaggaacgtccctcttttagtctgctgatggatatgctagaaaagctgccgaagttaaacagacggttatcccatcccggacatttttggaagagtgccgaactgtag

SEQ ID NO: 121596 - DNA, 2634 bp, Artificial Sequence
  Description of Artificial Sequence: Synthetic coding sequence
atggatagggccgccctgagggctgccgcaatgggagaaaagaaggagggcgggggtggcggcgatgcagccgccgcggagggaggcgcaggggccgcagcgagtcgagccttgcaacagtgcggtcaattgcagaaactgattgacatcagcatcggatctctccgtggactacgtacaaagtgcgctgtctctaatgacctgacgcagcaggaaatacgcaccctcgaggcaaaactagttaggtacatttgtaagcaaaggcagtgcaaattgtccgtggctccaggagagcgtacaccagaattgaattcctaccctcgttttagcgactggctgtatacatttaacgtcagacctgaggtggtacaagaaattcctcgcgacctgaccctcgacgcattattggagatgaacgaagctaaagtaaaggagactttgcggaggtgcggagcttcaggagacgaatgcggcagattacaatacgctctgacctgccttcgtaaagtgactgggttgggaggggagcacaaggaggactcttcttggtcctcactggacgcccgtcgtgagagtgggagtggcccgtcaacagataccctctctgccgccagcctgccgtggccccccggctccagtcagctgggacgagccggaaactccgctcaaggtccccggtctattagtgtcagcgccttgcccgcctcagactcacctacacccagcttttccgagggcctttctgatacttgcatcccactacacgcgtcaggccggctgacaccaagggcactgcactctttcattacacctcccaccacccctcaactgaggcgacacacaaaactgaaacccccccggacccctcccccgccgagcagaaaggtatttcagctcctgccctctttcccaacacttacgcgttccaaatctcacgaatctcagctgggaaacaggatcgacgatgtctcgtccatgcggttcgatctcagtcatggctcccctcaaatggtccgccgcgatataggcctgtctgtcacccatcgctttagtacaaagtcctggctctcccaggtttgccacgtatgccagaagtcaatgatttttggggtcaagtgtaagcattgtagactcaagtgccataataaatgcactaaagaggccccggcttgtcgcatttcattcctcccactcacccgactgaggcggaccgagagcgtaccaagcgacatcaataatccagtggaccgcgcggccgagcctcatttcggcacgttgcctaaggccctaacaaaaaaggaacaccccccagctatgaatcacctcgactcctctagtaacccctctagcacaacatcaagtactccaagtagtcccgcccccttccccacgtcttcgaacccttcttccgcgaccactcccccgaacccgagtcccgggcagcgggatagtaggtttaacttccctgcagcatacttcattcaccatcgccagcagttcatttttcctgatatctccgccttcgcccacgccgcacctctccccgaagccgcagacggaacacgcctggatgatcagccaaaagccgacgtactcgaggcacatgaggccgaagctgaagagcctgaggctggcaaatccgaggcagaggatgatgaagacgaagtggatgacctacctagtagtaggcgcccatggcgcggtccgatttcacggaaggcatcacagacatccgtctacttgcaggagtgggacattccctttgaacaggtcgaattaggcgaacctattggtcagggccgctggggaagggttcaccggggcagatggcacggggaggtggctatacgcctgctggagatggacggacacaatcaggatcacttaaaactttttaaaaaggaagtcatgaactacaggcagacaagacacgagaatgtggtgctattcatgggtgcatgtatgaatcccccgcatcttgccataataacatctttctgtaagggacggacacttcactcattcgtgagggatcccaagacgtccctagacattaataaaacccgtcagatcgcacaggagattatcaaagggatgggatacctgcacgccaaggggatcgtgcacaaggatctgaagagtaagaacgtattttatgataatggtaaggtggtaatcacggacttcgggttgttcggaatcagtggtgtggtacgagaaggacgcagagagaaccaactaaagctgtcacacgactggctgtgctatttagcccccgagatcgtaagagaaatgacccccggcaaggacgaagatcaactgcccttctcaaaggcagcagacgtctacgcttttgggaccgtttggtatgaactgcaggctcgggactggccactcaagaaccaggctgccgaggccagcatttggcagatcggctctggtgaagggatgaaacgcgtgctgactagtgtgtcgttagggaaagaggtcagcgaaatcctaagcgcatgctgggcctttgaccttcaagaacgacccagcttctctctcctgatggacatgctggagaagcttcctaaattaaaccggcgcctttcacaccctggacacttctggaagtctgcagagttgtag

SEQ ID NO: 121597 - DNA, 1311 bp, Artificial Sequence
  Description of Artificial Sequence: Synthetic coding sequence
atgtacaacaagaaagccaaaatggaacccaacgcaagtgagtccgcaatccccgctaggaggcaacgtcagcctcgagccaagaaaaagtcaaagccgctgaatctgaagatccactcttcagtcgggtcctgtgagaatattccttcacaacagcggagcccattgctgagcgagcgctctctgagatcgttcttcgtcgggcacgcccctttcctcccatcaactcctcctgtccacactgaggccaatttttctgccaataccctttccgtgcctaggtggtcgccacaaattcctcgcagagatctggggaattccatcaagcaccgcttctcaacaaaatattggatgtcacagacatgtactgtgtgcgggaagggaatgctgtttggactaaagtgtaaaaattgtaagcttaagtgtcataacaaatgtaccaaggaggcacctccatgccatctgttaattatacatcggggggatcctgcaagactcgtccggactgaaagtgtgccctgcgatattaacaacccactccgtaaaccgccgcgatattcggatctgcatatttcacagacactcccaaaaacaaataagattaataaagatcacatcccggtcccataccaacctgactcatcgagcaaccccagttctactactagtagcacaccatctagccctgcgcctcctctccccccaagcgccactccgccatccccacttcatcctagcccacagtgtacgcgtcagcagaagaatttcaacctgccagcctctcactactataaatacaagcagcaattcattttcccggacgttgttccagtgccggagacacctacccgggcccctcaagtgattctccacccagtcacgagcaaccccatccttgaaggcaacccacttctgcaaatcgaagtggagccaacttcagagaatgaggaagtccacgatgaggctgaagaatccgaggacgacttcgaagaaatgaatttgagtcttctgtcagccagatcttttcctcgcaaagcctcccaaacctctatatttctccaggaatgggacatcccttttgagcagttagagataggtgaactcattggaaaaggccggttcggccaggtgtaccatggtagatggcatggggaagtcgcgatacggcttatcgatatcgagcgcgacaatgaagaccagctgaaagcgtttaaaagagaggtgatggcgtaccgccaaactcggcacgagaatgtggttcttttcatgggagcttgtatgagccctccccatctcgccataattacttag

SEQ ID NO: 121598 - DNA, 2853 bp, Artificial Sequence
  Description of Artificial Sequence: Synthetic coding sequence
atggacgaagagaatatgaccaagtcagaagagcagcaacctctatctctgcaaaaagctctgcagcagtgcgaactggtccagaatatgatcgacttgagcatatcaaatttagagggcctccgcactaagtgcgccacttccaacgatctgacgcagaaggagatccgcactctggaaagtaagctcgtgaaatacttcagcagacaactttcctgcaaaaagaaggtggctctacaagaaagaaatgccgagctagacgggtttccacagctaagacactggttcagaatcgtcgatgttaggaaggaggttctggaggaaattagcccaggacagctttctctagaggaccttcttgaaatgaccgatgagcaggtctgtgaaaccgtcgagaaatacggagccaaccgggaggagtgtgcccggttgaatgcctccctcagctgcctgcggaacgttcatatgtccggaggcaacctgagcaagcaggattggactatccagtggcccaccacggagacaggtaaggagaacaacccggtgtgtcccccagagcccaccccatggattcggacacatctatctcaaagcccccgcgtgccctccaagtgcgttcagcactactgccacacctcgcccacacctggggcacctgtatacacgcacgtcgataggctgacagtggatgcctatccaggcctctgcccaccaccacctctggagtcgggccatcggtccctgcctccctcgccacggcaaagacatgccgtccggacacctccacggacacctaatattgtaacaactgttactcccccgggcactccaccgatgcggaaaaagaataagctcaagccaccagggacaccgcccccctcatcacgcaaactgatacacctcatccccggctttaccgcccttcaccgaagcaagagccacgaatttcagttgggccaccgagtagacgaagcccacacgcccaaagccaaaaagaaatcgaagccgctgaacttaaagatacacagctcagtcgggtcatgcgagaacattccatcgcagcagcgcagccctctgctctcagagagatcgctgcgcagcttcttcgtggggcatgcgccattccttcctagcacccccccggtgcataccgaagcgaatttttcagccaataccctgagtgtaccgcggtggtccccccagattccccggcgcgacttggggaattctattaaacaccggttcagcactaagtactggatgagccagacctgtacggtttgcggaaaaggaatgctgtttggtctgaaatgtaaaaactgcaaactgaaatgccacaataaatgcacaaaagaggccccgccgtgccatctgctgattattcataggggcgaccccgcgagactggtgcgcacggaatctgtcccatgcgacataaataatcctttgcgaaaaccccctcggtattcagacctacatatctcccagactctgccaaagaccaataagattaataaggaccacatcccagtgccctaccagcctgatagttcttcaaacccttcatctactacatcctcaaccccttcaagccccgcccctcctttgccaccctcagctacacctccctctcctctccatccgagccctcagtgtacaagacaacaaaagaacttcaatctgcccgcctcacattactacaaatataagcagcagtttatttttcccgacgtggtgccagtacctgaaactccaaccagagcaccccaggtgattctccatcccgttacttccaaccccattctggagggaaatccgctactccagatagaggtggagccaaccagtgagaatgaagaagtacacgatgaggcggaggaatccgaggacgacttcgaagagatgaacttgtctttgctcagcgcccgctcattcccccgcaaagcaagtcagacttcgatctttttacaggaatgggacatcccgtttgaacaactggagatcggcgagttgatcgggaagggccggtttggacaggtgtatcacgggcggtggcacggtgaagtagctattagactgattgacatcgaaagagacaacgaagaccagctcaaggctttcaaaagagaggttatggcgtaccggcagacacgccacgaaaacgtggtcctgtttatgggggcctgtatgtcaccaccgcacttagccataatcacctcactttgcaagggacgcacactgtactccgtggtgagggacgccaagatcgtgctggatgtcaataaaaccagacagattgcacaggaaattgtgaaaggcatgggctatttgcacgcgaagggaattctacacaaggatctcaagagcaaaaacgttttttatgacaacgggaaggtggttataacagacttcggtctcttcagcatttccggggtgctccaagccggacggcgcgaggataaactcagaatccagaatggatggctgtgccacttggcccctgagattatacggcagcttagcccagataccgaagaagacaaactacctttctctaagcactcagatgtgttcgccctgggaaccatctggtacgagctgcatgcacgggagtggcccttcaagacacagccagcagaggccatcatctggcaaatggggacagggatgaagcctaatttatcgcaaatcgggatgggaaaggaaataagcgacattcttctcttttgctgggcattcgagcaggaagagcggcccactttcaccaagctgatggacatgctggagaaactgcccaaacgaaatagaaggctatcccatcccggacatttctggaaatccgccgaattgtag

SEQ ID NO: 121599 - DNA, 2766 bp, Artificial Sequence
  Description of Artificial Sequence: Synthetic coding sequence
atgatagacctatccatttctaacctagagggcctccgcacgaaatgtgcgacaagcaacgatttgacccagaaagagattcgaaccctggaaagcaagctggttaaatacttctcgcggcagctgtcatgcaagaaaaaggtggccctacaagagcgtaacgccgaacttgacggcttcccccagttaaggcattggttccgcatcgtggacgtgagaaaagaggtgttggaagagatatcccctggtcagctgtccctggaagatctcctggagatgacagacgagcaggtatgtgaaaccgtcgagaaatatggcgcgaatcgggaggagtgcgctaggctcaacgcatcactgtcttgcctaaggaatgttcatatgtcggggggcaacctatcaaaacaggactggaccatccagtggcctacaaccgagacgggcaaggagaacaatcccgtctgtccacctgaacccacaccctggattcgaactcatttatcccagtcaccaagagtaccctccaagtgtgtgcagcactattgccacactagccccactcccggagctcctgtctacacacatgtcgatagattgacagtcgacgcgtatcccggtctgtgccctccccccccactggaatctggacaccggtcgctgcctccatccccccgtcagcgccacgcagtcagaactcccccgcggacaccaaacatagtgactaccgtgaccccccctggcactcccccaatgcgcaagaaaaataagctcaagcctcccggcactcctccaccatcttcccgcaaattgatacacttaattccaggtttcaccgccctccaccggtctaagagccatgagttccagctggggcatcgtgtcgatgaggcccacactccgaaggcgaagaagaagtccaagccattgaatctgaagattcatagcagcgtaggatcgtgcgaaaacatcccctctcagcaacgctcacccctcctctccgagcggagtctgagaagctttttcgtggggcacgccccttttctcccttcaactcctccagtccataccgaagctaacttctcggcgaacacgctctccgtcccccgttggagcccccaaattccaagacgagaccttggaaacagcatcaaacacagattctctacgaagtattggatgtcccaaacttgtaccgtgtgcggcaagggcatgttatttggacttaagtgtaagaactgtaagttgaagtgccataataaatgcacaaaggaagctccaccatgccacctcctcataattcaccgaggtgatcccgctagattggttagaacagaaagcgtcccttgtgacataaacaaccctctacggaaacctcctagatattctgatctgcacattagtcagacgctacctaaaaccaataaaattaataaggaccatattcccgtgccatatcaaccagactccagttccaacccttcctccaccacatcctctaccccaagtagccctgcacctccgctacctccctctgccacccccccatcacccctgcatccatctcctcagtgcacgcgccaacagaagaacttcaacctccctgccagtcactattacaaatataaacagcagttcatattcccagacgtcgtgcccgtgccagaaacccctacgcgggctccacaggtcatcctccatcctgtgacatcaaaccccatcctcgaggggaatccgctcttgcagatagaagtggaacctacttcagagaatgaggaagtccatgatgaggcggaggaaagtgaggacgactttgaggagatgaacctgtcactgctgagcgcccggagttttcctcgcaaggcttcccaaacatcaatatttctgcaggagtgggatatcccatttgaacagctagagattggagaactcatcggcaaaggtcggttcggccaagtgtatcacggacgatggcacggcgaagtggcaattcggctaatagatattgagcgcgataatgaagaccagctcaaggcctttaaaagggaggtcatggcttatagacagaccaggcatgagaatgtcgtgctctttatgggggcctgtatgtcgcccccccacttagcaattataaccagcctctgtaagggccgcacactgtatagtgtcgtgagagatgcaaagatagtgctggatgtgaacaagactcggcagatcgcccaagaaattgtcaaaggcatgggttacctgcatgctaagggtatcctccataaagacttgaagagtaaaaatgtgttctatgataatggtaaggtggttattaccgactttgggctctttagcatatctggagtgctgcaggcggggaggcgggaggacaaattgagaatacagaatggatggttatgtcacctggcaccggagatcatacgccaactttcacccgacacggaggaagataagctcccattctccaaacactctgacgtgttcgcactgggcaccatatggtacgagctacacgcaagggagtggcccttcaaaacccagcccgccgaagcaataatatggcaaatgggcactggcatgaagcccaatctaagtcagatcggcatgggcaaggaaatttccgacatactccttttttgttgggcgttcgagcaagaggagagacctaccttcacaaagttaatggatatgctagaaaaacttccaaaacgaaaccgtagattgagccatccggggcacttctggaagtctgcagaactgtag

SEQ ID NO: 121600 - DNA, 1245 bp, Artificial Sequence
  Description of Artificial Sequence: Synthetic coding sequence
cgggctaagaagaagtccaagcccctcaacctcaagatccactctagcgtgggaagttgcgagaatatcccctctcagcaaagatcccccctgctgtccgagagatcgctgcgttccttctttgtagggcacgcgcccttcctcccttctaccccccctgttcacaccgaggctaacttctcagccaacactctctccgtgcctaggtggtccccacaaatcccccggcgggaccttggcaattctattaagcatagattctccaccaaatactggatgtctcagacatgtacagtttgcggaaaaggtatgcttttcggattgaagtgtaagaattgcaaacttaagtgccacaacaaatgtaccaaagaagcacccccctgtcacctgttgatcatccaccggggagaccctgccaggttagtcagaaccgagtccgtgccatgtgatattaacaatccactgcggaagcctcccagatattctgatctccacatctcacagactctgcctaagactaacaaaatcaacaaggatcatatcccggttccataccagccagactcgtctagcaatccctcatcaactacaagctctacaccgagctcgcccgcacctccactgcctccctctgctacacctccttccccattgcatccgtcacctcagtgcacccggcagcaaaaaaacttcaatctgcctgcctcccattactataagtacaagcagcaattcatatttccagacgtggtgcccgttcctgaaacacccacacgtgcaccccaggtgattcttcaccccgtgacatccaacccaatactcgaggggaatccactgctccagattgaggttgagccaaccagcgagaacgaggaggttcatgacgaggcggaggagagcgaggatgacttcgaggagatgaatcttagccttctttctgctcgctccttccctcgtaaagcatctcagacctccatctttttacaggagtgggacatcccatttgagcaactggaaatcggtgaactgattggtaaaggaagattcggtcaggtgtaccatggtcgatggcacggagaagtggccatcagactgattgatatcgaaagagataatgaggatcagcttaaagcgttcaagcgagaggttatggcctaccgccagacaaggcacgaaaacgtcgtgctgtttatgggggcatgtatgtcccccccacacctggctatcattacccggcccgtttag

SEQ ID NO: 121601 - DNA, 3921 bp, Artificial Sequence
  Description of Artificial Sequence: Synthetic coding sequence
atggaattctacgagtctgcctacttcatcgtgttaatcccttcaatagtaattactgtaatcttcctgtttttttggctgtttatgaaagaaaccctctacgacgaggttttggccaaacagaagcgcgaacagaagctgattcctactaaaactgacaaaaaaaaggccgagaagaagaaaaataagaaaaaagaaattcaaaatggcaacctgcacgagagtgactcagagtccgtgcccagggatttcaaactgtctgacgcgctagctgtggaggatgatcaagtggctcccgtgccgctgaatgtagtcgaaactagtagctcagtccgcgagagaaaaaaaaaggaaaaaaagcagaagcctgtgttggaggagcaggtcataaaagagtcagacgcctctaaaatccccggtaaaaaggtcgagcccgtgcctgtcacaaagcagcccactccaccaagcgaagcagctgctagcaagaagaaacctggacagaagaagtctaaaaacggcagcgatgaccaggacaaaaaggtggaaaccctcatggtgccttcaaaacggcaggaggcactgcctctacaccaggagaccaaacaagagagtggatcagggaagaagaaagcatcttctaagaagcagaaaacagagaacgtctttgtggacgaacctttaatccatgctactacctatatcccccttatggacaacgcagattcttctccagtggtggataagagggaagtgatcgaccttctgaagccggatcaagtcgaaggtatacagaaatccggcacaaagaagttaaaaaccgagaccgataaggaaaatgccgaggtaaaattcaaagactttctgttgagcttgaagaccatgatgtttagtgaggacgaggccttgtgtgtcgtcgatttgctgaaagagaaaagcggagtaattcaagacgcccttaagaagtcaagcaaaggagagctcacaacacttattcatcagctccaggagaaggacaaacttctggccgccgtaaaagaagatgctgccgctacaaaggatagatgcaagcagctgacccaagaaatgatgactgagaaggaacggagcaatgtcgtaatcactcggatgaaggatcggattggcaccctggaaaaagaacacaatgtcttccagaataagatacacgtgtcctaccaggaaacacaacagatgcagatgaaattccagcaagtgcgagagcaaatggaagccgagattgcccatctaaagcaggagaacgggattcttagggacgcagtgagcaatacaacgaatcagctggagtctaagcaaagtgccgagctcaataaactgaggcaagattacgcccgcttggtcaacgaactgacggaaaagaccgggaaattacagcaggaagaagtacagaaaaagaacgccgagcaggctgctactcaactgaaggttcagctgcaggaggccgagagacgctgggaggaagtgcagtcctatatcaggaaacgcacggcagaacacgaggcagcccagcaggacctccagtcaaagtttgtggccaaagagaatgaggtgcaatctctccactctaagctaacggataccctcgtgtctaagcagcaacttgaacagagactgatgcagctgatggaatcagagcagaaacgcgtgaacaaagaggaaagcctgcagatgcaggtgcaggatatccttgagcagaacgaggccctcaaagcccaaattcaacagtttcatagtcagattgcggcgcaaacctccgctagtgtactggctgaggaattgcacaaggttatcgcagaaaaggacaaacagatcaaacagacggaagacagtcttgcttctgagagagaccggctgactagcaaagaagaggaactgaaagacatccagaacatgaatttcctcctgaaagccgaggtccagaagctccaggctttggccaacgaacaggcagcggccgcacacgagctcgagaaaatgcaacagtctgtgtacgttaaagatgacaaaatcagactgcttgaagagcagctccagcatgagatcagcaataagatggaagagtttaaaatcctgaacgatcagaacaaagccctgaaatctgaggtgcaaaaactgcagacattagtttcagaacaacccaacaaagacgtggttgaacagatggaaaaatgcatacaggaaaaagatgaaaaattaaagactgttgaggaactgctggagaccgggctgattcaggtggctaccaaggaggaggaactgaatgccatccgcacggaaaacagtagtctgacaaaagaggtacaagatctcaaggccaagcagaacgatcaggtgtcgttcgcctctttagtagaggagctaaagaaagtcatacatgaaaaggatggaaagattaaaagcgtggaagagctactggaggccgaactgctcaaagtggccaataaggaaaagacagttcagctgtctatcacttccaaagtacaagaactgcagaatctactgaaggggaaggaggaacaaatgaataccatgaaggccgtcctggaagaaaaggaaaaggacctggcaaacactggaaaatggctccaggatttacaagaggaaaatgagtcactgaaagcccatgtacaggaagtcgctcagcacaatctcaaagaagcatcctccgcctctcagttcgaggaacttgaaatagttttgaaggaaaaagagaacgaacttaaaagattggaggccatgctgaaagaacgtgaaagtgacctgtcaagtaaaactcaactactccaggatgtgcaagatgagaataagctctttaagtcccagattgagcagctgaagcaacagaactaccagcaggcgagcagttttccaccgcatgaagaattactgaaagttatctctgagcgggagaaagaaatctctggcctttggaatgagctggactctttgaaagatgctgttgagcatcagagaaagaagaataatgatctgagggaaaagaattgggaggccatggaggcacttgcaagcacagagaagatgttacaggacaaggtgaacaaaacttcgaaagaacgccagcagcaggtggaagccgtggaacttgaagcaaaagaagtgctaaagaagctattccccaaggtgagcgtgccgagtaacctgtcctacggtgagtggctgcatggttttgaaaagaaagccaaggaatgtatggccggcaccagtggctccgaggaggtgaaggtcctggaacacaagctgaaagaggcagatgagatgcacactctgttgcagttggaatgtgagaagtacaagtccgtccttgccgagacagagggtatcttgcagaaactgcagagatcagtagagcaggaagagaataagtggaaggtcaaggtcgatgaaagccacaagaccatcaagcagatgcagagctcttttacatcaagtgaacaggagttagagcggctccggagcgaaaacaaagacattgagaacctgagaagggaacgggagcatctcgagatggaattagagaaggctgaaatggagcggtccacgtacgttactgaggtgagggaactgaaggctcagctcaacgaaactctcacaaaacttcgaaccgagcagaacgagcggcaaaaggtggcaggcgatctgcacaaagctcagcagagtctggagctgattcagtctaagattgtcaaagcagcgggcgacacaaccgttatcgaaaattcagatgtgagtcccgaaacagaaagcagtgagaaggaaactatgtctgtgagcctgaatcagacagtgacacagctccaacagctgctgcaggccgtgaatcaacaattgacaaaagaaaaagaacactatcaagtcctggagtag

SEQ ID NO: 121602 - DNA, 4074 bp, Artificial Sequence
  Description of Artificial Sequence: Synthetic coding sequence
atggaattttatgagtccgcttacttcatcgtccttatcccatccatcgttataaccgtcattttcctgtttttctggctctttatgaaggagacactttatgatgaagtgctggcaaaacagaaacgcgagcagaaactgattcccactaagacggataagaaaaaagccgaaaagaaaaagaataaaaagaaggaaatacagaatggaaacctgcatgagagtgactcagagtcagtgccccgcgacttcaagttgagtgatgctcttgctgtggaggatgatcaggttgcacccgtgcccctcaacgtcgtggagacgtcatcctctgtgcgggagaggaagaaaaaggaaaagaaacagaagcctgtgctggaggagcaggtgatcaaggaatctgatgcctcaaagatcccgggaaagaaggtggagccagttcccgtaaccaaacagcctaccccaccttctgaagcagccgccagtaagaagaagccaggccagaaaaagtccaaaaacggaagtgacgaccaggacaagaaggtagagactctgatggtgccatccaagcgacaagaagctctgcctttgcatcaggaaaccaaacaagagtccggctcaggtaagaagaaggcttcatcaaaaaagcagaaaaccgagaatgtatttgttgatgaacccctgatccacgcgacgacttacatcccccttatggacaacgccgatagttccccagttgtggataagagagaagtcattgatttactgaagccagaccaagtcgaaggaatacagaaaagcgggactaagaaactgaagacggagacagacaaggaaaacgcggaggtgaagtttaaggactttctcttatctctcaaaaccatgatgttttcagaagacgaggcgttgtgcgtggttgacctcctgaaggagaaatctggggtaattcaggatgcactgaagaaatcatcgaaaggcgagttgacaaccctgattcatcagcttcaggagaaggataaactcctcgctgccgtgaaggaggacgctgccgccaccaaggaccgctgcaaacagctgacccaggagatgatgaccgaaaaggagagaagtaatgtggtcattactagaatgaaggaccggattgggactctggagaaagagcataacgtgttccagaataagattcacgtttcttatcaagaaactcagcaaatgcagatgaaatttcagcaggttagagagcagatggaggccgagattgctcacctcaagcaagagaacggaattctgcgagatgccgtgtctaatacaacaaatcagttggagagcaaacagagcgcagaactcaacaagctgagacaggactacgctcgcctcgtcaatgagcttactgagaaaacaggaaaactccagcaggaagaggttcagaagaaaaatgcagagcaggccgctacacaactgaaggttcagttgcaagaagctgagcgaaggtgggaggaggttcagagctacattcggaagcgtaccgctgagcacgaagccgcgcaacaagacctccaaagcaagttcgtggccaaggagaacgaggtccagagcctgcattccaagctgacagacactctcgtctcaaaacagcagttagaacagcggctgatgcagctaatggagtctgaacagaagagagtaaataaggaggagtctctgcagatgcaggtgcaggatatcctcgaacaaaacgaagcccttaaggcccagatccagcagttccatagccaaatcgccgctcagacttccgcaagcgtcttggctgaggagcttcataaggtaattgccgagaaggataaacagatcaaacaaactgaagacagcctcgcctcggagagggatcgtttgacaagcaaagaagaggaactcaaggatatccaaaatatgaactttctacttaaggccgaagtgcagaaactgcaggcactggcaaatgaacaggcggcggccgcacatgaactcgagaaaatgcagcaaagcgtgtacgtcaaagatgataaaattagactgttagaagagcagctacagcacgaaatctcaaacaagatggaggaattcaaaatcctcaatgaccagaataaggcgttgaaatccgaagtgcagaaactgcagacgctcgttagtgagcaaccaaacaaagacgtggtggagcagatggagaagtgtatccaggagaaggacgagaagctgaaaactgttgaagagctgctggaaaccggactgatccaggttgctactaaggaagaagaactcaacgcgattagaacagagaatagttctctgaccaaggaggtacaagatttgaaggccaagcagaacgaccaggtgagcttcgcttcgctcgtggaagagttgaaaaaggtcatccacgaaaaggacggcaagatcaagagcgtggaggagctgttggaagccgagttgctgaaggtcgctaataaagagaaaacagtacaggaccttaaacaggagatcaaagccctcaaggaggaaatcggaaatgtacaactcgagaaagcccagcaactgtctatcacgagcaaggtccaggagcttcagaacctgctgaaaggtaaggaggagcagatgaacaccatgaaggctgtgctggaagagaaggaaaaggacttggccaacactggcaagtggttgcaggatctgcaagaagaaaatgagagtcttaaagcccatgtccaggaggtggctcagcacaatctcaaagaggcttccagcgcatctcaatttgaagaactcgagatcgtgctcaaggagaaagaaaatgagctcaagagacttgaagcaatgctgaaagaacgggaatctgatctgtcgagcaagacacagctgttacaggacgtacaggatgagaacaaactgtttaagtcccaaatagaacaactcaaacagcagaattatcagcaagccagttcctttccgcctcacgaagagctgctcaaagtgatctccgagagagagaaagaaataagtggactttggaatgagcttgactcgctcaaggacgccgtggaacatcagaggaaaaagaataacgatcttcgggaaaagaattgggaggcaatggaggccttagccagtaccgagaagatgctgcaggacaaggtcaataaaacctcgaaggagcggcagcagcaagtggaggcagttgagctcgaggccaaggaggtcctgaaaaagttattcccaaaggttagtgtgcctagtaatctgtcatacggggaatggcttcatggcttcgaaaagaaagccaaggagtgcatggctggtacctctgggtcagaggaggtaaaagtgctcgaacacaagctcaaggaggccgacgagatgcacaccttgttgcagttggaatgtgagaagtataagtccgtactcgccgaaacagaaggcatactgcaaaaactacagcgttccgtggaacaggaagagaataagtggaaagtgaaggtggacgagtctcacaagaccattaaacaaatgcaaagctccttcacctcctcagagcaggagctcgaacgactgcggagcgagaataaggatatagagaacttgagacgtgagagagagcacctcgagatggagctggagaaagccgagatggaaagaagcacctatgttacagaagtccgggagttaaaagatctgttgactgaactgcaaaaaaagctggatgactcgtattccgaagcagttaggcagaacgaggaacttaatctactcaaagctcagcttaacgaaaccctcacaaagttgcgtacagagcagaacgagcggcagaaggtcgccggtgatctccacaaggcccagcagagtctagagctgattcagagcaagatagttaaagctgccggggacaccacagtgatcgaaaattccgacgtttcgcctgagacagaatctagcgagaaggaaacaatgagtgtatctctcaaccagaccgttacccaactacagcagctccttcaagcagtcaaccaacagctgacaaaggaaaaggagcattatcaggtgcttgagtag

SEQ ID NO: 121603 - DNA, 3921 bp, Artificial Sequence
  Description of Artificial Sequence: Synthetic coding sequence
atggaattctatgagagtgcatacttcatcgtgttgatcccgtctatagttatcaccgtgatctttctcttcttctggttgtttatgaaggagacattgtacgatgaggtgttggcgaagcagaaaagggagcaaaagctcattcccaccaaaaccgataaaaaaaaggcagaaaagaaaaagaataagaaaaaagagatccaaaacggcaacctgcacgagtctgactccgaatcagtcccccgcgattttaaactctctgatgccctggctgtggaggatgatcaggtggcccctgtaccgctgaatgtagtggagacaagcagttcggtgagagagaggaaaaagaaggagaagaaacagaagccagtgttggaagaacaggtgatcaaagagagtgacgcaagcaaaattccaggaaagaaggtagaacccgtacccgtgacaaagcaaccaacccctccaagcgaggctgctgcttccaaaaaaaaacccggccaaaaaaagtccaaaaacgggtcagacgatcaggacaagaaggtcgaaaccctgatggtgccatccaagcggcaagaggccttaccattacatcaagaaacaaagcaagaatctggcagcggtaagaaaaaagcttcatccaaaaagcagaaaacagagaacgtgttcgttgatgagcccctgatccacgcgacaacttatattccgctgatggacaacgcggacagttccccagtggtagataagagggaagtgatcgacctattaaagcccgaccaggtagaaggaatccaaaaatccgggactaaaaaattaaagacagagacagacaaggagaatgccgaggtgaagtttaaggacttcctcctgtcgctcaaaactatgatgtttagcgaagatgaagcactgtgtgtggtggatctgctgaaggagaaaagtggtgttatacaggacgcactaaaaaaatcgtctaaaggagagctgaccacccttattcatcagttgcaggaaaaggataagcttctggccgccgtaaaagaagacgctgcggctacaaaggaccggtgtaaacagctgacccaagaaatgatgacagaaaaggagaggagcaatgtcgtaattaccaggatgaaggatagaataggaactctggaaaaggaacacaatgtgtttcagaataagatccatgtgtcctaccaagaaacccagcaaatgcagatgaagttccagcaggtccgagaacagatggaggctgaaatagcccatctcaaacaggagaacggcatactgcgagatgcagtaagtaacacgaccaaccaactggagtctaagcagtctgccgaactcaataagctgcgccaggattatgctcgccttgtgaatgaattaactgaaaagactggcaagctgcaacaggaggaggtacagaagaaaaacgccgaacaagctgcaacccagctgaaagtacagctccaggaagcagaaaggcggtgggaggaagtacaatcttacatacgcaaaagaaccgcggaacacgaagctgcccaacaggatctccaaagcaaattcgtggccaaggaaaacgaagtccagagcctccactccaagcttaccgacaccctggtctctaagcagcaactggagcaacggctgatgcagttgatggagtcagaacagaaacgagtgaataaggaggaatccctgcaaatgcaagtccaagacattcttgaacagaatgaggccttaaaggcacaaattcagcagtttcactctcagattgctgcccagacgagtgccagcgtgcttgccgaagagcttcataaggtgatcgccgagaaggacaagcagattaagcagaccgaggactctttggccagcgaacgcgaccgattgacgagtaaggaggaggagttgaaggatatccagaatatgaatttcctcctgaaggcagaggtccagaaacttcaagctctggcgaacgagcaggcagccgcggcgcacgagctggagaaaatgcagcagagcgtgtacgtcaaagacgacaagattaggttattagaggaacagctccaacacgagataagcaataaaatggaggagttcaagattctgaatgatcagaataaggccctgaagtccgaagtccagaaattgcagaccttggtaagtgagcagcctaataaggacgtggtggaacagatggagaagtgcatacaggaaaaagacgagaagctgaagactgtggaagagctgctggagactggcctgattcaagtcgccaccaaagaagaggagttgaacgctatccggacagaaaacagttcactcacaaaggaggtacaggatttaaaagccaagcagaacgaccaggtgagctttgcctccttagtggaagaactgaagaaggtaatccacgagaaggatggaaaaataaagagtgtggaggagttgttggaagctgagcttcttaaagttgccaataaggaaaaaacggtccagttgtccattacctctaaagtccaggagttgcaaaaccttcttaagggcaaagaggagcagatgaacacgatgaaagcagtgctggaggagaaagaaaaggacctagcaaatactgggaagtggcttcaagatctgcaagaagagaacgaaagcttgaaggcccacgtgcaggaggtcgcccagcataacctcaaagaggcctcatcagcgtcccaattcgaggagctcgagattgtcctgaaagagaaagagaacgagttgaagcggttagaggcgatgcttaaagagagggaatcggacctgtcctctaagacccaactcctgcaagatgtgcaggatgagaataaactcttcaagtcgcagatcgaacagctcaagcaacaaaattatcagcaagcctcttcttttcccccccacgaagagctactgaaggtgatcagcgagagagagaaagagatctcaggtttgtggaacgagcttgactccctcaaggatgccgtagaacaccagcggaagaaaaataacgacctgcgtgagaagaactgggaggccatggaggctttggcatctactgaaaagatgctacaggacaaagttaataagacctcaaaagaaagacaacaacaggttgaggctgtggaattggaggctaaagaggtgctgaaaaaacttttccccaaggttagcgtgcctagcaacttgtcttacggggagtggctacatgggttcgagaaaaaagccaaggagtgcatggcaggaaccagcggctctgaggaggtgaaagtcctggagcataagttgaaggaggccgacgaaatgcataccctcttacagctcgaatgcgaaaaatataaatctgtgttggcagagaccgaaggcattctccaaaaactccagagaagtgttgaacaggaggaaaataagtggaaggtaaaagttgacgaatcccacaagactatcaaacagatgcaatccagcttcaccagctccgagcaagaactggaacgcttaaggtccgagaataaggatatagaaaatctgcgacgtgagagggaacatcttgagatggaacttgaaaaagccgaaatggaaagatctacatacgtcacagaagttcgggaacttaaggctcagctcaacgaaactctcacgaagctgcggaccgagcagaatgaaaggcaaaaggttgccggggacctgcacaaggcccagcagagtttggagctgattcagtccaagatagtgaaggctgccggcgacacgacggttattgagaatagcgacgtatcacctgagaccgagtcttccgaaaaagagacgatgagcgtctcactgaaccagacagtaacccagcttcaacagctcctacaggccgtgaatcagcagctcaccaaggaaaaggagcactatcaagtgctggaatag

SEQ ID NO: 121604 - DNA, 4074 bp, Artificial Sequence
  Description of Artificial Sequence: Synthetic coding sequence
atggaattttacgagtctgcttactttatcgtcctcatccccagcatcgtgataactgtaatttttttgtttttctggcttttcatgaaagaaaccttgtatgacgaagtgcttgccaaacaaaaaagagagcagaagctgatacccacaaaaacagataagaaaaaggccgagaaaaagaagaataagaagaaggaaatccagaacggcaacttacacgaatcagattcagagagcgtgcccagagacttcaaactgagtgatgcactggccgttgaggacgatcaggttgctcccgtcccactgaacgttgtagagacatcctcatccgtgcgtgaaagaaaaaagaaagagaagaaacagaagccggtactcgaggagcaagtgatcaaagaatcagatgcctctaaaatccccggaaaaaaagtagagccagtgcccgtgactaagcagcccactccaccctccgaagccgccgcaagcaaaaaaaagccggggcagaaaaagtcgaagaatggctctgatgaccaggataaaaaggtggagaccctgatggttccttccaaaaggcaggaagcattgcccctccaccaggaaacaaaacaagagtcggggagcgggaagaagaaagcatcctccaaaaagcagaagacagagaatgtttttgtggacgaacctttaatacatgccacaacctatatccctctaatggataatgcagattcatcacccgtggtggataagcgagaagttatcgatcttctgaaacccgaccaagtggaggggattcaaaagtctggcaccaaaaagctcaagaccgagactgataaggagaatgctgaggtcaaattcaaggatttcctcctgagcctgaaaaccatgatgtttagtgaggatgaggccttgtgtgtggtcgacctcttgaaggagaagtcaggcgtcatccaggatgctctaaaaaagagcagcaaaggagagctcaccacactgatccatcagttgcaggagaaggacaagctgcttgctgcagtgaaagaggatgctgcagctaccaaagacagatgcaagcagctcacacaagagatgatgaccgaaaaagagcgatctaacgtcgtgatcacccggatgaaagatcggataggaacacttgaaaaagaacataacgtgttccaaaataagatccacgtttcctaccaggagacccagcagatgcagatgaagtttcagcaggtcagagaacagatggaagctgagatcgcccacctcaaacaggaaaatggaatcttaagagacgccgtgtcaaacaccacaaaccaattagagtccaaacaatctgccgaactcaacaagttgcgccaggattacgcccgactggtgaacgaattgactgaaaaaaccggcaaactgcaacaggaagaggtgcaaaaaaagaacgcagagcaagctgcaacccagcttaaggtgcagctgcaggaggccgagcgccgatgggaagaggtgcaaagctatattcgcaaaaggacagcagaacacgaagccgcccaacaggatctccagagtaaattcgtggcaaaagaaaacgaggtccaatctctccacagtaagctgacagatacactggtctctaaacagcaacttgaacagcgcttgatgcaattaatggaatctgagcagaagcgcgtcaataaggaggagtctctccaaatgcaggtgcaagatatattggaacagaatgaggctttaaaagcccagattcagcagtttcattcccaaatcgctgcccagacctccgcgtcggtactcgccgaagaacttcacaaagtcattgccgagaaggataaacagatcaagcaaaccgaggatagcctggctagtgagcgggataggctgacatcaaaagaggaggagctaaaagacattcagaacatgaactttttgttaaaagcggaggtgcaaaaactgcaggccttagccaatgaacaggccgctgccgctcacgagctcgagaagatgcagcagagtgtgtatgtgaaggatgataaaattagactgctggaggaacagctccaacatgagatttcaaataagatggaagagttcaaaattttaaacgaccaaaacaaggctctcaaaagcgaggtccagaaactccagacattggtcagtgagcagcccaacaaggatgttgtggaacagatggagaaatgcatccaggagaaagatgaaaagctgaagaccgtggaagaactcttagaaacagggctgatccaggttgctacaaaggaggaggagctgaatgcaatccgaacagagaactccagtttgaccaaggaagtgcaggacctgaaagccaagcagaacgaccaggtgagttttgcaagcctggtggaagagcttaagaaggtgatccacgaaaaagacgggaaaattaagtctgtggaggagctcctggaggcagagttgttaaaagtggccaacaaagaaaagaccgtccaagacttgaagcaggaaatcaaggcacttaaagaagaaatagggaacgtacagctggagaaagcacagcagctcagcataaccagtaaggtacaggagttacaaaatctgctgaaggggaaagaagaacagatgaataccatgaaagctgttctagaggagaaagagaaagatcttgcgaacacaggtaagtggctccaggatctgcaggaggaaaacgagagtcttaaggcacacgtgcaggaagtagcacagcacaacctgaaggaagccagctccgcatcacagtttgaggagctggagattgtgttaaaggagaaggagaacgaattaaaaaggctggaggccatgcttaaagagcgggagagcgatctttcctcaaaaacacaacttctccaggacgtgcaggatgaaaataaactgtttaagtcacagatcgagcaattgaaacagcagaactaccagcaggcaagtagttttccccctcacgaggagttgctcaaggtcataagcgaacgggagaaagagatctctggtctatggaacgaactggactccctcaaagatgccgtggaacatcagcgtaagaaaaacaacgatctgagagagaagaattgggaggccatggaagcactggctagcaccgagaagatgttacaggataaggtaaataaaacctcaaaggagcgccaacagcaagtggaggccgtggagctcgaagccaaggaggttctgaagaagctttttcctaaagtgagcgtcccgagcaacttgagctacggagagtggctgcatggtttcgagaagaaagccaaagagtgcatggccgggacttcgggttcggaagaggtcaaagtgctagaacacaaactgaaagaagccgacgagatgcacacgctcttgcagctggaatgtgaaaagtacaaatcagtgcttgctgagacggaggggatcctgcagaagttacagagatcagtggagcaggaggagaacaaatggaaagtgaaggttgacgagagtcacaaaaccatcaaacagatgcaaagttcttttacatcttccgagcaggagctggaacgacttagatccgagaacaaggacatcgagaacctgcgccgcgagcgggaacatctggaaatggaactggagaaggctgagatggagcgttccacctacgtcacagaggtgcgagaactcaaggatttgttgacggaactgcagaaaaagctcgacgacagctatagtgaagctgtcaggcagaatgaggagctcaatctgcttaaggctcagttaaacgagacactgactaagttaaggaccgagcagaacgaacgccagaaggtggcaggcgatttgcacaaagcccaacagagtctggaattgatccagtcaaaaattgtgaaagccgccggtgacacaacagtgattgagaattcggacgtgtcccctgaaaccgagtcgtccgagaaagagacaatgtcagtctcactaaatcagaccgtgacacagttgcaacagcttttgcaagcagtgaaccagcaacttaccaaagagaaggagcactatcaggtgttggagtag

SEQ ID NO: 121605 - DNA, 3921 bp, Artificial Sequence
  Description of Artificial Sequence: Synthetic coding sequence
atggagttctatgagagtgcgtactttattgttctgatcccctctatagtgattacagtcatattcctgtttttctggcttttcatgaaggaaactctttacgatgaggtcttggcaaaacagaagagggaacagaagctgattccaacaaaaacggataagaaaaaagcagagaagaaaaagaacaagaaaaaagagatacagaatggaaaccttcacgagtccgattccgagagtgtccctagagatttcaagctgtcagacgccctggctgttgaggacgaccaagtggcgccagtgcctctgaacgtggtggagacaagttcctcagtacgggaaagaaagaagaaggagaaaaaacaaaaaccagttctggaggaacaggtgattaaagaatcagatgcctccaagatcccgggaaagaaagtggaaccggtacctgtgacaaagcagcccactcccccctcagaggctgctgcatccaaaaaaaaacccgggcagaaaaagtccaaaaatggcagcgatgaccaggacaagaaggttgagacccttatggtaccttcaaagcgccaagaagccttaccgctccaccaggaaactaagcaggaatccggatcggggaagaagaaggcctcttcgaaaaaacagaagacagagaatgttttcgtggacgagccactgatacatgccactacctacatcccactgatggataacgccgatagtagccccgtggtagacaagagagaggtcatagacctgcttaaaccagaccaggttgaggggatccagaagtccggtacgaaaaaactgaagacagaaacagataaagaaaacgcagaggtgaaatttaaggacttcctgctgtcactgaaaaccatgatgttctcagaggacgaagcgctgtgtgtcgtggatcttctgaaagaaaagtcaggcgtcatccaagatgcccttaagaagagttccaagggcgagctgaccactctgattcatcagttgcaggagaaagataaactcctggctgcggtgaaagaggacgcggccgcgacaaaggaccggtgcaagcaactcacccaggaaatgatgacggagaaggaaagaagcaacgtggtgattacccgcatgaaggaccgcattggaaccctagagaaggaacacaatgtcttccaaaacaaaattcatgtgagctaccaggaaactcaacaaatgcagatgaagttccagcaggtccgcgagcagatggaagccgaaatagcacatcttaagcaggagaatggcattctaagggatgcagtctccaataccacaaaccagttagagtcaaaacagtcagccgaactgaacaagctgcgccaggactatgcccgtctggttaacgagttgacagagaagacagggaagttgcaacaggaagaagtgcagaagaagaatgccgagcaggcagccacgcagctgaaagtgcagctgcaagaggcggagcgcaggtgggaagaagtgcaatcatacataaggaaacggactgccgagcatgaagcagcccagcaggacctccagtctaaatttgtggccaaagagaatgaggtacaaagtcttcattctaagctaactgacacccttgtttccaaacaacaactagagcagagactcatgcagctaatggaatcagagcagaagcgcgtaaacaaggaagaatccttacagatgcaggtccaggacatcctggagcaaaacgaggccctaaaagcccagatccagcagttccacagccagatagctgctcaaacaagtgcatccgtgcttgctgaggagctgcataaggttatcgccgagaaagataagcagattaagcaaaccgaggactcacttgcaagtgaaagagacagactcaccagtaaggaagaagagttgaaagacatccaaaatatgaattttctattaaaggctgaggtgcagaaactccaggccttggctaacgagcaggccgcggctgctcatgaactggagaagatgcagcagagcgtttacgtgaaagatgacaagattaggctacttgaggagcaactgcagcatgaaatctccaataagatggaggagttcaagattctcaatgaccagaacaaggctttaaaatcggaagtgcagaaacttcagacacttgtatcagaacagcccaacaaagatgtggttgaacagatggaaaagtgcattcaggaaaaagatgagaagctgaagactgtagaagagctgttggaaaccggtctgatccaggtggctacgaaggaagaagaacttaacgcaattcgcaccgagaattcgtcccttaccaaggaagttcaagatctgaaagcaaagcagaatgaccaggtatcctttgccagcctcgttgaggagctcaagaaggtgatacatgagaaagatggtaagatcaaatcagtggaggagctcctggaggccgagctgctaaaggtggccaacaaagagaagactgtgcagctctcaattacctctaaggtgcaggagctgcagaatctcctcaagggaaaggaggaacagatgaatacaatgaaagctgtgctcgaggagaaggagaaggatctggctaacaccggcaagtggctgcaggacttgcaagaggaaaatgagagtcttaaagctcacgttcaggaggtggcccagcacaatcttaaagaagcgtcttcagctagtcagttcgaggagttagaaatcgtgctgaaggaaaaagaaaacgagctgaagcgtctggaggctatgttgaaggagcgcgagagtgatctgagctctaaaacccagcttctgcaagacgtgcaagacgaaaataagctgttcaagagccagatcgagcagctgaagcagcagaattaccagcaagctagttccttcccaccacacgaagagcttctgaaggtgatctccgagagagagaaagaaatttctggtttatggaacgagttggactctcttaaagatgccgtggagcaccaacgtaagaaaaataacgatttacgggagaagaactgggaagccatggaggccctggctagtactgaaaagatgctgcaggacaaggtcaataagacctccaaagaaagacagcaacaggtcgaggccgtggaactggaagctaaagaagtgctaaaaaaattatttccaaaggtgtctgttccatccaacctctcctatggggagtggttacacggcttcgaaaaaaaagcaaaggaatgcatggcgggcacctctgggagtgaggaggtgaaagttttggagcacaagctgaaggaagctgatgaaatgcacacattgctccagctggagtgtgaaaaatataagtccgtgctggccgagacggaagggatactgcaaaaacttcagaggtctgttgaacaagaagagaataagtggaaagtgaaagtcgacgagtcacataaaaccattaagcagatgcagtcttccttcaccagtagcgagcaggagctcgagcgcttgcgttctgagaacaaggacatcgagaacctgcgtcgcgaaagagagcatctggagatggaactcgagaaggctgagatggagagatcaacctatgtcaccgaagtgcgggaactcaaagcccaactgaatgagactctcaccaagcttcggactgaacaaaatgaacgacagaaagttgcaggcgacctgcataaagcacagcagtccctagagctgattcagtctaagatcgttaaagctgccggcgataccactgtgatcgagaactctgacgtgagccctgagacagaaagtagtgaaaaggaaactatgtccgtatccttgaaccagacggtgacccagctccagcagctcttacaagctgtcaatcagcagttgacgaaggaaaaggaacactaccaagtgctcgagtag

SEQ ID NO: 121606 - DNA, 4074 bp, Artificial Sequence
  Description of Artificial Sequence: Synthetic coding sequence
atggaattctatgagtccgcctacttcattgtgctgatcccttccatagtcattaccgtcatatttctgttcttctggttatttatgaaggaaactctatacgacgaagtgctggctaagcagaaaagggagcagaagttaatcccaactaaaacagacaagaaaaaagcggagaagaaaaaaaataaaaaaaaggaaattcagaacggcaatctgcatgagtccgattcagagtccgtgccaagagatttcaagctgtccgatgcgttagccgttgaagacgatcaagttgctcccgtgccactgaatgtggtggagacgtctagtagtgtccgcgagcgcaaaaaaaaggagaagaagcagaaacccgtgctggaagaacaggttataaaggaaagtgatgcgagcaagataccaggtaagaaagtggaacctgtccccgtgacaaagcagccaactccgccctctgaggctgccgcctccaaaaaaaaaccaggccagaagaaatctaaaaacggatctgatgatcaggacaaaaaagttgaaaccctcatggttcctagcaaaagacaggaagctctacctttgcatcaggaaaccaagcaggagagcggatcgggcaaaaagaaggcctcgagcaagaaacagaagaccgaaaacgtgtttgtcgacgagccactcatccatgctaccacgtacatccctctcatggataacgctgattcctcccctgtggtggacaagagagaggtaatcgatctgttgaagcctgatcaggtcgaaggtatccagaaaagcgggacgaagaaactgaagacggagaccgataaggagaatgccgaagtcaagtttaaggactttctgttatctctgaagactatgatgttttctgaagatgaggccctctgtgtggtagacctgcttaaggagaagtccggcgtgatccaggacgccctgaaaaaatcaagtaagggagagctgactaccctgatccaccagcttcaggagaaggacaaactgctagcggcagtgaaggaggacgccgccgctaccaaggacagatgcaagcaactaacgcaggagatgatgaccgaaaaggaacggagcaatgtggttataacccggatgaaagatagaatcggaacattagaaaaggagcataatgttttccagaataagattcatgtcagctaccaagagacccagcagatgcaaatgaaattccagcaagtccgggaacaaatggaggcagaaatagcccacctcaagcaagaaaacggaatcctgcgcgatgccgtatccaacaccacgaaccagttggagtccaaacagagcgccgagttgaacaaactgaggcaagactacgcccgactcgttaacgagctgaccgaaaaaacggggaagctgcagcaggaagaagtgcagaagaaaaacgccgaacaggcagctacccagctcaaagtccagctgcaggaggccgaacggagatgggaggaggtgcagagttatattaggaagcggaccgccgaacatgaagctgcccagcaggacctgcagtctaagttcgtggccaaggaaaacgaggtgcagtccctgcactccaaacttacagacaccctcgtgtcgaagcaacagctggaacaaagactgatgcaactgatggagagcgaacagaagcgggtgaacaaggaagaatccttacagatgcaggtacaggatatactcgagcaaaacgaagccctaaaagcgcaaatacagcagtttcatagtcagattgctgctcagacatctgcttctgtgctggccgaagagctgcacaaggttattgccgaaaaggataagcagatcaaacagacagaagactccctggcctctgaacgcgacaggcttacctcaaaagaggaggaactgaaggacatccaaaatatgaactttttgctcaaagccgaggtgcaaaagctccaggccctcgccaatgagcaggccgcagccgcccacgagctggagaagatgcagcaatcagtgtatgtaaaagatgataaaatccggcttctcgaagaacagctgcagcacgaaatatccaacaagatggaggagtttaagatccttaatgatcagaataaggctctgaaaagcgaggtacaaaagttacagacacttgtatctgagcagccgaataaggatgtggtcgaacaaatggagaaatgcatccaagagaaggacgagaagttaaaaaccgtggaagaacttctggagaccggcttgattcaggtagcgacaaaagaagaggaactcaacgccattagaacagagaactcatcactcactaaggaggtgcaggatctgaaggccaaacagaacgaccaagtgagtttcgcttcactcgtcgaggagctcaaaaaagtcatacatgagaaggacggcaaaataaaatccgtagaagagctcctggaggctgaactcctgaaggtggccaataaggagaagacagtgcaggacctcaaacaagaaataaaggccctcaaagaggagattgggaacgtgcaactagaaaaagcccaacagctcagtataacgagcaaggtgcaggagcttcaaaacctcctgaagggcaaggaagaacagatgaatacaatgaaagccgttctcgaagaaaaggagaaagacctggctaatacaggaaagtggctgcaagatctgcaggaagagaatgaaagcctgaaggctcatgtgcaagaagtggcacagcacaatctgaaggaggccagcagcgcttcccagttcgaagaacttgagatagtgctgaaagaaaaagagaacgagctgaaacggctggaggccatgctgaaagagcgggaatccgatctatcctcaaagacccagctacttcaggatgtgcaggatgagaacaaattgttcaaatcacaaattgagcagttgaagcagcagaactaccagcaggctagcagctttcccccacacgaagagttactgaaggtcatatcagaaagggaaaaagagatctctgggctgtggaacgagctggattctcttaaagatgccgttgagcatcagcggaaaaagaataacgaccttagagagaaaaactgggaagctatggaggccttggcgtctaccgagaagatgctccaagacaaagtcaataaaactagcaaggaacgccaacaacaggtagaagcagtcgagctggaggctaaggaagtgctgaagaagctgtttcctaaagtgagcgtacctagcaacctgtcttatggcgagtggctgcatgggttcgaaaaaaaggcgaaagagtgcatggccggcacttccgggtctgaggaggttaaggtgctcgagcacaaactgaaagaagctgatgagatgcatacgctgctgcagctggaatgtgagaagtataaaagtgtgcttgcagaaacagagggtatcctgcaaaaactccagagaagcgtggaacaggaggaaaacaagtggaaggtgaaggtggacgaaagccacaaaactattaaacagatgcaatcaagtttcacctcttctgagcaggaacttgaaaggctgaggtctgaaaacaaagatatcgagaacttacggagagagagagagcatctcgagatggagttagagaaagccgagatggaaagaagcacttacgtgaccgaagtcagagaactgaaggatcttcttaccgagctgcagaaaaagctggacgacagctatagcgaggctgtcaggcagaacgaggagctgaatctgctcaaggcccagctgaacgagacactgactaagcttaggactgagcagaacgagagacagaaagtggccggcgaccttcacaaggcccagcagtcacttgaactcatccagagcaagattgtgaaggcagctggcgatactactgtgatagagaacagcgatgtgagccccgaaacggagtcttctgagaaagaaaccatgagcgtgagcttgaaccagaccgttacccagctgcagcagcttctccaagccgttaaccagcaactcacaaaagaaaaggagcactaccaagttctagagtag

SEQ ID NO: 121607 - DNA, 3903 bp, Artificial Sequence
  Description of Artificial Sequence: Synthetic coding sequence
atggaattctatgaaagcgcttatttcattgtacttatcccctccatcgtcattacagtaattttcctgttcttttggctgttcatgaaggagactctgtacgatgaggtgctagcaaagcagaagagggaacagaagcttattcccaccaagaccgacaaaaaaaaagcagaaaagaagaaaaacaaaaaaaaggaaatccagaatggaaacctgcacgaaagtgactcagaatccgttccacgcgacttcaagttgagcgatgctttagccgtggaggacgaccaggtcgctccagtaccactgaatgtcgtggaaactagcagctcagtgagggaaagaaaaaaaaaggagaaaaagcagaaacccgtgctggaagaacaggtgatcaaagagagtgatgcttctaagatccccggcaagaaggtggagccagtgcctgtgacgaagcagccaacacctccaagtgaggcagctgcgagtaagaaaaaacccggacagaaaaaaagtaagaatgggagtgacgatcaagacaagaaggtagagacactgatggttccgtcgaagcgccaggaggcacttcccctgcaccaggaaaccaagcaggaaagcggttccggcaaaaaaaaagcttcatccaaaaaacaaaagactgagaatgtgtttgtcgatgaacctctgattcacgcaacaacttatattccactcatggataacgccgattcctcccccgtggttgataaaagagaagtcatcgatctactcaagcccgatcaggtagaggggattcagaagagcggtaccaagaaactgaagaccgaaactgataaagaaaacgccgaagtgaagtttaaagattttctgcttagtctcaaaaccatgatgtttagcgaggacgaagcattgtgcgtggtcgacttgctgaaggagaaaagcggcgtgatccaagatgcactcaagaaatcttctaagggggaattgactactctaatccaccaactccaagagaaagataaactgctcgcagccgtgaaagaggacgccgccgcaaccaaggatcgttgcaagcagctaacacaggagatgatgacggaaaaagagaggtctaacgttgtcattacacgaatgaaagaccgtattggcaccctggagaaagaacataacgtgtttcagaacaagattcacgtgagttaccaggagacacagcagatgcaaatgaagttccagcaggtcagagagcagatggaggctgaaattgcacacttgaagcaggaaaatggtatcctgcgcgacgccgtgagcaacactacaaatcaactggagtccaaacagtccgctgagcttaataaactgaggcaggactatgccagactggtgaatgaactgaccgagaagacaggcaagctccagcaagaggaagtacagaagaagaacgcggaacaggcggctacccagcttaaagttcagctgcaagaagccgagcgacgatgggaagaggttcaaagctacatccggaaaagaactgccgagcatgaggcggcccagcaggatctccagtcaaaattcgttgccaaagaaaacgaagtgcagtcgctccacagcaaactgacagacaccctggttagtaagcagcagctggagcagcggctcatgcagctcatggagagcgaacaaaagagagtgaataaggaagagtcgttgcaaatgcaggtgcaggacatattggagcagaacgaggccctcaaagcacagatccaacaattccactcccaaattgccgcacagacctcagcatctgtgctcgccgaggagttacacaaggtcattgctgagaaagacaagcagataaaacagaccgaggactcactggcttcagaacgtgataggcttactagcaaggaggaagaactgaaggacatccagaacatgaattttcttctgaaagctgaagtgcaaaagctgcaggcgctggcgaacgagcaggccgcggcagctcatgaattggagaaaatgcagcagtcagtctacgtcaaagacgataagatccgtcttctggaagaacaattgcagcatgaaatttcaaataagatggaggagttcaagatcctgaacgaccagaacaaagctcttaaaagtgaagttcaaaagcttcaaactctggtcagcgagcaaccaaacaaagatgttgtggagcagatggaaaaatgcattcaggaaaaagacgaaaaattgaagacagttgaagaactattggagacaggtcttatccaggtggcaacaaaggaagaagaactgaacgccatccgtacggaaaattctagcctgacaaaggaggtgcaagatctgaaggcaaaacaaaacgaccaagtcagttttgcttcactagtggaggaattgaaaaaggtgattcacgaaaaggatggaaagatcaagtcagttgaggaactcctggaagccgagctgctcaaggtagctaataaggagaagactgttcaggatctgaaacaggaaataaaagcactgaaagaggagatcggaaacgtgcaactggaaaaagcgcagcagctgagtattactagcaaagtgcaggaactacagaaccttctcaagggaaaggaagagcaaatgaacactatgaaggccgtgctggaggaaaaagagaaagatctggccaacaccggcaaatggctgcaggacctgcaggaggaaaacgagtcgctcaaagcacatgtgcaagaggtggcccagcataatctgaaagaagcctccagcgccagccagttcgaggaacttgagattgtccttaaggagaaggagaacgagctaaagaggctggaggccatgcttaaagaaagggagtcggacctttcatcaaagacccagctgttgcaggacgtgcaggacgaaaacaagctgtttaaatcccagatcgagcagcttaaacagcagaactatcagcaagcatcttcttttccacctcatgaggaactgttgaaagtcattagtgagcgggagaaagagattagcgggttgtggaatgagcttgatagtctgaaagatgccgttgagcatcagcggaagaaaaacaacgaaagacagcagcaagtcgaagcagtggaacttgaagcaaaagaggttttgaaaaaactgtttccaaaagttagcgttccttccaacctgtcctatggtgagtggctgcacgggttcgaaaaaaaggccaaggagtgcatggcaggcaccagcgggtccgaggaggtcaaagtgttggagcataagctgaaggaagctgatgagatgcacactttgctgcagttagagtgcgagaaatataagtcagtattggccgaaacagagggtatcctgcagaagctgcagagatcagtcgagcaagaagagaacaaatggaaggttaaagtggatgagtcccacaagaccataaagcagatgcagtcttcttttacctcatcagagcaggagctggagagactcaggagtgagaacaaggatatcgagaacttaagaagggaacgcgagcacctggaaatggaactcgagaaggcggaaatggaacggtcgacctatgttactgaggtccgcgaactgaaggcccagctcaatgagaccctgacaaagttgcgaaccgaacagaatgagagacagaaggttgcaggagacctacataaagcccagcaatcactagagttaatccagagtaagatcgtcaaggccgccggagataccaccgttatcgagaactcggacgtttcgcccgagacagagtcgtctgagaaggaaacaatgtcagtctccctgaaccagacagtgacgcaacttcagcagctgttacaggctgtcaatcagcagcttacaaaggagaaagagcactatcaggtcctggaatag

SEQ ID NO: 121608 - DNA, 4074 bp, Artificial Sequence
  Description of Artificial Sequence: Synthetic coding sequence
atggagttttatgaaagtgcctattttatagttctcatcccttccattgtgatcaccgtcatctttctcttcttctggctgttcatgaaggagacgctgtatgacgaggtgctggccaagcaaaaacgagagcaaaagcttattccgacgaagaccgacaagaagaaagctgagaagaagaagaacaaaaagaaggagattcagaatggaaacttacacgagtctgattctgagtcagttccacgcgacttcaagctttctgatgctctggctgtggaagacgaccaggtagcgcccgtgccgttgaatgtcgtagaaaccagtagttctgtgagagagcggaagaagaaagagaagaagcaaaagccggtgctggaagaacaggttatcaaggagagcgacgcctcgaaaatcccggggaagaaggttgagcctgtaccggtcactaaacagcctactccgcccagcgaggcagcagcctccaaaaagaaaccgggccagaaaaaaagtaagaatggatccgatgaccaggataagaaagtagaaaccctaatggtgccatcaaagcgccaggaggctctgccgcttcatcaggaaactaaacaggaaagcgggtccggcaaaaaaaaggcctcatccaaaaagcagaagactgaaaatgtcttcgtggacgagcccctcattcacgcaaccacatatatccctctaatggataatgctgactcatcaccagttgtcgacaagcgggaggtgatcgacctcctgaaacccgaccaagtcgaagggatccagaagtccggtacgaagaagctgaagactgagactgataaagaaaatgcagaagtgaagtttaaggatttcctcctttccctgaagactatgatgtttagtgaagatgaggcactctgcgtggtggatcttctgaaagagaagagcggggtcatccaggatgccctgaagaagtcaagcaagggcgaactaactaccctgattcatcagctgcaggagaaggataagctgctagcagcagtgaaagaagacgcagctgcgacaaaagatcgatgtaaacagctaacacaggagatgatgacagaaaaggaacgttccaacgttgttattacgagaatgaaagatcgaattggtactctggaaaaagagcacaatgtgttccagaataaaatacacgtgtcatatcaggagacccagcagatgcaaatgaaattccagcaagtgagagagcaaatggaagcagaaatcgctcatctgaagcaagaaaacggcatattgagagacgcggtttcaaataccacaaaccagctcgagtctaagcaaagtgcagaactcaataagctgcgccaggattacgccagactggtgaacgaattgactgaaaaaacgggaaagctgcagcaggaggaggttcaaaaaaagaacgcagagcaagcagcgacacagctgaaggtccagctccaggaagctgaacgaagatgggaagaagtgcagtcttacatacgaaagcgcacagccgaacacgaggcagctcagcaggacctacagtccaagttcgtggcaaaagaaaatgaagtccagagcctacacagcaaattgacagatacactggtctcaaaacagcagctggaacagaggctgatgcagctaatggagtctgaacagaagcgggtcaataaagaggaatctcttcaaatgcaggtgcaggacatcttagagcagaatgaggctcttaaggcgcagatacagcagttccactcccaaatcgccgcccagacttcagcaagtgtgctagcagaagaactgcataaggtgattgcggagaaggacaagcaaattaaacaaacagaagactcattggcgtcagagcgagataggctgacttccaaggaagaggaactgaaggatatccaaaatatgaatttcctgcttaaggcggaggtgcagaagctccaggcgttagccaacgaacaagccgctgccgcgcatgagctggaaaaaatgcagcagagtgtctatgtcaaggatgacaagatcaggctcctcgaggaacagcttcaacatgagataagtaataagatggaagagttcaaaatcctcaacgaccagaacaaagctctaaaaagcgaagtgcaaaagctccaaactctggtctccgagcagcccaataaagacgtggtagagcagatggaaaagtgcattcaagagaaggacgagaagctgaagaccgttgaggaactgttggaaactggactcattcaggttgccactaaagaggaggaactgaacgccatacggaccgagaatagctcactcactaaggaagtgcaggatctcaaggccaaacagaacgaccaggtcagtttcgctagcttggtggaagaactgaagaaagtcatccatgaaaaggatggtaaaataaaatccgttgaggaacttctggaggctgaactgctgaaggtcgccaacaaggaaaagactgtgcaggaccttaaacaggagatcaaagccctgaaggaggaaatcggtaatgtgcagctagaaaaggcacagcagctgtcgatcacctcaaaagtgcaggagcttcagaatttgctcaagggcaaagaagagcaaatgaatacaatgaaagccgtgctagaggaaaaagagaaagacctcgctaatacaggtaaatggctccaggatctccaagaggaaaatgaatcactgaaagcgcacgttcaggaggttgcgcagcataacctcaaagaagcctcatccgcttcccagttcgaggaactagaaatcgtcctaaaggagaaagaaaacgaactcaaacggctggaggctatgctcaaagagagagaaagtgatttatccagcaaaacgcagctgctgcaggatgtacaagatgagaataagctgtttaagtcacagatcgagcagctgaaacaacagaactaccagcaagcttccagttttccacctcatgaagagctgctgaaggtaatatcagagcgcgagaaagagatcagcgggctgtggaatgaactggacagtctgaaagatgcagtggaacatcagagaaaaaagaacaacgaccttcgggagaaaaactgggaagcaatggaggcactcgcttccactgaaaagatgttgcaggataaggtgaacaaaacctccaaagagagacaacagcaagtggaagcggtcgagcttgaggcgaaagaagtcctaaagaagctgtttccgaaggtcagcgtcccttccaatctctcctatggcgaatggctgcacggttttgaaaagaaagccaaagagtgcatggcaggcacctctggctctgaagaggtcaaagtgctggagcataagttgaaggaggccgacgaaatgcataccttattgcagctggaatgtgagaagtataagtcagtcctggctgagacggagggtattttgcagaaactccagaggagtgtggaacaagaagaaaataaatggaaagtgaaagttgacgaatctcacaagacaataaagcagatgcagagctctttcacctccagcgaacaagagctggaaagattacgaagtgagaacaaggatatagaaaatctgagacgagaacgcgaacaccttgagatggaattagaaaaggccgagatggaacggagcacatacgtgacagaggtgagggagctcaaggacctcctcacagaactgcagaaaaaacttgacgattcatatagtgaagctgtccggcagaacgaagagttaaaccttctcaaagcgcagcttaatgagacactgacgaagctgcgaacggagcagaacgagcgacaaaaagtggcgggagacctccataaggcccagcagtctcttgagctgattcagtctaagattgttaaggccgccggcgatactaccgtgatcgaaaattctgatgtgtctcccgagactgagtcttcagagaaggaaacaatgtcggtttctctcaaccagacggtgactcagctccaacagcttctgcaggccgtgaaccagcagctaacgaaagaaaaggagcactatcaagtcctggagtag

SEQ ID NO: 121609 - DNA, 228 bp, Artificial Sequence
  Description of Artificial Sequence: Synthetic coding sequence
atggagttctatgaaagtgcttactttattgttctaattccatccattgtgataaccgtcatctttctgtttttctggctgttcatgaaagaaacgctttacgatgaggtgctggccaagcagaagagggagcaaaaacttattccaaccaagaccgacaagaaaaaggccgagaaaaaaaagaacaaaaagaaggaaattcagaatggtaacctgcacgagtcttag

SEQ ID NO: 121610 - DNA, 183 bp, Artificial Sequence
  Description of Artificial Sequence: Synthetic coding sequence
atggagttttacgaatcggcatattttatagttctgataccttctatcgtgattactgttattttcctgttcttctggctgttcatgaaggagacgttatacgatgaggtactggccaagcagaaacgggagcagaaactaattcctacaaaaaccgacaagaaaaaggctgagaagaaatag

SEQ ID NO: 121611 - DNA, 3171 bp, Artificial Sequence
  Description of Artificial Sequence: Synthetic coding sequence
atggcctcacagcctaatagcagcgctaagaaaaaggaggaaaagggaaaaaacatccaggtggtcgtcagatgtagaccttttaacctggccgaaaggaaagcaagcgcccatagtatcgtagaatgcgatcccgtgcgtaaagaggtgagtgtgagaaccggaggcctcgctgataaaagttcacgaaagacctatacatttgacatggttttcggcgcatctactaaacaaatcgacgtgtacagatcagtggtgtgtcccatactggatgaggtgatcatggggtacaattgcaccatctttgcatatggtcaaaccgggactgggaagacctttaccatggagggtgagagatcacctaacgaggagtatacttgggaggaggatcccttggctggaatcatacccaggactctccaccagattttcgagaaattaaccgacaatggtacagaattctcagttaaggtgagcttgctggagatatacaacgaagagctcttcgacctgctcaatccttccagtgatgtctcagagcggctgcagatgttcgatgatcctaggaacaagaggggcgtgatcatcaagggcctggaggaaatcactgtgcacaacaaggacgaagtataccagattctggaaaaaggggcagctaagcgtactaccgcagccactctaatgaacgcatacagctcacgtagccatagcgtgtttagcgtcaccatacacatgaaggaaacaaccatcgatggcgaagagttggtgaagatcggtaagctgaacctggtcgatctggccggatcagagaacattggcagaagcggagctgtcgacaagcgggcccgagaggctggaaatattaatcaatcgctgctgacactaggtagggtaattactgcactggtagagcggacgccacacgttccctaccgggaatctaagcttacgaggattttgcaggacagcctgggaggacggactcgcactagtattatcgcgacaatatctcccgcttccctgaacctggaagagactctatccactcttgaatatgcccatcgcgccaaaaatatcctgaacaagccagaggtcaaccagaagcttaccaagaaggccttaatcaaggagtataccgaggaaatcgagaggctcaaaagggacctggctgcagcgcgcgagaagaacggcgtgtacatttctgaagagaactttcgtgtgatgagcggaaagctgacagtgcaggaagagcagatcgtcgaacttattgagaagatcggagccgtggaggaagagctcaaccgcgtgacagaactgtttatggacaataagaatgagcttgatcagtgcaaatctgatctgcaaaacaaaacacaggaactcgagacaactcaaaaacacttacaggagaccaagctgcagttagtgaaggaggagtatatcacgtctgctctcgagtcaaccgaagagaaactccatgacgcagcgtcaaagctgctaaatacagtcgaagagaccaccaaggacgtgtccggtctacatagtaagctggaccgcaagaaggctgtggaccagcacaacgccgaagcacaggacatctttggcaaaaacctcaattctctgttcaacaatatggaggagttaattaaagatggaagtagcaaacagaaagcgatgttggaggtgcataagacactgttcggaaatctgctgtcaagcagcgtgtccgcattggataccataactactgtcgcactggggtccctgacttcaatcccggagaatgtgagtactcacgtctctcaaatcttcaatatgattttgaaagagcagagcttggcagctgagtctaaaacagtcctgcaggagctaattaatgtgctcaagaccgacctgctgtcttcactcgaaatgatactctcacccacagtggtgtccatcctcaaaattaactctcaactgaagcacatttttaaaacatcgctaacagtggcagacaaaatcgaggatcagaaaaaggaactggatggcttcctgagtatcctgtgtaataatctgcacgaactgcaagagaacactatatgtagtcttgtagaatcccagaagcagtgtggaaatctgacagaggatctcaagactataaagcagacccatagccaggaactctgcaaactcatgaatctctggacagaaaggttctgcgcactggaagaaaagtgcgagaacatacagaagcctctgtcctccgtgcaggagaacatacagcagaagtcaaaggacattgtgaacaagatgacatttcatagtcagaaattttgcgctgattctgacgggttctcacaggaactgagaaattttaatcaggaggggacaaagctggtcgaagaaagtgtgaagcactcggacaagctgaacggtaacctggagaaaatctctcaggagaccgaacagcgttgcgagtcacttaatactagaacagtctactttagcgaacaatgggttagttcacttaacgagagggaacaggagctgcacaatctgctggaggtagtgagtcagtgctgcgaagcgtcctctagcgatattactgaaaagagcgacggtcgcaaagccgctcacgaaaaacagcacaatatctttttggaccagatgaccattgatgaggataagctgatcgcccagaatctcgagctcaacgaaactattaaaatcggcctgactaagttgaattgctttttggaacaggatctgaaactagatatccctacagggaccacccctcagagaaaatcatatctgtatccaagcaccctcgtgagaacggagcccagagagcatttactagaccaactgaagaggaagcagccagagctgttaatgatgctcaactgtagcgagaataacaaggaggaaacaatccccgatgtagacgtcgaggaggccgtgctgggccaatataccgaagaacctctctcacaggaaccttctgtggacgcgggagtagactgctcatctatcgggggcgtgcccttttttcagcacaagaaaagccacgggaaggacaaggagaatagaggtataaatacactggagcgctcaaaagttgaggaaaccacggagcacttggtaaccaaatcccgcctgcccctcagagcacagattaacctgtag

SEQ ID NO: 121612 - DNA, 5418 bp, Artificial Sequence
  Description of Artificial Sequence: Synthetic coding sequence
atgtcagacaccaaggtgaaagtcgctgtacgcgttcggcccatgaacagacgtgagcttgaactgaacacaaagtgtgttgtggagatggagggtaaccaaacagtgcttcatccacctcccagcaataccaagcagggcgaacgaaaacctccaaaggtctttgcattcgactattgtttttggagcatggatgagagtaatacaacgaaatacgctgggcaggaggtggttttcaagtgtttgggcgaaggtatattggaaaaggcctttcaggggtataatgcttgtatcttcgcgtatggacagaccggcagtggtaaaagcttctctatgatgggccatgctgagcagttagggttaatccctcgactgtgctgtgctctctttaaaaggatctccttagagcaaaatgagtctcagaccttcaaagtggaagtcagctatatggaaatatataacgaaaaggtgcgagacctgctagacccaaagggctctaggcagtctttaaaggttagggagcataaagtccttggaccatatgtagatggactgagccaacttgctgtgacgtcctttgaggatatcgagagcctgatgtccgagggtaacaagtctcggaccgtggcagccactaatatgaacgaggagtcgtctaggtcacacgcagtgtttaacataattattacccaaactctgtatgacctacaatccgggaacagcggcgagaaggtctcaaaagtgagcctggtggaccttgcagggtccgagagggtaagtaaaacaggggcggctggggaaagactcaaagagggctcaaatattaataagagtctcacaaccttgggtctcgttatttcatccctggccgatcaggccgctggaaagggcaagagcaaattcgtcccttatagggattctgtcctaacctggctgcttaaggacaacttagggggaaattcccagacctcgatgatagctactatctctcccgccgccgataactatgaagagacgttatccaccctgaggtacgcggatcgggcgaaacgtatcgttaaccatgcagttgtgaacgaagatccaaacgccaaagtgattagagaattgcgagaagaggttgagaagctcagagagcagttgagccaggcagaggccatgaaggcccctgagttaaaggaaaagttggaagaatcggagaagctgattaaagaattaaccgtgacttgggaggagaaactcagaaagaccgaggaaattgcccaggagcggcagcggcagctggagtcgatgggtatcagtttggagatgtcagggatcaaagtaggggatgataagtgctacctagtcaaccttaatgcagatccagcattgaacgagctgctcgtgtattatctcaaggatcatactcgagttggcgccgatacctcccaagatatccagctcttcgggatcggcatccagccacagcactgcgaaatcgacatcgccagcgatggcgacgtgaccctcactcctaaggagaacgctcgctcttgtgttaacggcaccttagtctgttcaactacgcagctgtggcatggcgaccgaatcctgtggggcaacaaccactttttcaggatcaacttgcccaagcggaagcgtcgcgattggttgaaggatttcgagaaggagactggcccccctgaacacgacttggatgccgcttccgaggcctctagcgagccggattataactatgagtttgctcagatggaagtgatcatgaagaccctgaattcgaacgacccggtgcaaaatgtggtgcaagtgctcgaaaaacagtacctcgaagaaaagaggtctgctctcgaagagcagcgcctgatgtacgaaagggaacttgagcagcttcggcagcagctatcaccggacaggcaaccgcagtcgtcaggaccagatcggctggcctactcttcccaaaccgcacaacaaaaagtaacacaatgggctgaagagagagacgagctcttccggcagagcctggctaagctccgcgagcagctcgtgaaggccaatacattagttagggaggccaactttctagctgaggaaatgtccaagttgactgattatcaagtaactctgcaaatccccgcagctaatctgtcagctaatcggaagagaggagccattgtatccgagcccgcaatccaggtcagacggaagggtaagtccacgcaggtgtggaccatagagaaactggagaacaaactcattgatatgagagacctctaccaggaatggaaggagaaagtgccagaggccaaaaggctctacgggaaaaggggcgatcccttttacgaagcccaggaaaaccataacttgatcggcgtcgcaaatgtatttcttgagtgcttattttgcgacgtaaaattgcagtatgctgtcccaatcatttctcagcagggcgaggtggccgggagactacacgtcgaggtgatgcgggtgaccggagcagttccagaaagggtggtcgaagacgactccagtgaaaattcctcagaatccggctctttggaagtggtcgattccagcggtgaaattatacacagggtaaagaagctgacatgtcgtgtgaaaatcaaagaggcaaccggcctgcctctgaatctgtcaaactttgttttctgtcagtacactttctgggaccaatgcgagagtaccgtcgctgctcccgtggtggatccagaggtcccttctccacagagcaaagatgctcagtacacagtgacattcagccactgtaaggattacgtggtgaatgtgacagaagaattcctggagttcatttctgacggggcactagctatcgaagtgtggggccatcgatgtgccggaaacggatcctcaatctgggaggtggattcactgcatgccaaaactcgtacgttacacgacaggtggaatgaagtgacgaggcggattgagatgtggatatcaatccttgaactgaatgagctcggggagtacgccgccgtagaactccatcaggcgaaggatgtgaacacagggggaatctttcaattacgtcaaggtcactccagaagagtgcaggtgactgtgaagccagtccagcactcaggaaccctcccgcttatggtggaggctatcctgtcagttagcatcggctgcgttacagcccgtagcactaagctgcagcgggggctggactcgtaccagagggacgacgaagatggagatgacatggacagttaccaagaagaagacctcaattgcgtgcgggagcgctggagtgatgcactgatcaagcgacgagaataccttgatgaacagatcaaaaaggtctcgaataaaacagaaaagacagaggacgacgttgaacgtgaagcccaactagtggaacaatgggtgggtttgactgaagagcggaacgccgtgctggttccggcccccggcagtggcatcccaggcgcaccggcagactggatccctccccctgggatggagacccatatcccagtcctctttcttgacctaaacgccgacgatctgagcgccaatgaacagctcgtggggcctcacgcatcgggggtgaactcaatcctcccaaaagaacacgggtctcagtttttctatctcccgattatcaaacacagtgatgatgaagtctcggcgacagcatcatgggacagttcagtccacgatagtgtgcaccttaatcgcgtcacccctcagaacgaacgcatctaccttattgtgaagacaaccgtgcagctgtcccatccagctgccatggagctcgtgctccgaaaaaggattgccgctaatatctacaacaagcagtcttttactcagtctctaaagcgccgcatctctctgaaaaacatcttctactcctgcggcgtcacctatgagatcgtgagcaacatccccaaggcgaccgaggagatagaggacagagaaaccctcgccttgttggctgcgcgatcagagaacgagggtacttccgatggcgagacatatatcgagaaatacaccagaggcgttctgcaggtggagaatattcttagcctcgaacgtctgcggcaggcagtcacagtgaaggaagcattgagcacaaaagctcgccacattcgcaggagcctctctacaccaaacgtgcataatgtgtcatctagtcggcccgatctaagtgggtttgacgaggacgataagggatggcccgaaaatcagttggacatgtccgattacagcagcagctatcaagacgtggcctgctacggcacactgcctcgcgactccccacgtaggaacaaagaaggctgcacttcagagactccccatgctcttaccgttagccctttcaaggccttcagcccccagcctccaaagttctttaagccactgatgcctgttaaggaggagcacaagaagcggattgccctcgaggctcgccccttattaagtcaagaatctatgccaccgccacaggctcataatccgggttgcatagtcccctctggaagtaacgggtcttccatgcctgtagaacataattctaagcgggagaagaaaattgactctgaggaagaggagaacgaattagaagcaatcaacaggaagctgatcagctcacagccttacgtgccagtcgagttcgcggactttagtgtctacaacgcttccctggagaacagagaatggttcagctcaaaggtggatctgtccaatagccgggtgctggaaaaggaagtcagtcgcagcccaacaacaagcagtatcacctcagggtactttagccacagtgcctcgaacgcgactctgagtgacatggtggtgcctagtagcgattcctcagaccagctcgccatccagactaaggatgcggacagcacagagcatagcaccccctcgctggtgcatgacttccgcccttcttctaataaggagctcactgaagtggaaaaggggcttgtgaaggacaaaatcatcgtagtgccgctgaaagaaaactctgccctagccaaggggtcacctagcagccagtctattcctgaaaagaattccaaaagcctgtgccggactggcagttgtagcgaactggacgcctgtccctccaaaatctcccagcctgctaggggattctgtcccagagaagtgaccgtggaacacaccacaaatattctggaagatcattcttttacagaattcatgggcgtgagtgaggggaaggacttcgacgggcttacggattcgtctgcgggagaattgtcctcgagaaggagcctgcccaataaaaccgggggtaaaacagtctccgacggcctccaccatccatcccagctgcatagtaagctcgagaatgaccaggtcatcattcctgaagccgccttctgggtgctgtgttgtcagtag

SEQ ID NO: 121613 - DNA, 5250 bp, Artificial Sequence
  Description of Artificial Sequence: Synthetic coding sequence
atgtctgacacaaaagtcaaagtggcagtccgtgttcgccctatgaatcggagagaactcgagctgaacaccaaatgtgtcgtggagatggagggtaaccagacggttctgcacccaccgccctcaaacacaaaacagggtgaaaggaagccgccaaaagtcttcgcatttgactactgcttttggtcaatggatgaatcaaacacaacaaagtatgctggacaggaggtggtctttaagtgcctgggggaaggcatcctggaaaaagcattccagggttataacgcatgtatatttgcctatggacagaccggctctggtaagtcattcagtatgatgggacatgccgagcagttgggacttattccacgcctttgctgcgcattgtttaaacggatttctctggaacagaacgaatcccaaacatttaaggtggaggtctcttatatggagatctataacgagaaagtccgggatctgcttgatccgaaaggttctagacaatctcttaaggttagggagcacaaggtgctgggcccctacgtagacggacttagtcagctggctgttacaagctttgaagatatcgagagtctcatgtccgaaggtaataaatcccgtaccgttgctgctacaaacatgaatgaggagtcaagcaggtcacacgctgtgttcaatattatcatcactcaaactctatacgatctgcagagcggtaacagtggtgagaaagtgagcaaagttagccttgtcgacttagccggcagcgaacgcgtgtccaagacaggcgccgccggggaacgtctgaaagaaggatcaaatataaataagagtctgacaaccttgggactcgtgatcagttccctggcagaccaggcagccgggaagggcaagagcaagtttgtcccttaccgcgactccgtgctgacatggcttttaaaagataatttaggcggtaattcccagacgtctatgattgcgacaatctcccctgctgccgataattacgaagagaccctgtcgacacttagatacgccgaccgtgctaaaaggatcgtaaatcacgcagtcgtgaatgaagacccgaatgccaaagttatacgggaactgagagaggaggtcgagaagctcagagaacagttgtctcaggccgaagcaatgaaggcgccagagctgaaggaaaagttggaggagtcagagaagctcattaaggaactgactgtgacctgggaggagaaactgagaaaaaccgaggaaatcgcccaagagcggcagcgccagctagagagtatgggcatctcgttagagatgagcggcatcaaagtgggagacgacaaatgctacctagtgaacctaaatgctgatccggccttgaacgaacttttggtctactacctcaaggatcacacgcgcgtcggcgccgacacatctcaagatatccaactttttggtataggtattcagccccagcactgtgagatcgacattgccagtgacggagacgttaccctgactcccaaggaaaacgccagaagctgcgtgaacggtaccctggtgtgctcaacaacgcagctctggcacggtgatcgaattctctgggggaataatcacttctttcggatcaacctgccaaagaggaagcggcgcgattggcttaaggacttcgaaaaagagactggcccccccgaacatgacctagatgcagcctcggaggctagcagcgagcctgactataattacgaatttgctcagatggaagtcatcatgaagacccttaactctaatgaccctgtccagaacgttgtgcaagttctagagaaacagtacttagaagagaaacgctccgcactggaagagcagaggcttatgtacgaacgggagctcgagcagttaagacagcagttaagtccagataggcagcctcagtcctcaggcccggataggctggcctatagttcccagactgctcagcagaaagtgacccaatgggccgaggagcgtgacgaattgttccggcaatccctggcaaagcttcgcgagcagctcgtgaaggccaacacactagtccgcgaagctaactttctggcagaggagatgagcaaactgaccgattaccaggtgaccctacagattcctgccgccaatctgtcagcgaatcgcaaaagaggagccattgtgtctgagccagcaatccaagtgcggcgcaagggaaaaagtacacaagtttggacgatcgaaaaattggagaacaagctcatcgacatgcgtgacctttaccaagaatggaaggagaaggtcccagaggctaagagactgtacggtaagagaggagatcccttttacgaagcccaggagaaccacaaccttatcggagtcgctaacgtctttctggagtgtctcttctgcgacgtcaaactgcagtacgccgtacccatcatcagtcaacagggagaagtggccggacgcctacatgtggaggtgatgcgcgtgacaggagccgtgccagagcgcgtagtggaggatgactcctccgaaaactccagcgaaagcggttcccttgaggtggttgacagcagcggagaaatcatccatcgtgttaaaaagctcacctgccgggtcaaaattaaagaggctaccggactgccactgaacctctccaattttgtcttttgtcagtacactttctgggatcagtgtgagtcaacagtggccgctcccgtggtggaccctgaagtcccaagccctcaaagtaaggatgctcagtacaccgtgacttttagccactgtaaggactacgtggttaacgtgactgaggagttcctcgaattcatttccgatggtgctctcgccatcgaggtgtggggccatagatgtgcgggcaatggatccagtatctgggaggtggactctctccacgctaaaacacgcactttgcacgaccgatggaatgaagtgacgcgacgaatcgagatgtggattagcatattggagctcaacgaactgggagaatacgcagctgttgagctccatcaggccaaagatgtaaacacaggcggaatattccagcttcgccagggtcactctcgacgtgtgcaagttacagttaaaccggttcagcactccggaactctgccactgatggtggaggctatcttatccgtctctattggatgtgtgactgcacgctctacgaaactgcagaggggtttggatagctatcaggaggaggacttgaactgtgtgcgcgaacggtggtccgacgcactcattaaacgaagagagtatttggatgaacaaataaaaaaagtctccaacaaaaccgagaaaacagaggacgatgttgaaagggaggctcagctcgtcgaacagtgggtgggcttgactgaagaacgcaacgctgtgctggttcctgctccggggtctggcatcccgggagcacctgctgactggatcccaccccccggaatggaaacccatatccccgtgctttttctggaccttaatgcagacgacctgtcagctaacgaacagctggttgggccccatgcctccggcgtgaacagtatccttcccaaggagcatggcagtcagttcttttacctccccattatcaaacacagtgatgacgaagtttccgcaacggcatcctgggactcttccgtgcacgatagcgtgcacctcaatagagtgactccacagaatgagcgcatttatcttattgtgaagaccaccgtccagctgagccatcccgctgccatggagctcgtgctgagaaagcggatcgcagccaatatttacaacaagcaatcgtttacgcagagcttgaaacgccgaatctccctgaaaaacatcttttactcttgcggagtgacatatgagatcgtcagtaatattcccaaagctaccgaagagatagaagatcgcgagacattagctctgctggcggccaggtccgaaaatgagggaacatccgacggcgaaacgtatatcgagaagtatactcgcggggtgctgcaggtggaaaatatcttgtctctggagcggctacggcaggccgtcacagtgaaagaagcgctgagcaccaaagccaggcatataagacggagcctgagtacgccgaacgtgcataacgtatcttccagtcgtcctgatttatcaggctttgacgaagatgataaggggtggcccgagaaccagctggatatgtccgattattcctcctcctatcaggatgtggcttgctacggcacgctaccacgagactccccgcgccgcaataaagaaggctgcacctcggaaaccccgcacgccctgacagtgtcaccttttaaggcattttccccccagccgcccaagtttttcaagccactgatgccggttaaagaggagcacaagaaacggatcgctttggaggctcgccctctgctctcccaggaggattctgaagaagaagagaacgaactggaggcgatcaatcggaagcttatctcctcacagccatatgtgcccgttgaattcgccgacttcagtgtttataatgccagtctggaaaaccgagagtggttctcaagcaaagttgatttgagcaatagtcgagtgctcgagaaagaagtctcccgctccccaactacatcttctattacctcgggctacttctcacacagtgccagtaacgcaacactcagcgatatggtggtcccgagctccgactcctccgatcagttggccatccagacaaaagatgcagattccacagagcattcaacgccctcactagtgcacgattttaggccctcctccaataaggagctgacggaagtcgagaagggactggtgaaagacaaaatcatagtggttcctctgaaggaaaatagcgcgttggccaagggctctccttccagccagtcaatcccagaaaaaaactccaagtcgctgtgccgcacagggagttgctccgagttggacgcctgtccttctaagatcagccaacctgcacgaggcttctgtcctagagaagtgacagtggaacacacaacaaacatcttagaagatcacagctttactgaatttatgggagtctctgaggggaaggattttgacggtctgacagactcctccgctggggaactaagttcccggaggtctcttccaaacaagactggaggtaaaacagtgagcgatggcttgcaccacccaagtcaactgcatagcaagcttgaaaatgatcaggggggtacaacaagcaggtag

SEQ ID NO: 121614 - DNA, 5313 bp, Artificial Sequence
  Description of Artificial Sequence: Synthetic coding sequence
atgtctgataccaaggtgaaggtggctgtgagagtgagacctatgaatcgccgggagctggagctgaataccaaatgtgtcgtggagatggaagggaaccagacagtgttgcacccacctccctccaatacgaagcaaggagagcgtagaccaagccaggtcttcgcctttgattactgtttctggtcaatggacgagtcaaatacaaccaaatatgccggccaggaggtggtctttaagtgcctgggagagggtattctcgagaaagcttttcagggttataatgcgtgcatcttcgcttacggccagaccggtagcggtaagtcgttcagcatgatgggccatgccgagcaattgggccttatcccacgcctgtgttgtgctttgttcaaacgtatcagcttggagcagaatgagtcccagaccttcaaagttgaagtgtcctatatggaaatatacaatgaaaaagtgcgggatttgctggatcctaaggggtccaggcagagtttaaaagtgcgcgagcacaaggtgctgggcccttatgtggatggattgtctcaactcgccgtaacttccttcgaagatatcgagtccctcatgtcagaaggcaataagtctagaactgtggccgcgactaacatgaacgaggaatcatctcgatctcatgcagtttttaacataattatcacacagacactgtatgacctgcaatcaggcaacagcggcgaaaaggtgagtaaagtttcactcgttgacttagcgggatccgaacgggtgtctaagactggggcagccggcgagagactcaaggaaggctcaaatataaacaaatcccttaccaccctaggccttgttattagcagccttgccgaccaggctgccggcaagggaaagtctaaattcgtgccatacagggattccgtacttacctggctgcttaaagacaatctcgggggcaatagccaaacctccatgattgccacaatcagtcccgctgcagacaactatgaagagaccttgagtactctgagatacgcagacagggcgaaaagaatcgtcaatcacgccgtggtgaatgaggaccccaatgccaaagttattagggagctgcgtgaggaggttgagaagctgcgggaacagctgtctcaggctgaggctatgaaagctcccgaactgaaagagaagctggaagagagcgaaaagctcataaaagagctgaccgtgacctgggaggagaaactccgaaagacggaggaaattgctcaggaacgccagcggcaactggaatcgatgggtatttcactcgagatgagcgggattaaggtcggcgacgacaaatgttacctagtgaatctaaacgcagacccggctctgaacgagctccttgtgtactacctcaaggatcacacaagagttggagcagatacgagccaggatattcagctgtttggcattggcattcagccccaacactgtgagatcgatattgctagtgacggtgatgtgaccctcaccccaaaagagaacgcgaggtcctgtgttaatggcactctcgtgtgctctacaacccagctctggcacggcgatagaatattgtggggcaacaaccatttttttaggatcaatctcccaaagcgcaaaagaagagactggctgaaagactttgagaaagagactggcccccccgaacacgacctggacgccgcaagcgaggcttcgagcgagcccgactacaactatgagtttgcgcagatggaagtcatcatgaaaacccttaacagcaacgaccccgtccagaacgtagtgcaggtgttggagaagcagtacttggaggagaaaagaagcgctctcgaggagcagcgtttgatgtatgagcgcgagctagagcagttacggcagcagctgagccctgaccgccaaccacagtcgtcaggccccgaccggctcgcctacagctcccagaccgctcagcagaaagttacacagtgggctgaagagcgagatgaacttttccgacagtctttggccaaactgagggaacagctcgttaaagccaataccctcgtgcgggaggctaatttcctggcagaagaaatgagcaaactgaccgactaccaggttaccttgcagatacccgccgccaacctgagtgccaaccgcaaacgcggagccatcgtgtccgagcctgccatccaagtccgcagaaaaggcaaaagcactcaggtatggactattgaaaagctggaaaacaaattgatcgatatgcgtgatttataccaggagtggaaggagaaagttccggaagccaagcgactctacggcaagaggggagacccgttctacgaagcacaggagaaccacaatcttatcggagtggcaaacgtgttcttggagtgcttgttctgcgatgtgaagttacaatacgctgtgccgattataagtcagcagggagaagtggctggcagactgcatgttgaagtgatgcgcgtgactggcgcagtcccagaacgagtggtggaagacgactcaagcgagaactcttcagagtctgggtccctggaagtagtggactcttctggcgaaattatccatagggtgaaaaagctgacgtgcagagtcaaaattaaggaggctacggggttgcctctaaacctgtcgaatttcgtcttttgccaatataccttttgggaccagtgtgaaagtactgtcgcagcccctgtggtggatcctgaggttccctccccccaatcaaaggatgcccagtatacagtgacttttagccattgcaaagattacgtggtcaatgtcacggaggagtttctggagttcatttcagacggggcactggcgatcgaggtatggggccaccgctgcgcagggaacggatccagcatttgggaggtagatagcctgcatgcgaagactagaacactgcatgaccgctggaatgaagttacacgaagaattgagatgtggattagcatactggagctcaacgaactgggcgaatacgctgccgtggagctgcaccaggccaaggatgttaacaccggcggcatcttccagctaaggcagggacattccagacgagtgcaggtcacagtgaaaccggttcaacatagcggcaccctgcccctgatggtcgaagcaatcctttctgtgtccatcggttgtgtaaccgctcgatcaaccaaattacagcgggggctggacagctaccagcgtgatgacgaggacggggacgacatggactcctaccaggaggaggatctcaattgtgtccgagagcgctggtccgacgctctgatcaaacggagagagtatcttgacgaacaaatcaagaaagtaagtaacaagaccgagaaaactgaggacgacgttgaacgggaagcacagctcgtagagcagtgggttggactgactgaggagagaaatgcagtgctcgtccctgctcctgggtccggtatccccggcgctcccgccgattggatcccccctcctggaatggagacccacatacccgtcctgttcctggatctgaatgccgacgacctttctgccaacgaacagctcgtagggcctcatgcaagcggcgtgaatagcatccttccaaaagaacatggcagccagtttttctaccttcctattatcaaacactccgacgacgaagtgagtgcaacagcgagctgggattcttcagttcacgactctgtgcatttgaatagagtgaccccccagaacgaacggatataccttatcgtcaagaccacagtccaactgtcacacccagccgcaatggaactggtccttagaaagagaattgctgccaatatctataataagcaatcttttacacagtcgctgaagagaagaattagtctgaagaatattttttattcctgcggggtgacttacgaaatcgtgagtaacattcctaaagcaacagaggagattgaggatagggaaaccctcgcgttgctggccgctagatccgaaaacgagggcacttccgacggcgaaacgtacatagaaaaatatacacgcggagtcctgcaggtcgaaaatattctcagtctggaacgcttacgtcaggccgtaaccgtaaaggaagccctgtccacaaaggcccgacatattaggagaagcctgagcacccctaacgtccataatgtgagttctagtagacctgacttgagtggctttgacgaagatgacaaaggctggccagaaaatcagttggacatgagcgattattctagttcttaccaggatgttgcttgctacggcactctgcctcgcgatagtccaagaaggaataaggagggatgcacctctgagacaccccacgcgctgacagtatctcccttcaaggccttctctcctcagcctccaaaattttttaaaccgctgatgcctgttaaagaagagcataaaaagcggattgctctcgaagctaggcccttgctcagccaggaagattccgaagaagaggaaaacgagctggaggccatcaaccgaaaactaatctcttctcaaccgtacgtccccgtggaatttgctgacttttctgtctacaatgcaagtctggaaaatcgcgaatggtttagtagcaaggttgaccttagcaattctagagtgttggaaaaagaggtatctcgcagccctactacaagtagcatcacatcgggatatttttcccacagcgcaagtaatgcaacactgtccgacatggtcgtgccctctagcgactcaagcgaccagctcgcgatccagacgaaagacgctgactcgactgagcacagcactccttccttggtgcacgatttccgcccttcttctaacaaggagctgacggaagtagaaaagggactagtgaaggataaaatcattgtcgtgcccctgaaagagaattctgcacttgcgaagggtagtccctctagtcagtctatccctgaaaaaaactctaaatcgctgtgccgtaccggctcctgctctgagttagacgcttgtccctctaagatcagccagcccgcacgcggcttttgtccccgagaggtaacagtggagcacaccacaaacatcctcgaggaccattcctttacagaattcatgggagtttctgagggtaaggacttcgacggactgacagacagctctgctggggaactgagctcaagacgctcgttacccaataaaacaggaggaaaaactgtgagtgatgggttgcatcatccatcccagctacacagcaaactcgagaatgatcaagttatcatcccagaagccgcattctgggttctttgctgccaatag

SEQ ID NO: 121615 - DNA, 5313 bp, Artificial Sequence
  Description of Artificial Sequence: Synthetic coding sequence
atgagtgataccaaagtcaaagtggccgtgagggtccgaccaatgaacaggcgggagctggagctcaatacaaaatgtgtagtggaaatggagggtaatcagactgtgcttcaccccccccctagtaataccaagcagggcgaaaggaagccaccaaaggtatttgccttcgattactgcttttggtctatggacgagagcaacaccactaagtacgccggccaagaagtggtgttcaagtgcctgggggaaggcatcctagagaaagcattccagggatacaacgcgtgcatctttgcgtatggacaaacggggtccgggaaatcattcagtatgatggggcatgctgagcaactaggcctcatacctcgtctctgctgcgcgctgttcaagcgcatctcactggagcagaacgagagccaaaccttcaaggtcgaggtgtcgtatatggagatttacaacgagaaggtcagggatctattagatcctaaaggctcccgacagtcactgaaagtgagagaacacaaagtcctcgggccctacgtcgatggcctctcccagctcgcagtgaccagttttgaggatattgagtctttgatgtctgagggaaacaaatcccggacagttgccgccaccaacatgaatgaagagagttcacgatcgcacgctgtgtttaatatcattatcacacagactctgtatgaccttcagagcgggaacagcggcgagaaagtctctaaagtttcactggtagatctggcaggttccgagagagtttccaagactggggctgctggagagcggctgaaggagggctccaacattaacaagagcttgacaacgctgggattagtgatatctagcttggctgatcaggcagcaggcaagggtaaatccaagttcgtcccctatagggactccgttctcacatggctacttaaagacaatctcgggggcaactcccagacaagtatgatcgcaactatctccccggcggcggataattatgaagagaccctctcaactctgaggtacgccgacagagccaaaaggattgttaatcacgccgtcgtgaatgaggaccctaacgctaaggtcatcagggagcttcgggaggaggtggagaaattaagggagcagctctctcaggccgaggcaatgaaggccccagaactgaaagaaaagttggaggagtcagaaaaactcatcaaagaattaacagtgacctgggaagagaaactgcgaaagaccgaggaaattgcccaagaacggcagaggcaattggagtcgatgggcatcagtctggaaatgtcaggtatcaaagtgggcgacgacaagtgttacctggtgaatcttaatgctgatcctgcactgaatgaactgcttgtctattatctaaaagatcatacgcgcgtgggcgccgatacaagtcaggatattcagctttttggcatcggaattcagccacagcactgcgagatcgacatcgcgtctgacggggatgtgacccttacccccaaggagaatgcccgatcctgtgttaacgggacccttgtctgctctacgacacaactgtggcatggggataggatcctctggggtaacaatcacttcttcagaatcaatctacctaaaaggaagcgacgagactggctgaaagatttcgaaaaagagacaggtccacccgagcacgacctagacgcggcttcggaggcttctagcgagcccgattataactatgagttcgctcagatggaggtgatcatgaagaccctgaacagcaatgatcccgtgcagaacgtggtgcaggttctggaaaagcagtaccttgaagagaaaaggagcgccctggaggagcagcggctcatgtacgagagagagttagagcagctcagacagcaactctcaccagatcggcaacctcaaagctccgggccagaccggctggcatactcatcccaaaccgcccagcagaaggtcacccaatgggcagaggagagagacgagctcttcaggcaaagcctggctaaactgcgggaacagttggtgaaagcaaatacactggtcagggaggcgaatttcctagctgaagaaatgagcaagcttaccgactaccaagtaacattgcagatccccgccgcaaacctatcagctaataggaaacgcggcgccatcgtgagcgagcctgcaatccaggtcaggaggaaaggcaaaagtacacaggtatggacgattgaaaagctggaaaacaagctgattgacatgcgcgacctatatcaggagtggaaagaaaaggtgccagaggcaaagaggctgtacggcaaacggggcgatccattctacgaggcgcaggagaaccataatcttataggtgtggctaatgtgtttctagaatgcctgttctgtgacgtgaagctgcagtacgctgtgcccatcatatcacagcagggcgaagtcgcaggacggctgcacgtggaggtgatgagggttaccggtgcagttcccgaacgggttgttgaggatgactcgagcgaaaactcgtctgaatcagggtccttggaagtcgtcgattctagtggtgaaattattcatcgggtgaagaagctgacgtgccgtgtcaagatcaaagaggccaccgggcttcccctcaacttgtccaattttgtgttttgtcagtacactttctgggaccaatgtgaatccaccgtcgcagccccagtggtggaccctgaggtgccaagtccacagtctaaggacgcacaatatactgtcaccttctcgcattgtaaagattacgtggtgaatgtaaccgaagagtttctggagtttatatctgacggtgcactcgccatcgaagtgtgggggcatcgctgcgcagggaatggatcgagcatctgggaggttgacagtcttcacgcgaagactagaacattgcacgatcggtggaatgaggtgactaggcgcatcgaaatgtggatcagtattctcgaacttaatgaacttggtgagtacgccgctgtggagttgcatcaagctaaggatgtcaacacaggcggtatcttccagttgaggcagggccactccagacgggttcaggttacggtgaagccagtgcagcacagcggtacgctccctctgatggtcgaggctattttatcagtgagcattggttgcgttacggcccgcagcacaaagctgcaacgcggtctcgatagctaccagagggatgacgaagacggcgacgacatggacagttaccaagaagaggatctgaattgtgtgcgcgaaaggtggagcgacgctctgataaaaaggcgcgaatacttagacgagcagattaagaaggtctccaataagacagagaagaccgaagatgatgtggagagagaagcccagctggtggaacaatgggtcggcctcacggaggagagaaacgctgtgttagtgcctgcgcccggcagcgggatcccaggggcgcccgcagactggatcccaccccccgggatggaaacccacattcccgtgctgtttttagacctcaacgctgacgacttatccgctaatgaacaactcgtcggcccacatgcgagcggcgtcaactcaatcctccctaaagaacatggctcacaattcttttatctccctataatcaagcattccgacgatgaggtctcagccaccgctagttgggactcgagcgtccatgactccgttcacttgaatcgagtcactccacaaaacgagagaatttacctgatcgtgaaaacaacagttcagctttcacacccggcggcgatggaactagtcttgaggaagcgtatcgccgctaacatttacaataagcagtcattcacccagagtctcaagcgcagaataagcctgaagaacatcttctatagttgtggggtcacttatgagattgttagcaacatcccaaaagccacagaagagatcgaggatcgcgaaacactcgcactgctcgcagctcggtcagagaacgaaggaacatctgacggcgagacctatatcgaaaagtacaccaggggagtccttcaggtggaaaacatcctgagcctcgagagactccgtcaagctgtgacagtaaaggaggctctttctaccaaagctcgacatattcgcagaagcttgtcaacccctaatgtgcacaacgtgagcagctccagacctgacttgtctggcttcgacgaggatgacaagggctggccagaaaatcagctggacatgtccgactattcctcttcttatcaggatgtagcctgttatggtactctcccacgagattcaccgcggagaaataaagaaggctgtaccagcgagacaccccatgcccttacagtgtcgccattcaaagcctttagccctcagccccctaagttcttcaaacccctcatgcctgtaaaggaggagcacaagaaacgcatagcgttagaggctcgcccgcttttgtcccaggaggatagtgaagaggaagagaacgaactggaggcaataaataggaagctgatatcctcccagccttacgtccccgtcgaattcgctgatttctctgtctacaacgctagcctcgaaaatagagaatggttcagttcaaaggtagacctttccaattccagagtgttggagaaggaagtgagcagatccccaaccacgagcagtattacttcaggttatttcagccattcagcctcaaacgcaaccttaagcgacatggtcgttcctagctccgactccagtgatcagcttgcaatccagacaaaggatgccgattcaacagagcactctacgccatcactcgtccacgacttcagacctagctcaaacaaggaactgaccgaagtggagaagggcctggttaaggacaaaattatcgtggtgcccttgaaggagaactcagcgcttgccaaggggtccccgagctctcaatccattccagaaaagaacagcaagagcctctgtcgcacgggcagttgttctgaactcgacgcatgccctagcaaaatctcccaacctgccagaggtttttgcccccgggaggtgactgtggagcatactaccaatatcctagaggatcactcttttaccgagttcatgggtgttagcgaggggaaagactttgatgggctcactgattccagtgcaggagagctgtcctccagacgaagcctaccaaacaagacaggcgggaaaaccgtgagtgacgggcttcatcacccgagtcagttacactctaaactagagaacgaccaggtaattattccggaggccgcattctgggtgctgtgctgtcaatag

SEQ ID NO: 121616 - DNA, 5274 bp, Artificial Sequence
  Description of Artificial Sequence: Synthetic coding sequence
atgagtgacacaaaagtgaaggtagccgtgcgcgtaaggccaatgaatcgtcgcgagctggaactcaacaccaagtgtgtggtcgagatggaagggaaccagaccgtcttgcatcccccaccatcgaataccaaacagggtgagcgcaagccccctaaggtgtttgcgttcgattactgtttctggtcaatggatgagagtaacaccactaagtacgctggacaagaggtggtgttcaaatgcctcggagagggcattctggagaaggcctttcagggttacaatgcatgtatctttgcttatggtcagaccggatcagggaagtcatttagcatgatggggcacgctgaacagctggggctaataccaaggctgtgttgcgcgctcttcaaacggatttctttggaacaaaatgaaagtcagacctttaaggtagaggtgtcctacatggagatatacaatgaaaaagttcgagacctacttgatcccaagggttcccgacagtcacttaaggttcgggaacacaaggtgctaggaccatacgtggatggtctatcacagctcgctgtgacctccttcgaagacatcgagagcctcatgtcagaaggaaacaagtccaggactgtggctgccacgaacatgaacgaggaatctagcagaagccatgcagtgttcaatataattatcacacagacactgtatgatctacagtcaggcaacagtggggaaaaggtgtcaaaagtgtctctcgtcgacctcgcggggtctgagagggtgtcaaaaaccggggccgccggcgaacgacttaaagaaggctctaacattaacaagagcctcacaaccctcggtttggttatctcaagcttggcagaccaggcagccgggaaaggtaagtccaagttcgtgccatacagggattcagtgttaacctggctccttaaagataacttaggaggtaattcccagacctccatgatcgcaaccatctcgccagcagccgacaactatgaggaaaccctgagcaccctgagatatgcagaccgcgcgaaacgcattgtgaatcacgctgtagtcaatgaagatcctaacgccaaggtgatcagggagctccgcgaagaagtggagaagctgcgcgagcagttatcgcaagccgaggctatgaaggccccggagctgaaggaaaagcttgaagaaagcgagaagctcatcaaggagttgactgtgacctgggaagagaagctgcgcaaaaccgaagagatagcccaggaacgccagaggcagctggaaagtatgggtatcagtctcgagatgtccgggataaaggtcggtgatgacaagtgttatctggtgaatttgaacgccgaccccgccctaaacgaactgctagtttattatctgaaggatcacacgcgcgttggagcagatacatctcaggacatacagctgtttgggattgggatccagccccagcattgtgagatcgatattgcgtctgatggtgacgtcaccctcactcctaaggaaaatgctcgttcttgtgtgaatggcacacttgtgtgctccaccacgcaattgtggcacggagaccgtatcctctggggcaacaaccacttcttccgcatcaatctgcccaagcggaagcggcgggactggctgaaagattttgaaaaggagacaggtcctcccgagcacgatcttgatgcggcctcggaggccagctctgaacctgactataactacgaattcgcccagatggaggttattatgaagacacttaactctaacgaccccgtgcagaatgtggtgcaggtactggagaaacagtatttagaagagaaaaggtctgcgctagaagagcagcgtctcatgtacgagcgagaactcgagcagctccgccagcagttgagcccagaccgtcagccacagagcagcgggcccgataggctggcctactcatctcaaactgcgcagcagaaagtgacgcagtgggcggaggagagagacgagctgttccggcagagtctagcgaagctcagagaacagcttgttaaggccaacactcttgtacgtgaggcgaatttcctggctgaagagatgtctaaattaactgactatcaggtcactctccaaatccccgccgcaaacctgagcgctaaccgtaaaagaggagctatcgtgtcggagcctgccatccaagtgaggcgcaagggcaaatcaactcaagtctggaccattgagaaacttgagaataagctgattgacatgcgagacctataccaggagtggaaagaaaaggtgccagaagccaaacgactttacggcaaacgaggcgacccgttttacgaggctcaggagaatcacaatttgatcggagtcgccaacgtgtttctggaatgcctgttctgcgatgtgaagttacagtacgccgtgcctattatttcacagcaaggagaggtcgccgggcggctgcatgtagaagtgatgagggtgacgggggccgttccagagcgggtcgtggaagatgatagttctgaaaattccagtgagtctggctccctcgaggtcgtggatagctcgggggaaatcatccatagagttaagaaactgacctgccgtgttaagattaaagaagcaaccgggttgcctttgaacctcagcaatttcgttttttgtcagtatactttctgggatcaatgcgagagcacggtggccgctccagtggtagaccccgaagttccctccccacagtctaaggacgcccagtataccgttaccttttcccattgtaaagattacgtggttaacgtaaccgaagagttcctggagtttatctcagatggagccctggcgatcgaggtctggggacaccggtgcgcgggtaacggctctagcatctgggaggtggactcactccacgccaaaactaggacactgcacgaccgatggaacgaggtgaccagacgtattgaaatgtggatatccatcttggagctaaatgagttgggcgaatacgccgctgtggagttgcatcaggccaaggatgtaaacacaggcggaattttccagctgcgccagggccattctcggagggtgcaggtaactgtgaaacctgtccagcacagtggaacgctcccattgatggttgaagctattctgagtgtatccattggctgcgtaacggctaggtccaccaaactacaaaggggcctcgacagctaccaggaggaagacttgaattgtgtccgagagaggtggagcgacgccctcataaagcgccgggagtacctcgatgaacagatcaaaaaggtgagcaataagactgaaaagacggaggacgacgtggagcgtgaggcccagctagtggagcagtgggtcgggttgacggaagagaggaatgccgtcctggtgccagctccgggatccggtatcccaggcgctccagctgattggattcccccccctggtatggagacacatattcccgtactcttcctggatctgaacgcggacgacttatctgctaatgagcagctcgtcggccctcacgcttccggtgtgaattcaattctcccaaaggaacatggtagtcagtttttctacctgcccatcatcaaacatagtgacgacgaagttagcgctacagcatcttgggattctagtgtgcatgactctgtacatctgaaccgtgtgactccgcagaatgagcggatttacctcatcgttaaaaccacagtgcagctctcccacccagccgccatggagcttgtcctccggaaacgcatcgctgctaatatttataataaacagtcttttacccaaagcctgaagagaaggatcagcctcaaaaacatcttttattcttgcggagtaacttatgagatcgtgagtaacatacccaaggcgacagaagagatcgaagacagagaaacgcttgcactcctggcagccagaagcgaaaacgaaggaacatcagacggggaaacttatattgagaaatatacacgcggcgtccttcaagtggaaaacatactaagcctcgagagactgaggcaagcagttacagtgaaggaggccctttcaaccaaggctaggcatattagaaggagcctaagtacacctaatgtgcacaacgtttcaagttcacgccccgatctttccggtttcgatgaggatgacaaaggttggccggaaaatcaacttgacatgagcgattacagctcttcataccaggatgtcgcctgctacggtactttgcccagagacagtcctagacggaataaagagggttgtacctccgagaccccgcatgcactgacggtgagcccttttaaggcatttagcccccagccccctaagttttttaaacctcttatgccagttaaggaagaacacaagaaaagaattgctctggaggccaggccactgctcagccaagaggatagcgaggaagaggaaaacgaattagaagctattaataggaagctcatctcctcccaaccttacgtaccagtggagtttgcggatttcagcgtgtacaacgccagtctggagaatcgggagtggttctcgagtaaggtcgacctgtccaactccagagtcctcgagaaagaggtttcgcgttctccaaccacatcctccatcacctcaggttatttcagtcactctgcctcaaatgccacactctcagacatggtggtgcccagcagcgactccagtgatcaacttgcaatccagactaaagatgccgacagcaccgaacactccaccccaagcttggtccacgattttcgcccttcttcaaataaggagctcactgaagtcgagaaaggccttgtcaaggataaaatcattgtggtgcccttgaaggaaaactcagcccttgcgaaggggtctccctccagtcagtccatccctgagaagaacagcaaatcgctctgccgcacagggtcttgctcggaacttgatgcatgcccctccaagataagtcagccagcccgagggttctgtccgagggaggtgaccgtggaacacaccaccaatatccttgaagaccacagttttaccgagttcatgggtgtgagcgagggcaaggatttcgatggcttgactgattcctccgcaggtgaactgtcaagcaggaggagcctcccaaacaagaccggcggcaaaaccgtgtccgatggtcttcatcacccatctcaactccattctaaactggagaatgatcaagttatcatacctgaagccgccttttgggtgctgtgttgccagtag

SEQ ID NO: 121617 - DNA, 213 bp, Artificial Sequence
  Description of Artificial Sequence: Synthetic coding sequence
atgtcagataccaaagtgaaagtggcggtccgggtgaggcctatgaatcgacgagaattagaactcaacaccaaatgtgtggtggaaatggaagggaatcagaccgtccttcacccccctccaagtaatactaagcagggggaacgccttgtgaccgtggcacacatttcaaattccagcaccctggggggccaaggcaagagaataacatag

SEQ ID NO: 121618 - DNA, 1038 bp, Artificial Sequence
  Description of Artificial Sequence: Synthetic coding sequence
atgcccaagctcttgaagagtctgttcccagtgagggatgagaaacgaggcaagagaccgtcccccttggctcatcaggctcagccggagatgggcccggatgttctcgtgcagacgatgggcgcccctgccttaaagatttgtgacaaacccgctaaagtgcctagtccacctcctgtcattgccgtgactgcagtgaccccagcgcctgaggctcaggacggccccccttctcccttatctgaagcttccagcggatactttagccacagcgtcagtactgcgactctatccgacgctctgggccccggcttggacgccgcagctccacctggcagtatgcctacagcacccgaagcggagcctgaagccccgatttcccatccgccgccccctactgccgttccagctgaggaacctccggggccacagcagctggtgagtccagggcgagaacgcccggacctggaggcccccgcccctgggagcccattccgggtgagacgtgtgcgcgccagtgaactcaggtcattttctcggatgctggccggagatcccggttgttcaccgggtgccgaagggaacgcacccgcgccaggggccgggggtcaggccttggcctccgacagtgaggaggccgatgaagttccagaatggctgagagagggggagttcgtgaccgttggcgcccataaaaccggggtggtgcgatacgtcggcccagctgatttccaggaagggacctgggtgggagtcgagctcgatctgcccagcggtaagaacgatgggtccataggcgggaaacaatatttccgctgcaatccaggatacgggctgctggtgaggccgagcagagtgcgacgcgctacaggccctgtccgcagaaggagcaccggtctgcgtctgggggcccctgaggccaggagaagcgctaccttgtcaggaagcgctacaaacctcgcctccttgaccgccgcccttgcaaaggccgaccggtcccacaaaaaccccgaaaacaggaagtcttgggcctcttag

SEQ ID NO: 121619 - DNA, 5481 bp, Artificial Sequence
  Description of Artificial Sequence: Synthetic coding sequence
atgggcgacagcaaggttaaggtggctgtccgaatccgtccaatgaatcgtcgcgagaccgacttgcataccaagtgtgttgtggacgtcgacgcaaacaaggtcattctcaatccagtcaacactaacctgtcaaaaggagatgcacgcgggcagccaaaggtatttgcatatgatcactgtttttggtccatggatgagagtgtgaaagaaaagtatgcgggacaagacatcgtgtttaagtgcctgggcgagaacatccttcaaaatgcttttgatgggtataacgcctgcatcttcgcctacgggcaaaccggatcaggtaagtcctacacaatgatgggcacagccgaccagccaggcctgatcccgaggctctgcagtggcttattcgaacgtacccaaaaagaagagaacgaagaacaaagcttcaaggtggaggtgtcatacatggagatttataacgagaaagtgagagacctgcttgaccccaagggttcccggcagaccctaaaggtcagagaacattccgttctggggccctacgttgacggtctcagcaagctggcagtcacctcttacaaggacattgaaagccttatgtccgaggggaacaagtcaagaacagtagctgccacaaacatgaatgaagagagtagcagatctcacgcagtttttaaaataaccctcacccataccctatatgatgtgaaatcaggcacatcaggagagaaggtgggcaaactctccctcgtggaccttgctggcagtgaacgagctactaaaaccggcgccgctggtgaccgcttaaaggagggttcaaatataaacaaatctctaacgacactgggcttggtgatcagcgcactggccgaccaatcagctgggaaaaacaagaacaagtttgtgccttatagagactccgttttaacctggctgcttaaggactccctaggcggcaactcaaagactgcgatggtcgctactgtgtcccccgcagccgacaattatgacgaaacactttccaccttaagatacgccgatcgtgccaagcatatcgtgaaccacgccgttgtgaatgaagatcctaatgcaaggatcattagggatcttagagaggaggtggagaagttgagggaacagttgacaaaagccgaagcaatgaagtcacctgagcttaaagataggctcgaggagtctgagaagctgattcaagagatgacagttacttgggaagagaaactgagaaaaacagaggagatcgctcaggagagacagaaacaactagagtctttaggcattagtctgcagtccagcggaattaaggtgggagacgataagtgcttcctagtcaacttgaacgccgacccggcccttaatgaactgctcgtgtactacctgaaggagcatactctcattggctctgccaactctcaagatatacagctgtgcggcatgggcatcctccctgagcactgtattattgacatcaccagcgaagggcaggtgatgttgacccctcagaagaataccagaaccttcgtgaacgggtcctcagtttcttctcccatccagttgcaccacggcgatcgaatcttgtggggcaacaaccatttcttcagacttaaccttcctaaaaaaaagaagaaggccgaaagagaggatgaagaccaggatccttctatgaagaatgaaaattccagtgagcaattggatgtcgacggagactctagttctgaagtgagcagcgaggtgaacttcaactacgaatatgcccagatggaagtgactatgaaagccctcgggagtaatgatcctatgcagtccattctaaactccttagagcagcagcatgaggaggagaagaggtctgcactcgaacggcagagactgatgtatgaacacgagctggagcagctgaggagacgcctctcccccgaaaagcagaattgcagaagcatggaccggttctccttccatagcccaagtgcccaacagagacttcgccaatgggcggaggaacgagaggccaccctcaataattccttaatgcgtctgagggagcagatagtgaaggccaacctgctagtccgggaggctaactatattgctgaagaattggataaacgcaccgagtataaagtaacccttcagattccggccagctcccttgacgccaacaggaaacgcggttcactgctctctgaacccgcaattcaggtgcgccggaaaggcaaaggtaagcaaatctggagcttggagaagctggataatcgtctgcttgatatgcgcgatttataccaagaatggaaggagtgcgaagaggataatcccgtgatcagatcatacttcaagcgggcagatcctttttacgatgaacaagagaatcattctctcattggagtggctaacgtctttctggagtccttattttacgatgtgaagctgcaatacgcagtccctattattaatcaaaagggtgaggtcgcggggcgactacatgtcgaagttatgcggctttcaggggacgttggcgagagaatagccggcggggacgaagtcgccgaggtaagctttgaaaaagaaacccaagagaacaagctcgtctgtatggtcaagattttgcaggcgactggcctgccccagcacctatcgcatttcgtgttctgcaaatattcattctgggaccaacaggagcctgtgattgtggctcccgaagtggataccagtagctctagcgtctctaaggaacctcattgcatggttgtcttcgaccactgcaacgagttctccgtgaacatcacagaggactttatcgaacacttaagcgagggcgcgctcgctattgaggtgtacggccacaagataaacgatccccgaaagaacccggcactatgggatctggggataattcaagccaaaacacggtcactgagggatagatggagcgaggttactaggaaactggaattctgggtacaaattttggagcaaaacgaaaatggagaatattgccctgttgaagtgatttctgccaaagacgtcccaaccggcggtatattccagctccgccagggccaatcccgtcgggttcaggttgaagttaagtccgtacaagaatccggcacccttcctctgatggaggaatgcatcctttctgtgggaattggctgtgtgaaggtgcgaccgcttcgggccccaaggactcatgagacatttcatgaagaggaggaagacatggacagctaccaggacagggatctagagcgcctgcgtagaaaatggttgaatgctttgactaaacgacaggaatacttagatcaacagttacagaagctagtgagcaagagggataaaactgaggatgatgccgaccgagaagcccagttgctggaaatgagacttacactgaccgaggagagaaacgcagtaatggttccctcagctggatcaggcatcccaggagctcccgcagagtggactcctgtgcccggcatggaaacacatattccggtgattttcttggacctgaatgccgacgacttttcatctcaggataatctggatgacccagaagccggcgggtgggacgctaccttgactggagaagaagaagaggaattcttcgagctgcagattgtaaagcagcacgacggggaggtgaaggctgaagcctcctgggactccgccgtgcatggatgtccacagttatccagggggacaccagtggacgagcgcctatttctgatagtgagagtgactgtccaattgtctcaccccgcagacatgcagctggtgctccgcaaacgaatatgtgtgaatgtgcacggcaggcaaggattcgcacagagcctcctgaagaagatgtcacacagatcgtctatccctgggtgcggcgttacgttcgaaatcgtgagtaatatacctgaagatgcacagggagtggaggaacgggaggctctagcccggatggcagccaatgtggaaaaccctgcaagtgccgatagcgaggcatacattgaaaagtatctgaggagtgtacttgctgttgaaaacctcctgacgctcgatcgcttgcggcaggaagtcgcagtcaaggagcagctgactggcaaaggcaaactgagcaggcgttccatttcgtccccaaatgtgaaccgactctccggcagcaggcaggatctgattccatcctactcattgggaagcaacaaaggtcgatgggagagccagcaggacgtttctcagacaaccgtgtcccgaggaattgcccccgctccggccctgagcgtgtcaccccaaaataaccattcaccagaccccggcctgtcaaatctcgctgcttcgtatctgaatcccgttaaatcctttgttccccagatgcccaaactgctgaaaagcttattcccggtccgtgacgagaagagaggcaagcgccccagcccccttgcccatcaacctgtaccacggattatggtgcagtccgccagcccagacattcgcgtcaccagaatggaagaagcccaacccgagatgggtccggatgttttagtgcagaccatgggcgcccccgcattaaaaatctgcgataaaccggctaaagttccgtcccccccacctgtgatcgccgtgaccgccgtgacccctgcaccagaggctcaggacggtcccccatctcctctttcggaggccagctcgggctactttagccactcagtctcaaccgccacattgtctgacgccctgggcccaggtctggacgcagctgcaccgccaggctcaatgccgactgcaccagaagccgagccggaggctccaataagccacccacccccccccacggctgtaccagctgaggaacccccgggtcctcagcagctggtgtcacctggcagagagcggcccgatctggaggcacccgctcccgggagtccctttcgggtccggagggtgcgcgccagcgaacttaggtctttttctcgcatgctcgccggggaccccggatgctccccaggagctgagggcaatgcccctgcccctggcgccgggggtcaggctctggccagtgattctgaggaagccgacgaagttccagaatggctgagagagggggagtttgtgaccgtgggcgctcacaagacaggagttgtgagatacgtcggccctgccgactttcaggaaggcacttgggtgggggtggagcttgacctgcccagcggcaagaacgacggatccattggaggcaaacagtacttcaggtgtaatcccggttatgggttgcttgtgaggcccagtcgcgttagaagggctactggaccagttaggcggaggagcaccgggcttagactcggtgccccagaagcccggaggagcgcgaccctgagcgggagcgccactaatttggcgagcctcactgccgcattggctaaagctgaccgcagtcacaaaaatccagaaaatcgcaaaagctgggcctcatag

SEQ ID NO: 121620 - DNA, 4947 bp, Artificial Sequence
  Description of Artificial Sequence: Synthetic coding sequence
atgagtttgcacagtacccacaatcgtaataatagcggtgatatcctggacattccatcgagccagaactcttcttctttgaatgccctcactcatagctctcgcttaaaactgcacctgaagtctgatatgtccgagtgcgaaaatgacgatccactattacggtccgcaggcaaggtgcgcgatatcaaccggacctatgttatctccgcatcccggaagaccgctgatatgcctctaacgcctaatccagttggccggctcgccttgcagcgccgcactacccgcaataaagaatcaagtctgctggtgtccgagttggaagacactaccgagaaaacagctgagaccaggttgaccttgcaaaggcgggccaaaactgattctgcggaaaagtggaagacagcagagatcgacagcgttaagatgacactgaacgttggtggtgaaactgaaaataacggtgtcagcaaagaatcacggaccaatgtgaggatcgtcaacaacgcaaaaaactccttcgtggcctcatcggtccccctcgatgaggaccctcaggtgattgaaatgatggccgataagaagtataaggagactttcagcgcgccctcccgggcgaatgagaacgttgcactcaaatattcttccaatcgaccgcctatagctagcctgtcacagacagaagtagtgcgcagcggtcacctgactaccaaacccacccagtccaaactggatatcaaagtcctggggacagggaacctgtatcacagatccattgggaaggagatagccaaaacaagtaataagttcggtagtttagaaaaacggacgccaaccaagtgcactactgaacacaagcttactactaagtgctccctgccccagttgaagagtccagctccctcgatcctgaagaaccggatgagtaacctccaagtgaagcagcggcctaaatcaagcttcttagccaacaagcaagaacgctctgctgagaacactatacttcccgaagaagaaactgtggtgcagaatacatctgccgggaaagatccactaaaagtggagaactctcaagtgacggtcgctgtgcgtgtgagaccctttactaaacgggagaagatcgagaaagccagccaagtggtctttatgtccggcaaggagatcaccgtggaacatcctgataccaaacaggtgtataacttcatttatgatgtttcattttggtcatttgatgaatgccatccacattatgcgagtcagactacggtgtacgaaaagctcgctgcccccctgctggagcgggcattcgaagggtttaacacgtgcctgtttgcatatggacagactggaagtggcaaatcctacacaatgatgggtttttcagaggaaccaggcattattccgagattctgcgaggatctgttttctcaagtagcaaggaaacaaacccaagaggtcagctatcatatcgagatgtccttcttcgaggtgtacaatgagaagatacacgaccttctggtgtgcaaggacgagaacgggcagaggaagcagccgttgcgtgtgcgcgagcacccagtctacggaccgtacgtagaggcgttaagcatgaacatagtctcatcgtacgcggacatccagagctggctcgagctgggaaacaagcagcgagcgactgctgccacaggcatgaacgataagtcatcacggtcccatagcgtctttacgctggtcatgacccagacaaaaacagagttcgtggagggagaggagcacgaccaccgcatcacctcaagaatcaacctgattgacctcgccggcagtgaaaggtgtagcactgcccatacaaatggagatcgactgaaagaaggggtgtccattaacaagtccctgctgacattggggaaagttatctccgcgctgagcgaacaagcgaatcagagatcggtatttattccttatcgggagtctgtgttgacttggttgctcaaagaatccctcgggggaaactccaaaaccgcaatgatcgcaactattagccctgctgcatcaaatatcgaggagaccctgagtaccctgcgctatgcgaatcaagctaggttgattgtcaatattgctaaggttaacgaggatatgaacgctaagctaattagggaactcaaggccgaaatcgcgaagttgaaggcggctcagagaaattcccggaacattgatccagaaaggtacagactctgccgacaggagatcacctctctccggatgaagctgcatcagcaggagagagatatggccgagatgcagagagtctggaaggaaaagtttgaacaggccgaaaagaggaagctgcaggagacaaaggagttgcagaaagctggcataatgtttcagatggacaaccaccttcccaacctcgtcaacttgaatgaggaccctcaactctccgaaatgctgctctacatgatcaaggaaggaacaaccacggtaggcaagtataagccaaattcttcccatgacatccagctcagcggtgtgctcatcgctgacgatcattgcaccatcaagaattttggtggaactgtcagcatcatacctgttggggaggcgaagacgtacgtgaacggaaagcatatcctcgagatcactgttttaagacatggggaccgtgttatactagggggtgatcattacttcagattcaatcacccagttgaggtacagaaaggcaaaagaccatcaggacgggacacccctatcagcgagggacccaaagactttgaattcgcaaaaaatgaattgctgatggcacaaagaagccagctcgaggctgaaatcaaagaggctcagctgaaggctaaggaagagatgatgcaggggatccaaattgcaaaagagatggctcagcaggagttgagctcccagaaggccgcttacgagtccaaaataaaagcactggaggctgagctgcgagaagagagccaacggaaaaaaatgcaggagataaataatcagaaagccaaccacaaaatagaggagttagagaaagctaagcaacacctggagcaagagatttatgtgaacaagaagcgcctcgagatggagacgctggccaccaagcaggccctcgaagatcactccatccgccacgctcgaatcttggaagctcttgagactgagaagcagaaaattgccaaagaggtgcagattttgcaacagaatcgcaataacagggataaaaccttcactgtgcaaaccacctggagctcgatgaagctatccatgatgatccaggaagccaacgctatctcctccaagcttaaaacttattacgtattcggtcgtcacgatattagtgataaatcgtcatccgacaccagcatccgggtgcgaaaccttaagctgggaatcagtacattctggtctttagaaaaattcgagtcaaagctcgctgccatgaaagaactttacgaatcaaatggttcaaaccggggggaagacgcattttgcgaccctgaagacgagtgggaaccggatataaccgacgcccccgtctctagtctctcaagaagacgcagtagatcgctgatgaaaaatcgtcggattagcggatgcctgcatgacattcaagtgcatccaataaagaacttacactcatctcacagtagcggcctgatggacaaatcctcaacaatatactccaatagcgcagagtccttcctaccaggaatctgcaaggaactgatcgggtccagtctagactttttcggccagtcttatgatgaggagcgcaccatcgccgacagccttatcaactcatttctaaaaatctataacggcctctttgctatctcaaaagcccacgaggagcaggacgaggaatcccaggataacctgttctcctcagacagggccattcaatcactgacgattcagactgcgtgtgcattcgaacagctcgtggtgttaatgaaacattggctgtctgaccttcttccatgtactaacattgcacgactggaggatgagctccgccaggaagtaaagaagttgggcggatacctgcagctgtttcttcagggttgctgcctcgatatcagttcaatgataaaggaggcacagaagaatgcgatccagattgttcagcaggccgtgaagtatgtgggtcagctcgcagttctaaagggaagcaaacttcactttctagaaaacggcaacaataaggctgcctctgtccaggaggaattcatggatgccgtgtgcgatggggtggggctgggcatgaagatacttctggacagcggactggagaaggcgaaagagcttcaacacgagctcttccgccagtgtaccaaaaatgaagtcactaaggaaatgaagacaaatgccatggggctgattaggagtctcgagaatatctttgcagagtccaaaataaagagctttcgtaggcaggttcaggaagagaacttcgagtatcaggattttaaacgaatggttaatcgggctcctgagttcctgaaactgaaacactgcctggagaaggctatagaaatcatcatatctgcccttaagggctgtcactcagatatcaacttgctccagacttgtgtggagagcattcggaatcttgcaagtgatttctactctgattttagcgtaccgagtacctctgtgggttcctacgaaagccgcgtcacccacatcgtacaccaggagctggagtctctggctaaatcactccttttctgctttgagtctgaagagtcccctgatctactgaagccatgggagacttataatcaaaatacaaaagaagagcatcaacagtccaagtcgtcaggcatcgacgggtcaaaaaacaaaggcgtgcccaagcgggtctacgagctgcacgggagctccccagcggtatcttcagaggagtgcaccccatcaaggattcagtgggtgtag

SEQ ID NO: 121621 - DNA, 5073 bp, Artificial Sequence
  Description of Artificial Sequence: Synthetic coding sequence
atggcgggggcctctgtcaaggtcgccgtgcgggttaggccatttaacagtagggaaatgagcagggattcaaaatgtatcattcagatgtccgggagcactactactatagtgaaccccaagcagcctaaggagactccgaagtcttttagttttgattactcctactggagccatacttctcctgaagatataaactatgccagtcagaagcaggtgtacagggatatcggcgaagaaatgttacagcacgcctttgaaggatataacgtttgtatatttgcttatggtcagacaggtgcgggaaagtcttatactatgatgggaaagcaagagaaagatcaacaggggataataccccagctgtgtgaagacctcttctccagaatcaatgacactactaatgataacatgagttacagtgtcgaggtgtcttatatggagatttactgtgagcgtgtgagggatctgctcaacccaaaaaataagggaaacctcagagtgcgggaacaccctctgctgggaccctatgtcgaggacctgtctaagttggccgttaccagttataacgacatccaggacctgatggatagtggaaataaagccagaacagttgccgcaacaaacatgaacgagaccagttcacggtcacacgctgtgttcaacattatcttcactcagaaacgccatgacgctgaaacgaatatcacaacggaaaaggtgtcaaagatttcgttagtggacttagctggctctgaaagggctgattctaccggggctaagggaacgaggttgaaagagggcgcaaatattaacaagtccctgaccaccctggggaaagttatctccgcattggccgagatggactctgggcccaataaaaataaaaaaaagaagaagacggactttatcccctacagggattccgttctgacatggctgttgcgcgaaaacttaggaggtaattcgcggaccgccatggtggctgcgctttccccggccgatattaattatgatgaaaccctgtccacgctcagatatgcggaccgtgctaaacagattcgctgtaatgcggttattaacgaggatcctaataataaactgattcgggaactgaaggatgaagtgacaagactgagagatctgctctatgcacagggcctgggtgacattacggacatgacaaacgccctggtaggcatgtcgcccagctcatccctctccgcccttagtagtagagcagctagcgtgtccagtctgcacgagcggatcctgtttgcaccaggttccgaagaagcaatagagcggctgaaggagacagagaaaattatcgctgagcttaatgagacatgggaggaaaagctgagaagaactgaggctattcgcatggagcgcgaggcattattggctgaaatgggggtggccatgagggaagatggaggcactctcggagtcttctctcccaaaaagaccccacacctcgtcaatttgaatgaagatcccttaatgagtgaatgtcttctgtattacattaaagatggcatcacacgcgttggccgcgaagacggagaacggcggcaggatatcgtactttctggtcactttatcaaagaggagcattgtgtttttcggagcgactcccgaggcggctcggaagctgttgtcacactggagccatgtgaaggagcagacacttacgttaacggaaagaaggtcacagagccgtctattctgagatctggcaatagaatcattatgggaaaatcccacgtcttccgcttcaatcatccagaacaggctaggcaggagagggaacggacaccctgcgcagagacacccgctgagccagtggactgggcctttgcgcagcgcgaattattggaaaagcagggtatagacatgaagcaggagatggagcagcgcttgcaggagctcgaagatcagtacaggagggagcgagaggaagccacttacctcttagagcagcaaagactggattatgagtcaaagctcgaggctttgcagaagcagatggactctcggtattatcccgaggtaaacgaagaagaagaggaaccggaggatgaggtccaatggactgagcgagagtgtgagctggctctttgggccttccgtaagtggaaatggtaccaatttacctccctgcgcgacctgctctggggaaatgctatcttcctcaaggaagctaacgcaatctccgtggaattgaaaaagaaggtgcagttccagtttgtcctcctaactgatacactgtacagcccacttccacctgacttgctgccgcccgaggctgcgaaggaccgagagactaggccttttcctcgtactattgtggccgtcgaggtgcaggaccaaaagaatggggccacccactattggacattagagaaattacggcaacgcctggatctgatgagagagatgtatgatagagcagcagaggtccctagctcagtgatcgaggattgcgataacgtggtaaccggcggagatcctttttatgacagattcccttggttccggctggtgggccgggcatttgtctacctaagcaacctgctatacccagtgccactggtgcatagggtcgcaattgtgagcgagaagggggaggtgaaaggattcctccgggtggctgtgcaggccatcagcgcagacgaagaggcaccagactatggctctggggttcgccagtccggaaccgcaaagatatcattcgacgaccagcattttgaaaaatttcagagcgaatcatgccccgtggtgggaatgtccagaagcggcacctcccaagaggagttacgaatcgtagagggccaaggccaaggcgccgacgttgggccctctgctgacgaagtaaataataacacctgttctgccgtgccccccgaaggcttgctgctcgattcctctgagaaggctgcactggacggccctctggatgccgctctggatcacttaaggctcggaaatacatttacattcagagtcaccgtgcttcaggcgtcttctataagcgctgagtatgccgacatcttttgtcagttcaactttattcaccgtcatgacgaggccttcagcaccgaaccactcaaaaacaccgggagaggcccgcctcttgggttttatcacgtccagaatatcgcggttgaggttaccaaatcattcattgagtacatcaagtctcagcccatcgtgtttgaagtattcggacactaccagcagcacccgtttccacctttgtgcaaggatgtgctgtctcccttaaggccctctaggcggcacttcccaagagtgatgcccttatcaaaacccgttcccgcgacaaaactgtcaacactcactcgcccatgccctggaccatgtcattgcaagtacgatctcctcgtttacttcgagatctgtgagttggaagccaacggtgattacattcccgccgtagtggatcatagaggcgggatgccctgtatggggactttcttgctgcaccaggggatccagaggaggattacggtcacactcctgcacgagacagggagtcacatccgctggaaggaagtgcgggaactggttgtcggacgcatccgtaatactccagaaactgatgagagccttatcgaccctaacatattgagtctgaatatcctgagctctgggtatatccatcccgcacaggacgatagaaccttttatcaatttgaagctgcttgggacagtagcatgcataatagccttctcctgaatcgagtcacaccctaccgcgaaaagatctacatgactctctctgcatacatcgagatggaaaactgtacacagcccgcagttgtcacgaaggacttttgcatggtgttctattcaagggacgcaaagcttcctgcctctaggagcattcggaacctcttcggcagcggctctcttagagcgagtgagtccaatcgcgttactggcgtttatgaactgtcgctgtgccacgtggcagacgccggaagtccaggcatgcagcggaggcgcaggcgggtgctcgacacatcagttgcatatgtgaggggggaggagaatctcgcgggatggaggcctaggtctgactcattgattttggaccaccagtgggaactggaaaagctgagcttactacaggaagtcgaaaaaacaaggcattacttactgctccgagagaagctcgagacggcgcagcggcctgttccggaagcgttgagccccgccttctcagaggactccgagtcacacggcagttccagcgcaagcagtcccctgtcagcagagggtcgaccaagtcctttggaggcaccaaatgagcggcagcgggaacttgcagtcaaatgcctcagactgctgacccataccttcaatcgcgagtacacacactcccacgtgtgcgtgtccgcctcagaaagcaagctcagcgaaatgagtgtaacgctgctccgggatccttctatgagccccctgggagttgccactctaacccccagcagcacctgtccctctctggttgagggccgctacggtgcgacagacctgagaacgccacagccctgttcgcggccagcttccccagaacccgagctgctgccggaggcagattccaaaaaactccccagccctgcccgcgccaccgaaacagacaaggaaccccagcggcttttggtgccagatatccaggagatcagagtctcccccatagtaagtaaaaagggctacctgcatttccttgagccccacacctctggctgggcccggcggtttgtagttgtacgtaggccctacgcctacatgtataactccgacaaagatacagtcgaaaggtttgtcctgaacctggcgacggcccaggtcgaatactctgaggaccagcaggcaatgcttaagactcccaatacttttgcagtgtgcaccgaacatagagggatcttactgcaggcagcctcggataaagatatgcatgactggttgtacgccttcaatcccctgctagccggcaccattcgtagcaagttatcacgaagacggtccgcccaaatgagagtgtag

SEQ ID NO: 121622 - DNA, 5400 bp, Artificial Sequence
  Description of Artificial Sequence: Synthetic coding sequence
atggccggtgcatccgtgaaggtggccgtacgcgtgaggccttttaattcgcgcgaaatgtctcgggacagcaagtgcataatccagatgagcggatcgacgacaacaattgtgaatcctaagcagcctaaagagacgccgaaaagcttcagctttgattattcttactggtcacacacctcccccgaagatatcaattacgccagccagaaacaggtgtatagggatatcggggaggagatgcttcagcatgcgtttgagggctataacgtgtgtatcttcgcttatggacagaccggcgcgggtaaaagctataccatgatgggaaagcaagagaaagaccagcagggtatcatcccacaactgtgcgaagacctcttctcccggatcaacgatacgacaaacgacaacatgtcttattccgtggaggtttcatacatggagatttattgcgagcgagtgagggatctgctgaatcccaagaacaagggcaatctgcgggtgagagaacacccgctgttagggccctacgtcgaagatctatcaaaactggcggtgacgagctacaacgacatacaggacctgatggattccggcaataaggctcggacagtagccgctacgaacatgaacgagacttccagcagatcccacgcagttttcaacattatttttactcagaagcgccatgacgcagaaaccaacatcactactgagaaggtttctaagatttccctggtggacctggcaggttctgagcgagccgacagcaccggagcaaaggggactcgtcttaaagagggtgcaaacatcaacaagtctctgacgaccctggggaaggtgatcagcgccctggccgagatggtatcagggccagctcggaataagaagaagaagaaaacagacttcataccatatcgggattcagtgctgacatggctgcttagggaaaatctcggaggcaattcaaggactgctatggtggctgcactgtcaccagccgatataaattacgatgaaaccctctcaacattacggtatgcagatcgcgcaaagcaaatcaggtgtaacgccgtcatcaacgaagatcctaataacaagttaatccgtgaattgaaggatgaagttacacggctccgcgatttactatatgcacagggactgggggatatcaccgacaccaacacagtgcccggcggccccaagcttactaatgccttggtgggaatgtcgccctcctcttccctcagcgctttgtcctctagagccgctagtgtttcttccctgcacgagcgtattctcttcgcccctggaagcgaggaagccattgaacggctcaaggaaacagaaaagatcatcgctgagctcaacgaaacatgggaggagaaactgagacggacagaagccatacgtatggaacgcgaggctttgctcgctgagatgggagtggctatgcgggaagatgggggcactctaggagtgttctcccctaagaagactcctcatttggtgaaccttaacgaggacccccttatgagcgaatgcctgctctactacatcaaggacgggatcacaagggtgggccgcgaggacggggaacgtcgacaggatattgtgttgagcggacatttcattaaggaggagcattgcgttttccgatctgattcccgtgggggatcagaggcggtggtaactctagagccttgcgaaggggctgatacctacgtaaacggaaaaaaggtaaccgagcctagcatactgaggagtggaaaccgaatcattatgggcaaatctcatgtgttccgtttcaaccacccggagcaagctcgccaagagagagaacggacaccgtgcgcagagacacccgccgagcctgtggattgggcgtttgcccagcgcgagctgctcgagaagcagggcatcgacatgaagcaggagatggaacagcggctgcaggagctggaagatcaatatcggagagagagggaggaggctacttacctgctggagcagcagcggctggactacgagtcaaagctagaagccctgcagaaacaaatggacagcaggtattaccctgaggtgaatgaggaggaagaagaacccgaggacgaggtgcagtggaccgaaagagaatgcgagctagccctttgggcatttcgcaaatggaaatggtatcagttcacatcacttagagatctcttatggggcaatgccattttcctgaaagaggcaaatgcgatttctgtggagctcaagaagaaagtccagtttcagttcgtcctcctcactgacacactgtacagcccactgcctcccgacctattaccccctgaagccgccaaggaccgcgagacacggcctttcccgaggacgatcgtggcagtcgaagttcaggatcagaagaacggggctacgcactattggacactggaaaagcttcgacagagactcgacctgatgcgcgagatgtatgatcgcgcagccgaagtcccttcgagcgtgatcgaagactgtgataatgttgtcacgggaggagatccattttacgacagattcccttggttccggttagtgggatcctcagctattagtggctgtaacagttatcctctcttgaatacttgtatgagcgagaggatggctgcgctcaccccctcgccaacctttagtagtcctgatagcgatgctactgagcctgctgaagagcagtcagttggtgaggaagaagaggaggaagaagaagaagaggatgaggaggaggaggatctggaagacgatgtgtttcctgaacacgctctgtgcgacggcagagaccccttctatgacaggcctcccttgttcagcttggtgggaagggctttcgtctatcttagcaacttgctttatcctgtgcccttagtccatcgcgtggctattgttagcgagaagggagaggtgaaaggctttctgcgtgtagccgtccaggctatctcagcggacgaagaagctccggactatggctccggggttaggcagtccgggacggctaaaattagtttcgacgatcagcacttcgagaagtttcaatcagagtcatgcccagtagttgggatgtcacgcagcgggacctctcaggaggaactgaggattgttgagggccagggccagggagctgacgtcggtccaagtgctgacgaggtgaataacaacacgtgcagcgctgttcctcctgagggcctgcttttggactcgagtgagaaagctgctctcgatggccctctggacgccgccctggatcatttgcgtctggggaacaccttcactttccgagtaactgtacttcaggcttcttccatttctgccgaatatgccgacattttctgtcagtttaacttcattcatagacacgacgaggccttctccacagagcccctcaagaacaccgggcgcggccctccgcttggtttttaccacgtgcagaacattgccgttgaggttaccaaatcatttatagagtacattaagtcccaacctattgtttttgaggtgttcggccactatcagcagcatccctttcctccactctgcaaagatgtgttatctccgcttcgccccagccggagacatttcccccgtgtgatgcccttgtccaaaccagtacccgctacaaaactctctacactgaccaggccttgtcccgggccatgtcattgtaagtacgacctgctggtttactttgagatctgcgaactcgaagccaatggcgattacattcccgctgtggtcgatcacagaggaggcatgccgtgtatgggcacttttcttctgcaccagggaatccagaggaggatcacagttaccctgctccacgagactggaagtcatattaggtggaaggaagtacgagagctggtggtggggaggattcggaatacaccggagaccgacgagagtctaattgatccgaatattctgtctcttaatattctctctagcggttacatccatcctgcacaagatgatcgcgtaagcctcggaaatgatacgcgtaccttttaccagtttgaggcagcgtgggactcaagcatgcataactcactactgctgaaccgggtgacaccctatcgagagaagatctatatgaccctgtcagcttacatcgagatggaaaactgcacacagccggcagtagtcactaaagatttctgcatggtgttttacagcagagatgcaaagcttccagcatcgcgctccattcgcaatctgttcggctccggcagtctgagagcgagcgaaagtaatcgggttaccggcgtgtatgaattaagcttatgccacgtcgccgatgcgggcagtccaggaatgcagcgccggcgtagaagagtgctcgacactagcgtggcctatgtccggggagaggagaacctggctggctggaggccgcgctcagactcactcattctggatcaccaatgggagctggagaaactgagtctactccaggaggttgaaaagaccagacattatctacttctgcgcgagaagttggagacagcccagagacccgtgccggaggctctgtctcccgcattttccgaggacagcgagtctcacggctcgagctcagcgtcatcccctctgagcgcggagggtcgaccctcacctctcgaagcgcccaatgagcgtcaacgcgagcttgctgtgaagtgtctgcgattactgacgcatacattcaacagggaatacacccattctcatgtctgcgtaagtgcctccgaatcaaaactcagtgaaatgagcgtaactctgttacgagaccctagcatgagtccactcggggtggccaccctgactccaagttccacatgcccaagcctggtggaagggcggtacggggcaacagacctgagaacgcctcagccttgctctagacctgctagcccagaacctgagttgttaccagaagctgatagtaagaaacttccatctcctgctagagctaccgaaaccgataaagagccacaacgtctcctagtacccgacatccaggagattcgggtctcacctatcgttagtaaaaaaggctatctgcactttctggagcctcatacgtctggttgggcacgtagatttgtggttgtccgacgcccttatgcttatatgtataatagtgacaaggacaccgtggagcggtttgtccttaatctggcaacagcacaggtagaatactccgaggatcaacaggctatgctgaaaacacccaacacctttgcagtgtgcacagaacatagggggatactgttgcaggcagccagcgacaaggatatgcatgattggttatacgctttcaaccctctgcttgcaggtacgattagatcgaagttgtccaggcggcgaagcgcccagatgagggtgtag

SEQ ID NO: 121623 - DNA, 117 bp, Artificial Sequence
  Description of Artificial Sequence: Synthetic coding sequence
atggctggcgcttccgtgaaggttgcagtccgggtcagaccctttaactcccgcgagatgtcccgtgatagcaaatgtataatccaaatgagcggctctacgacaacaatcgtgtag

SEQ ID NO: 121624 - DNA, 5376 bp, Artificial Sequence
  Description of Artificial Sequence: Synthetic coding sequence
atggcaggcgcctctgtcaaagtcgctgtccgggtgcgtcctttcaactccagagaaatgtcaagagactcaaaatgtatcatccagatgagtggcagcacaactactatagtgaaccccaagcagcctaaagagacgcctaaatccttcagctttgactatagctactggtctcacacctcgcctgaagatattaattacgcctcacaaaagcaggtttacagagatattggcgaggagatgttgcagcatgcctttgagggctataatgtatgtattttcgcctacggtcagaccggtgctggcaagtcatataccatgatgggcaagcaggagaaggatcagcagggcataatccctcagctatgtgaagatctcttctcccggattaatgacaccaccaatgacaacatgagttattcagtggaggtctcatacatggaaatttactgtgagcgagtccgtgacctactgaatcctaagaataaagggaacctgcgcgtcagggaacaccccctccttggcccctatgtagaggacttgtccaaattggccgtcacaagttataatgacatacaggatctgatggatagcggcaataaggcccggactgtggcagctacaaacatgaacgagacatcttctcgaagtcatgctgttttcaacatcattttcacccagaagaggcatgacgccgaaacgaatatcactaccgagaaagtgagcaagatctctcttgtcgatctcgccgggtcagagagagccgattccacgggcgctaaggggactcggttgaaggagggggcaaatattaacaagtccttgactacactggggaaggtgatcagcgcactggcggaaatggattccggccccaacaagaataaaaaaaagaagaagacagactttatcccttatagggactccgtactgacatggctgctccgtgagaaccttggaggcaattcaagaacagccatggtggcagccctgagccctgcggacattaattatgacgagaccctgtcaacccttcggtacgcagatcgagctaagcagatcagatgcaatgccgtcatcaatgaagaccctaacaacaagctgatccgagagctcaaagatgaagtgacaaggctccgcgacctgctatacgctcaaggtctgggcgacattacagacacgaataccgtgcctggcgggcctaaactaacaaacgcccttgtggggatgagcccaagctctagcttatcggctctgtcaagccgagccgcatccgtctcatccttgcatgaacgcatactattcgctccgggctctgaggaggccatagagcgactgaaagaaaccgagaaaatcattgcagaattgaatgagacatgggaggagaaactaagacgcactgaggctatcaggatggagcgggaggctctgctggcagagatgggggtcgccatgagagaggacggcggaacactgggcgtcttttcgccaaagaagacaccccacttggtcaacctcaatgaggaccccctcatgtcagagtgtctcctctattatattaaggatgggattacaagggtgggccgagaggatggggagagaagacaggacatagtgttgtccggacattttatcaaagaagagcactgcgtgtttaggagcgattccagagggggctctgaagcggttgttaccttagagccatgcgagggcgcagatacatatgtgaatggaaagaaagttaccgaaccttcaatactcagatctggcaataggataatcatgggaaagtcacatgtgttccggtttaatcaccctgagcaggcccgccaggagcgtgagagaactccttgtgctgagaccccagcggaacccgtggactgggcctttgcccagcgcgagcttctcgaaaagcaaggtatcgacatgaagcaggagatggagcagcgcctccaggagctcgaagatcagtatcggagagagcgtgaggaggcaacttatctgctcgagcagcagagactggactacgagagcaaactggaagctcttcagaagcagatggattctagatactacccagaagttaatgaggaggaggaggagccggaagacgaagtgcagtggaccgaaagagaatgtgagctggcgttgtgggcatttcggaaatggaagtggtaccaattcaccagtctgcgagatctcctatggggcaacgccatcttccttaaagaagctaatgccatcagcgtcgagctgaagaagaaagtacagttccagttcgtgctgttaactgacactctgtacagccctctccccccagacctgctccccccagaagctgctaaggacagagagacaagaccctttcctcggacaattgtggccgtggaggtgcaagaccaaaagaatggagctacacactattggacgctggaaaagttgcgtcagcgactagatttgatgcgggagatgtacgacagagctgctgaggttcccagttcagtcattgaggactgcgacaacgtggtgacagggggggatccgttttatgatcgcttcccatggtttcgcctcgtgggaagtagtgcaatcagcggctgcaatagctaccctctgcttaacacttgcatgagcgaaaggatggccgctctgacaccatctcctacctttagttccccagactccgatgctaccgagccggccgaggaacaaagtgtgggcgaagaagaggaagaagaggaggaggaggaagatgaagaagaagaggacctggaagacgacgtgttccccgaacatgccctgtgtgatgggcgtgaccccttctatgatcgcccccccctttttagcctcgtaggccgtgcgttcgtttatttgtcaaacctgttatacccagtccccctagtacacagggtggcaattgtaagtgagaaaggcgaggtaaaaggctttctccgagttgcagtgcaggccattagcgctgacgaagaagctcctgattatggcagcggggtgcggcaaagcggaaccgccaaaatctctttcgacgaccaacactttgagaagttccaatccgaaagttgtccagtggttgggatgtcacggtctggcacaagccaggaagaactgcggattgtcgaggggcaaggacagggtgccgatgttggacccagcgcagacgaagtaaataataacacgtgcagtgcagtcccccctgaagggcttctgctcgattcctccgagaaggccgcactcgacgggccccttgatgccgctctggatcacctccgcctaggaaacacatttacatttcgggtgaccgtattacaggcgagctccattagtgccgagtatgcggacattttctgccaatttaactttatccaccgccatgacgaggcattcagtacagaacctctaaagaacacaggcagagggccccccttgggcttttaccatgtgcaaaacattgccgtggaagtcactaagtcatttatcgagtacataaaatcccagccgattgttttcgaagtcttcggtcactatcagcagcacccatttcctccgctttgcaaagacgtgctgtcaccccttaggccctcccgccgccacttccccagagtaatgcctctgagcaaaccagtccccgcgacaaaactgtccaccctgacccggccatgccccgggccatgtcattgcaaatatgatctactggtctacttcgagatatgtgagctcgaagccaacggagattacatacctgcggttgtcgaccacagaggcggtatgccctgtatgggtaccttcctcctgcaccaaggaattcagcgccgcattacagtcaccctgctgcatgaaaccgggtcccatatccgttggaaggaggtccgcgaactggtcgtgggacggatccgcaacacaccggagacagacgagagcctgatcgaccccaatattctcagcctgaacatcctgtccagcggatacattcacccagcgcaggacgatcgcaccttttatcagtttgaggccgcctgggactcaagcatgcacaactcgctgcttctgaatagagtcaccccctacagagaaaagatctatatgactctgtcggcgtacattgagatggaaaattgcacacagcctgctgtggtgaccaaagatttttgcatggtcttttattccagagatgcaaaactgcctgcctcacggagcatccggaacttgttcggttctggctccctgagagcctctgagtcaaatagggtcaccggagtctacgagctgtctctctgtcacgtggccgatgcagggagcccagggatgcagcggcggagaaggcgcgtactggacacttctgttgcctatgtgagaggcgaagagaatctggcgggctggagacctcgaagtgattctctgatcttggaccaccagtgggagttggaaaaactgagccttctgcaggaagtggaaaagaccagacattacctcctgctgcgcgaaaagctcgagacagctcagcgccctgtccctgaggccctttccccagcattttctgaggactctgaatcgcatggctcgagcagcgccagtagtcccttgagcgcagaggggcggcccagtccactggaggcaccaaacgagcggcaaagggaacttgcagtgaagtgtctgcggctcctgacacacaccttcaacagggaatacactcacagccacgtctgtgtgagtgcctcagaaagcaagctctccgagatgtctgtgaccctcctcagggatcccagcatgtcacccctgggagttgctactctgactccatcttctacctgcccgagtcttgttgaggggaggtacggcgctactgatctgcgtaccccgcaaccttgctctcgaccagccagccccgaaccggagctgctgcctgaagcagatagcaagaaactcccgagtcccgccagagccacggaaaccgataaggagccacagcgcctcctggtgccagatatccaggagattagagtgagccctatagtctcaaaaaagggttacctgcacttcctggagccccacaccagtgggtgggccaggcggttcgtcgttgtgcggcgtccctatgcatatatgtataattccgacaaagacacggtggagcgatttgtgctaaacctggccaccgctcaggtcgagtattcagaagatcagcaggcaatgctaaaaacacccaacacattcgcagtttgtactgagcatcggggcattctcttacaagcggcaagtgataaagatatgcatgattggctctatgcattcaatcccctgctggccggaacaattcggtctaaactgtctcggaggagatcagctcagatgagggtctag

SEQ ID NO: 121625 - DNA, 5313 bp, Artificial Sequence
  Description of Artificial Sequence: Synthetic coding sequence
atgagcggtgcgagcgtgaaggtggccgtgagagtccgccccttcaattcacgggagacgagcaaagagagcaagtgtataatccagatgcaagggaacagcacgagcataatcaacccgaagaaccctaaagaggcccccaaaagcttcagcttcgactactcgtactggtcacacacttctccggaggatccctgcttcgcgtcacagaacagggtgtataatgacataggaaaggagatgctcttacacgcgtttgagggctataacgtgtgcatctttgcctatggacagacaggtgccggcaagagctacacaatgatggggaagcaggaagaatcccaggcgggtatcattccgcagctgtgtgaagaactgttcgagaaaatcaacgataactgcaatgaggagatgtcttatagcgtggaagtgagctatatggagatctactgtgagagggtgagggatctgctgaaccccaagaacaagggcaatctgagagtgagagagcaccccctcctgggaccttatgtggaggatctaagcaaactcgccgtgaccagttatactgacatcgcggacctcatggacgctggaaataaggctcgcacggtggctgcaactaatatgaacgaaacctctagcaggtctcacgccgtgttcaccattgtctttacacagaagaagcacgataacgagaccaacctctcgacagagaaggtgtcaaagatttcccttgtggatttggctgggtccgaaagagccgactcaacaggagccaaagggacacggttaaaggaaggtgcaaatattaataagtctttaactaccttgggaaaagtgatctccgctcttgctgaagtctcaaagaaaaagaagaagaccgatttcatcccctaccgtgattccgtgctcacttggcttttgcgggagaatctgggtgggaattcaagaacggccatggtggccgcactctctccagccgatattaactatgacgagactttgagcacgcttcgctacgccgaccgggctaaacagattaaatgtaacgccgttatcaatgaggatcccaacgctaaattggtccgcgagcttaaggaagaagtcactagactgaaagaccttctcagggctcagggtctgggcgacataatcgacacgagtatgggctccctcacttcctcaccctcatcctgtagcctgagtagccaggtgggtctgacctccgttacatcaattcaggagaggattatgtcaacccccgggggtgaggaagccatcgagagactcaaggaaagcgagaaaatcattgccgaactgaacgaaacatgggaggaaaaactccgcaagactgaggccattcggatggaacgagaggcactcctggcggaaatgggggtggccataagggaggacggaggcaccctcggggtcttttctcccaagaaaacccctcatctggtaaatctgaacgaggacccattaatgtccgagtgtctgctgtactatataaaagacgggatcacacgggtgggccaggctgacgccgaaaggagacaggacattgtgcttagtggggcccatattaaggaagaacactgtattttcagatctgaacggtcaaacagcggggaagtgattgtgaccctagaaccttgcgagaggtctgaaacgtatgtgaacggaaagcgggtgtcccagccggtccagctacggtccggaaaccgcatcatcatgggaaagaaccacgtgttcaggttcaaccaccctgagcaggcaagagcagagagagagaagacgccgtcagctgagaccccatcagaacctgttgactggacgttcgcccagagggagctccttgaaaaacaagggattgacatgaaacaggaaatggaaaaacggctgcaggagatggaaatcttatacaagaaagagaaagaggaagctgacctcctcttggagcagcagcggttagattacgagtccaagctgcaggccctccaaaaacaggtggagacacgcagcctcgctgcagaaacgaccgaggaggaggaggaagaggaggaggtcccctggacccagcacgaatttgaattagcccagtgggcattcagaaaatggaaaagccaccagttcacctcactgcgggacctgctgtgggggaatgctgtgtatctcaaagaagctaacgctattagcgtagaactgaaaaagaaagttcaatttcagttcgttctgctaaccgataccctgtattccccactgcctccggagctgctcccaaccgagatggaaaaaacccacgaggatcgccctttcccaagaaccgtcgtggctgtagaggttcaggaccttaaaaacggagccacccactactggtccctggaaaagctcaagcaacgactcgacctgatgcgggaaatgtacgaccgtgccggtgagatggcatccagtgcacaagacgagtccgaaacaactgtgacagggtctgacccattctatgatcgctttcattggttcaagttggtcggcagcagcccaatctttcatggatgtgtgaatgagcgcctggccgatcggacgccctcacccaccttctctactgcagacagcgatatcacagaactggccgatgagcaacaagacgaaatggaagactttgacgacgaggcatttgtcgacgatgccgggagtgatgctggaaccgaggaggggagcgatctcttctccgacggccatgacccgttttatgataggtccccctggttcattcttgtcggcagggcattcgtgtacctgtccaacttgctgtaccccgtaccgctcattcatagagtcgccattgtcagtgagaagggagaagtgagggggtttctccgcgtggcggtccaagctattgctgcagacgaggaggctcccgattatggaagcggaatcagacagtctggaacggccaagatcagtttcgacaatgagtatttcaaccagagtgatttcagttctgtggcgatgacaaggagcggcttatctttagaggagcttcggattgtggagggccagggacagtcatcagaagtgatcaccccccccgaggagatcagccggatcaacgacctcgatctgaagtcatctacactgctcgatgggaaaatggttatggaggggttctcagaggaaataggaaaccacttgaagcttgggagcgcttttacatttagggtgactgtcttacaggcttcgggtattcttccggagtacgcagacattttttgtcagttcaattttctacatagacacgacgaggcattttcaacagaaccccttaaaaacaatgggagaggctcacctctcgccttctatcatgtgcagaacatcgcagtggagatcaccgagagctttgtggactatataaagaccaaaccaatcgtgttcgaggtgtttggacattatcagcaacacccactgcatcttcagggtcaggagctgaatagtcccccccagccctgtcggcggttcttccctccccccatgccgctgtctaagccggtgccagccacaaagttgaatacgatgagcaaaactagcctcggccagtccatgtccaaatatgatctgctggtgtggttcgagatttctgaactggaaccaaccggcgagtacattccagccgttgtagaccacaccgcgggcctgccatgtcagggcactttccttctgcaccagggaatccaacgaagaataacagtaacaataattcacgagaagggttccgagttgcattggaaagacgtgagagagctcgtggtcggcaggatccgaaataaacccgaggtggacgaagccgccgtggatgcaattctctcactgaacataatttctgccaaatatttaaaatcctctcataattctagtagaactttctatcgcttcgaggccgtgtgggactcatctctgcataacagcttgctcctcaacagggtcaccccatatggcgagaaaatctatatgaccctctccgcttacctggaattggaccactgtattcagcctgctgtaattaccaaggacgtgtgcatggtcttctactccagagacgcaaagatatcgccccctagatcccttcggagcctctttggatctggttacagcaagtcccctgactccaatagggtcaccggaatttacgagttgtcactatgtaagatgtccgatactgggagccctggaatgcagcgcaggagacgcaaaatcctcgacacatctgtggcctatgttagaggagaggaaaatctggcaggctggagacctaggggagattccttaattcttgagcaccagtgggaactagaaaagttggagctactccatgaggtggaaaaaacgcgtcacttcctcctgctgcgcgagagattgggggattcaattcctaagagcctgagcgatagcctgagcccgtcactgagttccggtaccctcagcacatcaaccagtatatctagtcaaatctccaccaccaccttcgaaagcgctatcaccccatccgaatccagcggctacgattctggtgacattgagagtctggtcgatagagagaaggaattggcaaccaagtgtctgcagttactcacccacacctttaaccgggaattttctcaagttcacggctctgtgagtgattgcaaactctcggatatctctccaatcgggagagatccctccgagagctcatttagctctgctacattaaccccctcttcaacttgtccctctctcgtggactctaggagtaactctctcgaccagaaaaccccagaggctaatagccgcgctagcagcccctgccccgaattcgagcagttccagatagtaccagcagttgagacaccgtatctcgcccgggcaggaaagaacgaatttttgaatctcgttcctgacattgaggaaatccggccatcttcagtggtgtccaaaaagggatacctccatttcaaagaaccactgtactccaattgggcaaagcattttgttgtggtgcggcgtccttacgtgttcatatacaactcagacaaagatcctgttgaaaggggtataatcaacctgtccactgcccaagtggagtatagcgaggatcagcaagctatggttaagaccccgaacacttttgccgtctgcacgaaacacagaggagtgctgctccaggctctcaatgataaggatatgaacgattggttgtacgctttcaatccattgctggctgggacaattcgctccaagcttagtcgtagatgccctagtcaatctaaatattag

SEQ ID NO: 121626 - DNA, 5472 bp, Artificial Sequence
  Description of Artificial Sequence: Synthetic coding sequence
atgagtggtgcctctgtaaaagtcgccgtcagagtcagaccctttaactctcgagagacatccaaggaatccaaatgcatcatccaaatgcaagggaactccacatccatcattaacccgaagaacccaaaagaggcccctaagagtttctcctttgactacagctactggtcacatacaagccccgaggacccatgttttgcatctcagaaccgagtttataatgacattgggaaggagatgttactgcatgcttttgagggctataacgtctgcattttcgcctatggtcaaacgggagctggtaaatcttataccatgatggggaagcaagaggagtcccaggcgggtattataccccagctgtgtgaagagctgtttgaaaaaattaacgataactgcaatgaggagatgagctacagcgtagaggtgtcctacatggaaatctactgcgagagggtgagggatttattgaacccaaagaataaaggcaacttgagagtgcgggagcaccctctgctcgggccatatgtcgaagatttgagcaaactggccgtgacctcttacaccgacatcgccgatttgatggacgccggaaacaaagcgaggacggtggctgccaccaatatgaacgaaaccagctctcgcagccacgcagtgtttaccattgtgtttacccagaagaaacacgacaacgagactaacttgtccactgaaaaagtctccaaaatcagtcttgtggatctcgccgggagtgaacgcgcggactccacaggggcaaaaggcacccgacttaaggagggagccaatattaacaagtccttaactacactagggaaagtgatctcagccctcgccgaggttgacacttctaaaaagaagtccaaaaagaagaagaaaaccgatttcatcccataccgtgattccgtgcttacgtggctgcttcgggagaatcttggtggcaattcgcgtacggcgatggtagctgcgttgagccccgccgatattaattacgatgagactttaagcactttgcgttacgccgatcgcgctaagcagattaaatgtaatgcagtcattaatgaggaccccaacgctaaactcgtgcgagaattaaaggaagaggtcacccggctgaaggacctgctgcgcgcacagggcctgggggatattatagatatagatcctttgatcgatgactacagtggcagcgggtccaagtatctgaaggacttccagaacaacaagcatcgatatctgctcgcctcggagaatcagcggcccgggcacttttccactgcttccatgggatcactgacctcgtccccttcctcctgctcattgagcagtcaagtcgggctgacctccgttacctcaatccaggagcggataatgtccaccccaggcggtgaagaagctatagagaggctgaaggagtccgagaaaataatcgccgaattgaacgagacctgggaagagaaactcagaaagaccgaggccattaggatggagagggaggcgcttcttgccgagatgggagtagcgatccgggaagatgggggcaccctaggcgtattttctcctaaaaagacgccacatctcgtcaatttgaatgaggacccactgatgtccgaatgtcttctctactacatcaaggacggaattacaagagtaggccaggccgatgccgagcgccggcaagatatcgtgcttagtggcgcgcacatcaaggaagaacattgcatcttcaggagtgaaaggtcaaactctggcgaagtgattgtcactctggagccgtgcgaaagaagcgaaacatatgtcaacggtaaaagggtgtcccaacccgtccagcttagaagtgggaacagaatcatcatgggcaaaaaccatgttttcaggttcaaccaccctgagcaagccagagctgagagggaaaagacaccttcagccgagacacctagtgagccagtcgattggacctttgcgcagcgagagctgctcgagaagcaaggtatagacatgaagcaggaaatggagaagaggctgcaggaaatggaaatactctataagaaggaaaaagaggaggcagacctgctgctcgagcaacagcgcctcgattacgagtcaaagctgcaagcactacagaagcaggtggaaacccgtagcctcgccgctgagaccacagaggaagaggaggaagaagaggaggttccatggactcagcatgaatttgagctcgctcagtgggcgttcagaaagtggaaatctcaccagtttacatccttgcgcgatttgctctggggaaacgccgtttacttaaaggaggcgaatgcgatttcggtggaacttaagaagaaagtacagttccaattcgttcttttgacggacacattatactcacccttgcctccagagctgctgccaactgaaatggagaaaacccatgaggacaggccttttcctaggactgtggtggcagttgaggtgcaagacctgaagaatggagccacgcactattggagtctggaaaaactgaaacagcgcctggacctcatgagagagatgtacgaccgcgccggagaaatggcaagcagcgcccaagatgaatctgaaacgaccgtaaccggcagcgatcccttctatgaccggttccactggttcaagctggttggatcaagccctatctttcacggatgcgtcaacgagcgacttgccgacaggacacccagccccactttcagcacggccgacagcgatatcaccgaactggccgatgagcaacaggatgaaatggaggacttcgatgatgaagcctttgtggacgatgcaggatcagatgcaggtacagaggaggggtccgacttatttagtgacggacacgaccctttttatgaccgcagtccgtggttcatactggtagggcgcgcctttgtgtacttgtctaacttattgtaccccgtgccgctgatccatcgcgtagccattgtcagcgagaaaggtgaagtgcgcgggtttctgcgcgtggccgtgcaggctatcgcagccgacgaggaagctccggattatggaagcgggattcggcaatccggtacggccaaaatctcattcgacaacgagtactttaaccagtccgatttttcaagcgtcgccatgactaggtccgggttgtcactcgaggagctgaggattgtggaaggccaggggcaatcaagcgaggtgattactcctccagaggaaataagccggattaacgacttagatctaaaaagttccactctactggacggtaaaatggtaatggaaggcttctctgaagaaataggtaaccatctcaagttaggctccgccttcaccttcagggtgaccgtgctgcaggcatctggcatcctgcccgaatatgcagacattttctgccagttcaattttcttcacaggcacgacgaagcgttctcgacagaacccttaaaaaacaatgggaggggcagccctctggccttctaccatgtgcagaacatcgctgtggaaatcaccgagagttttgtggactacatcaaaactaagccaatcgtcttcgaagtgttcggacattatcaacagcaccccctacacctccagggccaggagctaaactcacccccccagccatgtcgcaggtttttccctcctcccatgcctctgagcaaacctgtccccgccaccaaactgaacacaatgagcaaaactagccttggacagtcaatgagcaagtacgaccttctcgtgtggttcgaaatcagtgagctggagccgacaggggaatacatccccgctgtggtggatcatactgctggattaccttgccaggggacattcctgctccatcaaggtattcaaagacgcatcacagtgaccataatccacgagaaggggtcagaattacattggaaagacgtacgtgagctcgtggtgggccggatccgcaataagccggaagtggatgaagccgcagtggacgctatactcagcctaaatataatcagcgcgaagtatctgaaatcatcccataactccagcagaaccttttaccgcttcgaagccgtgtgggattcgtctctgcacaactccctgctcttaaaccgtgtcactccttacggagagaagatttatatgacgctgagcgcatacctcgagttggaccactgcattcagcccgccgtgatcaccaaggatgtgtgcatggtcttttatagcagggatgcaaagattagcccaccgagatctctgagatccctcttcggttcaggctattccaagagcccagactctaaccgggtaactggcatctatgagctgagtctctgcaagatgtcagatactggctcccccggcatgcagcgacggagacgaaagatcctcgatacttctgttgcgtacgtcaggggtgaagaaaacttggctggctggcggcccaggggcgacagtttgatattggagcaccaatgggagctcgaaaagctggagctccttcatgaggtagagaagacccggcactttctcctcctgcgcgagcgcctgggtgatagtattcccaagagtctttccgactccctgagtccaagcctgagcagcggcactctctcaacgagtacatcaatttcatcacagatatcaacaaccacatttgagagtgcaattacgccctctgaatcctccggttatgactccggtgacattgagtctttggtggaccgggaaaaagaattagccaccaagtgtctgcaattactcactcatacttttaacagggaattcagccaggtgcacggttctgtcagtgactgtaagctcagcgacatctctcccattggcagggatccctcagaatctagcttttcgtccgctactcttactccttcttccacatgcccgagtctagtcgactcacggagtaattccctggaccagaagactcctgaggctaacagtcgagctagttccccctgtcctgagtttgagcagtttcagatcgtccctgccgtggagaccccttacctggcccgggctggcaaaaatgagttcctcaacctggtccctgatattgaagagatccgacctagttctgtggtcagcaagaagggatatttgcattttaaggagcccctgtacagcaactgggcaaagcacttcgtggtggtgagacgcccctatgtgttcatatataattctgacaaagaccccgttgaaagagggataataaatctctccaccgcccaggtcgagtactctgaggatcagcaggcaatggtgaagaccccaaatacattcgcagtttgtaccaaacatagaggcgttcttttgcaggctctcaatgacaaagacatgaacgattggctgtacgcgttcaaccctttattggcgggaaccattagacctggtcatcttgcgtcggagataatccgggaagataagtcagtctcattctcgtgccagtag

SEQ ID NO: 121627 - DNA, 5472 bp, Artificial Sequence
  Description of Artificial Sequence: Synthetic coding sequence
atgagcggcgcctccgtgaaagtggctgtgagggtcaggccatttaacagtcgcgagaccagcaaagaatctaagtgcattattcagatgcagggaaactccactagcatcatcaaccccaagaatccaaaggaggccccaaagtctttcagcttcgactatagctactggagtcacacctcccccgaggacccttgtttcgcttcccaaaaccgggtgtataatgatatcggaaaagagatgttactccatgccttcgaaggatacaacgtttgtattttcgcttacggacaaacaggcgctgggaagagctacacaatgatgggaaagcaggaggaatctcaggccgggataatccctcagctctgcgaggaactgttcgagaaaatcaatgataattgcaacgaagagatgagctactcagttgaggtgagttatatggaaatttactgcgagagagtcagagacctgctaaatccaaaaaataagggaaaccttcgagtacgtgagcatccactcttgggcccctatgtggaagacctgagtaagctcgcagtaacctcatacacagatatcgccgacctcatggacgccggaaataaggcccgaaccgtcgccgctactaatatgaacgagacatcctcgagatctcatgctgtgttcacaattgtgtttacacagaagaagcacgataatgagaccaatctttctactgagaaagtgtcaaagatctccctcgtggatctggctggtagcgaaagggcagattccacaggcgcgaaagggacaaggctcaaagaaggcgccaatattaataaatctctgactactctggggaaagtaattagtgcgctcgctgaagtcgataattgcacaagcaagtccaaaaagaaaaaaaagaccgattttattccctacagggactccgtccttacgtggctgctgcgggagaatttgggtggtaattctcgtactgccatggtcgccgcactgagccctgctgatatcaactatgacgagacgcttagtacactacggtacgcggatagagctaagcagatcaaatgtaacgctgttataaacgaggatcccaacgcaaagctggtgcgagagctgaaggaggaggttactcggctcaaggatctgctccgggcgcagggactcggggatataatagacattgaccctctcatcgacgattattcgggttctgggagtaaatacctgaaggatttccaaaataataagcatagatacctgctggcctctgaaaaccagagacccggtcacttttccaccgcttccatgggcagccttacctcttctcctagctcatgttccctgtcgtcccaggtggggttaacgtcagtgacctctatccaggagaggattatgagtactcccgggggagaggaagctatcgaaagactgaaggagagcgagaagatcatagcagagcttaacgagacatgggaggaaaaacttcgtaagactgaggccattcgaatggagcgggaggcactgttggctgaaatgggggtcgccatacgggaggacggcggtactctcggggttttttctcctaagaagacaccacatttggtaaacctcaatgaggaccctttaatgtccgaatgtctgctgtattacattaaagacggcattacaagggtgggccaggcagatgccgagcgccgccaggacattgttcttagcggtgcgcacattaaggaagagcactgtatttttaggtcagaaagaagcaactccggggaagtaatcgttactctggaaccctgcgaaagaagcgagacctatgttaatggaaagagggtctcccagcccgtccagctccgctccggcaaccgcattatcatgggaaagaaccacgtatttcgctttaatcacccagaacaggcccgagccgaacgagagaaaaccccatcagctgaaaccccatccgagcctgtggactggacattcgcccaaagggagctactggagaaacagggtattgatatgaaacaagagatggagaaaaggctgcaggagatggagatcctctacaagaaagagaaggaggaggctgaccttctgctggaacagcagcgactagattacgaaagcaagcttcaagctctgcaaaaacaggtcgagacccggagcctggcggctgagacaaccgaggaggaagaagaggaggaggaagtaccatggacccagcacgagtttgagctggcgcagtgggccttcaggaagtggaaatcccaccaattcacttctcttcgcgacctgctatgggggaacgctgtgtacctgaaagaggcaaatgcaattagtgtcgagctcaagaagaaagtgcagtttcagtttgtgctgctcactgatacgctttactcgccattacccccagaactcctgccgacggagatggagaaaacgcacgaggaccggccatttccgcgtaccgtggtcgctgtagaagtgcaagacctcaagaacggggccacccattactggagcctagaaaagttaaaacagcgcctggatctgatgagggagatgtatgatagagcaggggaaatggcctcttctgcccaagatgagtccgagacaactgtcacaggcagcgaccctttttacgatcgattccattggttcaaactggtgggatcgtcgcctatcttccatggttgtgttaacgaacgactcgccgataggacgccctcccctacgttcagcaccgccgattccgacatcacagagctcgccgacgagcaacaggacgaaatggaggatttcgacgacgaggccttcgtagacgatgctgggagcgacgccggtacagaagaggggagcgatttgttcagcgacggtcatgatccattctatgacagatctccctggtttattcttgtcggtcgcgcctttgtctatctgagcaacctgctgtaccctgtgcccctgatccaccgggttgccatcgtgagcgagaaaggagaagtaaggggcttcttaagggtggccgttcaagccatcgccgcagatgaggaggcccccgactacggtagcggcatacgccaatcaggcactgccaagatctcctttgataatgagtactttaatcagtctgattttagcagcgtggctatgacgaggagcggcctgagtcttgaggaactgcgcattgtagaaggccagggccaatcatctgaggtaattaccccacccgaagagatttcccgtatcaacgatctggatctgaaatcttccactctactggatggcaaaatggtgatggagggattcagcgaggagatcggtaatcacctgaagctggggtccgcgtttactttcagagtgacagtcctccaagcctctggcattctcccggagtacgccgacattttctgccaattcaacttccttcacaggcacgatgaagccttctccacggaaccactcaaaaacaacggcagaggatctccacttgcattctaccacgttcagaatattgctgtggagattacagagagttttgtggactatatcaaaacaaagccaattgtgtttgaagtcttcggccactaccagcagcacccattacacctgcagggccaagaattgaacagtcccccccagccctgtaggaggtttttcccgccacccatgcccctctccaagcctgttccggctacaaaattgaatactatgagcaagacctctctgggacagtctatgtctaaatacgacctcttggtttggttcgaaatctccgagctggagccaacgggcgagtacatccctgccgtggtggatcatacagccggactgccttgccagggaacttttctgctccaccaggggatccagagacgaattactgttactatcattcacgagaagggctccgaacttcactggaaagacgtgagggagcttgtcgtgggccgtattaggaacaagccagaagtagatgaggctgcggtggacgctattttgagcctgaacattatctcagcaaagtacctgaaatccagccacaatagctctaggaccttctaccggttcgaggccgtctgggactcgtcgttacataacagtctgctgctaaatcgggttaccccatatggcgagaagatttatatgacactctctgcctatcttgaactcgaccactgcatacagcctgcggtgatcacgaaagatgtgtgtatggtgttctacagccgggacgcaaagatctcccctcccaggagcctgagatccctgtttgggtctggatactccaagagcccagacagtaatcgcgtaaccggaatctatgagttatctttatgcaaaatgtccgatacaggcagtcctggcatgcagcgacggcgccgcaagattctggacacatcagtagcttatgtgaggggggaggagaacctggccggctggcgtccgcgcggagattccctgatattggagcatcagtgggaattagagaagttagagcttctacacgaagtggagaagacaagacattttctgcttttgcgcgaacgactgggcgattcaatcccaaaatctctgtctgattctctgagtccatctctgagtagtggcacgctgtcgacaagcacttcaattagttcacagatatccaccacaaccttcgagtctgctataactccgtcggaatcttccggctacgattcgggagacattgagtccctggtagaccgggaaaaggagctagcaacaaaatgcctacagctgttgacacacaccttcaacagggagttctctcaggtccacggatcagtaagtgactgtaaactgtccgacatttcgcccattggtagagacccctccgaatcatcattctcttccgcaaccctgactccgagtagcacttgcccttctctggtggattcacgctctaattctcttgatcagaaaaccccggaagccaattcccgggcatcaagtccttgccccgaatttgaacaattccaaatcgtaccagcagtcgagacgccgtatctggccagagccggaaagaacgaattcctgaacctcgtgccagacatcgaggagattagacccagtagcgtggtgagtaaaaaaggctacttgcacttcaaggagcccctctacagcaattgggcaaagcatttcgtcgtcgtgcgccgcccctatgtgtttatatacaactcagataaggatccggtcgagaggggcataattaacttgagtacagcacaggtggagtacagcgaagatcagcaggcaatggtgaaaaccccgaatacctttgccgtgtgtaccaagcaccgcggagtgctgttgcaggctctgaacgacaaagatatgaacgactggctgtacgcttttaacccgcttttggctgggactatcagaccgggacatctggcctcagagatcatacgcgaagataaatccgtgtcctttagctgccagtag

SEQ ID NO: 121628 - DNA, 3462 bp, Artificial Sequence
  Description of Artificial Sequence: Synthetic coding sequence
atgagtggcgctagcgtgaaggttgctgtccgtgttagaccttttaattccagagagacgagtaaagaatccaagtgtattatccagatgcaaggcaattctacctctatcataaacccaaagaaccccaaagaagccccaaagtccttctctttcgactattcctattggagtcacacttccccagaggatccctgctttgctagtcagaacagggtgtacaacgacatcggaaaagagatgctcctgcacgccttcgaggggtacaatgtttgcattttcgcctatggccagacaggggctggcaagagctacaccatgatgggaaagcaggaggaatctcaagctggaatcatccctcaactgtgcgaggagcttttcgagaagatcaacgataactgcaacgaagagatgtcttattctgtcgaggtttcgtacatggagatctattgtgagcgggttagagatttgctgaacccgaagaacaaaggcaatctgagagtgcgcgagcaccccctgctcggtccctatgtggaggacctcagcaaactggccgtgacctcctatacagacattgccgaccttatggacgcgggaaacaaggcgcggactgtcgctgccactaacatgaatgagacgtcttctcgcagccacgccgtgttcacaatcgtgttcacacaaaagaagcatgacaacgagactaacctgtccaccgagaaagtgtccaagataagcctagtcgatcttgccggctctgagcgggctgattcaaccggggctaaaggcacccggctgaaggagggcgcaaatatcaataagagcttaaccacactagggaaggttatctcagcccttgcagaggtgtccaaaaaaaagaaaaagactgatttcatcccctatcgagatagcgttttgacttggcttcttagagagaatcttggaggtaacagccgcaccgctatggtcgcagcgttatcgcctgcagacattaattacgatgagactctgtcaactttgcggtacgccgatcgagccaagcagattaaatgcaatgctgtgataaacgaagacccgaatgccaagcttgttagggaactcaaggaggaagtgacccggctgaaagacctgctacgcgcccagggccttggtgacatcatcgatacctccatgggatcgttgaccagtagtcccagctcttgttctttaagcagtcaggtcgggctgacatccgtgacttctatacaggagcggattatgagtactcctggaggcgaagaggccattgaaaggctgaaggagtcagaaaagataatagcggagctgaatgaaacatgggaagagaaattgcggaaaaccgaggcaatacgcatggagcgtgaagccctgctggccgagatgggagtcgcaatcagggaagacggtggaacactcggggtgtttagcccaaagaaaactcctcacttggtgaacctcaatgaggaccctctcatgtccgagtgtttactgtattatatcaaggatggcatcactagagtcggtcaggctgacgcagagcgcagacaggacattgttcttagcggcgcgcacatcaaggaggagcactgcatcttcagaagcgaaagatccaattccggcgaagtgattgtaactttggagccatgcgaaagatctgaaacctacgtgaatggcaagagagtctcacaacccgtgcagctgcggagcggaaaccgcattattatgggaaaaaaccatgtattcaggttcaaccatcctgagcaggcacgtgctgagagggagaaaacgcctagtgctgagaccccatccgagccggtcgactggacattcgcccagagggagctactggaaaagcagggaattgatatgaaacaagaaatggagaaacggctgcaggagatggaaatcttgtacaaaaaagagaaggaggaggcagacctgttactggaacagcagaggctcgatgccgattcagacagcggggacgactctgacaaacgaagctgtgaggagtcctggaagctgatcacctccctcagggaaaagctgccaccgagtaagcttcagactatcgtgaagaaatgtgggttaccctcttctgggaaaaagagggagccgatcaaaatgtaccagatacctcagcgtaggcggctgtcgaaggattcgaagtgggttaccatctccgatctcaaaatccaggccgtgaaggagatttgctacgaggtcgcacttaatgacttccgccattcacggcaggagatcgaagcacttgcaatcgttaagatgaaggagctgtgtgccatgtacggcaagaaagaccccaacgagcgcgatagctggcgcgccgtcgcacgcgacgtgtgggacaccgttggagtgggggatgaaaaaatcgaagatgtgatggctactggtaaagggtccacagacgtagatgaccttaaggtccacattgataagctcgaggacatcttacaggaggtgaagaagcagaacaatatgaaggacgaggagatcaaggtgcttcgtaacaaaatgctgaaaatggaaaaagtgctgccactgatcggatcccaggaacagaagtcacctgggtcccataaggccaaggaacctgtgggagccggcgtttccagtacctccgagaacaatgtgagtaagggagacaatggtgagctggcgaaggaagaacgcgtttctcagcttatgaatggcgaccccgcattccgacgtggcaggctgcggtggatgcggcaagaacaaattcgcttcaagaacttacagcaacaagagattactaaacaactgcggaggcagaacgtgccgcatcggtttatcccaccagagaatcggaagccaaggtttccattcaagagcaaccctaaacatcggaattcatggagtcccggcacacacataatcatcacagaggacgaagtgatcgagctgcgtatacctaaagacgacgaggctcggaaaggtaataaggaagagtcccaggaaaagggaggtaaaggtgctttcaaggatcctcaattcccgtgggggtcccaggggatgagaagccaggaccatatccaagtgtcaaagcaacacattaacaaccagcaacagcctccgcagttgcggtggcggtccaactctctcaacaacgggcagcccaaatcaacccggtgccaggcatctgcaagtgctgagtctctaaacagtcactcaggtcatcccacggctgatgtgcagacgttccaggctaagaggcatattcaccaacaccgccagtcttattgtaattacaacactggcggtcaattagagggtaatgccgcaacctcttaccaaaagcagaccgataagccctcacactgttctcagtttgtgacgcctccacggatgcggagacagttctccgctccgaatttgaaggccggaagagaaaccacagtctag

SEQ ID NO: 121629 - DNA, 5451 bp, Artificial Sequence
  Description of Artificial Sequence: Synthetic coding sequence
atgagcggggccagtgtgaaggtcgccgtacgtgtccggcctttcaacagcagagaaacgagcaaagagtccaaatgtatcatacagatgcaaggcaattccactagtattattaatcccaagaatcctaaggaagcccccaagtcattcagcttcgattactcctattggagtcatacctctcctgaggacccatgcttcgctagccagaatcgagtatataatgatatcgggaaagagatgctgctgcacgcatttgagggttataatgtgtgtatcttcgcatatggacagaccggcgcaggaaaaagctacaccatgatgggtaagcaagaggaatcacaggccggcatcattccgcagctctgcgaggaactgttcgaaaagatcaacgacaactgcaacgaagaaatgtcctactctgtggaagtctcatacatggaaatttactgtgaaagggtccgcgacctgctgaaccccaaaaacaaaggcaacttgagagtgcgcgagcatccactgctcgggccgtatgtcgaggatctgtccaagctcgcagtgactagttacacggacatagccgacctcatggacgccggaaacaaagcacgtactgttgcagctactaacatgaatgaaacctcctcgagatcccatgccgttttcacgatagtattcacacagaaaaaacacgataacgaaacgaacctgagcactgaaaaagtgtcaaagatcagcctggtggatctggctggttccgaaagggccgattcaactggagctaaagggactcggcttaaggagggcgcgaacattaataagagcctgaccactcttggaaaagtgatctcagctctggccgaggttgacaattgtacctccaagtctaaaaagaaaaagaagaccgattttataccttatcgcgacagcgtgctgacatggttgctacgcgaaaacctcggtggaaactctcggactgccatggtcgcggcactctctcctgccgacattaactatgatgagactctgagcaccctgcggtatgcagaccgagctaagcagatcaagtgcaatgcagtcatcaacgaagatcccaacgcaaaattggtaagggaactcaaggaggaggtcacccggctgaaggatttgctacgggctcaaggtctgggcgatataatcgatatcgacccattgatagacgattattccggtagcggcagcaagtatttaaaagattttcaaaataacaagcatcggtacctattagcttccgaaaaccaacgtccagggcactttagtacggcctccatgggtagtcttacgagcagtcctagcagttgctccctgtcttcacaggtgggtttaacaagtgtgacttccattcaggaaaggatcatgtctacacccgggggcgaggaggcgattgagcgcctgaaggagtcggagaagatcattgccgaactgaatgaaacttgggaggaaaagttacgcaaaaccgaggccatcagaatggagagagaggctctgttggcagagatgggagtggccatccgcgaggatggcgggactttaggcgtcttcagtcccaaaaaaacgcctcacctcgtgaatttgaacgaggaccccctcatgagcgagtgcctcctgtactacatcaaagacggcatcaccagagttggacaggccgatgctgaaagacgtcaagacattgtgctttccggggctcatatcaaggaagaacactgtattttccgatccgaacgctctaactccggcgaggtcattgttacccttgaaccgtgtgagaggtcagagacttacgtaaacgggaaaagagtatcacagcccgtccagctccgcagtggaaacaggatcatcatgggaaaaaaccacgtgtttcgtttcaaccacccagagcaggctagagcagaacgggagaagacgcccagcgctgaaacaccttccgagcctgtggactggactttcgcccagagagagctgctagaaaaacaggggattgacatgaaacaggagatggagaaacgcctccaggagatggagattctgtacaagaaggaaaaagaggaagctgatcttctgctggagcaacagcgtttggattacgagtccaaacttcaagctcttcaaaaacaagtagaaacaagaagtctcgctgctgaaaccacggaggaagaggaggaggaggaagaggtcccatggacccagcacgagtttgagctagcccagtgggcttttcgaaaatggaagtcgcatcagttcacatccctcagagatttgttatggggaaacgccgtgtacctcaaggaagcaaatgccatctccgtggagttaaaaaaaaaggtgcagttccagttcgtgctccttacagatacactgtattcccctctgccccctgaactcctgcctactgagatggaaaaaacgcacgaagatcggccatttccccggaccgttgtagcagtggaagtgcaggatctgaaaaatggggccacgcactactggtcgctggagaagctaaagcagagactggacctcatgagagaaatgtacgacagggccggtgagatggcaagctcagctcaggacgaaagcgagaccacggtgactggaagtgaccctttttacgaccgcttccattggttcaagctggtcggatcatcccctatcttccacggatgtgtcaatgaacgactggcagatcgcactccttcaccaaccttcagcacagctgattctgacatcactgaactggccgacgagcagcaggacgagatggaagatttcgatgatgaggccttcgtcgatgacgcaggcagcgacgccggcaccgaggagggttctgatctcttttcggacggtcacgacccgttttatgaccgctcaccctggttcatccttgtgggcagggccttcgtctatctgtctaatcttctgtaccctgttccattgatccaccgggtggccatcgtgtccgaaaagggggaggtgcgcggatttttgcgcgtggcggttcaggctatcgccgcagacgaagaggccccagactatgggagcggcatcaggcagtccggaacagccaaaatttcctttgataacgaatattttaatcaatctgacttttccagcgtcgccatgacacggtctggcttaagcttggaggaacttcgcatagtggaggggcagggccagtctagcgaggttattacaccccctgaggagattagccgtatcaacgatttggacctgaagagctccaccctgctggatggaaagatggtgatggaaggcttttcagaggagatcggcaatcatctgaaactcggatctgcgttcacatttcgtgtaaccgtgctgcaagcctctggcattctgcccgagtacgctgacatcttttgccaatttaatttcttgcacagacatgacgaggcatttagcaccgagccgctaaagaacaacggaagaggaagtccactcgctttttaccatgttcaaaatattgctgtcgagatcacagaatcgttcgtagattacattaagaccaagcctattgtttttgaagtgttcggacactaccagcagcatcccctgcacctgcagggccaagaactgaacagtccgccgcagccctgccggagattttttcccccgccgatgcccttaagcaagccagtgcccgccaccaagctgaacaccatgtcaaagacttcccttgggcaaagtatgtccaagtatgatctcctcgtctggttcgagatctccgaattagagcccaccggggaatatatccctgccgtcgtcgatcataccgcaggcctaccatgccaagggactttcctgctgcatcagggcatacagaggcgaatcactgttactattatccatgagaaggggtccgaactgcattggaaggatgtgcgcgagttggtagttgggagaattcgcaataagcccgaggtagacgaggcggccgtggatgccattttgagcttaaacataattagtgctaaatacttaaagtcaagccacaattcctcaaggacgttctacaggttcgaagctgtgtgggatagctcgttgcataactcgctgctgctgaaccgagtcacgccatacggggaaaaaatctatatgaccctatcagcttatctggagttagaccattgtattcaaccggcagtaataaccaaagacgtctgtatggttttttattctagagatgcaaagattagtcctccgaggagcctgcgttctttgtttggaagcgggtatagtaaaagtccagactcaaatcgggtgactgggatttatgagctcagtctgtgcaaaatgtcggacaccgggtcgcctggcatgcagcggaggcgccgaaagatcctcgatacctccgttgcctacgttcggggggaagagaacttagctggatggcgtccgcggggggattcactaattctggagcaccagtgggaattggagaaactggagctgctgcacgaagtggaaaaaaccagacacttcctgcttctcagggagcggttaggtgacagcatccccaagtccctaagtgattcactctccccttcactctcaagcgggaccctgagcacttcaacttcaatcagtagccagatcagcaccacaaccttcgaaagtgccattacacccagcgagagctccggatacgattctggcgatatcgagtcgttagttgatagagaaaaggaactggccactaagtgccttcaactactgacccatacattcaaccgtgagttcagccaggtacacggctcagtctcagattgcaagctgagcgacatcagcccaatcggccgtgatccctctgaatcttctttttccagcgctaccctcactccgagcagcacttgtccgtcgttagtggattcacggtccaacagccttgatcagaaaactccagaagccaatagccgggcaagctcaccgtgtccagagttcgaacagtttcaaattgtccctgccgtagagaccccttacctggcccgggctgggaaaaatgagttcctgaacttggtacctgacatagaggagattcggccctcctcagtcgtttcaaagaagggctacttacatttcaaggaaccgctttactctaactgggccaaacatttcgtagtagttaggcgtccctacgtgtttatatataattctgacaaggacccggtcgaaagaggtatcatcaacctgagcaccgctcaggttgaatattctgaggatcagcaggccatggtgaaaacccctaatacctttgccgtttgtacaaagcaccgcggcgttctgctgcaggcccttaacgacaaggacatgaacgactggctctatgcatttaaccctcttctcgcaggcaccattcggtcaaagctgtccagacgttgcccatcccaatcaaaatactag

SEQ ID NO: 121630 - DNA, 3462 bp, Artificial Sequence
  Description of Artificial Sequence: Synthetic coding sequence
atgagcggtgctagtgtgaaagtggctgtgagggttcgccctttcaacagccgagaaactagcaaagagtctaaatgtatcatccaaatgcagggaaactcaacctctattattaatcctaagaaccctaaagaagcgcccaaatcctttagtttcgattattcatactggagccatacctccccagaagacccatgcttcgctagccagaaccgcgtttacaacgacattggcaaggaaatgctgctccatgctttcgagggctataacgtgtgcattttcgcctacgggcaaacaggcgctggcaagtcatataccatgatgggaaaacaagaagagagccaggctggtatcatccctcagctgtgtgaggagcttttcgagaaaattaatgataactgcaatgaagaaatgtcttactctgtcgaggtctcttacatggagatttactgtgaacgcgtcagagacttattaaaccccaagaataaagggaatctgagagtgcgcgagcatccgttgctagggccctacgtggaggacctgagtaaactggccgtgacatcctacaccgacatagcggacctcatggacgccggaaataaggcgcgaaccgtggctgccacaaacatgaatgagacatcaagtaggagccacgccgtcttcacaatagtgtttacccagaagaaacatgataacgagacaaacctgtccaccgagaaggtgagcaagattagcctcgtggacttggcagggagtgaacgcgcagactctactggcgcaaagggcactcgcttgaaagagggcgctaatatcaacaaaagccttaccaccctgggcaaggttatctccgcacttgccgaggtgagcaaaaagaaaaagaagacagattttataccttaccgcgattcagtgctgacatggctcttgcgggaaaacttaggagggaactctcgcaccgctatggttgcagctttaagtcctgccgacatcaactacgacgagaccctgtctaccctccgctacgccgatcgcgccaaacaaattaagtgcaacgccgttattaacgaagaccccaacgccaaacttgtcagagagttgaaagaagaggtgacacgcttaaaggacttactccgggcgcagggactgggggatatcatcgacacgtccatgggctcattgactagcagtccaagttcttgctcactgtcttcacaggtaggtctgacctcggtgacaagcatccaagaacggatcatgagcacaccgggaggagaagaggctattgagcggttgaaggagtctgagaaaatcatcgcagagctgaacgagacttgggaagagaaactcaggaaaaccgaggccattcgtatggagcgtgaagctctgttggcagagatgggcgtggcgattcgagaagatggcggaactctaggcgtttttagtccgaaaaaaacaccccatctggtgaatctgaatgaggaccccctcatgtccgaatgcctgctttattatatcaaggatggaattacacgggtgggccaagcagatgccgaacgacgccaggacattgtgctgtccggagctcatatcaaggaagagcactgcatcttcaggagcgaacgaagcaactccggggaagtcatagtcacactcgagccttgtgagcgtagtgagacctatgtaaatggtaaaagagtctcccaaccagttcaacttaggtctggaaaccggatcattatgggcaaaaaccacgttttccgattcaatcatcccgaacaagcgagggcggaacgggagaagaccccttctgctgaaaccccctcggagcccgtggactggactttcgcccagcgggagctgctcgaaaagcagggaatcgacatgaagcaggaaatggagaagcggctccaggagatggagattctgtacaagaaggaaaaagaagaggccgatctgctccttgagcagcagaggctggacgctgacagcgacagcggggatgactctgacaaacgatcatgcgaggagagctggaagcttatcacctcccttcgcgagaagctccccccttcaaaactccaaaccatcgtaaagaagtgcggcttaccaagctccggaaaaaagcgagagcctattaaaatgtatcaaattccacagagaagacggcttagcaaggattccaagtgggttaccataagcgatctgaagatccaggcggtcaaagaaatctgttatgaggtggccttgaatgactttaggcatagccgtcaggagatcgaagctttagcaatagttaagatgaaggaattgtgcgccatgtacggcaaaaaggacccaaacgagcgagatagctggcgggctgtagcccgtgacgtttgggatacagttggagtcggcgatgagaagatcgaagatgtcatggctacaggtaaaggtagtactgacgtggatgacctaaaagtccacatcgacaagctggaggatatccttcaagaggtgaagaagcagaataacatgaaagacgaggagattaaggtgttacgcaataaaatgttgaagatggagaaagtcttacccttaatcggctcccaggagcagaagagccctggcagccataaggcaaaagagcctgtaggtgcaggcgtttcttctactagtgaaaacaacgtgtctaagggagataacggcgaactcgcaaaagaggaaagagtgtctcagttgatgaatggtgatcctgctttccggagaggacgactccggtggatgcgacaagagcagatacggttcaagaatctgcaacagcaagagattaccaagcagctgcgacggcagaacgtgccacaccggttcatccctcctgagaatcggaagccccggtttccgttcaagtccaatccaaaacatcgaaacagctggagtcccggtacccatataatcataaccgaggacgaagtaattgagctcaggatccccaaggacgatgaggcccgtaaaggtaataaggaagagagccaggagaaaggaggaaagggagcctttaaagatccacagtttccgtgggggtcacagggcatgcgcagtcaggatcacattcaggtgtctaaacagcacatcaataatcagcagcaacccccacagttgcgctggcgctctaactcactgaataatggccagccaaagtctacaagatgccaggcatcggcctccgctgaatcactgaactctcactcaggacacccgacggcggacgtgcagactttccaagctaaaaggcacatccaccaacataggcagagttactgtaactataatacaggtgggcagcttgagggcaacgcggccacctcatatcagaagcagacagacaaaccctctcactgctcacagtttgtgacgccgccccggatgcgacggcagttttctgcccccaatttaaaagctgggagggaaacaaccgtgtag

SEQ ID NO: 121631 - DNA, 2673 bp, Artificial Sequence
  Description of Artificial Sequence: Synthetic coding sequence
atgtcacagggtatcctgtcaccccctgccggccttctgtctgatgatgatgtcgtagtgtcccctatgtttgagagcactgccgcagacctgggcagcgttgttcgaaaaaacctgctgtccgattgctctgtggtatcaacctccctggaggataaacagcaggtgccaagcgaggacagtatggaaaaggtgaaggtgtatctccgggtgaggcccctactcccatcagagctcgaacgccaagaggaccagggatgtgtgaggatcgagaacgtagagacgctggttctgcaggcgccaaaggatagtttcgcactgaagtctaacgagaggggaatcgggcaggcaacgcaccgattcacttttagtcagatatttggacccgaagttggacaagcttcatttttcaacctgaccgtgaaagaaatggtgaaagatgtccttaaaggtcagaactggcttatttatacttatggtgtgactaactccgggaaaacccatacgattcaaggcacgatcaaagatggaggaatcctgccccgctcactggccctcatattcaatagtctacaaggccagctgcatccgacacccgatctgaagccgctgttatccaatgaagtgatctggctggattcaaaacaaatccgccaagaggagatgaaaaagctgagcctcctgaacggtggacttcaggaagaggagctttctacaagccttaagagatccgtgtatattgagagtcgcatcggcacatccacatcctttgacagtggtatcgcaggtctgagcagtatatcacagtgcacctcttcatcacagctcgacgaaacttcccataggtgggcccagccagacaccgctcccttacccgttcccgctaacattaggttttcaatatggatctcatttttcgagatctacaacgagcttctttacgatctgctggaaccaccttcgcaacagcgaaagcggcagactctcagattatgtgaagaccaaaatggaaacccctatgttaaggatcttaattggatacacgtgcaggacgccgaggaggcatggaagctcctgaaggtgggcaggaagaatcagagtttcgccagcactcatctgaatcagaattcgtctaggagccattcaatcttcagcatccggattctgcaccttcaaggagaaggggacattgtcccgaaaatctccgaactgtccttgtgtgacctggcaggctcagagcgttgcaaggatcagaagtccggggaaaggctcaaagaagctgggaacatcaacacttctctgcatacactgggccgctgcatagctgcccttcgtcagaaccagcaaaaccgttctaaacagaatctggtgcctttccgtgacagcaaactgactcgagtttttcagggcttctttacgggtcgaggaagaagctgtatgatcgtcaatgtcaatccttgtgcctcaacatatgacgaaacgttgcacgtggccaagttttcggcaatcgcctcccagcttgtccacgcacccccgatgcagctcgggttcccatccttacacagtttcatcaaagagcacagtctgcaggtttcccccagtctggagaagggagcaaaagccgatactggactggacgacgacattgagaacgaggcagatatctctatgtatggcaaggaggagcttctccaggttgtcgaggctatgaaaacgctgctgttaaaggagcgccaggaaaaacttcagctggagatgcacctgcgggacgaaatctgcaatgagatggtcgagcagatgcagcagagagaacagtggtgctcggagcacctggatacacagaaagaactactggaagaaatgtacgaggagaagttaaacattctgaaagaatcactaacaagcttctatcaggaggagatccaggagagagacgaaaagattgaggaactggaggcgctactacaggaggctcgccagcagtcagtcgcacatcaacaatctgggagcgaactggcactgagaaggagccagcggctcgctgccagtgctagcactcagcagctgcaggaggtcaaggccaagcttcagcagtgtaaggcagaactcaatagcaccaccgaggagttgcataagtatcaaaagatgctggagccacccccatccgcaaagccttttaccattgatgtcgataagaagcttgaagaaggtcagaaaaacattagactgttacgaaccgagttacagaaactaggcgagtcactgcagagcgctgaacgggcttgctgccatagtaccggggcaggcaagctgaggcaagcccttacgacctgtgacgatatactgatcaaacaggatcaaactcttgcggagctgcagaataacatggtattggtgaaattggacctgcgaaaaaaggcagcttgtatcgccgaacagtaccacactgttttgaaactccagggccaggtttcagcgaagaaaagattaggaacgaatcaggagaaccaacagccaaaccagcaaccacctggaaaaaaaccattcctacgaaatctgttaccacgtacccctacatgtcagagctcgactgactgtagtccttacgcaaggatactgcgatcccggagaagccccctgcttaagtccggacccttcggcaaaaaatactag

SEQ ID NO: 121632 - DNA, 678 bp, Artificial Sequence
  Description of Artificial Sequence: Synthetic coding sequence
atgagccagggaatcctgtccccccctgccggcctcctgagtgatgatgacgtggtggtgtccccgatgtttgagtccaccgccgccgacttggggtcagtggtgagaaaaaatctgttatccgactgcagcgttgtgtctacctctctcgaggacaaacagcaagtcccatctgaggatagcatggaaaaagtgaaagtgtacctgagggtcagaccgcttcttcccagcgaacttgagcgtcaggaggatcaagggtgcgtgcgtattgagaatgtggagactctggttctgcaggcacctaaggatagctttgcattaaagtcaaatgaaaggggtattggccaagccacgcaccgcttcaccttctcacagattttcggcccagaggtcggccaagccagctttttcaacctgaccgtgaaagaaatggtgaaggacgtccttaaggggcagaactggctgatatatacttacggcgtgaccaatagtgggaaaacacataccattcaggggacgatcaaagacggcggaatccttccacgcagcctcgccctaattttcaattccttgcagggacaactgcaccctaccccggacctgaaacccttgctatccaacgaggtaatctggctggactcaaaacagattcggcaggaagagatgaagaagctgtag

SEQ ID NO: 121633 - DNA, 2619 bp, Artificial Sequence
  Description of Artificial Sequence: Synthetic coding sequence
atgtcacaaggaatactatccccgccagctggcctgttgagtgacgacgacgtggtggtgtctcctatgttcgagagtaccgccgctgacctggggagcgtggtcaggaagaatttgctgtcagattgctccgtggtaagcacttcattggaggacaaacaacaggtcccatccgaggacagcatggaaaaggaggatcagggttgcgtgaggattgaaaacgtcgagacccttgtgctgcaagctcccaaggacagttttgcgctgaagtctaacgaaagggggataggtcaagctacccataggtttacgttctctcagatattcggacccgaagtaggacaggcgagtttcttcaacctgacggtgaaggaaatggttaaagacgtcctcaaaggccagaactggctgatctatacgtatggggtgaccaacagcggtaaaacccacactatccagggcacaatcaaagatggcgggatcctgccaaggtccctggccctgatttttaatagcttgcaggggcagctgcatcctacccctgaccttaagcccctcctttccaacgaggtgatttggctggacagcaagcagatccggcaggaggaaatgaagaagctctctctcctgaacggggggctgcaagaggaagagctaagcacgagcctgaagcgtagcgtgtatatagagtcacgaattggcacatccacttcttttgactccggcatagcaggcttatcatcaatcagccagtgtacttcctcttcccagcttgatgagacctcccataggtgggcccagcccgatacggccccgcttccagttcctgccaacatacggttttccatctggattagcttcttcgagatttataatgagctgctgtacgacctcttggagcctccgtctcagcagcggaagcgccaaactctgaggttatgcgaagaccagaatggaaacccctatgtgaaagatctcaattggatacacgtccaggacgcagaagaggcttggaaactccttaaggtggggagaaagaaccagagtttcgcatctacacacctaaaccagaatagctctcggtcacactctatcttcagcatacgtatcctgcatctccagggggaaggcgacatcgtgccgaaaatctctgagctatcattgtgcgacctggctggcagcgaaaggtgcaaggaccagaagagtggcgagagattgaaggaagccggaaacatcaacacaagtcttcatacccttgggcgatgtatcgctgcactgaggcaaaaccagcagaaccggagcaaacagaacctagtcccgttcagggattcaaaactgaccagagtgtttcaaggtttttttaccgggcgtggccggagttgcatgattgttaacgtcaatccatgcgcttctacctacgatgagaccctgcatgtggccaaattctctgcaatcgccagccagctggtgcacgcacccccaatgcaactaggatttccttcgctccactcttttatcaaagagcattctctgcaggtcagcccatccctcgagaagggagccaaagcagacaccggattagacgatgatatcgagaacgaggctgatatctccatgtacggaaaagaggagctactgcaggtggtcgaagcaatgaagactctgcttttgaaagaaagacaggagaagctccagctcgaaatgcacctccgtgatgagatatgcaatgaaatggtcgaacagatgcagcagagagaacagtggtgcagcgagcatctggatacacagaaggaactactggaggagatgtatgaagagaagctgaacatcctcaaagaaagcttgacatccttctatcaagaagaaatacaggagagggatgaaaagattgaggaattggaagccctgctgcaggaagcgaggcaacaaagcgtggctcaccaacagagcggttctgaacttgcacttcgacggtctcagaggcttgcggcctctgctagcactcagcaactgcaggaggtgaaggctaaattacagcagtgcaaggcagagctgaattcaacaacagaggagttgcataagtaccagaagatgctcgaaccacccccatcggctaagcctttcaccatcgatgtcgataaaaagctcgaagaaggacagaagaacatcaggctgctgcgcacagaacttcaaaagctcggcgaatctcttcagagtgccgaaagagcctgttgccactctactggagctgggaagcttaggcaggccctgaccacctgcgatgatatcttaatcaagcaggaccaaaccctggctgaactgcaaaataacatggtgctcgttaagctcgatctgagaaagaaggccgcttgcatcgcggaacagtatcacactgtgctgaaacttcaaggccaggtgagcgccaaaaagcgccttgggacaaatcaggaaaaccagcagcccaaccagcagcctccagggaagaagccctttctgcgaaaccttctgccgcgcaccccaacgtgtcaaagcagtaccgattgtagcccctacgctcgtatcctccggagtagaaggtccccgcttctgaagtcgggacctttcggcaaaaaatactag

SEQ ID NO: 121634 - DNA, 480 bp, Artificial Sequence
  Description of Artificial Sequence: Synthetic coding sequence
atgagccaggggattctgagtccgcccgccggcttactgagcgatgacgatgtcgttgtgtctcctatgtttgaaagcaccgcagctgatctcgggtcagtggtcaggaaaaatctgctttccgactgcagtgtagtgagcacatccctggaagataagcaacaggtgccatctgaagattctatggagaaggtcaaggtttatctgcgagtccgacctctcctgccttcggaactggagagacaggaggatcagggctgcgtcagaattgagaatgttgaaaccctggtactgcaggcacccaaggactcattcgctttaaagagcaatgaaaggggcatcgggcaagccacccacagattcacttttagtcagatcttcggccccgaggtgggccaagcatctttctttaacctgactgtgaaagaaatggtgaaggacgtcctgaagggccagaactggctcatatacacatactag

SEQ ID NO: 121635 - DNA, 4884 bp, Artificial Sequence
  Description of Artificial Sequence: Synthetic coding sequence
atgttgggcgcgccggatgaaagttctgtgagggtcgccgtccgcatccgtccccaattggccaaggagaaaattgagggctgccacatctgcacttcagtgacccctggagaaccccaggtgttcctaggtaaggataaagcatttacgttcgactatgtcttcgacattgactctcagcaggagcagatctacattcaatgcatagaaaagctgatcgagggttgctttgaggggtacaatgccactgtttttgcttatggtcaaacaggcgctggaaagacttacacaatgggaaccgggttcgacgtgaatattgtggaagaagaactgggaatcatctcaagggcagtcaagcacttgtttaagtcaatcgaagaaaagaaacacatcgctatcaaaaacggcctgcctgctccagacttcaaggtgaacgctcagtttctggagctgtataatgaagaggtgttggatctgttcgatacaactcgcgatatagatgcaaagtctaagaagtcaaatattcgaatacatgaggactcaactggaggtatctatactgtcggagttacaaccaggacagtcaacacagagtctgagatgatgcagtgtctgaagctgggggccttgagtcgcacaaccgcctccacccaaatgaatgttcagagttcccggtcccatgccatcttcaccatccatgtgtgccaaacaagagtctgtccccagatcgatgccgacaacgctacggataacaagatcattagcgaatcagctcagatgaacgaatttgagacattgactgccaaatttcattttgtggatctcgcagggagtgaaaggctgaagcgaacaggtgccactggggaacgagctaaagaagggatcagtattaactgcggactgcttgcgctgggtaacgtgatttcagccttgggtgataagtctaaacgcgcgacccacgttccttatagggattctaaattaactaggctgcttcaggatagcctgggtggtaattcccagactatcatgatcgcctgcgtgtccccgagtgatcgtgattttatggagaccctcaataccctgaagtacgcgaaccgagccaggaacatcaaaaacaaagtgatggtcaatcaggatcgagcctcccagcaaatcaacgccctgagatctgaaattacccggctccagatggagctgatggagtataagacgggcaagagaattatcgacgaagaaggcgttgaatctattaacgacatgttccacgaaaacgctatgttgcaaactgagaataataatttgagggtccggataaaggctatgcaagaaactgttgatgctctccgcagcagaataacccagctggtgtctgatcaggctaatcacgtgctggccagagcaggcgagggcaatgaggaaatatctaacatgatacactcttacatcaaggaaatcgaggatcttcgcgccaaactgctggaatcggaggctgtgaatgagaacttgcgtaagaatctgacgagggcaacagcccgcgctccatacttcagcggcagttctacttttagccccacaatcctgtcgtcggacaaagagactatcgagatcattgacctagccaagaaggacttggaaaagctgaaacgtaaggaaaaaaggaagaagaagcgcctgcagaaactggaggaaagcaatagagaagaacgttcagtggccggcaaggaagacaatacggatacagaccaagaaaagaaggaagaaaaaggggtatccgaaagggaaaacaacgaactggaagtcgaagagtcccaggaggtatccgaccatgaagatgaagaagaagaggaggaagaagaggaggacgacatcgacggtggcgagtcctctgacgagagtgatagcgaaagcgacgagaaagccaattatcaagccgacttggcgaacattacttgcgaaattgccattaaacagaagctgatcgatgagctggaaaacagccagaagcgcctgcagaccttgaaaaagcaatatgaggagaagctgatgatgctgcagcataagatcagagacactcaactagaacgggaccaggttttacagaacctgggtagcgttgaatcatacagtgaagagaaagctaaaaaagtccgatctgaatacgagaagaaacttcaggccatgaacaaagagctccaacgattgcaggccgcgcagaaagaacatgcccggctcctgaaaaatcagtcacaatatgaaaaacagctcaagaaattgcagcaggacgttatggaaatgaaaaagaccaaggtccgtctgatgaagcagatgaaggaggagcaggaaaaggctcgtctgaccgagtcacggcggaacagggagatcgcccaattaaaaaaagatcagcggaagcgcgaccaccagttacgattactggaggcccagaaaagaaatcaggaagtcgtgctgcgtcgcaagacggaagaggtgactgcactgcggaggcaggtacgcccaatgagtgataaggtggcaggaaaagtgaccaggaagctgtcctcatccgacgcgcctgctcaagatacagggtccagtgccgctgcggttgaaaccgatgccagtcggaccggcgcccagcagaagatgcggatcccggtggctcgtgtgcaggccctgccaacacctgcgacaaacggcaatcggaagaagtaccagcgcaaagggctcaccggaagagtcttcattagtaagaccgctaggatgaaatggcagcttctcgagaggcgggtgaccgatataattatgcaaaaaatgaccatttccaacatggaagctgatatgaatcgccttttgaagcagcgggaagaactgacgaaaagaagggaaaaactaagtaagagacgcgaaaagattgtaaaggaaaacggggaaggcgacaaaaacgtggcaaacattaacgaggaaatggagtccttaaccgcgaatatcgattatatcaatgactcgattagcgactgtcaagcaaacattatgcagatggaagaggcaaaggaagaaggggaaacccttgatgttaccgcagtgatcaacgcgtgtactcttacggaggcgcggtatttactggatcatttccttagcatgggcattaacaagggactgcaggccgctcagaaggaagctcaaataaaggtgctggaaggccgcctgaagcaaaccgagatcactagtgccacacagaaccagttgctcttccacatgctgaaggaaaaagcggagctcaatcctgagcttgatgccttactcgggcacgccctccaagatttcaaacatttcttcgtggagaatgtcgaggactcaacagacgaagatgctccactcaacagtccgggctccgaagggtccaccctctcctccgacttaatgaagctctgcggcgaggtcaagccaaagaataaagcacggcggcgaacaaccacccaaatggagctgctgtacgcggacagctctgagctcgcaagtgatacctccactggtgatgcatctctgcctggacccctgacaccggtggcggaggggcaagagataggtatgaacacagagacctctggaacttccgcacgtgaaaaggaattgtctcctccccccgggctgccatccaagattgggagtattagccgtcagagctccttatcagagaagaaaataccagagccaagccccgtaaccagacgcaaagcctatgaaaaggcggagaagtccaaggccaaggaacagaaacagagcgatgagtcagacagcagtctttccgaggtgcatagaggaatcatcaacccatttcctgcttctaagggcattcgcgcattcccattacagtgcattcacattgccgaagggcacactaaggccgtgttatgcgtcgattccaccgacgatcttttgttcaccgggtccaaggatcgcacatgcaaggtgtggaatctagttacgggtcaggagattatgtccttaggggggcacccaaataacgttgtcagcgtgaaatattgcaattatacatccctcgtgttcactgtctccacgtcctacattaaagtctgggacattcgggattcagcaaagtgtatacggaccctgacttcttcaggccaggtgaccctcggcgatgcttgttctgcaagcactagccggaccgttgctattccgagcggcgaaaatcaaatcaatcaaatcgcactgaatcccacagggacctttctgtacgccgcctccgggaacgctgtgagaatgtgggatcttaagaggtttcagtctacagggaagctgacaggtcacctgggccccgtgatgtgtttgaccgttgatcagattagcagcggacaggacctcataattacggggtcaaaggatcactatattaaaatgttcgatgttactgaaggagctctgggaaccgtctcccctactcataactttgaaccaccccattatgatggcatcgaggctttgaccatccagggagataatctcttttctggtagccgcgacaacggtatcaaaaagtgggatctgactcaaaaagacctgctgcaacaggttcctaatgcccacaaggactgggtttgtgcgctcggagtagttcctgatcatcccgtccttctttccggctgccgcggcggaattttgaaggtgtggaatatggacacattcatgccagtaggtgagatgaaaggccacgattcaccaattaacgcaatctgcgtgaattctacacacatattcactgctgccgatgatcggactgtgaggatttggaaggctcgcaacctgcaggacggccaaatctcagatacgggggatctgggtgaagacattgcctctaattag

SEQ ID NO: 121636 - DNA, 5025 bp, Artificial Sequence
  Description of Artificial Sequence: Synthetic coding sequence
atgctcggagccccagatgagtcttccgtcagggtggctgtccggatccggcctcagctggctaaagaaaaaattgaaggctgccatatatgtacatccgtgacccccggggagccccaggttttccttgggaaagataaagcctttactttcgactacgtttttgacatcgacagtcagcaggaacagatctacatccagtgcatcgaaaagctgattgaggggtgctttgaaggctacaatgcgactgtcttcgcttatggccagacgggcgccggcaaaacctacactatgggtaccgggttcgatgtgaacatagtggaagaggagcttggcatcatatcccgagcagtgaagcatctgtttaagtccatcgaagagaaaaagcatattgccattaagaatgggctgccagcacctgacttcaaggtgaatgcccagtttctggagctctacaatgaagaagtgttggatctgttcgacaccacccgagacatcgacgccaagagtaaaaaatctaatattaggatccatgaggactctactgggggtatttacacagtgggagtaacgacgcgcacagtgaacacggaatccgagatgatgcaatgcctgaagctcggtgccctcagccggacaactgcctcaacccagatgaacgtgcaatcttctcgctctcatgccatcttcacaattcacgtttgccaaacccgggtctgtccacaaatcgacgccgacaatgccaccgataataaaattatttctgaaagcgcacagatgaatgagttcgagacattgactgctaaatttcacttcgttgacctagctggctccgaaaggctcaaaaggaccggagcaactggagaacgagcaaaagaaggcattagcattaactgcggcctactggcactagggaacgttatttccgcactgggagataagtcaaaacgggcaacccacgtgccataccgtgactctaagttgactcgtctgctgcaagattccctgggtggaaattcacaaaccatcatgattgcctgtgtctctccttcagatagagactttatggagacactgaataccctgaagtatgcgaatagggccagaaacatcaaaaataaagtgatggtgaaccaagaccgcgcttctcagcaaattaacgcgctgcgaagcgaaattacacggctgcaaatggagctaatggaatataaaaccggcaaacgcattatcgacgaagagggagtggagtccatcaatgacatgtttcacgagaacgcaatgctgcagaccgagaataataacttacgagtgcgaatcaaggccatgcaggagacagttgatgccctgcggtccagaattacccagttggtaagtgaccaggcgaaccacgtgctcgctagagcgggagagggcaacgaagagatttcgaacatgattcactcctatatcaaggagatagaggatctccgtgccaagctgcttgaaagtgaagctgtcaatgaaaatctccgcaaaaacctaactcgggctacggcgcgggccccttacttctcgggcagttcgaccttctccccaactatcctctctagcgataaagagacgatcgagatcatcgatctggcaaaaaaggatcttgagaagttaaaaagaaaagagaagaggaaaaaaaagaggctacaaaaactcgaagaatcgaaccgggaagaacgatcggtcgctggaaaggaggataacactgacaccgaccaggagaaaaaggaggagaaaggggtctctgagagggagaacaatgagctggaggtggaggagtcgcaagaggtctctgaccacgaagatgaggaggaggaagaggaagaggaggaagacgatatcgatggtggcgagtcaagcgatgaatcagattccgagagtgacgaaaaggctaactatcaggccgacctagccaatatcacttgtgagattgctattaaacagaagctgatcgacgagttagaaaactctcagaaacgtctccagacccttaagaagcagtatgaagagaaactgatgatgctgcagcataagatccgcgacacccaacttgaaagagaccaggtactacagaatctgggtagtgtcgagagctattctgaggaaaaggctaagaaggtgcgctctgaatatgaaaagaagttgcaagccatgaacaaggagctccagagactacaagcagcccagaaggaacacgctaggctattgaagaaccaatcccagtacgagaaacagctcaagaaacttcagcaggacgtcatggaaatgaaaaaaaccaaggtgaggttaatgaagcaaatgaaggaggaacaggaaaaggcccggcttaccgaaagccgccgaaatcgggagattgctcagctcaagaaggaccagcgtaaaagagatcatcagctccgcttactggaagcccagaaacgcaatcaggaggttgtactgagaagaaagacagaggaagtgaccgcactgagacggcaggtacggcctatgtccgataaagtggccggaaaggttacccggaaactgtcttcctcagacgcccccgcccaagatactggatcgagtgctgccgctgtggaaaccgacgcttcgcggactggcgctcagcagaagatgaggatccccgtagccagggtgcaggctcttccgacgccagcaacgaacgggaaccggaagaagtatcaacggaaagggttaaccgggcgggttttcatctctaagacagcccgaatgaagtggcagctgctggagaggagagtaacggatattatcatgcaaaaaatgaccatctccaacatggaagctgatatgaatagacttctaaaacagagagaagagctaaccaagcgaagagagaagctttccaagcgacgcgaaaaaatcgtcaaagagaacggtgagggtgataaaaacgtggcaaacattaacgaggaaatggaatctctgacagccaatattgattacatcaacgactcaatcagtgattgccaggcaaacatcatgcagatggaagaggccaaggaggagggcgagacccttgatgtgacagccgtgataaacgcatgtaccttgaccgaagcccgatatctcctggaccatttcctgagcatgggaattaataagggcctgcaagcagctcaaaaggaagcccagataaaggttctggagggacggctgaagcaaaccgagatcactagtgccactcaaaaccaactactctttcacatgttgaaggaaaaggccgagctgaaccctgaactggacgccctgttgggacacgcgctgcaggacctggactcagtgcctcttgaaaatgtggaggattcaacagacgaggacgccccactcaactcacccggctcggagggcagtaccctgagtagcgatctgatgaagctctgcggagaggtcaaaccgaagaacaaggcaagacggaggacgacaactcaaatggaactcttgtatgccgattcctcggaactggccagcgatactagtaccggagatgcttctctcccaggtcccctcactccggttgctgaaggtcaggagatagggatgaataccgaaactagcggaacaagtgcaagagaaaaggaactgtccccccccccaggcctgcccagcaaaatcggctcgattagccgtcagagctcgctgagcgaaaagaagattcccgagccatcccccgtgaccaggagaaaggcatacgagaaagcagaaaagtcaaaagccaaagaacagaagcattccgattcagggacttctgaagcctcactgagcccgccctcctctcctccgagcaggccccgaaacgagctgaacgtgtttaatagactgaccgttagccagggcaataccagcgtgcaacaggataagtctgacgagagcgactctagtctctccgaagtccatagatcctcccgccgaggaatcattaacccattcccagccagtaaagggataagggccttcccgctccagtgcatccatatcgccgaagggcatacgaaagcagtgctttgcgtggatagtaccgatgaccttttgttcactgggtctaaggataggacctgtaaagtttggaacttggttacaggacaggagatcatgtctttgggaggtcatcctaataacgtcgtaagtgtgaagtattgcaattatacaagcctcgtcttcacagtgagtacaagctacatcaaagtgtgggatatacgtgactcagcaaaatgcattcgcactctgacgtcatcaggccaagtaactttaggagacgcctgttctgcatctactagccgcactgtggccatcccatcgggggagaatcagattaatcagatcgccctaaatccaactggaacattcttatacgccgcgagcggaaacgctgtgagaatgtgggacctcaagcggtttcaaagtacaggtaagctcaccggtcacctcgggcccgtgatgtgcctgacggtggaccagattagctcagggcaagatctgatcatcaccggttctaaggatcactatatcaagatgttcgacgtcacagagggagcattagggactgtctctcccacccataatttcgagcctccccactatgatggcattgaggccctgaccatacagggtgataacttattctcaggctcacgagacaatggaatcaaaaagtgggaccttactcagaaggaccttttgcaacaggtgccaaatgcgcacaaggattgggtttgcgctctgggagtggtccccgatcacccagtgcttctcagcgggtgcagaggtggcatcctgaaggtgtggaacatggacaccttcatgcccgtaggtgaaatgaaggggcatgattcccctattaatgcgatctgcgtgaattctactcatatttttacagccgctgacgacagaactgtgaggatctggaaagcccgtaatttacaagacggccagatcagcgatacaggggatttgggagaggatatagcaagcaactag

SEQ ID NO: 121637 - DNA, 4986 bp, Artificial Sequence
  Description of Artificial Sequence: Synthetic coding sequence
atgctgggggcccccgacgagtcctccgtccgggtcgcagttcggatccgaccccaactggccaaggagaaaatcgaggggtgtcacatctgcacatctgtgactcccggagaaccacaggtgtttcttggcaaagataaggccttcacgtttgactacgtgttcgacatcgattcccaacaagagcagatctacatccagtgtatagagaaacttatcgaggggtgttttgaaggatacaatgccaccgtgttcgcctacggccagactggcgcagggaaaacttacactatgggtaccggtttcgatgtgaatattgtcgaggaagaactcggcatcatcagtcgcgcagtgaagcatttgtttaagagtatcgaagagaagaaacatatcgcaatcaaaaacggcttgcccgcgcctgattttaaggttaatgcccagtttttggagctgtacaacgaagaggtgctggacctcttcgacaccacaagggatatcgatgccaagtcgaagaagtccaacatacggatccacgaggacagcaccgggggaatctatactgtgggagtcactactcgcacagttaatactgagtccgaaatgatgcaatgtctaaagttgggggctctatccagaaccactgccagtactcagatgaacgtgcaaagcagtagatcccacgccatctttactatccacgtgtgtcagactcgcgtctgtcctcaaatcgacgccgacaacgcgacagataataagattatcagcgagagtgcccagatgaatgagttcgaaaccctgacagcaaagtttcacttcgtcgacctcgccggatccgaacgactcaaacgaaccggagcaactggagaacgtgctaaagagggcatctctattaattgcggtttgctggcactcggaaatgttatctccgcactgggggataaatcaaagcgcgcaacacacgtgccatatcgagacagtaagctgactagactgctgcaggatagcctgggcggcaattcacagactataatgattgcctgcgtgtctccctcggacagggactttatggagactcttaatacactgaagtacgccaatcgagcccggaatattaagaataaagtgatggtgaatcaggacagagcaagccaacagataaacgccctcagaagcgagataacacggcttcagatggaactgatggagtataagactggaaagaggatcattgatgaggagggtgtggagtccatcaacgacatgttccacgaaaatgccatgcttcagaccgagaacaataatctgagggtcagaataaaggcgatgcaagaaaccgtggatgcgctgcgctctagaatcacacagctggtgtcagatcaggccaaccacgtgttggctcgagcaggcgaggggaatgaagaaatctccaacatgatccactcctacattaaggaaattgaagatctgcgagcaaaactgctcgaaagcgaggctgtgaacgagaatctgcgaaaaaacctgactcgggctacggcacgggccccatactttagtggctccagcactttttccccgaccatactgagcagtgacaaagaaacaattgagatcatcgatttggctaagaaggacctcgaaaagttgaaaaggaaagaaaagaggaagaaaaagtcagtggccgggaaggaggataataccgacactgatcaggaaaaaaaggaggaaaagggagtcagcgagagggaaaataacgaacttgaggtggaggaatcccaggaggtaagtgaccacgaggacgaggaggaagaagaagaggaagaagaggatgatattgatggcggcgagtccagcgacgagtccgacagcgaaagtgatgagaaggctaattaccaggccgatctcgccaacataacatgcgagatcgctattaaacaaaagctgatcgacgagctggaaaactcacaaaagcggctgcaaaccctcaagaaacagtatgaggaaaaactgatgatgctgcagcataagatccgggacactcagctggaacgagaccaggtactccagaatcttggcagcgtggagtcctattcggaagagaaggcaaaaaaagtgcgctctgagtatgaaaaaaagttgcaggccatgaacaaggagttgcagagactccaagctgcccagaaagaacacgccaggctgctgaagaatcagagccagtacgaaaagcagctgaagaagctgcagcaggacgtcatggaaatgaagaagacaaaggtccgcttgatgaaacagatgaaggaagaacaggaaaaggcaaggttgactgagtcacgtagaaatagggagattgctcaattgaaaaaagaccagcgtaagagagatcatcagttacgcttgctggaggcacagaagagaaatcaggaggtggtgctgaggcggaagaccgaagaggtgactgctctccgtcggcaggtacggccaatgagcgataaggttgccgggaaggtcacccgcaaactctccagcagcgatgccccggcccaggataccggaagttctgctgctgctgtggagaccgacgcaagccgaacaggtgcccagcagaaaatgcgcattcctgtggctcgcgttcaggccctgcctacaccggctaccaatggcaaccgcaagaagtaccaaaggaaaggcctgacaggccgcgtgttcatcagcaaaactgcccggatgaagtggcaactcctggagcggcgggtaacagatattatcatgcaaaagatgacaatttccaacatggaagcagacatgaaccgattgctgaaacagcgcgaagagctgacaaagaggagggagaagctctccaaacgccgggaaaaaatcgtcaaggagaacggcgagggggacaaaaacgtagccaacatcaacgaggagatggaaagcctgaccgcaaatatagattatatcaacgactcgatctccgattgccaggcaaatataatgcagatggaggaagcaaaggaggagggcgaaaccctggacgtaacagccgtaataaatgcctgcactctgacggaggctcggtaccttctcgatcacttcctgagtatggggatcaacaaaggcttacaggctgcgcagaaggaggcccagataaaagttctggagggtcggctgaaacagactgaaatcacttctgcaacgcagaaccaactgctgtttcacatgctgaaagaaaaggccgagctcaatccggagctggacgccctacttggccatgcattgcaagatctggattcggttcccctagaaaatgtggaggactctacagacgaggacgctccgctgaattcgcccggctctgaagggtctactttgtcctcagacctaatgaagctgtgcggtgaggtaaaaccgaagaacaaggcccgaagaagaacgaccactcagatggaactcctttacgcagattcttctgaattagcgtctgatacatcgaccggagatgcatctctccccggtcctctcacccccgtcgcggaggggcaggaaattggcatgaacacagaaacaagtggtacttccgcccgcgagaaggaactgagtcctcctccaggcctgcccagtaagatcggatctattagccgacaaagcagcctcagcgaaaaaaagataccagaaccgagccccgtcactcgcagaaaggcctatgaaaaggcggaaaaaagcaaggcaaaggaacaaaagcactcagatagtgggacatccgaggcctccctgtcccccccttcgtccccaccgtcccgcccacgtaacgaactgaatgtctttaatcgcctgaccgtgtcgcaaggaaatacttctgtgcagcaggacaagtcagacgagtctgacagctccctcagcgaagtgcatcgctcctctcgcaggggaataattaatcctttcccagcctcaaagggtatcagagcctttcctctgcaatgtatccatatcgccgaaggccatactaaagccgtgctgtgcgtggattccactgacgaccttttgtttacgggcagtaaagaccggacttgtaaggtgtggaacctcgttacgggtcaagagatcatgagcctaggaggacatccaaacaacgtggtttctgtcaagtactgcaattatacttctctggtgttcacagtgtcgaccagctatatcaaagtgtgggacattcgcgactctgcaaaatgtataagaactcttacttcaagcggacaggttactttgggcgatgcctgttccgccagtacatctagaactgttgcgataccctccggagagaaccagattaaccagatcgcactcaacccaacgggcacttttctctatgccgcttctgggaacgcagtgcgcatgtgggacctgaagcggtttcagagtactggaaagctcaccgggcacctcggccccgtgatgtgcttgaccgttgaccagatctcttccggccaggatctcatcattacagggtctaaggatcactatatcaagatgtttgacgtgacagagggggccctgggaacagtgtccccgacccataatttcgagcctccacattacgacgggatagaggcactgacgatccagggggataacctcttttccggatcccgtgacaatggcatcaaaaaatgggaccttacacagaaagaccttctccaacaggtccctaatgcgcataaagattgggtgtgcgccttgggagtcgtgccggatcacccggtattgctctctggatgtcgcggaggtattctgaaggtgtggaatatggacacgttcatgcccgttggcgaaatgaaaggacatgactcaccaattaacgctatttgcgtgaactccacacatatcttcaccgccgccgatgatcgtacggtcaggatatggaaggccagaaacctgcaagacggccagatcagcgacaccggcgacctcggggaagatattgccagcaattag

SEQ ID NO: 121638 - DNA, 5028 bp, Artificial Sequence
  Description of Artificial Sequence: Synthetic coding sequence
atgctcggcgcgccagatgagtcctccgtcagggtggcagtgcgtattcggccgcaattggccaaggaaaaaatcgaagggtgccatatctgcacatccgtaacacccggagaacctcaggtgtttctcggcaaagacaaggcattcactttcgattacgtatttgatatagatagccagcaagagcagatttacatccaatgcattgaaaaacttatagagggctgcttcgagggctataacgccaccgtattcgcatacggacagaccggagctgggaagacatatactatgggcacgggctttgacgtgaacatcgttgaggaggagcttggaattatcagccgcgctgttaagcatctctttaagtctatcgaagagaagaaacatatagcaataaagaatggtctgccagctccagacttcaaagtcaacgcccaatttctggagctgtataacgaggaggtcctggacctgtttgacacgaccagggatatagacgctaagagcaaaaaatccaacatccgtatccatgaagattcgactggcgggatatacaccgtgggagtcaccacaagaactgttaatactgagtccgaaatgatgcagtgccttaaacttggcgccctttcaaggaccacagcgtctactcagatgaatgtccagagcagccgatcccatgccattttcaccatccacgtgtgtcagacccgtgtgtgcccccagattgatgccgataacgccacagataacaagattatctctgagtccgcacaaatgaacgaattcgaaacattaactgctaaattccattttgtcgacttagcaggttcagaaaggttgaagcgcaccggagccactggagagcgcgccaaagagggaattagcattaactgcgggctcctggctcttgggaacgttatcagcgccttgggcgacaagtcgaagcgggctactcacgtcccctaccgggactctaagttaactaggctgttgcaagactcattgggcggaaattctcagactatcatgatagcctgcgtgtctccttctgatcgtgattttatggagacccttaatacactcaagtatgccaacagggcccgcaatatcaaaaacaaggtcatggtgaaccaggatcgggctagccaacagataaatgctctgcgtagcgagattacccggctgcagatggagctgatggaatacaaaactggtaaaagaatcattgacgaagaaggtgttgaaagcatcaacgatatgttccatgaaaatgcaatgctgcagaccgagaataacaatttaagggtgagaatcaaggccatgcaggaaaccgtggatgctttgaggtccaggattacacagttggtctcagatcaggccaatcacgtgctggcacgggccggtgaggggaacgaggaaatttccaatatgatccatagttacataaaggagattgaggacctccgcgccaagctgttggagtccgaggccgtgaatgaaaatctccgaaaaaacctcacccgcgccacagcaagagctccatatttcagtgggtcctcaaccttcagcccgactattctgagcagcgataaggagacaatcgagatcattgacctggccaagaaagacctcgaaaaactgaagagaaaagaaaagagaaaaaaaaaacggctgcagaagcttgaggagtcgaatcgcgaggagaggagtgttgcgggaaaggaagataacactgacacggaccaggagaagaaggaggaaaaaggcgtgtccgagagggagaataacgaactggaagtcgaagagagccaggaagtgtccgaccatgaggatgaagaggaggaggaagaggaagaggaggacgatatcgatggaggcgagagttctgacgaatcagattccgaatccgacgagaaagcaaattatcaggctgacctcgcgaatatcacctgtgaaatcgctataaaacagaagttaatagatgagctagagaattcgcagaagaggctacagaccctaaagaagcagtatgaagagaaactgatgatgctacaacacaaaatcagagatactcagttggaacgcgatcaggttcttcagaatctgggctcagtcgagtcttactcggaggagaaggcaaagaaagttagatctgagtatgaaaaaaaactgcaggctatgaataaagagctgcagcgtctgcaagcagcccagaaggagcacgcacgcctgttaaagaaccagagccagtacgagaagcagttaaagaagctgcagcaagacgtcatggaaatgaagaaaacaaaagtgcggttaatgaagcagatgaaggaagagcaagagaaagcccgcttaactgagagccggcgcaatagggagatcgcccagctgaagaaagaccagcgaaagcgggatcaccagctgaggctgctggaagcacagaagcgcaatcaggaagtggtactccgacgcaaaacggaagaagtaaccgctctgcggagacaggtgaggcctatgagtgataaagtagccgggaaagtgactcggaaacttagcagctccgatgctcccgctcaggatactggtagctcggcagcagccgttgaaacggacgctagccggacaggcgcccaacagaagatgcggatcccagtcgcaagggttcaagcactgcctactcctgccaccaatggcaatagaaagaagtaccaacgcaagggcctcactggccgggtatttatcagcaagaccgctcggatgaaatggcagctgttggagaggcgggtcaccgatattattatgcagaaaatgacaattagtaatatggaagctgatatgaataggctccttaagcaaagggaggagctcacaaaacggcgcgagaagctctccaaaaggcgggagaaaatcgtgaaggaaaacggtgaaggcgataagaatgtggccaatattaatgaagagatggagagcctgactgccaacatcgactacataaatgacagcatctccgattgccaagctaacatcatgcagatggaagaagcaaaagaggaaggggagacattggatgttaccgctgtgataaacgcctgtactctgacagaagcgcgctatttgcttgaccattttctgagtatgggaataaacaaaggccttcaagcagcacagaaggaagcacaaattaaagttctggaggggagactcaagcagacagaaatcactagcgcaacacagaaccagctgctgttccacatgctaaaagagaaggccgaactgaatcccgagctggacgcactactcggccatgccctgcaggactttaagcatttctttgtagagaatgttgaggacagtaccgatgaagatgcaccacttaactcccccggatctgagggctcaactctgtccagtgaccttatgaagctgtgcggggaggtgaaacccaagaacaaagcccggaggcggacgactacccagatggaactcctatacgccgattcatcggagctggcttctgacacgagtacgggagacgcttcgctccccgggcccctcactccagtggctgaaggacaggagatcggtatgaacactgaaacctcaggcaccagcgctcgcgaaaaagaattaagccccccccccggcttgcctagcaaaataggtagcatctcaagacaatcttccctgtcagagaagaagattccagaacccagccctgtaaccaggcgaaaagcatatgagaaagcggagaaaagcaaggcaaaggagcagaagcattctgatagcggtaccagtgaggcttcactgagccctccaagttcccctccaagcaggccacgaaacgaactgaatgttttcaataggctcaccgtgagtcaggggaacacatccgtgcaacaagacaagtctgatgagagcgacagtagcctgagtgaggtccaccgtaattcaaatttgagaggtatcatcaatccatttccagcctccaaaggcatacgggctttccccctgcagtgtatccacatcgccgaggggcacaccaaagccgtgctctgtgtggactccactgacgatttgctgtttaccggctcgaaggatagaacatgtaaagtatggaatctggtcaccggacaggaaatcatgtctctcggagggcaccccaacaacgtggtatctgtcaagtattgtaattacacttccctcgtgttcactgttagcaccagctacattaaggtgtgggatatacgagacagcgcgaaatgtattcgcactctcacttcctccggacaggtcaccttgggggacgcgtgcagcgcatccactagcagaacagtggcaattccaagcggagaaaaccagataaatcagatcgcacttaacccaaccggaaccttcctgtacgcagctagtggaaatgccgtgagaatgtgggacctaaaaaggtttcagtcaaccggcaagttgacaggccatctgggccccgtgatgtgcctgacagtggatcagatcagttctggccaggacttgatcattactggcagtaaagatcactatattaagatgtttgacgtcactgagggagcattaggcacagtctctccaacacataattttgagcccccccattacgatggaatagaagcgctgactatccagggtgacaacctgttctccggaagccgggacaatgggattaagaagtgggatttaacacagaaggatctgctccagcaagtacctaatgctcacaaggattgggtgtgcgctctaggcgtcgttcccgaccaccctgtgctcctttccggatgcaggggcggcattctaaaagtatggaacatggacaccttcatgcccgtaggtgagatgaagggacatgacagccctattaacgccatctgcgtgaattccacacacatcttcactgcagctgacgacagaactgtaaggatttggaaagcccgcaacctacaggatgggcaaatctccgataccggagacttaggagaggacattgcctctaactag

SEQ ID NO: 121639 - DNA, 4866 bp, Artificial Sequence
  Description of Artificial Sequence: Synthetic coding sequence
atgcttggtgctcccgacgaaagcagtgtgagagtggccgtacgcataagaccccagctcgctaaggaaaaaatagagggctgtcatatctgcacctctgtgacccctggggaacctcaggtgtttttgggcaaagataaggccttcacttttgactatgtgtttgatatagactcgcaacaagaacaaatatatattcagtgcatcgagaaactgattgaaggctgtttcgaggggtataacgccaccgtgttcgcctacggacagactggtgctggaaagacctatacaatgggcacgggcttcgacgtgaacattgtagaggaggagctgggcatcatttcaagggctgtcaaacacctcttcaagagcattgaagagaaaaaacatattgccattaagaatggcctccctgcacctgattttaaagtcaacgctcagttcctcgaactgtacaatgaggaagtccttgatttgttcgataccactcgggacatcgacgcgaaatcaaaaaagtctaacattaggattcacgaagactcgaccggcggaatctataccgtcggcgtgacaactaggacagttaatacggaaagcgaaatgatgcagtgccttaagcttggcgccctgtcgcgaactactgccagcacccagatgaacgtgcaaagcagtcgctcacatgccatatttactatccatgtttgccagactagggtctgccctcagatcgatgccgataacgccaccgataataaaatcatcagcgaaagtgcccagatgaacgaattcgagactctgacggccaagtttcactttgtggatctggcaggcagcgaaagactgaagaggaccggcgccactggggagcgcgccaaagaggggattagcattaattgtggtcttctcgcgttggggaatgtgatcagcgccctcggggacaagtccaaacgcgcgacccatgtgccttatagggactctaagcttactcggctgctgcaggacagtctaggtggaaactcccaaaccatcatgatcgcttgcgtgtcaccatccgatagagattttatggagaccctgaataccttgaagtacgcgaacagagctagaaacataaagaacaaggtcatggtgaaccaagaccgggccagccagcagatcaacgccctccggtcagagatcaccaggctgcagatggaattgatggagtataaaacaggaaagcggattatcgacgaggaaggggtggagtccatcaacgacatgttccacgagaatgcaatgttgcagactgaaaacaacaacctgcgggtcagaatcaaggccatgcaggagacagtcgacgcactgcgaagtcgcatcacccagcttgttagcgatcaggcgaaccatgtcctagctcgcgcgggcgaggggaacgaagaaattagcaacatgatacattcttacatcaaagagatagaagacttgcgtgccaagcttctggaaagtgaggctgttaacgaaaatctgagaaagaatctcaccagagctaccgccagagccccgtacttctccggctcgtcaactttttccccaaccatcctttcttccgacaaggaaactatcgaaatcattgacctggctaaaaaggacttggagaagctgaagcggaaagaaaaacgtaagaagaaaagcgtggcagggaaggaagacaacacggacactgaccaggagaagaaagaggaaaaaggcgtgtcagagcgtgaaaacaacgaactcgaagtagaagaatcccaggaagtgagtgatcatgaggacgaggaggaagaagaggaagaggaagaggacgatatcgatggcggggagagttctgacgaaagcgactcagaaagtgacgaaaaagcaaactaccaggccgatctggcaaatatcacctgtgaaatcgctataaagcagaagctcatcgacgagctcgaaaactcccagaaacgtctccagaccctgaaaaaacaatacgaggagaagctgatgatgcttcagcacaaaatccgggatacccagttagaacgggatcaggtcctccagaatttggggagtgtcgaatcatattccgaggagaaggccaagaaggtcaggagtgagtacgaaaagaaactacaagcaatgaataaggagctgcaacgcctgcaggccgcacagaaagagcatgctcgtctgcttaaaaaccagagccagtacgaaaaacagctgaaaaagcttcagcaggatgttatggagatgaagaagacaaaggtcagactgatgaaacagatgaaggaggaacaggagaaagccagactaaccgagtcaagaagaaatcgagaaatcgctcagctcaaaaaggatcagagaaagagggatgtaaccgccttgcgcagacaggttagacccatgagcgacaaagtggccggcaaggttactcggaagttatcgtcttccgatgcccccgcccaagacaccggcagcagcgccgcagccgtcgagacggacgccagcagaacaggagcacagcagaagatgagaatacctgtcgcccgggtgcaagctcttcccactcctgcaaccaatggaaacagaaagaagtatcaacggaagggactcactgggcgtgtcttcattagtaaaacagccaggatgaagtggcagctgcttgaacggagggtcaccgatatcattatgcagaagatgactatttccaacatggaagctgatatgaatagattgttaaaacagcgggaagagctaactaaaagaagggagaagctgagtaagcggcgcgagaagatcgtcaaagagaatggggaaggcgacaagaatgtggccaatatcaatgaggagatggagagcctaacagccaacatagactatatcaatgacagtataagcgattgtcaggccaacattatgcagatggaggaggcaaaagaggagggagagactctcgacgtcacagccgtgattaacgcttgtacccttacagaggctcgatatctgctcgaccattttctgagcatgggaatcaataaaggtctgcaagctgctcagaaagaggcacagatcaaggtgctggagggccgcctgaagcagaccgaaataacgagtgctactcagaaccagttgctgttccacatgctgaaggagaaggccgagctgaaccctgagcttgatgctctattaggccacgctcttcaggacttggattctgtgcctcttgaaaatgtcgaggattctacggacgaggatgcgcccctgaactcccctggctccgagggttctaccttgagctccgacctgatgaagttatgcggggaagtcaagccgaaaaataaagcacggcggcggacaacaacccagatggaactgctgtacgcagatagttccgaattggccagtgacacaagcactggagacgcctccctgcctggccccctcacccctgttgccgagggccaagagataggaatgaacacagaaacttcaggcacctctgctagggaaaaagagctctctccacccccgggactgcccagtaaaatcggaagtatctcacgccaatctagcttatctgagaagaaaattcctgagcccagccccgtgacccgcagaaaagcatatgaaaaggccgaaaagtccaaggctaaggaacagaagcactccgactctggcacgagcgaggccagcctcagcccaccatcctcccctccctcacgacccagaaatgaactgaacgtcttcaatcgcctgacagtgagccagggcaataccagtgtccagcaggataagggaatcattaacccgtttcctgcttccaaaggcattcgcgcttttcccttacagtgcatccatatagcagagggccacacaaaggcagtgctttgtgtggatagtaccgatgacctcctgtttacaggcagcaaagaccgcacatgtaaggtgtggaacttagtgacaggacaagagatcatgagtcttggggggcaccccaataatgtggtctccgtgaagtactgcaactatacaagtctggtgttcaccgtgtccacctcctatatcaaagtttgggatatcagggattcagctaaatgtatccgcaccctgacttctagcggacaggtgacactcggtgacgcctgctccgcctccaccagcagaacggtcgctatcccatcaggcgagaaccagatcaaccagattgcgctcaacccgaccgggacttttctttatgctgcctctgggaatgctgtgagaatgtgggacctgaaaagatttcagtccactggcaagctcactgggcacttgggccccgtgatgtgtctgactgtcgaccagatctcatcaggacaggatctgataatcaccggatctaaagaccactacataaagatgtttgatgtaaccgaaggcgccctcggcaccgtgtcccccactcacaacttcgaacccccacattacgatggaatcgaggccctcactatccagggggacaatctgttctctggttcaagagataatggcattaaaaagtgggatttaacccagaaggacttgctgcaacaggtgcctaacgcccacaaggactgggtctgtgccctcggagtggtgcccgatcacccagtgttgctgtcaggatgccgcggggggatcctgaaagtgtggaacatggatacattcatgcctgtcggcgagatgaaaggccatgattcacccattaacgctatttgtgtaaatagtacacacatcttcacagcagcggacgacagaactgtgcgtatttggaaagcccgcaatctgcaggacggccagatttccgataccggcgaccttggtgaggacattgccagtaactag

SEQ ID NO: 121640 - DNA, 4914 bp, Artificial Sequence
  Description of Artificial Sequence: Synthetic coding sequence
atgcttggggcacccgatgagagctccgtaagggttgctgtgagaatccgcccgcaacttgccaaagagaagattgaaggttgccatatttgcactagtgtgacacctggcgagccccaggtgtttctaggaaaggataaggctttcaccttcgattatgtcttcgatatcgactcacagcaggaacagatttatattcaatgcatcgagaaattgatcgagggctgcttcgagggttacaatgctaccgtgttcgcatacggccagacaggcgcagggaaaacctatacgatgggcaccggatttgacgtaaatatcgtggaagaggagctcggaataatctcccgggccgtgaagcacctgttcaagtcaatcgaggagaagaagcatattgcaattaaaaacggactccctgctccagatttcaaggtcaatgcacagtttctagagttatacaatgaagaggtgcttgaccttttcgacacaaccagggacatcgacgccaaaagtaagaagagtaacattaggatacatgaggacagcacaggagggatctacactgtgggcgtgaccacgaggacggtgaataccgaaagcgaaatgatgcagtgtctgaagctaggcgctttgagccgcaccacagcatctacccagatgaatgtgcaaagttcccgctctcacgctatcttcaccattcacgtgtgtcagacacgtgtgtgcccgcagattgacgccgacaatgcaacagataacaagataatctccgagagtgcacagatgaatgagtttgagactttgacggccaagtttcatttcgtcgatctggccgggagtgagagactgaaacgtacgggtgcgactggagaacgagccaaggagggcatttccataaattgtggcctgctggcattgggcaatgtaatcagtgcactgggcgataagagcaagcgggccacgcatgtaccctatagagactctaagttgactcgactgctgcaagattccttgggcggcaactcacaaacaatcatgatcgcctgtgttagcccgagtgaccgcgattttatggaaacccttaataccctgaagtacgctaacagagccagaaatattaagaacaaggtcatggttaatcaagacagggcttcccagcagatcaatgccctgcgctccgaaataacaagactccagatggaactgatggagtacaagacaggtaagagaataatcgatgaggagggcgtagagagcattaacgacatgtttcacgagaacgcgatgctgcagactgagaacaacaatttgagggtaagaatcaaggcgatgcaggaaactgtggatgcgctgcggtcccgcataacccagctggtttccgaccaggcgaaccatgtgctggcccgtgctggggagggtaatgaggagatctctaatatgattcatagttacatcaaggagatagaggatctgagggcaaagcttctggaaagtgaagcagtgaacgagaatctgcgtaagaacttaacgcgagccactgccagagctccttacttctcaggcagctcaacattctctcccacaattctgagctcagacaaagaaactattgagattattgatcttgccaagaaagatctggagaagctaaagagaaaggagaaacggaaaaagaaatctgttgccggcaaagaggacaacacggatacagatcaggaaaaaaaggaggaaaaaggggtcagcgagcgcgagaacaacgaactggaggtggaagaaagccaggaggtctctgaccatgaagatgaagaagaagaggaggaggaggaggaggatgacatcgatggaggggaatcctcagacgagagcgactccgagagcgacgaaaaggcaaattaccaggccgacctggccaacatcacatgtgagatcgcaattaagcaaaagctgatagatgagttggagaacagccagaaacgcctccagaccttgaagaaacaatatgaggagaagctgatgatgctgcaacacaagatcagagacactcagcttgaacgcgaccaggtgcttcagaacctgggctctgttgagtcctactctgaagagaaggccaaaaaggtgagatccgagtatgagaagaaattgcaagcaatgaataaggaattacagcgcctgcaggccgcccaaaaggagcacgcacgtctcctaaagaatcaaagccaatatgagaagcagcttaaaaaactccaacaggatgtcatggagatgaagaaaacaaaggtgcgccttatgaaacagatgaaggaggagcaagagaaggcccgtctgaccgagagcagaagaaatagggaaatcgcgcagctgaagaaagaccagcggaaaagagatcaccaactgcgcctgctcgaggctcaaaagcggaaccaggaagtggttcttcggcggaaaacagaagaggtcactgcattgcggcgccaggtgcgccctatgtccgataaggtggctggcaaagtaacgaggaagctgtcttcatcagacgcccccgctcaggataccggctcctcggctgctgccgtcgaaacggatgcttcaaggaccggcgctcagcagaagatgcgcattcccgttgcacgcgtgcaggcactgccgactcccgccaccaatgggaaccgcaaaaaatatcagagaaaggggttaacagggcgagtctttatatccaaaaccgcacgtatgaagtggcagctcctggaaaggcgcgtcactgacattataatgcaaaagatgacaatcagtaatatggaggccgatatgaatcggttacttaagcagcgggaggaactgaccaagcgacgcgagaagcttagtaaacggcgggagaaaattgttaaggagaacggcgagggcgacaagaacgtcgccaacattaatgaagaaatggagagcttgacagctaacattgactatatcaatgactctatctcagactgtcaggctaacattatgcagatggaggaagcaaaggaggagggggagacactggacgttactgccgtaatcaatgcctgcactctgaccgaagcgcgatacctactggaccacttcctttccatgggaataaacaaaggactgcaggcagcccagaaggaagcgcagatcaaggtgctcgagggcagactgaagcaaaccgaaatcacctcggccactcaaaaccagttgctgtttcacatgctcaaagagaaggcagagctcaatcccgagctggacgccctgctcgggcacgctctacaagagaacgttgaggactctaccgatgaagatgcccctttgaattctccaggttctgagggctcaaccctgagcagcgaccttatgaagttatgcggagaagtgaagccaaaaaataaggcccgacgccggacaaccacccagatggaactgctgtacgccgattcatctgagctggcctcagatacaagtaccggcgatgcctctttgcccggacctctgaccccagtagccgaagggcaagaaattgggatgaacaccgagacatccggtaccagtgcccgggagaaagagctgagccctccaccggggttgccttctaaaatcggcagtatcagtaggcagagctcgctctctgagaagaaaataccagaaccatctccagtcactcggcgcaaagcgtatgagaaggcagaaaagtctaaagctaaggagcagaaacattcagactctggaacctcagaggccagcttgagccccccttccagccccccctctcgccctcgaaacgagctcaatgtttttaacagacttaccgtttcacagggcaacacctcagtccagcaggacaaaggaataatcaacccctttcccgccagcaaaggtatcagagcttttccccttcagtgcatacatatagcagagggtcacactaaggctgtgttgtgcgtcgacagcaccgacgatttactctttacaggatcgaaagatcgtacgtgtaaagtgtggaatctcgtgactggacaggagataatgtctcttggtggccatcccaataacgtcgtgtccgtgaagtattgcaattacaccagtctggtcttcaccgtaagtaccagctatattaaagtttgggatatccgagatagcgccaaatgtatcagaactttaacttcttctgggcaggtcacattgggtgacgcatgctccgcgtcgacatcacggacagtcgcgattccttctggcgaaaaccagattaaccaaatcgcgctgaacccaaccggcacctttttgtacgccgcaagcggaaacgcagtgcgaatgtgggatctcaaacgcttccagtcaacgggaaagttaactggccacctgggccctgtaatgtgcttaacagtcgaccagatatcatcaggacaagatcttatcattacaggttccaaagaccattacattaagatgtttgatgtgaccgaaggcgccttggggactgtgagtcctacccacaatttcgaacccccccattatgatggtattgaggccctgaccatccagggggacaatctgttttctggcagcagagataatggcatcaagaaatgggatctaacccagaaggatctcctgcagcaggtccctaacgcccataaggactgggtatgcgcccttggggtcgttcccgaccaccccgtgctactttccggctgcagaggaggtatcctgaaagtgtggaatatggacacctttatgcctgtcggggaaatgaagggacatgacagcccaattaacgcaatctgtgtgaacagcacccacattttcacagcagcggatgatagaacagttaggatctggaaggctcgcaacctccaggatggtcagatttccgacacaggggatctgggtgaagacattgcatccaactag

SEQ ID NO: 121641 - DNA, 1986 bp, Artificial Sequence
  Description of Artificial Sequence: Synthetic coding sequence
atgaaccgcctcctaaaacagcgcgaggaacttaccaaacgaagggagaaactctctaagcgaagggaaaaaatcgtgaaggagaacggtgagggggacaaaaatgtggccaacatcaacgaggaaatggagtcactcaccgcaaatattgactacattaatgactcaatatcggactgccaggccaatattatgcaaatggaggaggctaaggaagagggggagactctggacgttacggcagttatcaacgcttgcacgctcacggaggccaggtatttattggaccattttctctcaatgggcataaacaaggggcttcaggcagcgcagaaagaagctcaaatcaaggtgttggagggccgcctgaaacagacggagatcacttctgccacgcagaatcagctactcttccatatgctaaaagagaaggccgaactcaaccccgagctggatgccctgttgggacatgcgttacaggagaatgtagaggattcaactgatgaagacgccccgctgaatagtccgggatccgaagggtctacattatctagtgacttaatgaaactctgtggggaggtaaaaccaaaaaataaggcccgccgccgcaccacaacgcagatggaactgctgtacgccgatagctctgagttggcttccgatactagcaccggcgacgccagtctgccaggaccgttgacccctgtggcagagggacaggaaataggaatgaacaccgagacctcagggacctccgcccgcgaaaaggagctgagcccccctcccggactgccgagcaaaattggatctataagtcgtcagagctccctcagtgaaaaaaagatccctgagccctcccccgtgacgagaaggaaggcgtatgagaaggccgagaaaagcaaggccaaggagcagaagcagggaatcatcaatccattccctgctagcaaaggaatccgcgcatttcctctgcaatgtattcatatcgcagaagggcataccaaagccgtgctctgcgtggatagcaccgacgatctcctattcaccggcagtaaagatcgaacctgcaaagtgtggaatctggttaccggacaggagattatgtccctgggcggtcacccgaacaacgtggtcagtgtgaagtattgtaattatacttcgcttgtgttcaccgtgagtacctcctatatcaaggtgtgggatatacgcgactcagccaaatgcatccgcacacttacctcctccggccaggtaaccctaggagacgcatgcagcgcctctacttctagaacagtggcaattcccagcggcgagaaccagatcaatcagattgctctgaatcctacaggaacttttctgtatgctgccagcgggaatgcggtcaggatgtgggatctgaaaaggttccaatccacgggaaagctgacaggtcatctgggccctgttatgtgtctgaccgtggatcagatctcctctggtcaagacctcattattacagggtcaaaggatcactatataaaaatgtttgatgttactgagggggccctgggcaccgttagccctacacacaatttcgagccaccacattatgacggcatagaagctcttacgattcagggcgacaatctcttcagtggcagccgtgataatgggataaagaagtgggacctgacccaaaaagatctgttgcagcaggtgcctaacgcccataaggactgggtgtgcgcattgggagtcgtccccgaccatcccgttctactgtccgggtgcagggggggcattcttaaagtatggaacatggatacctttatgcctgtgggggagatgaagggccatgacagtcctatcaatgctatatgtgtgaatagtactcacatctttaccgccgcggacgacaggactgttcgaatttggaaagcccggaatttacaggatgggcagatatccgataccggcgatttgggcgaggacatcgccagtaattag

SEQ ID NO: 121642 - DNA, 4875 bp, Artificial Sequence
  Description of Artificial Sequence: Synthetic coding sequence
atggctggccagggtgattgctgtgtcaaggtggctgtccggattaggcctcagctaagcaaggaaaaaatcgaaggatgtcacatctgcactagcgttacgcccggtgagcctcaagtactcctcggcaaagataaggccttcacatatgacttcgtttttgacctcgacacatggcaagaacaaatatatagcacatgtgtttccaagcttatcgagggttgtttcgagggctataacgccacagttctggcctacggacagactggcgccggtaaaacctatacgatgggtactgggttcgatatggccacttccgaagaagaacaaggaatcatccctagggcaattgcccacctgtttggaggcattgcagagcgcaaacgccgggcacaagaacagggggtggcggggcctgaatttaaagtttccgcccagttcctggaactttacaacgaagagatcttggacctgtttgacagtacacgcgaccctgatactcggcatcgccggagtaacataaaaattcatgaagacgctaacggcggcatttacacaacgggagtcacttccaggctgatccacagtcaagaggaactgatacaatgcctcaagcagggcgctctgagccggacaacagcctctactcagatgaacgtccagagttcaaggtcacacgccatctttaccattcatctctgccagatgcggatgtgtacacagcccgacctagtcaacgaggctgtcactggactccctgacggaactcccccatcctctgaatatgaaactttgacggcaaagtttcatttcgtggacctcgccggctcggaacggctgaagcgaacaggcgccaccggcgagagagcgaaggaaggcatctctatcaactgtggcctgttagctcttgggaatgtcatttcggcactgggagaccagagcaaaaaggtggtccacgtgccataccgagattcaaagctgacacggctgctgcaggatagcctgggggggaattctcagaccattatgatcgcgtgcgtctcaccgagtgatcgcgacttcatggagaccttgaacacgctcaaatatgccaaccgggcccggaacataaagaataaagtggtggtgaaccaggataagacatcccagcaaatctccgccctgagggccgagattgcccggcttcaaatggaattaatggaatataaagcaggtaaacgggtgattggcgaagatggggctgagggctactctgacctgttcagggagaatgccatgcttcagaaggaaaatggagcattgaggctcagggtgaaagctatgcaggaggctatcgacgctattaacaaccgcgtaactcagctgatgtcacaggaggcaaacctgctcctggcaaaggccggtgacggcaacgaggctattggggctctcatacagaattatattcgcgagattgaggagctgcgcacaaaattgctggaatcagaggcaatgaatgaatcactgcgcaggtcactctccagggcttcagcgcgatccccttattcacttggcgctagccctgctgcccccgctttcggcggttctcccgctagtagcatggaggacgcgtctgaggtcattaggcgagctaagcaagacctcgaacgactgaaaaagaaggaagtgcgacagagacggaagtcacctgagaaagaagcctttaagaagcgagccaagctgcagcaggagaatagcgaagagactgacgagaatgaggcagaggaggaggaagaagagcgtgacgagagcggctgcgaggaggaagaaggccgagaggacgaggacgaagattccggttccgaggagtcattggtggactcagattcagaccctgaggaaaaggaggtgaacttccaagctgacctagcagatttgacttgtgagattgagatcaagcaaaagctgatagatgaacttgaaaattcccaacgaagactgcagaccttaaagcaccagtacgaagaaaagcttatcctgctgcagaacaagataagagacacccaactagaacgggatcgggtgcttcaaaacctcagcacaatggagtgttacactgaggaaaaggctaataaaattaaagctgattacgagaaaagactccgtgagatgaatcgcgacctacagaagctgcaggctgcccagaaggaacatgcccgtctgctgaagaatcagtcacgttacgagcgtgagttgaagaagcttcaagctgaagttgccgaaatgaagaaagcgaaagtggccctcatgaaacagatgagggaggaacagcagaggaggcgtctggtggagaccaaacgcaatagggagatagcccaactgaagaaagagcagagacgtcaggagttccaaatcagagcacttgaatcacagaagagacagcaggagatggtgttaaggagaaaaactcaagaagttagcgccttgcgtcgccttgccaagccaatgagcgagcgggtggcgggacgggcaggactgaaaccccccatgctggattcaggagccgaggtatctgcatctacaacctcatccgaagccgagtccggagctcgtagtgtgtccagtatcgtacgtcagtggaataggaaaattaaccattttctgggcgatcatccagccccaactgtcaatggtactcggccggcgcggaaaaaattccaaaagaaaggggctagtcagtcgttcagcaaggcagccaggcttaaatggcaatccctggagagacgcatcatcgatatcgtgatgcagcgcatgactatcgtgaacttggaggctgatatggaaaggctgattaaaaagcgggaggagttgtttctgctgcaagaggccttacggagaaaacgagaacggctacaggccgagtcacctgaagaggagaaggggctgcaggaactggcggaggagattgaggtgctggccgccaacatagactatatcaatgatggaatcaccgattgccaagctaccattgtgcaactagaagaaaccaaagaagaattggactctactgatacctcggtagtgatcagtagttgcagccttgctgaggccagactgctgcttgataatttcttaaaggcctcaattgacaagggcttgcaagtagcccagaaggaagcccaaatccgcctgctagaaggacggctgaggcagacggatatggcaggtagctcccagaaccaccttctactcgacgctctgcgggagaaagctgaggcccatccagaactccaagcgttaatttacaacgtccagcaagagaacggatatgcctcgactgatgaggagatatccgagtttagcgaaggcagtttctctcagtctttcacgatgaaaggctccacaagtcatgatgattttaaatttaagagtgagcctaaactgagtgcgcagatgaaggccgtgtccgcagagtgcctgggaccccctttagacatatccactaagaacatcaccaagtccttggccagcctagtcgaaataaaggaagacggcgtgggtttcagtgtgcgcgatccttactaccgggaccgcgtcagcaggacagttagtctaccaaccaggggatcaacttttcccagacaatctagggctaccgaaacatctcccttgactaggcgtaagtcctatgataggggtcagccgatccgttctaccgatgtgggcttcacaccaccctcttcgcctccaacgcggcctagaaatgataggaacgtgttttctcgcctcacttcgaaccagtcccaagggagcgctctggataagggtatcatctctccagtcggaggagccaagggcgctcgcactgctccattgcagtgcgtgtctatggctgaggggcatacaaaaccaatactttgtttagacgccaccgacgagctgctgttcaccggatccaaggatcggtcctgtaagatgtggaacttggtgaccgggcaggagatagccgccctgaaggggcaccctaataacgtggtgagcattaagtactgttcccacagcgggttggtgtttagcgtaagtacaagctacattaaagtatgggatattcgggactccgctaaatgcatccgtaccctgacttcgtctggccaggtcatttccggggacgcatgcgcggctaccagcacccgggccatcacaagcgcacagggcgagcaccagatcaaccaaattgccctgtccccaagcgggacaatgttatatgctgcctccggaaatgcggtgaggatctgggaattgtctaggttccagccagttgggaagctgacagggcatatcgggccagtgatgtgtctgaccgtgactcagaccgcatcacagcacgacttggtcgtcactggatccaaagaccactacgtcaagatgttcgagttgggagaatgcgtaacagggaccatagggccgacacataattttgaacccccacactatgacggcatcgagtgcctcgctatccagggcgacattttgttcagtggatccagagacaatggtatcaagaaatgggatctagatcagcaggaactaattcagcagatacctaacgcccataaggactgggtgtgtgctctggcttttattcccgggagaccaatgttgctatccgcctgccgcgcaggtgtcataaaagtctggaatgttgacaatttcactcccatcggggagatcaagggccacgacagtcctatcaacgcgatttgcaccaacgcgaagcatatttttaccgcgtcatcggactgtcgggtgaagttgtggaactacgtgcctgggctcaccccttgcctgccgagaagggtgctcgctatcaaaggtcgcgccacaaccctgccatag

SEQ ID NO: 121643 - DNA, 4833 bp, Artificial Sequence
  Description of Artificial Sequence: Synthetic coding sequence
atggcgggccagggagattgttgtgtgaaggttgcagttcggatcagacctcagctctccaaagagaaaatcgagggatgtcatatatgtactagtgtgactccgggggagcctcaggtcttactggggaaagacaaagcctttacatatgacttcgtattcgacttagatacctggcaggagcagatctactcaacctgcgtgagtaagctaatagaggggtgctttgagggctataacgcaacagtactggcttatggacaaactggagcaggaaagacctacaccatggggacgggcttcgatatggcaacctcagaagaggagcagggtatcatacctcgagcaatcgcgcacttgtttggagggattgccgagagaaagcgacgtgcacaggagcaaggtgtcgccgggcccgaatttaaagtttctgcccagttcctggagctgtacaacgaagagattttggacttgtttgactccacaagggatcccgacactagacacaggagaagtaatatcaaaattcatgaagacgcgaacggcggcatttacactacaggggttactagtcggcttatccatagccaagaagagctcatccagtgcttgaaacaaggcgccctgtctcgaacgaccgcgtcaactcagatgaatgtgcagtctagccgttctcatgccatctttaccatccatctgtgccagatgaggatgtgcacccaaccggatctggtgaacgaggcagtcacgggtctgcctgatgggacgcctcctagcagcgaatacgaaactttgacagcaaagttccacttcgtcgacctcgcggggtcagagagactcaaaaggaccggcgccactggcgagcgcgccaaagagggaatcagtattaactgcgggctgctggccctgggtaatgtgattagcgccctgggcgatcaaagcaagaaggtggtgcacgtgccgtatcgtgacagcaagcttacccgtctgctccaggactcccttggggggaattcccagacaattatgatcgcctgcgtgtccccctcagatagagacttcatggagacccttaatacacttaagtatgctaacagagcccggaatattaaaaataaagtcgtggtgaatcaagacaagacttcccagcagattagcgctctacgggcagaaattgcccggttacaaatggagcttatggagtacaaggcggggaagagagtgattggggaagacggtgccgagggatatagcgatctatttcgcgagaacgctatgttacagaaggagaacggcgccttgagattaagagtcaaagcaatgcaggaagccattgacgccattaacaaccgggtaacccagcttatgagtcaggaggccaacctcctgctcgctaaggccggcgacggaaatgaggcgattggcgcattgatacagaactatatccgggaaattgaggaactcaggaccaagctgctggaatcagaggccatgaatgaaagtctgaggagaagcctatcacgtgccagcgccaggagcccgtactcgttgggcgcgagtccagctgccccagccttcggagggtctccagccagttccatggaagatgcatctgaggtgatccgccgcgcgaaacaggatctggaacggctcaaaaaaaaggaggtccggcaacgaaggaagtctcccgagaaagaagcttttaaaaagcgggctaagctccaacaagaaaacagtgaggaaactgatgagaatgaggctgaggaagaagaagaggagagagacgagagtggctgtgaggaggaggaaggaagggaggatgaagacgaggactcaggaagcgaggaaagcctggtggattcagattctgaccccgaggagaaggaggttaacttccaggctgacctcgcggatctgacatgcgagatcgagatcaaacagaagctcatcgatgagctcgagaattctcaacgtcgacttcaaaccctcaagcatcagtacgaggagaagctcatcctgttgcagaataagatccgcgacacccagttagagagagacagagtcctgcagaatctctcaacaatggaatgctatacagaggagaaagccaacaagatcaaggccgattacgaaaagaggcttcgggagatgaatagggacctccagaaacttcaggcagctcagaaagagcatgcccgtctgctcaagaatcagtctcggtacgagcgcgaactgaagaaactacaagctgaggtggcagaaatgaagaaggcaaaggttgcattgatgaaacagatgcgcgaggagcagcaaagacggcgcctcgtggagacgaaacgaaatagggagatcgcacagctcaagaaggagcagcggcgacaggaatttcaaatccgcgcactggaatcacaaaaacgccagcaggagatggtgctgagaagaaagacccaggaggtctccgccttacgccgacttgctaaacctatgtctgagcgggtcgcaggtagagcaggacttaaacccccgatgttggatagcggggccgaggtgagtgcctcaaccacgtcttcagaggcagaatccggcgccagatccgtatcatcaattgtccggcagtggaacaggaagatcaatcacttcctgggcgatcaccctgccccgaccgtgaatggcactcgtcccgctaggaagaaatttcagaagaagggcgcatctcaatcctttagtaaggccgcacgccttaagtggcagtccctggaacggagaatcattgacatagtgatgcagaggatgaccatcgtgaacctagaagcggacatggagcggctgattaagaagcgggaggagctgtttctgcttcaggaagcgctgcgtagaaagcgggagagactccaggcggaatcacccgaagaagaaaagggactgcaggagctcgctgaggagatcgaggtgctggcagccaacattgactatattaacgatggaataactgactgccaagcaactattgtgcaactggaggaaacaaaagaggaattggacagcactgacacgagcgtggtcataagttcttgcagcttggccgaagctcgtttgctcttagataactttttaaaagcctcgattgacaaaggactgcaggttgctcaaaaagaggcgcaaattcgtctgcttgagggtaggctccgtcagactgatatggccggatcatcccagaatcatctacttcttgatgctctccgcgagaaggccgaggcgcatcctgagcttcaggccctgatctacaatgtgcaacaggagaacggttacgcctctaccgatgaggagatctctgaattctccgagggcagctttagtcagagtttcaccatgaagggtagcacatcacacgatgatttcaagtttaagtcagagcctaaactttccgcgcaaatgaaggccgtcagtgctgagtgtttagggcctccgctcgatatcagcacaaaaaatataacaaagtccctggcgagcctcgtggaaattaaagaagacggcgtggggttctcagttagagatccttactaccgggaccgggtttctcgaacagtcagtctgcctactcgaggcagtacattccctcgccagagtagggctaccgagacatctcctttaactcggcgaaagagttacgaccgaggacagccaatccgtagcacagacgtgggcttcacccccccttctagccctccaacccggcccaggaatgacaggaacgtttttagcagactgacttcgaatcagtctcaagggtccgccctggataaggggattattagccctgtaggaggagccaaaggcgcccggacggcaccactgcagtgcgtatccatggctgaggggcacacaaagccaattctatgcctggacgccactgatgagttgctctttacagggtccaaagatcgatcatgcaagatgtggaatctggtgacaggccaggagattgctgcgttgaaaggccatcctaacaacgtcgtaagcattaaatattgctcccactcaggtctcgtgttttcagtgagtaccagctatattaaggtgtgggatatccgggactcagcaaaatgtatacggacccttacgtcatccgggcaggtgatttccggcgacgcctgcgcagccacaagcactagggctattacgtccgcacagggggagcaccagatcaaccaaatcgcgctcagcccgtctgggaccatgttatacgcagcatcaggcaatgctgtgcgaatctgggagctgtccagattccaacctgtcggaaagctcaccggtcacatcggaccagtgatgtgtctgaccgtgactcagaccgcttcacagcacgatcttgtggttacaggatcgaaagatcactacgtcaagatgtttgagctgggtgagtgtgtcacaggtaccataggacccactcacaactttgagccccctcactatgacggaatcgagtgtctcgctatccagggcgatattcttttcagcggttcaagagataacggcattaaaaaatgggatctggatcagcaagaactcatccagcagatccctaacgcccataaggattgggtgtgcgctctagcgttcatcccgggcagaccaatgcttctgagtgcctgccgggccggggtgataaaggtgtggaatgtggacaacttcactcccatcggtgagatcaagggccacgattctcctataaatgcaatatgcactaatgcaaaacacatattcacagcctccagcgatctgactgtgaagttttggagcgtgagacggctaccgcacagtgggcctccatag

SEQ ID NO: 121644 - DNA, 4914 bp, Artificial Sequence
  Description of Artificial Sequence: Synthetic coding sequence
atggcggggcagggagattgctgtgtgaaggtggccgtgagaatcagaccacagctaagtaaggagaaaatcgagggttgtcacatctgtacctcggttacccctggagagccgcaggtcttacttggaaaggacaaagctttcacctatgatttcgtgttcgacctggacacatggcaagagcaaatttacagcacctgtgtgagcaagctgatagagggttgttttgaaggatataatgcaaccgtgttggcttacgggcaaaccggtgctggcaagacttatacaatgggaacaggatttgacatggccactagcgaggaggaacagggaataatcccacgggcaattgcacatctgttcggcggcatagcggagcggaaacgccgcgcccaggagcagggcgtagccggcccagagttcaaagtgtctgctcagtttcttgaactttacaatgaggagatacttgatcttttcgacagcactagggatcccgatactaggcacagacgaagcaatatcaaaatccacgaagacgcaaacggtggtatttacactacaggagtgacctctcgcctcatacactcacaagaggagctgatacagtgcctaaagcaaggcgccctgtctcgtactactgcctccacccagatgaatgtccagtcctcaaggtcccacgcgatttttacaattcatttatgccagatgagaatgtgtacacagccagaccttgttaatgaagccgtcacagggcttcccgacggcacgccgccgagcagcgaatatgaaacactcaccgctaagtttcacttcgtggacttggctggttctgagcggttaaagaggacaggagccactggcgaacgagccaaagaagggatatccatcaactgtggtctcctggccctcggaaatgtgatcagcgccctcggcgaccagtctaagaaggtggtgcacgtgccctaccgtgactccaaactgacccgcctgctgcaggactctctcggcggcaactctcagacaattatgatcgcttgtgtttctccgtccgatcgcgattttatggaaacgctaaatactctcaaatacgctaaccgagcgaggaatattaaaaacaaagtagtcgttaaccaggataagacttcccagcaaatctcagctcttcgcgccgaaattgcaagactgcagatggagttgatggagtataaggccggaaaaagagtgattggagaggacggagccgagggctattcagatctcttccgggaaaacgccatgctccagaaggagaacggcgcgctacggctgagggtgaaggcgatgcaggaggctatagacgcgattaacaatagagtgactcagttgatgtctcaggaggcaaacctcctattagcaaaggctggagatgggaatgaggctatcggagccctgatacaaaactatattcgagagattgaggagctgcgcacaaaactgctggagagtgaagcaatgaacgaaagcctgcgcagatcactgtcacgggcctcggccaggtccccctactcccttggcgcttcccccgctgcccccgcctttgggggcagcccagccagctctatggaggacgcgtccgaggttatacggcgcgcaaagcaggatcttgaaagactgaagaagaaagaggtgcgacagagacggaaaagccctgagaaagaggcctttaagaaaagagctaagctgcagcaagaaaactctgaagaaaccgatgaaaatgaagcagaggaagaagaggaagaaagggacgagtccgggtgcgaagaagaggaggggcgcgaggatgaagatgaagacagcggaagtgaggaaagcctggtggactccgactccgacccagaggagaaggaagtcaatttccaagccgaccttgccgatcttacttgtgaaatagagattaagcagaaactcattgacgagttggaaaacagtcaaagacggctccaaacattgaaacatcagtacgaggagaagctgatcctgctgcaaaacaagattcgggacactcaactggaacgggatagagtgttgcagaacctatctaccatggagtgctacaccgaggagaaagcaaataaaatcaaggctgattacgagaagcgccttcgtgagatgaaccgtgatctgcagaaactgcaggccgcccagaaagagcacgcccgcctcctaaaaaatcagagcagatacgagcgcgaactaaagaagttgcaagcggaggttgccgagatgaaaaaggcaaaggtggcccttatgaagcagatgcgggaagaacagcagaggagacgactcgttgagacaaagcgaaaccgcgagatcgcacagctcaagaaagagcagagacgccaagaattccaaattagggcgctggaatctcagaagcgtcaacaggagatggtgctccggcgcaagacccaagaggtaagtgcccttaggagactggccaagcccatgagtgagagggtcgcaggccgggccggcttgaaacctcctatgctagactcaggcgccgaagtctctgcttccacaacctcttccgaggcagagtccggtgcacgtagcgtgtccagtattgtgaggcaatggaatcggaagattaatcattttctgggcgatcatcccgcccctaccgtgaatggaactaggccagcccgcaagaagtttcagaagaaaggggcgtcccaaagcttctccaaggccgcacgactgaagtggcagtcgctggaacgacgaatcattgacattgtcatgcagaggatgaccattgtcaacttggaggcagatatggaacgactcattaagaagcgcgaggagctgtttctgctgcaggaggcactccggagaaaacgcgagagacttcaggcagaatcaccagaagaggaaaaaggtctgcaggagcttgctgaggaaattgaagtcttggcagctaatattgactatataaacgatggcattaccgattgtcaggccaccattgttcagctggaagagaccaaggaagaactggactcgactgacacttctgttgtcatctcttcctgtagccttgccgaggcacggctgttgttggataacttcctgaaagcctccatagacaaggggttacaggtggctcagaaggaagcgcaaatccgccttctggaagggcggctcaggcaaacagacatggccggttcctcacagaaccacctgcttctggacgctctccgcgaaaaagctgaggcccatcctgagctgcaggccctaatctacaatgtgcagcaggagaacggctacgctagtacagatgaagaaatatcagaattctctgaaggatctttcagtcagagcttcactatgaaagggtcaacttcacacgacgattttaagtttaagtctgaacccaagttgtctgcccaaatgaaggccgtgagtgccgagtgccttgggcctccactcgacatatcaactaagaacatcactaaatctcttgcctctctagtggagataaaggaagatggggttgggttctccgtgagagacccctactatagagaccgcgtatcccgaaccgtgtcactgccaacccgcgggagcacctttccccgacagtcaagggcaactgaaacatcaccattaacaagacgtaagagctatgaccgtggccagcctatcagatcaaccgatgttggttttacaccccctagttccccgcccacacgcccccgcaacgaccgcaatgttttttcgcgccttaccagcaaccagtcacaggggagtgccctggataagagtgacgactcagactcctccctgtctgaggtactgagaggtattatctctccggtcggcggagccaagggcgctcgtactgcaccgttacaatgtgtcagtatggccgaggggcacaccaaacctattttatgcttggatgccaccgatgaactactgtttaccggatccaaggataggtcttgcaagatgtggaatctggtaacaggccaggagatcgcagcactcaaaggacatcctaataatgtggtgtcaattaaatactgctcacattcaggattggttttctctgtgagcacaagctatatcaaagtttgggacatccgcgactctgccaagtgcatccggaccttaacatcctctggacaggtcatctccggagatgcatgcgctgctacctccacccgtgctatcacatccgcccagggggaacaccagatcaaccaaattgcactgtccccctccgggacaatgctgtacgcggcctctgggaacgctgttaggatctgggaactttctcgcttccaaccagtggggaaactcactgggcatattggacctgtgatgtgcttaacagtgactcagaccgcttcacagcacgacctcgttgttaccgggtctaaggatcattacgtaaaaatgttcgagctcggggagtgcgtgacaggcacaatcggacccacccataactttgagccgcctcattacgatggcatcgaatgtttggcaattcaaggggacattctgttcagcggatcaagagacaacggcattaagaagtgggacctggaccagcaagagctgatccaacagatcccaaacgcccacaaagactgggtatgcgctttagcattcatccccggtcggcccatgctcctcagcgcctgtcgggctggagtgatcaaagtctggaacgtcgacaactttactccaattggtgagattaagggacacgactcccctatcaacgcgatctgtaccaacgccaagcatatttttaccgcctcatctgattgccgagtgaaattgtggaactatgttccaggtcttaccccatgcctaccaaggcgcgttcttgcaataaaggggagagccactactttgccttag

SEQ ID NO: 121645 - DNA, 4872 bp, Artificial Sequence
  Description of Artificial Sequence: Synthetic coding sequence
atggctggtcagggggattgctgtgtcaaggtagcagtgaggatccgcccccagctgagcaaggagaaaattgaggggtgtcacatttgcacaagtgtgacccctggggaaccccaagtcctgttaggcaaggataaggcttttacgtatgactttgtctttgatctggatacttggcaggagcagatctactccacatgcgtgtctaaactgatcgaaggttgtttcgagggatataacgcaacagtcctcgcctacggccagactggcgctgggaaaacctacacaatggggaccgggttcgacatggccaccagcgaggaggagcagggaattatcccacgcgcgatcgcacacttgtttggaggaatcgcagagcgaaagagacgtgctcaggaacagggggtggccggacctgagttcaaagttagtgcccaatttctagagctgtataatgaagaaattctcgatctgtttgactccactagagatcccgacactcgtcaccgacggtcaaatatcaagattcacgaggatgctaatggaggcatttataccaccggggtcacctcacggctaattcactcccaggaggagcttattcaatgtctgaagcagggcgctctgagtcggaccacagcctctacgcagatgaatgttcagagctctcgatctcacgccattttcacaatccacctctgccaaatgcgaatgtgcactcaacccgacctcgtgaatgaggcagtgaccggtctgcccgacggcaccccgccgtcttccgagtatgagaccttgactgccaagttccactttgttgatctggctgggagcgaacgtctcaagaggaccggggccacaggtgagagggccaaggaggggataagcattaactgtggactgctcgccctcggcaatgttatatctgctctgggggatcagtcaaagaaggtggtgcatgtaccataccgcgactccaagttaacccgcctcttgcaggactctctcggtggcaacagccagaccattatgatcgcttgcgtgtcgcccagcgaccgagacttcatggagaccctgaatactctcaagtacgcgaaccgggccagaaatataaagaacaaggtggtcgtaaaccaggacaagacaagccagcagatatctgctctgagagcggaaattgctcgtctgcaaatggagctgatggagtacaaagccggaaagcgggtgataggtgaagatggggcggagggatatagtgacctcttccgtgaaaatgctatgctacagaaggaaaatggggcattaagactgcgggtgaaggcaatgcaggaggcgatagatgctatcaacaaccgcgtcacgcagttgatgtcccaggaagcaaatctgctccttgccaaggccggcgatgggaacgaagcaattggcgccctcatacagaactacatccgagagattgaggaactacggacgaagcttcttgagagtgaagctatgaacgagagtctcaggcgcagcttgagcagagcgtcagcacgctccccatactcattgggagcctctcctgcagctccagcttttggaggcagccctgcctccagcatggaagacgcttcggaagtcatcagacgggcgaaacaggatctagagcggttaaagaaaaaggaggttcggcagcgacgcaagagccccgaaaaggaggcgtttaagaaacgcgcaaagctgcaacaggaaaatagcgaggagacggacgagaacgaggccgaggaggaagaggaagagagagacgaaagcggttgcgaggaagaggagggccgcgaggatgaagacgaggatagcggttccgaggagagccttgtagactccgacagcgatccggaggaaaaggaggtgaactttcaggcggatcttgcggacttgacctgtgaaattgagattaagcaaaaacttatagacgaattggaaaatagtcagagaaggctgcagactcttaaacatcagtatgaagaaaagctcattctgctgcagaacaagatccgcgacacacagctcgagcgggaccgggtcctgcagaacctctctaccatggagtgctacaccgaggagaaagccaataaaattaaagccgattatgagaaacgattgcgtgagatgaatagggacttacagaagctgcaggccgcccaaaaggagcacgccagactgcttaaaaaccagtcacgctacgaacgtgaactgaagaaactgcaggcagaagttgccgaaatgaagaaagccaaggtcgcactgatgaaacagatgagagaagagcagcagcgcagaaggctggtcgagactaaaaggaatagagagattgcccagcttaaaaaggaacagcgccgccaagaatttcaaatccgagcgctcgaaagtcaaaaacgacaacaggagatggtgttgaggcggaaaacacaggaggtttcagccctccggcggctggcgaaacctatgtctgagcgggtggccggccgcgctggcctgaagcctccaatgctggacagcggggctgaggtcagtgcatccaccacatctagcgaggctgaaagtggcgcccgcagcgttagcagcatcgtccgacagtggaaccggaaaattaatcactttctgggagaccatcccgcccctactgttaatggtactcgccctgcaagaaaaaaatttcagaagaagggcgcatcacagtccttctcaaaagcggcacgcctgaagtggcagtcactggaacggcggatcatagatatcgtcatgcagagaatgacgatagtcaacttggaggctgacatggagcgtcttattaaaaagagggaggagctgttcctgctccaagaagctctgcgccgaaagagggaacgtctgcaggccgaatcgccagaggaggaaaagggcctacaggagctggcggaggagattgaagtgctcgcagccaacattgattacattaacgacggaattacagactgccaggctacaatcgtgcagctggaagagactaaagaagaactggacagcaccgacaccagtgtcgtcatctcaagttgctcactggcagaagcccggttacttctcgacaacttcctgaaggcaagcatcgacaaaggcttacaggtggcacagaaagaagctcagatacgcctgttggaaggccgtctgcgccagacagatatggccggcagctcccagaatcatttgctcctggatgcccttcgagaaaaggccgaggcacacccagaactgcaggccctgatctataatgttcagcaagaaaacggttacgcaagcactgacgaggagatttccgagttctccgaaggcagcttcagccagagtttcacgatgaagggatctacctcacatgacgacttcaagtttaaaagcgaacccaagctgtccgctcaaatgaaggccgtttccgccgagtgcctcgggccgccactcgacattagtaccaagaacatcaccaaatcactagcatctctcgtcgaaattaaggaagatggggtcggctttagtgtgcgggacccctactacagagatcgggtcagcaggaccgtgtcactccctacgagaggatctaccttccctaggcagtccagggctaccgagactagccctttgactagaaggaaatcctatgaccggggccagcccatccgtagtaccgatgtgggctttacccctccctcctcacctccaaccaggcctaggaacgacaggaatgtattttcgcgcctgacatccaatcagtcacaggggagtgccctggataaatcagatgacagtgactcttctctgagcgaagtcttaagagggatcatatcacctgttggaggcgccaagggggctcgcaccgcgccactgcagtgtgtatctatggcagagggccatacaaagcccatcctgtgtttggatgccactgacgagctactgttcaccggctccaaagacagaagttgtaaaatgtggaaccttgtgactggccaagagatcgccgccctgaagggccaccccaataacgtcgtgtcaataaaatactgctcacactctggcctcgtgttctctgtgagcactagttacataaaggtgtgggacattcgcgactctgcgaagtgtatacggacactaacctcatctgggcaagtaatctcgggggacgcctgcgccgcaactagcacccgggctataacttccgcacagggagaacaccagatcaatcagatcgcactgtccccttccggaactatgctctatgcggcttcgggaaatgctgttcggatctgggagcttagtcgattccagcctgtggggaagctgactggtcacattggcccagtgatgtgtctgactgtgactcagacagcttcccagcacgatctggtggtgaccgggtctaaggatcactatgtgaaaatgttcgaactgggtgagtgcgttacaggaaccatcgggccaacgcacaacttcgaaccgccacattatgacggcatagagtgcctggccattcagggtgatattctgtttagcggctcaagggacaacggcatcaaaaaatgggatctggaccagcaggaactgatacagcaaatccctaacgctcacaaggattgggtgtgtgctctggcgttcatacccgggcggcccatgctcttaagtgcatgccgggccggggtgataaaggtatggaacgttgacaactttacccctattggggagataaaggggcatgactcacccataaatgccatttgcaccaacgctaagcacatctttaccgccagctcggatttgaccgtgaagttttggtcggtacgcaggctcccgcactcaggtcccccttag

SEQ ID NO: 121646 - DNA, 5007 bp, Artificial Sequence
  Description of Artificial Sequence: Synthetic coding sequence
atggcaggccagggtgactgctgtgtcaaggtggcggtccgcatacgaccacagctgagcaaggagaaaatcgaaggctgccacatctgcaccagcgtgactcctggggaaccacaagttctgctcgggaaggacaaggcctttacatacgattttgtgttcgacctggacacctggcaagagcagatttactcgacatgcgtgagtaagctgatcgaaggctgctttgagggatataacgccacagtactggcgtacggccagacaggcgctgggaagacctatacaatgggcacaggatttgacatggccacctcggaagaggaacaaggtatcatcccccgcgctatagcacatctctttggagggatcgccgaacggaagcgacgcgcacaggagcaaggtgtggccgggccagagtttaaggttagtgctcagtttctagagctctataacgaggaaattctcgatctgtttgattcaacacgggaccccgatacacggcatcggcggagtaatattaagattcacgaagatgcaaatggcggaatctacactaccggagtgacgagtcggctgattcactcccaggaagaactcattcagtgtctcaagcagggcgccctgagccggaccaccgcatctacacagatgaacgtccaatcatcccgcagccatgcaatcttcacaatccatctgtgccagatgcgcatgtgcacccagccagacctggtaaatgaggcagttaccggcctccctgatggcactcctccctcctctgagtacgaaacattgacggccaagttccacttcgtggatctggccgggagcgagcgcttaaagaggactggcgctacgggggagagggccaaggaagggatttccattaattgtggactactagctttggggaatgttatttcagcgctgggagaccagtcgaagaaagtggtacacgtaccttatagagatagcaagttgacccggctgctgcaggactcgttaggcggcaattcccaaacaatcatgattgcatgtgtgtcccctagcgacagggactttatggaaaccctaaatactctgaagtacgccaacagagccagaaacatcaagaacaaagtggttgtgaatcaggacaagacgtctcaacagatctctgctctgcgggccgagatcgcccggttacagatggaactcatggagtataaggctggcaaaagggtcataggtgaagacggggcggagggatactccgaccttttccgcgagaacgccatgcttcagaaggagaatggagcattaaggctgagagtcaaagccatgcaggaggccattgatgcgataaacaaccgcgtaactcagttgatgtctcaggaggcaaatctcttattagccaaggcaggcgatggcaacgaagcaattggcgctttgattcagaattatattagagagatcgaagagctccgcacaaagctactggagagcgaagccatgaacgagtctctgcgcaggtcccttagtagggcatccgccaggtcaccgtactcgctgggggcgtctcctgccgcccctgctttcgggggctcaccggcctcatcaatggaggatgcatcagaggtgattagaagagctaaacaggacttggagagattaaagaagaaagaggtgcgacagcgcaggaaatcccccgaaaaggaggcattcaaaaaacgggcgaaattacagcaggagaatagcgaagaaaccgacgagaacgaggcagaggaggaagaagaggagcgggacgagagcggctgcgaggaggaggaaggaagagaagatgaagacgaggactccggatctgaggaatccctggtcgattcagactccgatcccgaggaaaaggaagtaaactttcaagctgatctggcggatctgacctgcgagattgaaattaagcagaaattgattgatgaactggaaaattcccagaggcggcttcaaaccctcaaacaccaatatgaggagaaactaattctgctgcaaaacaaaatccgcgacacccagctggaacgggatagagtactgcagaatctatccaccatggaatgctatactgaggagaaggctaataaaatcaaggcggactatgagaaaaggctgcgggaaatgaacagggacttacagaagctccaggcagcacaaaaggaacatgcccggctgcttaaaaatcagagtaggtacgaacgtgaactgaagaaactccaggccgaagtggccgagatgaagaaagcaaaggtggctctaatgaaacagatgcgtgaagagcagcagcgtcgccgtctggttgaaaccaagaggaatcgagaaatcgcacaactgaaaaaagaacagcgccgtcaggagttccagattagggcgctagagtcccagaaacgccagcaggagatggtgcttcgcagaaaaacacaggaggtcagcgccttaagacgcctggccaaaccaatgagtgagagggtggccgggagagccggtctcaagccgccaatgctcgatagcggggctgaggtcagtgcctcaacaacttcaagtgaagccgagtctggcgcaaggagtgtgtcctctatagtgcgtcagtggaatcggaagatcaaccacttcctcggcgaccatccagctcctaccgtcaatggtactcggccggcacgcaaaaaattccagaagaaaggagcctctcagtctttcagtaaagccgccaggctgaagtggcaatcgttggagcgtaggattattgacatcgtgatgcaacggatgactatcgttaacctcgaagcagatatggagagattgattaaaaaacgggaggaactcttcctcctgcaggaggcactgcgtagaaaacgggagagactgcaggcagagagtccggaagaagagaaaggtctgcaagaacttgccgaggaaatcgaggtgttggcagcgaacatcgattatattaatgacggcatcaccgattgccaggctacaattgtgcaactggaagagaccaaagaggagttggatagcacagacacgtctgttgtgatttcctcatgctcactggcagaggcccgcctgctgctggataactttctaaaggcctcaatagacaaaggtctgcaagtggcccagaaagaagctcagatccggcttctcgagggacggctccggcaaaccgacatggcaggctcctcccagaaccacttgctgcttgacgccctcagggaaaaggctgaggctcaccccgaacttcaggccctaatctataatgtccagcaggaaaatgggtacgcatctacggatgaggagatctccgaattttccgagggctctttctcccagtcctttacaatgaaaggctcgacctcccacgacgatttcaaattcaaaagtgagccaaagttgtccgcacagatgaaagctgtatcggccgagtgcctggggccaccactggatattagcacgaaaaacattaccaaaagcctggcttccctggtcgagattaaagaggacggtgtggggttctcggtgcgggatccctactatcgagatcgggtgtcccgcaccgtgtctttgccaaccagaggcagcacctttcccaggcagtctagagccacggaaacaagcccattaactaggcgaaagtcctacgatagaggacagccaataaggtcaacggacgtcggttttactccaccctcatccccccccacgcgcccccggaacgacagaaatgtgttcagccgcttgacatcgaatcagtcccagggaagtgcattggacaaatccgacgactccgatagtagcctttctgaagttctgcgagggattatctcgcctgtgggtggcgccaagggtgccagaaccgcacctctgcagtgcgtgtcaatggcggaagggcacacaaagccaattctgtgtcttgatgccactgacgaacttctgttcaccggctctaaagatagatcgtgcaaaatgtggaacttggtgaccggccaggagatcgccgccttaaagggacacccaaacaacgtcgtatctatcaaatattgttcacactccggcctggtgtttagcgtgtctacttcttatatcaaagtttgggatattcgtgatagtgcgaaatgtatccggacactgacctcatccggacaggtcatatctggggacgcatgtgcagcgacatcaacgcgggcaattacttccgcccagggcgagcatcagatcaaccagatcgcactttccccctcaggcaccatgctgtacgcagcatccggaaatgcggtgcggatctgggagctaagtcggttccaacccgtggggaaactgacgggccatatcggccctgtgatgtgcctgaccgtcacccagaccgccagtcaacacgacctggtagtcaccggtagtaaagatcactacgttaagatgtttgaactgggggaatgcgttacaggtaccatcggaccaactcataacttcgagcctcctcactatgatggaatcgaatgtttggccatccaaggagatattctcttttctggctcacgggataacgggatcaagaagtgggacctggaccagcaggaactgattcagcagatccccaacgcacacaaggattgggtgtgcgccttggccttcatcccgggtcgcccgatgctgctgagcgcctgtcgggctggagtgattaaggtgtggaatgtcgataattttacaccaattggggagataaagggtcacgactctccgattaatgccatctgcacaaatgcaaaacacatatttaccgcttcatcagactgcagagtaaaattgtggaattatgtccccggcctgaccccttgcctgcctaggcgggtgctggctatcaaaggaagggccacgacttgccctgatccaccacagctgtccctgagtcctttaagtttcttccccagtttcttgttccccctcttcccccactttgacctgagctgcttcctcacctag

SEQ ID NO: 121647 - DNA, 1998 bp, Artificial Sequence
  Description of Artificial Sequence: Synthetic coding sequence
atggccgctggtgggtcgacccaacagaggcgaagggaaatggctgccgcttcagcggcagccatctcaggcgccggccgatgtagactttctaagataggtgccacgagaaggccccctcccgccagagttagagtggcggtgcgcctcaggccctttgtcgacgggaccgccggggcctcagacccaccctgtgttagggggatggacagttgctccctggagatcgcgaactggcgaaaccatcaggaaaccctcaagtatcagtttgacgccttctacggcgaacgtagtacacaacaggatatttacgccggcagcgtgcagccaatcctccgccatctgctggagggacagaacgctagtgtcctcgcctacggccccaccggcgctggcaaaacacacactatgctgggaagccctgaacagcccggggtgatcccccgcgcactaatggacctcctgcagctgacacgcgaagaaggggcagagggccgaccctgggcgctgtccgtaacaatgtcctaccttgagatctaccaagagaaagtcctcgatctcctggacccagcatccggcgacttagtgataagagaagattgtaggggtaacatcctcattcctggccttagtcaaaagccaatctctagttttgcagactttgagaggcatttccttcccgcctccaggaacagaacggtgggagctactaggctgaatcagaggtcgagcagaagccacgcagttctgctggtaaaagtcgaccagagggaacggttggctccattccgccaacgtgaaggaaaactctatctgatagatcttgctggttctgaggacaaccggcggactggcaacaaaggtctgcgcctcaaagagagcggcgcaatcaacacaagtctgttcgtgttgggcaaagtggtcgacgcgctgaatcagggcctccctcgcgtgccctatcgcgattctaagctcacaaggctcctgcaggactctctggggggtagtgctcatagtatcctgatagccaatattgcgcctgagagacggttctacctggatacggtatcagcccttaacttcgccgctagaagcaaagaagtcataaaccgcccctttaccaacgagtcactgcaaccacacgcccttggccccgtaaagctgtcccaaaaagagctgcttggccctccagaagcaaagagagcccgcgggccagaggaggaggagatagggtcaccggaacctatggctgctccagcctctgccagccagaagcttagccctcttcaaaagctaagttctatggatcccgcgatgctagagagattactgtccctggatagattgcttgcgtcacagggctcacagggtgcaccactgcttagcacacctaaacgtgagaggatggtcctgatgaagacagtggaggagaaggatctggaaatcgaaagattaaagaccaaacagaaagagctggaggccaagatgctggctcaaaaagccgaagagaaagaaaatcactgcccaaccatgctgagacccctctcccatcggaccgttactggcgctaaacctttgaaaaaggcggtggtcatgccattgcagctgatccaggaacaagccgcctccccaaatgctgagatacatatcctgaagaataaaggtagaaagaggaaattggagtccctggatgctctggaaccagaagagaaggctgaagattgctgggagctgcaaatcagccccgagttactggctcacggcagacaaaaaatactggacctgttgaatgaaggaagtgcccgagacctgaggtctctccagcgtatcggaccaaaaaaggcgcagttgatcgtcgggtggagagagctccacgggcccttctctcaggtagaggatctggagagagtcgagggcatcacaggcaaacaaatggagagcttcctgaaggccaacattctgggcttggccgctggtcagaggtgtggggcctcctag

SEQ ID NO: 121648 - DNA, 219 bp, Artificial Sequence
  Description of Artificial Sequence: Synthetic coding sequence
atgctggcccaaaaagctgaggagaaagaaaaccattgcccgactatgcttcgacccctatcgcacaggacagtgacgggtgcgaaacctctgaaaaaggctgttgtgatgcctttgcagcttattcaggaacaagctgcttcccctaatgctgaaatccacatcctcaaaaataaaggtcgaaaaaggaaaggcgcaaacattactaccgggtactag

SEQ ID NO: 121649 - DNA, 1794 bp, Artificial Sequence
  Description of Artificial Sequence: Synthetic coding sequence
atggacagctgcagtcttgagatcgccaattggcggaatcaccaagaaacattaaagtaccagtttgatgctttttacggagagagatccacccaacaagatatttacgccggctccgtgcaacccatactgcggcacctgttagaaggccagaacgctagtgtcctcgcttatggcccaaccggtgctggcaagacacatacaatgcttggcagccctgagcagccaggtgtgattcctcgggctctcatggacctgctgcaactgaccagagaggagggcgctgagggacgaccatgggccttgagcgtaaccatgagttacctggaaatctaccaggaaaaagtcttggacctgctggatcctgcgtccggagacctggtcatacgggaggattgcaggggtaatatccttatacctggcttgtcccaaaaaccaattagctcttttgccgattttgaaaggcactttcttcccgccagtcgtaacaggaccgtgggtgctacacggctcaaccaacgctccagcagaagccatgccgttcttctagttaaggttgaccagagggagcgcctggctcccttccggcagcgtgagggcaagctatacctgatagatctggctggatctgaggataaccgcagaacaggtaataaagggctacgcctgaaagagagcggggcaataaacacctcactgttcgtgcttggtaaggtcgttgacgccctaaaccagggattgccccgcgtgccgtatagagactcaaaactcactagattgctgcaagactcactggggggatcagcacatagcatattgattgccaacatagcccctgagaggcgcttttacctggacaccgttagcgctctgaacttcgcagcccgcagcaaggaggtcatcaatagacccttcactaatgaatcattgcagcctcatgctctgggccctgtaaaactgagtcagaaggaactcctcgggccccctgaggccaagagagccaggggccctgaggaggaggagataggttcgcctgaaccgatggctgcacccgccagtgcttcccagaagctgagccctttgcagaaactctcttccatggatcctgccatgctcgagagactgctgtctctggatcggctgcttgcgtcacaggggtcacagggggcacccctgctgagtacccctaaaagggagaggatggtgctgatgaaaaccgtcgaagagaaggacctggaaatagaaagactgaaaaccaaacaaaaagaactggaggctaagatgctggcccaaaaggccgaggagaaagaaaaccactgtcccacaatgctcaggccgctgtctcatagaaccgtcaccggagctaagccactcaaaaaagccgtggtgatgccactccagctgatccaggagcaggccgcttctccgaacgccgagatacatattctgaaaaataaaggccggaagaggaaactcgaaagcctggacgccctcgaacctgaggagaaggcggaagattgctgggagctgcaaatttcccccgagctgctggcacacggcagacagaaaatcttggatctgttgaacgaaggtagcgctagggatctgagaagcctgcaacgcatcgggccaaagaaagcccaactcatagtgggttggcgcgaactgcacggccccttcagccaggtggaggacctggaacgagtggaaggcataacagggaaacaaatggaatcgttccttaaggccaatattttagggctggccgctggacagaggtgtggagccagctag

SEQ ID NO: 121650 - DNA, 1794 bp, Artificial Sequence
  Description of Artificial Sequence: Synthetic coding sequence
atggacagttgtagtcttgagatagccaactggcgtaaccaccaggaaactctgaagtatcagtttgacgctttctatggggaacgatcaacccagcaagacatctacgccggttccgtgcagccaattttgcgacatttgctagaaggacagaacgcctctgtgctcgcgtatggacccacgggtgctggcaagacccacaccatgctgggctcgcccgagcagcctggggttattcctcgagccctgatggatctgttacaactgactagagaggagggcgcagagggccggccttgggcgctgtccgtgactatgagctatctggaaatctaccaggaaaaggtgctggacctccttgatcccgcaagtggggatttagttatcagggaggattgcagaggtaatattctgatcccaggtctctctcaaaaaccaatctctagtttcgccgacttcgagagacactttctccctgccagtcggaatcggaccgtgggcgcgacacggcttaaccaacggtcatcccggtcccacgccgtgttgctcgtcaaagtggatcagagagagaggttggcgcctttccggcagcgggaagggaaattatacctcattgacctggctggctccgaagataatcgtaggacgggtaacaagggactcagacttaaggagtccggcgccatcaatacatcattgttcgtgctgggcaaggtggttgacgcgctcaaccaagggctcccacgcgtgccatacagagatagtaagctgacccgtttactccaagactcactgggtgggtcagctcattccatcctgattgccaatattgcacctgagcggcgtttttacctggatactgtgagtgccctcaattttgctgccaggtcaaaggaggtgatcaatagaccttttaccaatgagtctctgcagccccacgccctgggtcctgtgaaactctctcagaaagaactcttgggtccccccgaggcaaagagagctcgcggacccgaagaggaggaaattggctccccagagccaatggctgcccctgcaagtgcgtcacagaagctgtcaccactgcagaaattgtcttcgatggatccggctatgcttgagaggcttttgtccctggacagactgctggctagccagggttcgcaaggcgctccattgctgagcacacccaaacgggaaagaatggtgctcatgaagaccgtggaggagaaggatctcgaaattgaaagactgaagactaaacagaaagagcttgaggcaaagatgctggcccagaaagcggaggagaaggagaatcactgtccgacaatgctccgcccactctcccacaggaccgtgactggcgccaagccactgaagaaggctgttgtgatgcctcttcagctgattcaggagcaggcagcgtcaccaaacgcggagatacacatcctgaagaataaaggacggaagaggaaactcgagagccttgatgctctggaacctgaagagaaagccgaagattgctgggaactgcagatcagcccagaactgttagcccatggccgccaaaagatcctagacttattgaatgaggggtccgcacgcgacctgcggagcctgcagagaatcggtcctaagaaggcgcagttgatcgtcgggtggcgagaactacacggacctttttcacaggtggaagacctggagcgggtggagggcatcaccggaaaacaaatggaaagctttctcaaagccaatatactgggcctagcagccgggcaaaggtgcggcgcatcgtag

SEQ ID NO: 121651 - DNA, 2883 bp, Artificial Sequence
  Description of Artificial Sequence: Synthetic coding sequence
atgaagtctgctagggctaagacaccacgaaaacctaccgtgaagaagggctcacagaccaacctcaaagaccccgtcggagtatattgcagggtccggcctctgggatttcccgaccaggaatgttgtattgaagtgattaacaatactaccgttcagcttcacacacctgagggatatcgcctgaatcggaacggtgattataaagaaacgcagtactcattcaagcaagtgttcggcacacatactacacagaaagaattattcgatgttgtcgcaaatcctctcgtaaatgacctgattcatggcaagaacgggctcttatttacctatggcgttaccgggtcaggaaagacccacactatgacaggcagtcctggcgaaggtggcttattgccaagatgcctggacatgatttttaatagcattggcagctttcaggctaaaaggtatgtcttcaagagcaacgacaggaactccatggatatccagtgtgaggtggacgccctcctcgagcgccagaaaagggaagctatgcctaacccaaaaaccagcagctctaagaggcaggtggatccagaatttgccgacatgatcacggtccaggagttttgcaaggccgaggaggttgacgaagacagcgtgtatggtgtgttcgtaagctacatcgagatctataacaattatatctatgacctcctggaagaggtgcccttcgaccccattaagccaaaacctcctcagagcaaattgctgagagaagataaaaaccataatatgtatgtggcaggttgtactgaggtcgaagttaagtcgacggaggaggccttcgaggtgttttggaggggacagaaaaaacgtcgaatcgccaatactcatctcaatcgtgaaagtagtcggtctcactcagtgttcaacatcaagcttgtgcaggccccgctggacgccgacggcgataatgtgctgcaggagaaagagcagatcaccatttcccagcttagccttgtcgacctggcaggatctgagcgcactaatcgcacaagggcagaaggcaaccggctgcgcgaggccggaaacatcaaccagtccttgatgacactccgaacttgcatggacgtattgagggagaatcagatgtatggtaccaataagatggtcccctacagggacagtaagctgacacatctgttcaagaactactttgatggggagggaaaggtgcgcatgatcgtgtgtgtcaacccgaaggcagaggactacgaagagaatctgcaggttatgagattcgctgaggttacccaggaggtcgaagtggcgcgcccagtcgataaggccatatgcggactgacccccggccgacggtatcggaaccagcctagagggcctgtcggcaatgagcctctcgtcactgacgtggttcttcagtcatttcctccgttgccatcgtgcgagatactggacattaacgatgagcagaccctgccccgcctgatcgaagcgcttgaaaaacgtcataatttaaggcagatgatgatcgatgagttcaacaagcagtccaacgcttttaaggcactgctgcaagagttcgataacgctgtcctcagcaaggagaatcacatgcagggcaaattaaatgagaaggaaaagatgatttcaggacaaaaactggagatagagagactcgagaagaagaataaaacgctggaatacaagattgaaatcctggagaagaccactaccatctatgaggaggataagcgcaatctgcagcaggaattggagacccagaaccagaagcttcaacgccagttttctgacaaacgccgcttggaggcacgactccagggcatggtcacagagaccacaatgaaatgggaaaaagaatgtgaacgtagggtagccgctaaacagctggaaatgcagaataagttatgggtgaaggatgaaaaactaaagcaacttaaggccattgtgacagagccgaagacagaaaaaccagagcgcccaagccgggaaagagatagggagaaagtgactcaaagatctgtgtcaccttcgccggttccattatcatccaactacattgctcagataagcaacggccagcaactcatgtctcaacctcagcttcataggcgaagtaatagttgctcctccatttccgtggctagttgcatttcagagtgggaacaaaaaatccccacatacaatactccactcaaagtgacatctattgcccgccggcgccagcaggagcccggacaatccaagacatgcatagtctccgaccggcgtcgcggtatgtactggacagaggggagggaagttgttcctaccttccggaacgaaattgagattgaggaagaccactgtgggagactcttgtttcaaccagatcagaatgccccccccattagactgcgccatcggcgtagtcggtcagcgggagaccgctgggtggatcataagccagcctcaaacatgcaaacggagaccgtgatgcaaccccatgtaccacacgccatcactgtgagcgtggccaatgagaaggctctcgctaagtgtgagaaatacatgcttactcatcaggaattagcttccgatggagaaatcgagacaaaactcattaagggggacatttataaaaccaggggaggaggccagtctgtccagttcactgacatagagactttgaagcaggagtcacctaatgggtcgcgtaagcgaagatcgagcacagtagcccccgcgcagcctgatggggcagagtccgaatggactgacgtggagaccaggtgcagcgttgcagtggaaatgagagctgggtctcagttggggccagggtaccagcatcacgcacaacccaaacgtaagaaaccgtag

SEQ ID NO: 121652 - DNA, 2022 bp, Artificial Sequence
  Description of Artificial Sequence: Synthetic coding sequence
atgataaccgtgcaggaattctgtaaggcagaggaagtggacgaggattccgtgtatggggtgtttgtttcttacattgaaatctacaacaactacatatacgatctcctggaagaagtgccttttgatccaattaaacccaagtggaattcatgctcgacaccaatgcgtaacaccgacttcgtacctcctcagagcaaactcctgcgtgaggataaaaaccataacatgtacgtggccggctgcacggaggtggaagttaaaagcacagaggaggcatttgaggttttctggcgaggacagaagaagcgccggattgcaaacacacacttgaatcgggaatcttctaggtcacactctgtctttaatattaagctggtccaagccccgctcgacgctgatggcgacaacgtgctgcaagaaaaagagcagataacaataagccagctcagcctcgtggacctggcaggtagcgagcgtaccaatcgtacgcgtgccgaaggcaatcgcctccgagaagcaggaaatatcaatcagagccttatgacgctgagaacctgcatggacgtacttagggagaatcagatgtatggtacgaataaaatggtgccttaccgagatagcaagctcacgcacttatttaagaactattttgacggagaggggaaggtgagaatgattgtgtgcgttaaccctaaggccgaagattatgaggaaaacctccaggtgatgcgctttgccgaggtgactcaggaggtcgaggtcgccaggcctgtggacaaagcaatctgtggtctgacaccaggcaggcgctaccggaaccaacctcgcggccccgtgggtaatgaacctctagtcactgacgtggtgctgcagtcattcccccccctgccatcttgcgagattctcgacattaatgatgagcaaacactgcccagactgattgaggctctggaaaagcgtcataatttgcggcaaatgatgatagatgagtttaataaacagagtaacgcgtttaaagctctgcttcaggaatttgacaatgccgtacttagcaaggaaaatcacatgcagggaaaattgaacgaaaaagagaaaatgatttctggtcagaagctggagattgagaggcttgagaagaagaataagacgcttgagtacaaaattgaaatcctcgagaagacaacaactatttacgaggaggacaaacgtaacctgcagcaggagctcgagacccaaaatcagaagctgcagcgccagttctcagacaaaaggcgactggaagcccgcctacaggggatggttacggagaccacaatgaagtgggagaaggaatgcgagaggcgggtagcagctaagcaattggagatgcagaacaaactgtgggtcaaggacgagaagctgaaacagctcaaagcgattgtcaccgaaccaaaaaccgagaagccggaacgcccgagcagggagcgcgacagggaaaaagttacccagaggtccgtatccccctctcctgtaccattgttgtttcagccggatcaaaatgcaccaccaatacggctgcggcaccgaaggagcaggagcgccggcgatagatgggtcgatcacaaaccggcctctaatatgcagactgagactgttatgcaacctcatgtgcctcatgcaatcactgtgtcagtcgcgaacgaaaaggcacttgctaagtgtgaaaaatacatgttgacgcatcaagaactggcctccgacggcgaaattgagacgaaattgattaaaggagacatctataaaaccaggggtgggggccagagtgtccagttcacggacatcgagacattaaaacaggaaagccccaacggcagtaggaagcgcagaagctctactgtggcccccgcacagcccgacggggccgagagcgagtggaccgatgttgagacgagatgttctgtagctgtcgaaatgcgggccggcagccagctaggccccgggtaccagcaccacgcccagccgaagcgaaaaaaaccgtag

SEQ ID NO: 121653 - DNA, 2022 bp, Artificial Sequence
  Description of Artificial Sequence: Synthetic coding sequence
atgatcactgtgcaggagttttgcaaggcggaggaggtcgacgaggactccgtctacggtgtattcgtgtcttatatagagatctataacaattatatatacgatctgttggaagaagtcccgttcgatcccattaagcccaaatggaacagctgttccacccccatgaggaatacggatttcgtgcctccgcaatcaaagctgttaagagaagataagaatcacaacatgtacgtggccggatgcacagaagtggaggtgaagagcacagaggaagccttcgaggtgttctggcgcggacagaagaaacgaaggatcgccaacactcacttgaaccgggaaagcagccgaagccactccgtcttcaatattaagctcgtccaggctccactggacgctgacggggacaatgtgcttcaggaaaaagagcagataactatttcccagctctctcttgtggacctcgccgggtccgagcggactaaccgaacacgcgctgagggtaatcgtctccgcgaggccggaaacattaatcagtccctaatgacactcagaacttgcatggacgtgttaagagaaaatcagatgtacgggaccaataaaatggtgccctatcgggatagcaaattaactcatctatttaaaaattatttcgatggggagggaaaggtgcggatgattgtgtgcgtgaaccccaaggctgaggactatgaggagaatttgcaggtcatgcgcttcgctgaggtcacccaagaggtcgaggtcgctcgacctgtggacaaggccatctgtggcctgactcctggaagaagatatcgtaatcagccgagaggccccgtgggcaacgagcctctcgtgactgacgtggtgctgcagtctttcccccccctgccatcctgcgagattctagatatcaatgacgagcagactttgccccgcctaatcgaagccctggagaagagacacaacctccgtcagatgatgatcgacgagtttaacaagcaatcgaacgcttttaaggcattactgcaggaattcgataatgcggtattgagtaaggagaatcatatgcaggggaaactcaatgagaaagagaagatgatttccggacaaaagttggagatcgaaaggctggaaaaaaagaacaagactctggagtataagatcgagattctggaaaagacaacaacgatctatgaggaggacaaaaggaacttacaacaggaattggaaactcagaaccaaaaactacaaaggcagtttagcgacaaacgcaggctggaagcgcgattacaaggcatggttactgaaactactatgaagtgggagaaagaatgtgaacgccgagtcgcggccaaacagctcgaaatgcagaataagttgtgggttaaggacgagaaactgaagcaactcaaggcaattgtcaccgagccaaaaactgagaaaccagaacgtccgagcagggagagagacagagagaaggtgactcagaggagcgtgtcaccaagccctgttcctttactgttccaacctgaccaaaacgcccctccaattcgcctccgacatcggaggtctcgctccgccggggatcgttgggtcgaccataagccagcctccaatatgcagacagagaccgtaatgcagccgcacgtaccccatgctattactgtaagcgtggccaatgagaaggccctggccaagtgcgagaaatacatgctcacacaccaggaattggcctccgacggggagattgaaacaaagcttataaagggggacatctacaagacaagggggggcggccagtccgtccagttcaccgacatcgagaccttgaaacaggaaagtcccaatggctcccgcaaacgacggtctagcactgtggctcctgcacagccagatggtgctgaaagtgaatggaccgatgttgaaactaggtgctcagtcgctgtggaaatgagagctggatcacagttgggccctggttaccaacaccacgcgcaacccaagcgaaaaaagccatag

SEQ ID NO: 121654 - DNA, 2571 bp, Artificial Sequence
  Description of Artificial Sequence: Synthetic coding sequence
atgaaaagcgcccgtgccaagacccccaggaagccaaccgtgaaaaagggctctcagactaatttaaaagatcccgtgggtgtctactgtagagtgagaccgttgggtttccctgatcaggagtgctgtatcgaagttatcaacaacacaactgtgcagcttcacacacccgaaggataccggctgaacagaaacggggactacaaggaaactcaatatagcttcaaacaagtgttcggtacacatacaacacagaaggaattgtttgatgtagtagctaaccccctggtgaacgatctcattcacggcaagaatggcctactgttcacctatggagtcacgggatcagggaagacccacaccatgactggaagcccgggagaaggtggactcctacctcgatgtctggacatgatctttaatagcattggctcatttcaggccaaacgctacgtctttaagagcaatgacaggaattcaatggacattcagtgtgaggtcgatgcgttactggaaaggcagaagagagaagcgatgccaaatcccaaaacaagctcatcgaagcgtcaggtggaccctgaatttgcagatatgattacagttcaggaattttgcaaagctgaagaagtggacgaagactctgtgtatggagtattcgtttcctacatcgagatctacaataattatatttacgacctgttagaggaggttccatttgaccctatcaaaccgaaaccgccccagtccaaactgctcagggaagataaaaatcacaatatgtatgtggcagggtgtaccgaggtcgaggtaaagagcactgaggaggcgttcgaggttttttggcggggacagaagaagagaaggattgcgaatacccacctgaatagggagagctctcggtctcattccgttttcaatatcaagctggtgcaagctccgctcgacgcagatggcgacaacgtgctgcaagaaaaggaacagattaccatttctcagctaagcctggtcgatctggctggttctgaacggacaaacagaacacgggccgaggggaaccgtctccgcgaggctggaaacattaaccagagcctcatgacactgcggacctgtatggatgtgctccgggaaaaccagatgtatggaactaataaaatggtgccgtacagagattccaagctcacccacttgtttaagaactattttgacggtgaaggcaaggttcgcatgattgtctgtgtgaatccaaaagccgaggactatgaggagaatctccaggtgatgcggtttgccgaggtcacacaggaggtggaggtggcccgccctgtggacaaggccatatgcgggctgactcctggcaggcgctaccgaaatcagcccagagggcccgtcgggaacgaacctctggtaactgacgtcgtcctacagagcttccccccactccctagctgcgagatcctagacatcaatgacgagcagactctgccgcgtctcattgaagccctcgagaagcggcacaaccttcggcagatgatgattgacgagtttaacaagcagtctaacgccttcaaggcactgctccaagagttcgacaatgccgtactctccaaggaaaaccatatgcagggcaagcttaatgagaaggaaaaaatgatttccggacaaaagctggagattgaacgcctcgagaagaaaaataaaactttggagtacaaaatagagatactggagaagaccacgacaatttacgaggaagataagcgaaatttgcagcaggaattggagacgcaaaatcagaaacttcaaaggcagttctctgataagcgacggctggaagcaaggcttcaggggatggtcactgaaactacaatgaagtgggagaaagagtgcgaaaggcgcgtggcagccaagcagctggagatgcagaacaagctgtgggtgaaggacgagaagcttaagcagctgaaagccatcgtgacagaaccgaaaaccgaaaaacctgaaagaccctcaagagagagagaccgggaaaaagttactcagcgctccgtcagtcctagcccggttcccttactgttccagcccgaccaaaacgccccaccaatccggctgcgccacaggcggagtcgaagtgcaggcgatcgttgggtggatcataaacctgcctcaaatatgcaaactgagactgtgatgcagccccacgtgccacatgccattacagtaagtgtggcaaacgaaaaggccctggccaaatgcgagaagtacatgctgactcatcaggagctggcctcggatggtgaaatcgagactaaactcattaaaggagacatctacaagaccaggggagggggtcagagtgtccaatttaccgatatcgagacactaaagcaggaatcccctaatgggagcagaaaaagacgcagctctaccgtggcccccgcccaacccgatggggcggaaagcgagtggacagatgtggagacccgctgctccgtggcggtcgagatgcgagcagggagtcaactggggccgggataccagcatcacgcacagcccaaaaggaagaagccatag

SEQ ID NO: 121655 - DNA, 2520 bp, Artificial Sequence
  Description of Artificial Sequence: Synthetic coding sequence
atgaccggatctccaggcgaggggggtctgctccctagatgcctcgatatgatttttaattccatcggaagcttccaagccaaaagatatgtgtttaagtcaaacgatcggaatagcatggatattcagtgcgaggttgacgccttgctggaaagacagaaacgggaggccatgcccaatcctaagacttcctcaagcaagcgccaggtcgacccagagtttgcagacatgattaccgtgcaggagttctgtaaggccgaggaggtggatgaggatagtgtgtatggggtttttgtgtcgtacatcgagatctataacaattatatttatgatctcctggaagaagtcccattcgatcctattaagccaaagcccccgcagagcaagctgctgagggaggacaagaatcacaatatgtacgtagccggttgcactgaggttgaggtaaaaagcactgaggaagcgtttgaggtgttctggcggggacagaagaagaggcgcattgccaatacccatctgaatagggaaagcagtcgcagccatagtgtgttcaacattaagctggttcaggctcctcttgatgctgacggggacaacgtactgcaggaaaaggaacaaattacaataagccagctgtcactggtcgacttggccggttccgagcgcaccaaccgaactagggcagagggaaatcggctgcgagaggctggcaatattaaccaaagcctgatgaccttgagaacctgtatggacgtgcttagggagaaccaaatgtacggaacgaacaaaatggttccttacagagacagcaagctgacacaccttttcaagaactacttcgacggcgagggtaaagtgcggatgatagtttgcgtgaatcctaaggctgaggattacgaagaaaacctgcaagttatgcgcttcgcagaggtgacccaggaggtggaagtagcaagaccggtggataaagcaatttgcggtttaacacctggaaggcggtaccgcaaccaaccgcgtggccccgtcgggaatgagccccttgtcacggatgtggtgttacagtcttttccacccttaccatcttgtgagattttggacattaacgacgaacaaacattaccacggctaatcgaggccctcgagaaacgccacaatctgcggcaaatgatgatagatgagttcaataagcaatctaacgcattcaaagcgctgctgcaagaattcgataacgccgtcctgtctaaggagaaccatatgcagggcaaattgaatgagaaagagaagatgatctcagggcaaaagctggagatcgaaagactggaaaagaaaaacaagaccctcgaatacaagatcgaaatcctagagaaaaccactacaatatatgaggaggataaaagaaacctgcagcaggaattagaaacacaaaaccaaaagctgcaaaggcagtttagcgataaaaggcgtttagaggcaagacttcagggaatggtcacagaaaccacaatgaagtgggagaaggaatgtgaaagacgggttgccgcaaagcagctcgaaatgcagaacaaactgtgggtgaaagacgagaagctgaagcagctgaaggctatcgtcactgagcccaaaacggagaaaccggaacgcccttccagggagagggatcgcgaaaaagttacccagcgaagtgtatctccatccccagttcctctgtcttcaaactacatagctcagattagcaacggccagcagttgatgagccagcctcaactgcataggcgctctaactcatgctcttctatcagcgtggccagttgtatttcggaatgggagcaaaagatcccaacatacaacacccccctcaaggtaaccagcatcgccagacggaggcagcaggagccgggacaatctaagacgtgcattgtgtcagaccgtcgccgtgggatgtattggactgagggacgagaggtggtgccgacattccgcaacgaaatcgaaatcgaggaggaccattgcggacggctgttgttccagcctgaccaaaacgcaccccccattcggctgcgtcaccgaaggtccaggagcgctggtgacagatgggtggaccataagccagcttccaacatgcaaacagagaccgtgatgcagccccatgtcccgcacgctatcaccgtgtcggtggcaaacgaaaaagcgctggcaaaatgcgagaaatatatgctcacgcaccaagaacttgcaagcgatggggagattgagacgaagctgatcaaaggcgacatttataagacgcgaggcggcgggcaatcagtgcagttcaccgatattgaaaccctgaaacaggagagcccgaacggcagcagaaagagacggtcgtcaacagtcgcacccgcacagccagatggcgctgaaagcgagtggaccgacgtggagacacgctgcagcgtcgcggtggagatgcgcgcaggatcacaattgggtccaggttatcagcaccacgcacagcctaaaaggaagaaaccttag

SEQ ID NO: 121656 - DNA, 3705 bp, Artificial Sequence
  Description of Artificial Sequence: Synthetic coding sequence
atggccagctggctttacgaatgcttgtgcgaggccgaattagcccagtactactctcactttaccgccctcggcctccaaaaaatcgatgagctcgcaaaaatcactatgaaagattacagcaagctgggcgttcatgacatgaatgatcgaaagcggctgtttcagctgatcaaaattattaagataatgcaggaggaggataaagccgtctctataccagagaggcatctccaaacaagctccctcagaatcaagtctcaggagctgagaagcggcccgagacggcagctgaactttgattctccagctgacaacaaggaccgaaatgccagcaatgacggctttgaaatgtgctctttgtctgacttttccgcaaacgaacagaaaagcacctatttgaaggtgctggagcatatgctgccagatgactcacagtatcataccaagaccgggatcctcaacgcaaccgccggagactcatacgttcaaacggaaatttcaacttccctgttcagccccaattacctgagcgctatactcggagactgcgacatacccattattcaacgtatttctcacgtttctggttataactatggaatcccacatagctgtataaggcaaaatacctctgaaaaacagaacccgtggacggaaatggagaaaatacgagtctgtgtgaggaaacgacctctaggaatgcgggaggttagacggggggagatcaatatcattactgtggaggacaaagaaacattattagtgcacgagaagaaggaagctgtggacctcacccagtacatcctccaggtgatcctgaagggtagtaaggaaaggtctacaggggccaccggggtcaacgctgacagctcccggagtcatgccgtgattcagatccagattaaagattccgctaaacggacttttggcaggatctcctttattgacctggccggctccgagagggcagccgacgctagagacagcgatcgacagaccaaaatggagggtgccgagataaatcagagtctcttagccctgaaagagtgcattcgggctcttgaccaggagcacactcatacgcctttccggcagtcgaagctgacccaagttctgaaggacagctttatcggaaatgccaagacctgtatgatagcaaatataagcccatcacacgtcgcaacagaacatacattgaacactctgcggtacgccgacagggttaaggaactaaagaaagggataaagtgttgtacctctgtaaccagtagaaatcggaccagcgggaactcttcccctaagcgtattcaaagttctccgggcgccttgagtgaggacaaatgttcacctaagaaagtgaagttaggattccagcagagcctgacagtggccgcacctggctctacaagggggaaagttcatccactgacctcccaccctcctaacattccctttacctcagcccccaaggtgtcaggcaagagaggtgggtctcgcggatcaccctcgcaggagtgggtaatccacgcctctcccgtgaagggtacggtgcggtccggccacgttgcgaaaaaaaagccagaggaaagtgctcccctttgcagcgaaaaaaaccggatggggaataagactgttctgggttgggagagcagagcctccgggcccggcgaagggttagtcagaggtaagttatctaccaagtgtaagaaagtgcagaccgtgcagcctgtgcagaagcagctggtgtcaagagtggaactgagcttcgggaatgcccaccacagagccgagtacagtcaggattcacagcgaggcactcccgcccgtcccgcttccgaagcttggaccaatatcccgccacatcagaaggagagagaggagcatctgcgcttttatcatcagcagttccagcagccccctttgctgcagcagaaactaaagtatcagccgctcaaaagatcacttagacagtataggccgcccgagggtcagttaaccaacgaaacaccacccttgttccactcatatagtgagaaccacgatggtgctcaggtagaggaacttgatgattccgatttctctgaggatagtttctctcacatttcgagtcagagggcaaccaagcagcgaaacactctggagaactccgaggacagcttttttctacaccaaacctgggggcagggtcccgaaaagcaggtcgccgagagacaacagagcctgttctccagtccccgaactggggacaagaaggatctaacgaagtcttgggtggacagtagggatcctattaatcaccggcgggcggcgctggatcattcttgttcccccagtaaaggaccggtggactggtcacgagagaattccacaagttccggcccatctcccagggactcgctggctgagaaaccatactgttcccaggtagacttcatataccggcaggaaaggggaggaggctcctcgtttgacctgaggaaggatgcctctcaatctgaggtgtccggggagaacgagggtaatctgccgtcgccggaggaggacgggtttactatttcactgtctcatgttgccgtgcccggatcacccgaccaaagggatactgtaactacaccacttcgagaagtctcggcagacggccctatccaggtgaccagtaccgtgaagaacggacatgccgttcctggcgaggacccaagagggcagctggggacacatgccgaatacgccagcgggctcatgagccctctgactatgtctttgctggagaaccccgataatgaaggatctccaccaagcgagcagctcgtgcaggacggcgcgacacactccctggtagccgaatccactggcggacctgtggtgagccacaccgtgccaagcggagatcaagaagcagccctccccgttagcagcgcaacccggcacctgtggctgagctcgtcccccccggacaacaagccagggggtgacctgcccgcattgagtccttctcctatacgacagcaccccgcagataagctccctagtcgcgaagccgatctcggagaggcttgccaatcgcgggagacagttttgttcagtcatgaacacatgggttccgagcagtatgatgcagacgccgaggagacgggactggatggcagttggggttttcctggcaaaccatttaccacaatacacatgggcgtgccacattcaggccctacgctgacaccacggaccgggtcttccgatgtggctgaccaactgtgggcacaggagcgcaaacacccgaccagactggggtggcaagaatttggacttagcaccgatcctattaaattaccatgcaattcagaaaatgtgacctggcttaagcctcgacctatctcccggtgtctggcccggccaagcagccctctcgtgccgagctgctctcctaaaacggctggaacactaaggcaacccaccctggaacaggcacagcaggtggtgattcgggcccaccaagaacagcttgacgaaatggccgagctaggcttcaaagaagagacgctcatgagtcaactggcctctaacgatttcgaagatttcgtgacgcaactagacgaaatcatggtgctcaaaagcaagtgcattcagtctctccggtcccagcttcagttatacctcacatgccatgggccgaccgctgcaccagaaggtacagtgccgtcatag

SEQ ID NO: 121657 - DNA, 4107 bp, Artificial Sequence
  Description of Artificial Sequence: Synthetic coding sequence
atggcctcctggttgtatgagtgtctttgcgaagccgagcttgcccagtactattctcatttcactgctctgggtcttcaaaaaattgatgagctcgctaagattacgatgaaggactattccaagttgggcgtccacgatatgaatgataggaaaagactgttccagctgataaagattatcaaaattatgcaggaagaggataaggccgtgtccatccctgaaagacacctgcagacttctagcctgcggatcaaatcccaggaactgcggagcggccctaggcgccagcttaactttgacagtccagccgacaataaagaccggaatgcctctaatgacggctttgaaatgtgttccctgagtgactttagtgccaacgagcaaaaatcaacatacctaaaggtactcgaacacatgctacccgatgactcgcaataccacacgaaaaccggtattctgaacgccaccgccggggacagctatgttcagacagagatcagcacctccctattcagcccaaactatctgtccgcaattcttggggactgtgacattcccattatccagagaattagccatgtgtccggttacaactacggaatcccccattcatgcattcggcagaacacgtcagaaaaacagaacccttggacagaaatggagaagataagggtctgcgtcaggaaacggccattggggatgagagaggtgcgtcgtggggagatcaacataatcacagtggaggataaagagacactgctggtccacgaaaagaaggaggcagtagacttgacccagtatatcctacagcatgttttctacttcgacgaagtgttcggagaggcttgcacaaaccaggacgtatacatgaaaaccactcacccgcttatccagcacatatttaacggaggaaacgccacttgcttcgcatacggccagacaggcgcggggaaaacatatacaatgatcggtacacatgaaaaccccgggctttatgccttggctgcaaaggacatattccgccagctcgaggtgagtcagcctcggaagcacctattcgtgtggatttctttttacgagatatattgcggccagctgtatgacttgctaaaccgcagaaaaaggctctttgcacgcgaagacagtaaacacatggtgcagatagtggggctccaggaacttcaggttgattctgtggagctgctgctcgaggtcattctgaaagggtccaaggagagaagtaccggcgcgaccggcgtcaacgccgactcttctcgttcacacgctgtgatccagattcagatcaaagattctgctaaaagaaccttcggtagaatcagcttcattgacctggccggctctgaaagagccgccgacgcgagagactcagaccggcagacaaagatggaaggggccgagatcaatcaatcactcctggccctgaaagagtgtattagagccctcgaccaggagcatacccatactccctttaggcaaagtaagttgacacaggttcttaaagactccttcattggcaatgcaaagacatgtatgattgccaatatttctccctcacatgtggctacagagcacaccttaaatactctgcgctacgctgaccgggtcaaagagttgaaaaagggaatcaagtgctgcacatctgtcaccagcagaaatagaacttcgggcaatagcagccccaaacgtatccaaagcagcccaggcgcactgagcgaggacaaatgttcccctaagaaagtaaagctggggttccagcaaagccttaccgtggctgcccctggctcaacccggggcaaagttcacccactgaccagccatccacccaacattccatttacgagtgccccgaaggtctccggcaaaagggggggtagccgaggaagcccctcccaagagtgggttattcacgcgagccctgtgaaaggcactgtgcgttccgggcacgtcgcaaaaaagaagcctgaggaaagtgcccccctctgctctgaaaaaaatagaatgggaaataagactgttctagggtgggagagccgggctagcggccctggggaagggctggtgcgcggcaaactgtctaccaagtgtaagaaggtccagaccgtgcagccggtccagaagcaactcgtctcccgagtcgaactgtctttcggaaacgctcatcaccgggcagaatatagtcaggatagccagcggggtacacctgcgcgtcctgcttccgaggcctggactaatatccctccccaccagaaagagcgggaagaacatctaaggttttaccatcagcaattccagcagccaccactgctccagcagaagttaaaataccagccactgaaacggtcccttcgccagtatcgtccacctgagggccagctgactaacgagactccaccgctgtttcattcctattccgagaatcacgacggcgctcaggtggaagaactggatgactccgacttttcagaggattcttttagccacataagcagccagcgcgctacaaaacaacgaaacacactggaaaactcggaggattccttttttttacaccagacctggggccaagggcccgagaaacaagtggccgagcgccagcagtctctcttcagttccccacggaccggggataagaaagatctgaccaaatcttgggtcgactcaagggacccaatcaaccataggcgcgccgcacttgaccattcctgcagcccctcaaagggaccagtggattggagccgagagaattctacatcttccggacctagccctagagattctctcgctgagaagccatattgcagccaagtggattttatataccggcaggaaagggggggagggtcatcatttgatctgaggaaagacgcgtcacagagcgaagtgtcaggtgaaaatgaaggcaatctgccgtctccagaggaggatggatttactatttccctgagccacgttgcagtgccgggctcgcctgatcagagggatacagtgaccacaccactgagggaagtgagtgccgacggacccatccaagtgacctcaaccgttaagaatgggcatgccgtacccggtgaagatccgagaggacagctggggacccacgcagagtatgctagcggcctgatgtcacctctgaccatgagcctgctggagaatcccgataatgagggctcccctcctagtgagcagctggtgcaggatggagcaactcacagcttggtcgccgagtcaacaggaggcccagttgtgtcgcatacagtgccctctggtgaccaagaggccgcacttcctgtaagctccgcgactcggcacctatggctttcatcctcccctcccgataacaagcccgggggtgatctgcctgcattatccccgtccccaattagacaacaccctgccgataaactgcccagccgagaagctgaccttggagaggcctgtcaaagccgtgagactgtgctgtttagtcacgagcacatggggtctgaacagtatgacgcggacgcagaggagaccggcttggatggcagttgggggtttccgggcaagcccttcactacaattcacatgggggttcctcattccgggcctaccctgactcctaggaccggtagctcagacgtcgctgaccagctgtgggctcaagaacggaaacaccccacccggctaggctggcaggagttcgggctgtctaccgatcccattaaactgccctgcaactctgaaaacgtgacatggctaaagcctagacccatttccagatgtctggcacggccatcatcacctctcgtgccatcgtgctcgccgaagacggccggtacactccgccagccaacattggaacaggctcagcaggtggttattcgggcccaccaggaacaattagacgagatggctgagctgggattcaaagaggagacgctcatgagccagctcgcaagcaacgacttcgaagactttgtcacccagctggacgagatcatggtgctgaagtctaagtgcattcaatctctcagatcccagttacaactgtatctgacttgtcacggcccaacggcagcccccgaggggactgttccctcctag

SEQ ID NO: 121658 - DNA, 4107 bp, Artificial Sequence
  Description of Artificial Sequence: Synthetic coding sequence
atggcctcctggctgtatgagtgtttatgtgaagccgagctggcacaatattactctcactttacggccctggggctacagaagatcgatgaactagcaaaaatcactatgaaagactattccaaacttggggtgcacgatatgaatgaccggaagcggcttttccagttgattaaaattatcaaaatcatgcaggaggaggataaagccgtctccatacctgaacgccatctgcagaccagtagcttgcgcattaaatctcaggaacttcgttccgggccccgcagacagctgaactttgattcaccagccgataataaggatagaaacgcctcaaatgatggcttcgagatgtgctccctgtctgactttagcgctaacgagcaaaagtccacatacctgaaagtgctggagcatatgctgcctgacgacagtcagtatcacactaagacgggcatcctgaatgctacagctggtgatagctacgtccaaacagaaatcagtaccagcctgttctcgccgaactacctgtccgccatcctaggcgattgcgatattcccataatacagcgtatctctcacgttagtgggtataattacgggatcccccatagctgtatcagacagaacacctctgaaaagcagaatccttggaccgaaatggagaaaatccgtgtctgtgtgcgaaaaaggccactagggatgagggaagtacgtaggggggagatcaatattatcaccgtggaggataaggaaaccctgctcgtgcacgagaagaaggaggccgtagatctcacccaatatattctccaacatgtgttctactttgacgaggtatttggagaagcctgcactaaccaggatgtgtacatgaagactactcatcctttgatccaacatatttttaacgggggaaacgccacatgtttcgcttacggacaaaccggcgctggaaagacctacactatgataggaactcatgagaatcctgggctatacgcacttgctgcaaaagacattttccgacagctggaagtgtcacagccccggaaacatctgttcgtctggatctcgttctatgaaatctactgtggccagctatacgatctcttgaatcgtcggaagcgcctcttcgcacgcgaagactccaagcatatggtgcagatcgttggtcttcaggagctccaggtcgactccgtggaactgcttcttgaggtgatcctgaaagggtctaaggagaggtccacgggggccactggtgtgaacgcggattcctcccgcagccacgccgtgattcagatacagattaaagatagcgcaaagcgcacgttcggacgcatttctttcatcgacctggcaggatcggagagggccgcagacgcccgagactcggatagacagacaaaaatggagggtgccgagattaaccagtccctgctggctttaaaagagtgcattagagctttagatcaggaacatacacacactccgttccggcaatccaaactgacccaggtgctcaaggactcattcattggcaacgccaagacctgcatgatagccaacataagccccagccacgtggcgactgagcatactctcaacacattaaggtacgctgaccgggttaaggagctcaaaaaggggatcaagtgctgcacatccgtgacctctagaaatcggacatcaggcaacagctcccccaagcgtattcagtcttccccaggagctctatcagaagataaatgttccccaaaaaaagttaagttggggttccaacagtccttgaccgttgcggctcctggttccacgagagggaaagtacatccactcacttcccaccccccaaatataccatttacatccgcccccaaagtttctggcaagaggggaggaagccgaggctcccctagtcaagaatgggtcatccatgcctcccccgtgaaagggaccgtccgatccggccatgtcgcaaagaagaagccagaggagagtgcaccactctgctcagaaaagaaccgaatgggcaataagacggtactcggatgggagtctagggccagcgggcccggggagggtcttgtgcgcggcaagctttccaccaagtgcaaaaaagtccaaactgtgcagccagtccagaagcagctggtctcgagagtggagctgtccttcgggaatgctcaccacagggcagagtattcgcaggactcacaacgaggaaccccagcgcgccccgctagtgaggcatggaccaacatcccaccgcaccaaaaggagcgcgaggaacaccttcgtttttaccaccagcagtttcagcagcctcctctcttacaacagaaattaaagtatcagcccctcaagcgcagcctgaggcagtatcgccctcctgaagggcagctgacaaacgagacacctccactctttcactcctatagcgaaaatcatgatggtgcccaagtcgaggaattagacgactcagacttcagtgaagatagctttagccacattagtagtcagagagccacaaagcagcggaatactcttgaaaactccgaggattcattttttctgcaccaaacctggggccagggacccgagaagcaggtggctgaaagacagcaaagcctcttcagtagccctaggaccggagataagaaagacctgaccaaatcttgggtcgacagcagagacccgattaaccaccgccgggcagccctcgaccattcatgcagtccatccaaaggacctgtggactggtcccgggagaattctactagcagcggccctagcccacgagacagtctggccgaaaagccctattgctcacaggtggatttcatttaccgccaggagcgcgggggagggtcatcttttgacctcaggaaggacgcctctcagagcgaggtcagcggggaaaacgaaggcaatttgcccagcccagaagaggatgggtttaccatttctctatcacatgtcgctgtgccgggctcccctgatcagcgggataccgtcacaactcccctgagagaggtgagcgcagatggcccaatacaggtcaccagcactgtgaaaaatgggcatgccgtgcctggtgaggatcctagaggtcaactcggtactcatgccgagtacgccagcggtctgatgtcacccctgacaatgtccctccttgaaaatcccgataatgaagggagcccgccttccgaacagctggttcaggatggtgccacccattctctcgtagcggagagcaccgggggcccggtcgtgtcccacacggtgccaagcggggaccaagaggctgcccttccagtgtcctccgccacccgccacttatggttgtcctcctctccacctgacaataagccaggtggcgatctgccagcccttagcccaagtccaattcggcagcaccccgctgataaactgccctcaagagaagccgacttgggcgaggcgtgtcagtcgagagaaacggtgctgttcagccatgagcacatgggatctgagcagtacgatgctgacgctgaagaaacaggcctggatggatcatgggggttccctggcaagcctttcaccactatccacatgggagtcccacatagcggaccaacgctaactccacggacgggcagcagcgatgttgctgatcaactatgggctcaggaacgaaagcacccaacccggctgggttggcaggagtttggattgtccaccgatcctattaagttgccatgtaatagcgagaacgttacttggcttaagccaaggcctatttcacggtgcctggctagaccatcctccccgttggtgccctcttgcagtcccaagaccgctggtactctgagacaacccacactagagcaggctcagcaggtagttatacgcgctcaccaggagcagctggacgagatggcagagctcggattcaaggaggagacgctgatgtcacaactagcaagcaacgacttcgaggactttgtgacacagttggatgagatcatggtgcttaagagcaagtgtatccagtctcttcgatcacagttgcaactctacctgacctgtcacggccccacggccgcccctgagggaactgtaccatcatag

SEQ ID NO: 121659 - DNA, 3477 bp, Artificial Sequence
  Description of Artificial Sequence: Synthetic coding sequence
atggctagctggctgtatgagtgtctgtgtgaggccgagctggctcagtactatagccactttacagcattgggtctccagaaaatcgatgaactggcaaagataacgatgaaggactatagtaaattaggagttcatgacatgaacgacagaaaacgcctcttccaactcattaaaatcattaaaattatgcaagaggaagataaagcagtgtccataccagaacggcatctgcagacctctagtctgagaattaaaagccaagagctgagaagtggtccccgtcgccaacttaactttgacagtcccgcagataacaaagaccgtaatgcaagtaacgatgggtttgagatgtgtagtctgtccgatttctccgcaaatgaacagaagtccacttacctcaaagtactggagcatatgctgcctgacgattcccagtatcatacaaaaaccggcatcttaaatgccaccgccggagatagctacgtccagactgaaataagtacttctctgttctcccctaattacctgtctgccattctgggagactgcgacatacccattatacagcgaatttctcatgtaagtggctacaattacggtatcccacacagctgtatccgtcagaatacaagtgaaaaacagaacccatggacagaaatggagaaaatccgcgtgtgcgttcggaagcggcctctgggtatgcgtgaagtgagaagaggcgagataaacattatcaccgtagaagataaagagaccctgcttgtccacgaaaaaaaagaggcagtcgacctaacgcaatacatcttgcagcacgtgttctactttgacgaggtgtttggcgaagcttgcactaatcaggacgtctacatgaaaactacacacccactgatccaacatatttttaatggaggcaatgccacctgctttgcctatggacagacaggtgcaggtaagacctataccatgataggaacccatgagaatccaggcctttatgctctggctgcaaaggatatattcaggcaactggaggtcagtcaaccccggaaacacctctttgtttggattagcttctatgaaatttactgtggacagctctacgatttgctgaaccgtagaaaacgcctgttcgccagagaggatagcaaacacatggtacagattgtcggtctgcaggagctgcaagtggattccgtggagcttctgctggaggtgattctgaaaggttccaaagagcgctccacaggggcgaccggcgtgaacgcagattctagtcgctcacacgccgttatacagatccagatcaaggatagtgcaaaacggacattcgggaggatttcgttcatcgaccttgctggctcggagcgagctgctgacgcaagggattccgatcggcaaacgaagatggagggggctgagataaaccagtccctgctggcactgaaggaatgtattcgggccctggaccaggaacacactcataccccattccggcaatccaaactaacccaggtacttaaggactcattcattggcaatgccaagacttgcatgatcgcaaacatctccccctctcacgtggccacggagcacaccttgaatacactccgatatgccgatcgggtcaaggagctcaaaaagggcataaaatgctgcacgagcgtcacttctcggaatcgcacttccggtaacagctcgcccaaaaggattcaaagctcgcccggggctttatctgaagacaagtgtagtcccaaaaaggttaaactggggtttcaacagtctcttaccgtggccgccccggggagtacacggggaaaggttcatccgctgacgtctcatccgcctaacatacctttcacttccgctcctaaagtctccggaaagaggggcggtagtcgcgggagccctagtcaggaatgggtgattcacgcaagcccagtgaaaggcaccgtgcgcagcggtcatgtagctaagaaaaagcccgaggaatcagcgcctctgtgttccgagaagaatcgtatgggaaacaaaactgtactgggctgggagtcccgcgctagcggcccaggcgaaggcctagtcagggggaaactgtctacaaagtgcaagaaggttcagaccgtccagcctgtccagaagcaactcgtcagtcgtgtggaactgtccttcggcaatgcgcatcatagggctgaatacagtcaagatagccagagaggcacccccgcacggccggcttcggaagcatggaccaacatccccccacaccagaaagagagggaggaacatctgcgcttctatcaccagcagtttcagcagccacctcttctgcagcagaagttgaagtaccaaccactgaaacggtccctgcggcagtatcgccctcctgagggtcagctgacgaatgagactccacccctgttccatagctattctgagaaccacgatggcgcacaagtcgaagagttggatgatagtgacttttcagaggactctttctctcatatctcctcccaaagagctactaagcagaggaatacgttagagaattcagaggacagcttttttcttcatcagacttggggacaaggcccggagaagcaggtcgctgagaggcagcaaagtttgttcagttctccgaggaccggggataagaaagatctcaccaagtcatgggtcgattcacgggatccaattaatcatcgtcgagccgcactggatcactcctgttccccgtcaaaaggcccagttgattggtcccgcgagaacagtacatcatctggtccatccccacgggactctctcgccgaaaaaccgtactgctcccaggtggattttatttatcgccaggaacgtggaggtgggagtagcttcgatctgaggaaagacgcctctcaatcggaagtgtcgggcgagaacgagggcaatctgccctcccccgaggaagatgggtttacaattagtctgtcgcatgttgccgtgcccggatccccagaccaaagggataccgtcacaactccactccgggaggtctctgcggacggccctatccaggtcactagtactgtcaaaaatgggcacgccgtcccgggggaagatccgaggggccagctgggaacccacgcagaatatgcctccggactgatgagtccgctaaccatgagcctattggaaaaccctgacaacgagggttcaccacctagcgaacagctcgttcaggatggcgcgactcactcgctggtggccgagagtaccggaggacctgtggtctcacatacggtgccttctggagatcaagaagccgccctgcctgttagcagtgcgaccagacatctctggttgagctcctcgccacctgataacaaaccaggcggtgacctgccagccttaggcccaggcgagaagacatcatacaaggcatggctcgccggggtgtggttcgtgcaccgccctcatcaggtggctctgcagcaatag

SEQ ID NO: 121660 - DNA, 999 bp, Artificial Sequence
  Description of Artificial Sequence: Synthetic coding sequence
atgacatggacctcgggtcaattacagcgcgaaaagcaggcccgcccaggtagcggagccgtacttgcctttccagatgacaaggacctccgagtttatgggccagcagagtctcaaagtgctgtttttggcgacgtatgtcctttgttaacctctctgctggacggctacaacgtgtgtgtaatggcatacggtcagactggttcagggaagtcttataccatgctcggccgacattcagatgatgggcctgtcctcccactcgatccccaaagtgaccttggcatcatccctagagtcgccgaagaactctttcgcctgattctggagaatacaagtcgatcccccaaggtcgaggtgtcaatcgttgaagtatacaataacgatatctttgacctgctagcgaaggactcaatcgccgctgtatccggggttaaaagggaagtcgtaactgccaaggatggcagaaccgaagtcgcgctgctagccagcgaagcagtcggttcagccagtaagctgatggaattggtccacggaggcctgcagcttagggcaaagcaccccaccttggttcacgcagatagctcgcgcagccacttaattattacagtaacactgactacagccagctgcagcgattctacagcagaccaagcctgcagcgctactctgccaagggagcagactgaggccgggagagcagggaggtcaagacgggcatctcaaggcgccctggctccacagctcgtgcctggaaacccagccggtcacgcagagcaagtgcaggcgaggctgcagcttgtggactctgctggaagcgagtgtgttggcggcgacgctaaacttctcgttattctctgtatcagcccctcccagagacatctggcccagacactgcagggcttggggttcggcatccgggccagacaggtgcagcgcggacctgcgaggaagaagcctccctcgtctcaaacggagggaaagcgacgaccagattag

SEQ ID NO: 121661 - DNA, 1155 bp, Artificial Sequence
  Description of Artificial Sequence: Synthetic coding sequence
atgacatggacgagtggccaattgcagagggaaaaacaggctcgcccaggcagcggcgctgtcttggcatttccagacgacaaggatctgagggtttacggtccggccgagtcacagtcagcagttttcggggacgtttgtcccctcctgacatcacttttggacgggtacaatgtgtgcgtgatggcttatggccagaccgggtctgggaagtcctataccatgctgggtaggcattcagatgatggcccggtcctccccttagatccccagtctgatctaggcatcattccccgggttgccgaagaattgttccgtctgattttggaaaatacaagccggagccctaaggtggaggtgtcaattgtcgaagtttacaataatgatattttcgacctgcttgccaaggatagcattgctgccgtgagtggcgttaaacgagaagtagtcacagccaaagatggtaggaccgaggtagctcttctagcttccgaggctgtcgggtcagcaagcaaattgatggagttagtccatggagggctccagctgcgcgccaagcaccccacacttgtgcacgctgactccagcagaagccacctgattatcactgtcacgctgacaaccgcctcttgttctgactcaacagccgatcaggcatgctccgctacgctgccccgagaacaaactgaagcgggcagagcagggcgcagtcgcagagcaagtcagggcgcgctggctccccagctagtccctggaaacccagccggccacgctgaacaggtacaggcccgtctgcagctggtcgacagtgcgggaagtgaatgtgtcggcgtgtccggcgtaactggcctcgctctccgagagatggcttgcatatccaggagtctcgcagctctcgcgggagtcctcggagcactcctcgaacaccggggccacgccccgtacaggaattcccggctcacacatctgttgcaggattgtctcggaggagacgcaaagctgctcgtgattctatgtatctctccatcgcaaaggcacctggcccagactctgcaaggcctcgggtttggcattcgcgcccgacaggtgcagcgcggaccagccaggaaaaagccaccaagctctcagactgaagggaagagaaggcccgactag

SEQ ID NO: 121662 - DNA, 1155 bp, Artificial Sequence
  Description of Artificial Sequence: Synthetic coding sequence
atgacatggacctccggccagctccagagggagaaacaagcgaggcctggctctggagcagtcttggccttccccgacgataaagacttgcgagtgtatggtccggctgagtcccagtcagcagtgttcggcgacgtatgtcccctgctgactagcctgttggatgggtacaacgtttgcgtcatggcgtacggtcagacaggtagtggcaagtcatatactatgttgggaaggcatagcgatgatgggccggtgctgccattggacccgcagtcggacttaggtatcattccacgagtggcagaagagctgttcaggctgatattggagaatacttccagatctccaaaggtcgaggttagcatcgtggaagtttataataacgacatcttcgatttactagcaaaagattccatcgctgctgtgtccggggttaagcgagaagtcgtcaccgccaaggacggcagaaccgaagtcgccctgctggcctctgaggcagtaggcagcgcgtccaagctaatggagcttgttcacggaggcctccagctccgggctaaacatcccactttagtccacgcggactccagccggtcccacttgatcatcactgtgacgctgaccaccgcaagttgctcagactcaactgccgatcaggcctgtagcgccaccttgccccgcgaacagacagaagccgggagagctggccggagtaggagagcaagtcagggagccctggccccacagctagtaccgggaaaccctgccggccatgcggagcaagtccaggcccggctgcagctggtggactccgctggatcagagtgcgtgggggtatcaggcgtcaccggtctggccctgcgcgagatggcgtgtatcagtcgaagtctcgccgctctcgcgggcgtcctcggtgccttgttggaacatcgcggccacgctccttatagaaacagccgccttacgcatttgctgcaggattgcctggggggcgacgcgaaactgctggtgatcctgtgcattagccctagccagcggcacctggcccagacgcttcagggtctaggcttcggtattagggcccggcaggtgcaaagaggcccagcacggaagaaacccccttcctctcagacagaaggcaagcgtcgccctgactag

SEQ ID NO: 121663 - DNA, 5649 bp, Artificial Sequence
  Description of Artificial Sequence: Synthetic coding sequence
atggttggtcggggcgtgcccctatgcgctgcacaaccggcagtggcagaggggggcccggctcgtgagccgccgcctcttctcgaggtgtctccccggaagcggctgcccgccggtcctgatcaagacccatgtgggagtcgcccagcgccagaaggggccggcgctggcccggagcagggccactccgctggagggggcggctggtgccggcattgtcacaccaaactggtcgaattgaagaggcaggcttggaagttggtgagtggacctggaacaacattgcgcgacccgtgcctctctgcattgcttcttgacaaactgccagcccctggggctcttccagcgtgccgaccagaagccgaaagacgctgtgatgtctgcgccacccatctgcagcagctcacaagggaggccatgcacctactgcaggctccagcatctcacgaggatctggacgcccctcacggcggtccaagcctggctcctccctctactactacgtccagtcgtgacaccccggggcccgcaggccccgctgggcggcagccgggtcgtgcgggaccagatcgcacaaaggggctggcctggtctccaggccctagtgtgcaggtgagcgtagcacccgccggcctcggaggcgcactatcgacagtaactatccaggcacagcaatgtctcgagggcatgtggagcgtgtcaagggtgaactcatttttgcctcctgcctgcctagccgaggccgctgtggctgcggtcgctgtggccgacaccgtgcgggagtgtccacctgtcgccggcccagatggactctcaaaagcctgggggagaggaggtgtgtgtacatccgccctagtgacacctacacccgggtccgtcggcggctctacgggacccagcgccgccgccagcttctttatccgggccatgcagaaactgagccttgctagcaaaagaaagaagccgcacccgccacctccacctgctacccgaggcacatcgacgtacccaactgacttctcaggcgtgcttcagctgtggcccccgccggccccaccatgtcttcttagggcagccagcaagactaaggacaacccggggtccattggcaaggttaaagtgatgcttcgtatttggcccgcgcagggcgcccagaggagcgctgaagctatgtcctttttaaaagtagatccaaggaaaaagcaagtaatcctgtacgaccccgctgctgggcctcctggatccgccggcccacgcagagccgccacagcggctgtcccaaaaatgtttgctttcgacgctgtctttccccaggacagcgagcaggctgaggtgtgtagtggcacagtggcagatgttctgcaaagcgttgtgtcaggggccgacggctgcatctttagttttggacacatgagcctggggaagtcgtataccatgatcggcaaggattcctcaccgcagagtctgggaatcgtaccatgtgcaattagctggcttttccgattaattgaagaaagaagagaaaggaccgggactagattcagcgtgagggtgagcgcagtagaggtgtgcggcagggaccaatccttgagagacttgcttgccgaggtggctccggggagccttcaggacacccaaagccctggcgtataccttagggaagacccagtgtgcggagctcagctgcagaatcagtctgagctgagggcgccgaccgctgagaaggcggcattttacttggatgctgctctggcggctaggagcacaagccgcgctgggtgtggagaagatgcaaggaggtcctctcatatgttgttcacattacacgtctatcaatatcgcatggagaaatgcggccggggggggatgagtggtggacgcagtaggctgcatctcattgacctgggatcatgtgaggccgccgcaggcagagcgggggaggcggccggcggtccactttgcctgagtctctctgccctgggctccgtcatcctcgctctggtcaacggagccaagcatgttccctacagagatcacagactgaccatgctattgcgggaatcgctcgctactgccgggtgcagaaccaccatgatcgcacatgtttcggacgcgccagctcaacatgcagaaacactgagcaccgtgcagttagccgcccgcatccaccggctcaggcgtaaaaaggctaagtacgccagttctagcagcggcggtgagtcatcgtgtgaagagggcagggctagaaggcccccacacctgcgccctttccacccgaggaccgtggccctggacccagatcggacccccccatgtctacccggggacccggactacagctcctcctctgaacagagctgtgacactgtgatatatgtgggtcccgggggcgcagccctttccgaccgagaactgacagacaacgaagggcccccagactttgtccccattatcccagcgctgtcccgccatcgcccctctaaaggacctagagatgctgatcacttcagatgctccacctttgctgagctccaagaacggctggaatgtatggacggaaacgagggaccctccgggggtcctggaggcacagacggagctcaggcatcccccgcaaggggtgggcgtaagccttccccacccgaagcagcctcacctagaaaagccgtcggcacccctatggcagcctccacaccccgtgggagctcggggcccgacacacatcaggggacacctgaaccttgtaaagccatcgtgtggggggaccagcgcgaagattcttcagcctggccggagctccttgtgccggaaaaggcagccgtatctggaggcagacgcccgctgccaagccccgcaccaccaccaccgcaactgctcgaggcctgtagggccccagaggaacccggtggaggaggcacagatggtgtagcgcgaacaccacccgtcggtatgtcagggcaggtagcagggtctccaatgttgccgggagcaacctgtcccaggcttgctgctggctcaaggtgtccggaacggggtctcctaactaccacagtgaccttgcagaggccggtggagctcaacggcgaggatgaactggtctttaccgtcgtggaggagctgagccttggagctcttgccggcgctggaaggcccactagtctggcatcttttgattctgactgcagcctccgggccttggcttccggatcccgacctgtgagtataattagctctatcaatgacgagtttgatgcgtatacgtctcaggcgcctgagggtggaccgctggaaggggcagcttgggccgggtcttcccacggttcctctatcagcagctggctctccgaagtgtcagtttgcaccgccgactctcgagaccctaccccccaaccccgtttctcacctgatagtctcgccggacttgatccaggtggcccacctgctctggacggaagcctgggtgatggcagttcaggctttctgggcccagatcggcccgactcccctgggcccacatggggcccatgtccaggcgaggtcgcagcggttgcaccaagccgcccaggcagagaaccgcaggctggcccctcgcgatgggcctctgcagctcagacaattcacagttcgctcccacgaaaaccaaggaccgcctcagcgaccacccgggttggttgcgcaaggctcggacagtccccccccgggagggggggactgttcgaggacccttggctactgagagtgggggagtgcgacactcaagcggcatctgccggccgggccccttctccaaccttggggtcaccgcgcctccctgaagctcaggtgatgctggcatgtgcccagcgggttgtagacgggtgcgaagtagccgcccgggctgcgagaaggccggaggcagtggccagaattccgcccctccgacggggagcaaccacactaggtgtcaccacccccgctgtaagctggggcgatgcaccgacggaggtggtggcatgctccggatcgctgaaagcttcaccaacttcaaaaaaaggtctcgctcctaaggccggcttccttccgcgtccctcaggcgcggctcctccagctccacctacccggaaatcaagcctcgagcagaggtccagccccgcatctgcccctccccatgccgtaaaccccgctcgggtaggcgctgcagctgtactcaggggcgaagaggaaccccgcccaagcagtcgggctgatcacagcgtgccaagggctactagctctctgaaggcccgggcctcaaaggtcgaagccgcccatagacttgccggacacgcctccctggaacgctacgaaggcctggcacacagcagcagcaaagggagagaagcaccaggtcggccccctcgggcagttccaaagctgggggtgccaccctcctcacctacacatgggcccgcacccgcttgcagatccggtgccgccaaagcagtcggagctcctaagcctccggtcggcggtggcaaaggcaggggcctggtcgcaggagggtcccgagcactgggaccgtctgtcaagctctctactgctagcgttacgggccggagtcctggcggccccgttgcaggacccagggctgccccacgggccggtccaagtgtaggtgcaaaagctgggcggggcaccgttatgggcacaaaacaggccctgagggccgcccacagtagagttcacgagctgagcgctagtggggcaccgggtcgggggggctctagctggggtagtgctgactcggactccgggcacgacagcggggtgaacgttggcgaagagagaccccctaccgggcctgcactgccgtccccttactccaaagtgaccgccccacgccgcccccagaggtatagctctggacatggatctgacaattcatcagtgttgtctggcgagctgccaccggccatgggcagaactgccctattccaccacagtggcggcagcagcggttatgagagcctacggagagacagcgaagcaactggatctgcttcaagtgcccccgacagcatgtctgagtcgggagcagcgagtcccggggcgcgcacgaggtcactcaagagccctaagaagagggccactgggctgcagcgtcgcaggcttatacccgcaccattgcctgatacaactgctctggggaggaagccatcgcttcccgggcagtgggtcgaccttcccccgccacttgcagggtccctgaaagagcctttcgagatcaaggtttatgagattgatgacgtggagcggcttcaaagaccgcggcccaccccacgggaagctcctacgcaaggattagcgtgtgttagcaccaggttaagactggcagagaggaggcagcagcggcttagagaggtccaagctaaacataaacacctctgcgaggaacttgccgagacccagggaagactaatgttggagcccgggcggtggctggaacagttcgaagtggacccagagcttgaaccagagtccgctgaatatcttgctgccctggagcgagccacagcagcattagagcaatgcgttaacctctgtaaagctcacgtgatgatggtaacctgcttcgatatcagcgtagccgcaagcgccgcaattcccggtcctcaagaagtcgacgtctag

SEQ ID NO: 121664 - DNA, 5184 bp, Artificial Sequence
  Description of Artificial Sequence: Synthetic coding sequence
atgatgatggactggaaggcagtcgctgcacagaagctcaacctgtcaagcaaaaagaagaaacaccgccctagtacctcttccgcggcagagccccctctattcgccacctcatttagcggtatcctgcagacatctccaccccctgccccaccttgtctcctacgggctgtgaacaaggttaaagacacccctggcctggggaaggtcaaggtgatgctgcgcatatgtagcacgctggctagagatacctccgagagcagcagcttcctgaaggtagatcctaggaagaaacagataactctgtatgacccactgacatgtggcggccagaacgccttccagaaacgaggaaatcaggtcccccctaagatgttcgccttcgacgccgtctttccacaggacgcttctcaggcagaggtgtgtgctggcactgtggcagaggtgatccagtctgtagtcaatggtgcggacggttgtgtgttctgtttcggacacgccaagctcgggaagtcctacacaatgataggaaaagacgactcaatgcagaacttggggatcattccttgtgcaataagttggctgtttaaattgattaatgaaagaaaagagaagacaggggctcggttcagcgtgcgagtctccgcagtggaggtgtggggcaaggaagaaaatctgagagatttgttatccgaggtagcaaccggatcactccaagacggacagtcaccaggcgtgtacctctgcgaagaccccatatgcgggacgcagttgcaaaaccagtcggaattacgcgctccaaccgcggaaaaggccgccttcttcttagacgctgctatagcatcccggaggtctcaccaacaagactgcgatgaggacgatcatcgaaactctcacgtattctttaccctccatatatatcagtatcgcatggaaaagagtggtaagggcgggatgtccggcgggagaagtaggctgcatctgattgatctggggtcctgcgttaaggctctgtctaagaatcgggagggaggatccggactgtgcttgtcgctgtcagctctgggcaatgtgatactggccctggtcaacggcagcaaacacattccttacaaagagtccaagctggcaatgctcttgcgtgaatcactgggcaacatgaattgtcggaccactatgatagctcacataagcgcggccgtcggatcctatgccgaaaccctttctaccatacaaatcgcttcaagagttctgaggatgaagaaaaagaagacgaagtacacttcgtcctcatccgggggggagtcaagctgtgaggagggcagaatgcgcagaccaacacagcttagaccttttcatacaagagccacagtggacccggacttccctatagcacacctgagctctgaccctgactactcttcctccagcgagcagtcctgcgacacggtaatctacatcgggccaaatggcactgctctgagcgacaaagaacttactgataatgagggaccacctgactttgtgcctattgtgcctgccctccagaagacccgcggggattctcggcccgccgaggccggtgaagccgcggctggcaagtctgagagagactgtttaaagtgtaacacgttcgccgagctgcaggagcgcctggattgcatcgacggttcagaagaaccctcatcctttccatttgaagaactcccagcccagttcggacctgagcaggctagcagaggccctaggctgtctcaggccgccggggcctctccactttccgagtccgacaaagaggataacgggagcgaggggcagctgaccaaccgggaagggcccgaactgccagcctcaaagatgcagcgtagccacagccccgtacctgccgccgcaccagcgcacagcccatccccagcgagtcctaggtcagtacctgggagctcctcgcagcacagtgcaagccccctggtccagtcgccatccctgcaatcctcaagagagagtcttaatagctgtgggttcgttgaaggaaaacccagaccgatggggagtcccagactcgggattgctagcttgtccaagacatccgaatataaacccccgtcttctcccagccaaaggtgcaaagtgtatacccagaagggtgtccttcccagccctgctcctctgcctccttcctctaaggacagtggcgtggcctcccgggagtctctgctgcagcccgaggttcgaacacctcctgtgggaatgtcaccccaggttctgaagaagtcaatgagcgccgggagcgagggctttcctgagacccctgtcgatgatgagcagcaagcagctacacccagcgagtcaaaaaaagaaattctgagcactactatggtgactgtacaacagccccttgagctaaatggtgaggacgaactggtgttcacactggttgaggaactgaccatttccggcgtgctggactctggccgaccaacctccattatatcatttaatagcgactgctcagcacgggccttagcctcaggcagcagacctgtttcaatcatctcctccataagtgaagatcttgagtgctatagctcaaccgcccccgtgtccgaagtgtctataacacagtttctgcctcttcctaagatgagcttagacgaaaaggcacaggatgctggaagtaggaggtcctcgatttcctcctggctctccgagatgtccgccggctccgaaggagaacagtcctgtcactcttttatagcccaaacgtgttttggccacggtgaagccatggccgaaccagttgcttcagaattcgtgtccagtctgcagaatacagccgttgtgtgtagagagaagcccaaagcctcgccagacaacctgctgattctctctgagatgggtgatgactcttttaataaagccgctcctatcaagggttgtaagatctcaaccgtgtctaaggccatggtgacaattagcaatacagccaacttgtcaagttgcgagggctatattcctatgaagactaatattaccgtgtatccctgcatagccatgagccctcgaaatattcaagagccagaggcccccaccgccactccaaaagccgggcccaccttggcccaatctagggaatccaaggaaaactcagcaaagaaagagatgaagtttgaagacccatggcttaagcgggaggaagaagttaaaaaggaaactgcccatcccaacgaagagggcatgatgcggtgcgagacagccacagggccgtcaaacgcagaaacccgcgctgaacaagagcaggacggcaagccatctccaggggatcggctgtcctcatccagcggggaagtgtctgcttcgccagttactgataattttcggagagttgtggatggttgtgaaatggctttaccgggcctggccactcagtccccagtacaccccaataaaagcgtcaaatccagtagcctccctagggccttccagaaagcgtcccggcaggaagagcccgacagcctgagctattattgtgccgcggagacgaacggcgtaggagccgcaagcggcactcctccatccaaggccaccctggaaggcaaggtcgccagccccaaacactgtgttctggcccgacccaaagggaccccccccctgcctcccgtccggaagagctccttagaccagaaaaaccgcgcatctccgcagcattctgccagtgggtctggtacaagcagcccgctcaatcagcctgccgctttccccgctggcttgccagacgagcctagcgggaagacaaaggacgcatcatctagttcaaaactcttctcagcaaagctggaacagctcgccagcaggagcaactcgctagggcgcgccaccgtgtcccattatgagtgcctttccttggaaagggccgagagtctgtcttctgtgagctcccgcctgcatgccgggaaagacggtacaatgcctagggccgggaggagtttgggacgaagcgccggaacctcccccccaagcagtggcgcctctccaaaggccgggcagtcaaaaattagcgctgtgtctagactcctgcttgcttccccccgagctcggggccccagtgccagcaccacgaagaccctcagcttctccacgaaaagcttacctcaggcagtgggccagggcagctctagcccccccgggggaaagcacactccttggtctactcagtccctgtcaagaaacagatcctccggcctggcaagtaagctgccactccgggctgtcagcggccgaatcagtgaactcctgcagggcggtgctggcgcgagaggcttacagctccgggctggccctgaggctgaagctagaggtggggccctggctgaggatgaacctgctgctgcccaccttttaccgagcccctactcaaaaatcactcccccaaggagaccccaccggtgttcctctggtcatggttcagataattctagcgtgctatccggggaacttcctcctgctatgggtaagacagcactgttctatcactcaggcggcagcagcggctatgagtcagttatgcgcgattccgaggctactggctcagctagttctgcgcaggactctacttctgagaactcctcatccgtcggcggaaggtgtaggtctctgaaaacccccaagaagagatccaaccccggatctcagcggcgtagactgatccctgccttgtcactggatacctcatctcctgtacggaagccacctaattctaccggggtccgctgggtggacggccctctcagatcctccccacgcggtctgggggaaccatttgagattaaagtgtacgagattgacgacgtggagaggttacagcgtcgaagggggggtgccagcaaggaggcgatgtgcttcaacgccaagttaaagatactagaacacaggcagcagcggattgccgaggttagagcaaaatacgagtggctcatgaaggagctcgaagctaccaagcagtacctgatgctggaccccaacaagtggctgagcgagttcgacctcgaacaggtttgggaattagacagccttgagtacttggaggcgctcgagtgtgtgacagagaggcttgagagtcgtgtgaacttctgcaaagcccatctcatgatgatcacttgttttgacataacctctcggagaagatag

SEQ ID NO: 121665 - DNA, 6327 bp, Artificial Sequence
  Description of Artificial Sequence: Synthetic coding sequence
atgaatagtgtggcaggcaacaaagagcgcctggccgttagtactcgggggaagaagtacggcgtcaacgaggtatgcagcccaaccaagcctgccgcgcctttttctcctgagtcttggtaccgtaaagcatacgaggagtcccgtgccggttctcgccccacccctgaaggtgctgggtccgcgctcggatcctcgggcaccccctctccaggaagtggtacttcctctccgtcctcgttcactggcagtcctggccccgctagccctggaattggaacttcttcacccggcagccttggcggatcaccagggttcggtactgggtcaccagggagcgggtccggcggtggtagttctcctggcagcgaccggggtgtttggtgtgaaaactgcaacgcacggcttgttgaacttaagcgccaagctctgcgtctgcttctcccagggccattcccgggaaaggatcctgcattttcagctgtcatccacgataagctgcaagtacccaacactattcggaaggcgtggaatgacagggataacaggtgcgacatctgcgctacgcatctaaaccagctgaaacaggaagctatacagatggttctgactctggaacaggccgccggatcagagcattacgatgcctccccatgcagcccacctcctctctcaaacatacctactctggtgggaagccgacacgtgggcggcctgcagcagccccgcgactgggctttcgtacctgccccgtgtgcaacgagcaactacactggctttgccaacaaacatggtagcaagccatcttcattgggggtctcaaatggggccgaaaagaagtctggatctccaactcatcaggctaaagtgtccctgcagatggcgacttctccttctaacgggaatattctgaattcggtggcaatccaggcccaccagtacctcgacgggacttggtccctctcacgcacaaacggggtgacattgtacccttaccagatcagccagctgatgacggagagctctagggaagggctcactgaggcagtgctcaacagatataacgccgataaaccatccgcctgcagcgtccctgcatcacaggggtcttgcgtagcgtctgagacaagtactggtacctctgtcgccgccagcttcttcgcacgtgccgcacagaagctgaatttgagttccaagaagaagaagcaccgtccatcgacttcaagcgcagcagaacccccattatttgctacctcattctcaggcatcttacaaaccagtccaccacctgcacccccctgtctgttacgggctgttaataaggtaaaagataccccagggttagggaaagtcaaggttatgctccgtatatgctcgacacttgccagggacacaagcgagtctagttctttcttgaaggtggacccccgcaagaaacagattaccttatacgatccgctcacttgtgggggccagaatgcattccagaaacggggcaaccaggtgccgccaaagatgtttgcattcgatgctgtattcccacaggacgcctcccaggctgaagtctgcgctggcaccgtcgcagaggtgatccagagtgtggttaatggtgccgacgggtgtgtcttttgctttggccacgccaagctggggaagtcttacactatgatcgggaaagatgactcaatgcaaaacctgggtatcattccctgcgccatctcctggttatttaagttgatcaacgaacggaaggagaaaactggcgctcgcttttccgtccgcgtgagtgccgtagaagtttggggaaaagaggagaatctcagagaccttctgtcagaagtcgccactggctcactgcaggatgggcagagtccaggagtgtacctctgtgaggaccccatttgtggcacccagctgcagaaccagtccgagctcagagcgccaacggccgagaaagcggccttttttctagacgcagctatcgcaagcaggcggtctcaccagcaagattgtgatgaagatgatcaccgcaattcccacgtattctttaccctgcacatctatcagtatagaatggagaagtctggaaaaggaggaatgtccggtgggcgttcccgattacacctgatcgacctgggaagctgcgtcaaagccctgtcaaaaaatcgcgagggcggtagcggactgtgcctcagcctcagtgccctcggcaacgtgatcctggccctggtgaatggatcaaagcatattccatataaagaatcaaagctagctatgctgctgagggaatccctcggaaacatgaattgtcgaaccactatgattgcccatatttcagcggcagtcggcagctatgcagagaccctgtccacaatccagattgcctccagagtcctgagaatgaagaaaaaaaagactaaatatactagcagctccagcggcggtgaatcatcctgtgaggagggtcgcatgcggcggcccacgcagcttcgcccctttcacactcgcgcaactgttgatcctgattttcctattgcccacctgtcctcggaccccgattattcttcttcctccgagcaatcctgtgacacggttatatacatcggacctaacggcaccgccctctccgacaaagaactgaccgacaatgaggggcctccagatttcgtcccaattgtacctgctcttcagaagacccggggagactcccggccagctgaagcaggggaagccgcagcaggaaaatcagaacgcgactgtttgaagtgcaatactttcgccgagctgcaggagcgattagattgcatcgacggatccgaggagccatctagctttccttttgaggagctgcctgcacagttcggaccagaacaggcctctcggggtccacggcttagtcaagccgcaggcgcttcacccctgagcgaaagcgacaaggaggataacggctctgagggtcagctcacaaatagggaaggacccgaactgcccgcatcaaagatgcagagaagtcactctcctgtaccagcggccgccccagctcacagcccctcgccagcaagccctcgaagcgtgcccgggtcaagtagccagcattctgcaagtcccctcgtacagtcgccttcacttcaatcgagcagagaaagtctgaactcctgtggctttgtggaaggcaaacctagaccgatgggctctcctcggctcggcatcgctagcttgtctaagaccagcgagtataagccaccctcttcaccatcccagaggtgcaaagtgtatacacagaagggagtgctgcctagccctgcaccgctgcctccatcctctaaagactctggggtcgcgtctagggagtcacttctccaaccagaggtgcgaaccccgcccgtgggtatgagtccccaggtgttgaaaaaatcaatgagtgcagggagcgagggtttccctgaaacccccgtggacgacgagcagcaggccgctacaccgtctgagagcaagaaggaaatcctctctaccaccatggtgaccgtacaacagcctcttgagctcaacggggaagatgagctcgtttttaccctggtcgaggagctgacgatatctggagtgctcgattccggacggccaacgtcaataatcagcttcaatagcgattgcagtgcccgcgcccttgcttcaggatctaggcccgtctcaatcatctcgtccatctcagaagacctggaatgttactcatctacggccccagtgtccgaagtctcaattacccagtttctgcccctccccaaaatgtccttagacgagaaggctcaagacgctgggtcccgtcggtctagcatcagcagttggctgtccgagatgagcgcgggttccgaaggagaacagagctgtcattcatttattgctcaaacttgctttggacacggcgaggccatggccgagcccgtcgcttctgaatttgtgtcttctcttcagaacaccgctgtcgtgtgtagggagaaaccgaaggcaagcccagacaacctgctcattctgagtgaaatgggcgacgattccttcaataaggccgcgccgattaagggttgcaagatcagcactgtgagtaaagctatggtcactatctccaatactgctaacttgtccagctgcgaagggtacatcccaatgaaaaccaatataacagtgtatccatgtatcgctatgtccccacgcaacatccaggagcctgaagcacctacagctacaccgaaggctgggcccacattagcccagagtagggagagtaaggagaactcagcaaaaaaagagatgaaattcgaggacccctggttaaagcgcgaagaggaagtgaagaaggaaaccgcgcaccccaatgaagagggaatgatgagatgtgagacagccactggcccctccaacgccgagacacgggccgaacaggagcaggacggaaaaccgagtccaggcgaccgactaagctccagctcaggagaggtttctgccagcccagttaccgataactttaggcgggtggtcgatggttgcgagatggctctcccaggcctcgccacgcaatcccccgttcacccaaacaagtctgttaagtcctctagtctgcccagagcatttcagaaggcaagcaggcaggaagagcccgactccctgagctactactgtgcagccgagacgaatggtgtgggggcagccagtggcaccccaccaagtaaggccaccctggaggggaaagtggcttcgcccaaacattgtgtgcttgccaggcccaaaggcacgcctcccctccctcccgtgcggaaatccagccttgaccaaaagaaccgagcctctccccaacactctgcaagtgggtcaggaacgagtagccctttgaatcagccagcagccttcccggcagggctgcccgatgagccaagcggcaagactaaagacgcatcatctagctcaaagttattctcagcgaaactggagcagctggcctcacggagtaattccttaggccgagctaccgtgagccactatgagtgcctttccctcgagagggccgaatcattatccagtgtgtcgagcaggctacatgcaggaaaagacgggactatgcccagggccggccgatcactgggtcggtccgccggcacatctcccccatctagtggcgcttctcctaaagctgggcagtcaaagatttctgctgtgtcaagacttcttctcgcctcaccccgagcccgcggcccctctgccagtactaccaaaacactgagtttttccactaagtcgcttccacaggccgttggacagggctcatccagcccacctggtggtaagcatacaccgtggagcacccagagcctgagtaggaaccgtagctccgggttggcctccaagctacctctgcgtgccgtatccggacgtatttccgagttattacagggtggggccggcgccagggggctgcagcttagagctgggccggaagcggaagccaggggcggagccctcgctgaggatgagccagctgcggcacaccttctgccaagcccctacagcaaaataactccacccagacgtccacaccgatgtagctctggacatggaagcgataatagtagcgtgctgtctggcgaactgccccctgcaatgggcaagaccgccttattctaccattctggcggcagtagcggttatgaatctgtgatgcgcgacagcgaggctaccggaagcgcctcctcagcccaggactctacctccgaaaatagtagttcagtcggcggtcggtgtcggtcacttaagaccccaaagaaaaggtccaaccccggatcgcagagacgcagactgataccagctctgagtcttgacacttcctctcccgtgagaaaaccacccaattccaccggtgttcggtgggtcgatggccccctacgcagctctcctcgcggattaggcgagccgtttgagatcaaggtctatgagattgacgacgtggagcgactccagaggcggcgcggcggagcatcaaaggaggcaatgtgtttcaatgcaaaacttaaaatcctcgagcacaggcagcagagaattgcagaagtgagggccaaatatgagtggttgatgaaggaacttgaagccactaagcaatacctgatgttggatcccaacaagtggctgtctgagtttgacctcgaacaagtgtgggaactggattcactggaatacctcgaggctctggaatgcgtgactgaaagactggagagccgtgttaacttttgcaaagcacacctgatgatgatcacctgttttgacatcacttcgaggaggagatag

SEQ ID NO: 121666 - DNA, 5175 bp, Artificial Sequence
  Description of Artificial Sequence: Synthetic coding sequence
gactggaagacgaaggccgcccagaaactgaacctgtcctcgaaaaaaaagaaacaccgccccagcacttcaagcgctgcagagccccccttgttcgccacatcttttagtggaatcctgcaaacatccccgccgcctgcgcctccttgtttgctgagggctgtgaataaggtcaaagacaccccaggcctgggtaaggtgaaggtaatgctgcggatctgctctacgcttgcccgggatacgtctgagagctcctcattcctgaaggtggatccaagaaaaaagcaaattacactctacgaccccctgacatgtggtggtcagaacgcattccagaagagaggaaatcaggtcccgcccaagatgtttgccttcgacgctgtcttcccacaggacgcctcacaagcggaagtatgtgccggaacagtcgccgaagttatccagagtgtggtgaatggtgccgatgggtgcgtcttctgttttggccacgcgaaactcggaaaatcatataccatgataggcaaggacgactctatgcagaacctggggattatcccgtgcgccattagctggctctttaagttgattaacgagagaaaagagaaaaccggcgcccgcttttcagtgagggtgtcagcagtggaggtgtggggtaaggaggaaaatttgagagacctactctcagaagtggcgacaggcagcctccaggatggtcagtcccctggagtgtatctgtgcgaagatcccatatgcggaacccagctgcagaaccagagcgaattgcgagcccccacagcggagaaagccgccttctttctggacgccgccatcgcatctaggagaagccaccagcaagattgtgacgaagatgatcatcggaatagtcacgtgttcttcacactacacatttatcaataccggatggaaaagagtgggaaaggaggaatgtctggtggccgtagcaggctccatctgattgacctgggtagctgtgtaaaggctctgtctaaaaatagagaaggaggatcgggactgtgcctgtccctttcagcacttggcaacgtgattctggctctggtgaatggcagtaagcacattccttataaagaatcaaagctggcgatgttactgagggagagcctgggtaacatgaactgtcgcactacaatgatcgcacatatttccgccgctgtgggcagctacgctgaaaccctctccaccatccagatcgccagccgcgttctacgtatgaaaaagaaaaaaaccaaatacacctctagcagctccggcggggagtcgagctgcgaggaagggaggatgcgtcgcccaacccagctgagaccgttccacaccagagccaccgtggatccagatttccctatagcacacctgtctagtgatcctgattacagcagctcgtccgaacaaagttgcgatactgtgatttacatcggacccaatggcaccgccctgagcgataaggagttgacagacaacgagggcccgccagacttcgtccctattgtccccgcactacagaagacgagaggcgattcccgcccagcagaagcaggcgaggctgctgccggtaagtccgagcgtgattgcctgaaatgtaacactttcgctgaactacaggaacgccttgactgtattgacggatccgaggaaccatcaagttttccgttcgaggaactccctgcccagttcggacccgagcaggcatccagaggcccacggctatcccaggcagccggagctagtccactcagcgaatccgacaaggaggataatggctccgagggacaactgacgaaccgggaggggcctgagctgccagcaagcaagatgcagagatcacatagcccagttccggccgcagctcccgcccactccccgagtccggcttcccctcgaagcgtaccagggagttctagtcaacatagcgcatctcccctggtgcagtctccctctttgcagtcctctagggagtcactgaattcctgcgggtttgtcgaaggtaagccacggcccatgggtagtccccggcttggaatcgcaagcttgtctaagacgtcggagtacaagcctcctagttcaccatctcaacgatgcaaggtgtacacccagaaaggcgttctgccgtctcccgccccgcttcctccatcatccaaagatagcggagtggcctctcgggagagtctgctgcaacctgaggttcggacaccgcctgtcggaatgagccctcaagtgttgaagaaatcaatgtctgccgggtctgaaggatttccagagacacctgtggacgacgagcagcaggctgcaactcctagcgaaagcaagaaggagattctctctactaccatggttaccgtgcagcaaccattggagctcaatggcgaggatgaactggtattcaccctcgtcgaagagttgactattagcggcgtactcgacagcggccggccaacctcaatcattagctttaacagcgattgcagcgctcgggccctcgcgagcggatccaggcctgtgtccattattagctccatctcagaggatctggaatgctacagcagtaccgcccccgtttccgaggtttctatcacccagtttctgcctttgcccaaaatgagtttagacgagaaggcccaagatgcggggtccagacgaagttccatttcttcatggctgagcgagatgagcgccgggagcgaaggggaacagtcgtgccattccttcatcgcccaaacctgttttggccatggtgaagccatggccgagcctgtagcctcagagttcgtgtcaagtctccagaacaccgcggtagtgtgcagggagaagcccaaggcctcgcccgataatctgttgatcctgagcgaaatgggggatgattccttcaataaggccgccccaatcaaagggtgtaagatttcaacagtgagcaaggccatggtgacgatctccaacacagccaatctgtcctcctgcgagggctacatcccaatgaaaaccaatattaccgtatatccctgcattgcgatgtcccccaggaacatccaagagccagaggcccccactgccacaccgaaagccggccccaccctcgcacagagtagggaatcaaaggagaacagcgctaagaaagaaatgaaatttgaagacccctggctcaaaagagaagaagaggtgaagaaggagactgcccatccaaacgaggaggggatgatgcgttgcgaaacagcaaccgggccttctaacgcggaaacacgggccgagcaggaacaagacggaaaaccatctcccggggacaggctcagttcatcctcaggcgaagtgagtgcttcaccagtcaccgacaatttccgaagagtggtggatggatgcgagatggccctcccgggcctggccacccagtctccagtacaccccaataagagcgtaaagtcttcctctctaccaagggcctttcagaaggccagccgccaagaggagcccgacagcttgagctattactgtgctgccgaaacaaacggcgtgggggctgctagtggcacacctccatctaaggccaccctggagggtaaggtggcatctcctaagcattgcgtcctcgctcgccccaaaggtacaccacctttgccgcctgtcagaaagtcatccctggatcagaaaaacagagcaagcccccagcactccgccagtggttctggcacttcaagtcctcttaaccagccggccgccttcccagctggactcccggacgagcccagcggtaagacaaaggatgcttcctcaagtagcaagctgtttagcgccaagttggaacagctggcgtcgcgcagcaattctttaggcagggctactgtctctcactacgaatgtctgtcgctcgagcgcgccgagtccctgtctagcgtttccagcaggctgcatgctgggaaggatggaacaatgccacgggctgggcggagcctggggagaagcgccgggactagtccccctagctcgggcgcttcgccaaaggcgggtcagtctaaaattagtgcagtaagtcgactactcctggcaagtcctcgggcgcgcggtccctctgcgtccacaaccaaaaccctctcgtttagtacaaaaagtctcccccaggccgtggggcagggttcatcctcgcccccagggggtaagcacactccttggagcacacagtctctttccaggaatcgatcatctggacttgcctccaagcttccgcttcgcgccgtgtccggccgcataagtgagcttctccaggggggggctggagctaggggactacagttgcgcgcaggaccagaggctgaggcgcgaggcggagctctcgctgaagacgaacctgcagctgcgcacctcttgccctccccatactcaaaaattaccccgccccgaaggcctcatcgctgctcatccggccatggctctgacaatagctccgtgctgtccggggaactacctccggctatggggaaaaccgccctgttttatcattctggcggatccagtggctatgagagtgtgatgcgagattcggaggccaccggctccgccagcagtgcccaggattcaacaagcgaaaatagtagctccgtcggaggtaggtgtcgctcactgaagacacccaaaaaacggagtaatcccgggagtcagagacgccggttgattcctgcccttagcctggatacctcctctcccgtccgcaaaccaccaaactccacaggagtccgctgggtagacggacccctgcgtagtagtccgcgcggactgggcgaaccatttgagattaaagtttacgagatcgatgatgttgaacgactccagcggcgtcggggcggtgcaagtaaggaagcgatgtgcttcaatgcaaagctgaagatattggaacacagacagcaacggatcgccgaggtgcgcgccaaatacgagtggctgatgaaggaactggaggctactaagcagtacctcatgctcgacccgaataagtggctttccgagtttgatctcgagcaagtctgggagttggattccctcgagtatctggaggctctggagtgcgtgaccgagcgtctcgagtcacgagtgaacttttgtaaggctcacctaatgatgatcacctgttttgatattacctctaggcgcagatag

SEQ ID NO: 121667 - DNA, 2016 bp, Artificial Sequence
  Description of Artificial Sequence: Synthetic coding sequence
atgattgatttcgacgacgtggccgccattaatccagaactcctgcaattactgccattgcaccccaaggacaacttgcctctccaggagaacgtgacaattcagaaacagaaacgcaggtctgtaaatagcaaaattcctgctccgaaagaaagtcttcgctcccgctccacacgaatgagcactgtgtctgagcttaggatcacagcacaggaaaatgatatggaagttgagttaccagccgccgctaactcacggaagcaattctcagtccctcccgcccccacccggcccagttgccccgccgtggctgaaattcccctgcgcatggtgtcagaggagatggaggaacaagtgcattccattcgcggaagctcgagcgcaaatcccgtaaattcagtacgacggaagtcatgcctcgtgaaggaagtggaaaagatgaaaaacaagagagaagaaaaaaaagcccagaactccgaaatgcggatgaagcgggcccaggaatacgactccagcttccctaactgggaatttgcacgcatgatcaaggagttcagggcgactctggagtgccaccccctcaccatgaccgaccccatagaggagcaccgcatctgcgtttgtgtgaggaaacggcctctgaacaaacaggagcttgccaaaaaagaaatagacgttatttccattcctagcaagtgcttgctcctggtgcacgaaccaaaacttaaggttgatctgactaaatatctcgagaatcaagccttttgtttcgattttgcatttgatgaaactgcttcgaacgaagtggtctaccggttcaccgcgagacctttggtgcagaccatctttgagggaggcaaggccacgtgttttgcatacggacagaccggatccggaaaaactcacacaatgggcggagacctatcaggcaaagctcaaaacgccagcaagggcatttacgccatggctagcagggatgtgttcctcctcaagaaccagccttgttaccggaagctgggtctggaggtctacgtgaccttttttgaaatatataacggcaagttattcgatctccttaacaagaaagccaagctgagagtgttagaggacggcaagcagcaggtgcaagtcgttgggctgcaggagcatctggttaacagcgctgacgacgtgatcaaaatgatagatatggggtcagcatgccgaacgtccgggcagacttttgcaaacagcaattccagccgtagccacgcgtgcttccagattattcttcgggcaaaagggcgtatgcacggcaagttctctttagtcgacctagctggcaacgagcggggagcagacacttcctctgccgaccggcagacaaggatggagggagccgaaataaacaaatctctgctggctctgaaagaatgtatccgcgcacttggacagaataaggcacatacacctttccgagaaagcaaactaactcaagtgctacgcgactcgttcatcggagagaatagccgcacctgcatgatcgccacgatatctcctggtatcagctcctgtgagtatacactgaatacactaagatatgccgaccgggtgaaggaattgtctccccacagtgggccttccggcgaacagctcatacaaatggaaaccgaggagatggaggcctgttcaaacggcgcgctcatccctggaaatctgtccaaagaagaggaggaactgtccagccagatgagttctttcaatgaggctatgactcagataagggagctggaagagaaggcaatggaggagttaaaagagattattcagcagggaccagactggctggagttgtctgaaatgaccgaacagccagattatgatctggaaaccttcgttaacaaggctgagtctgcgcttgcgcaacaggcaaagcactttagcgctcttagggatgttataaaagcactgaggctcgcaatgcagctggaagaacaagcctctcggcagatctctagtaaaaaacgacctcagtag

SEQ ID NO: 121668 - DNA, 2055 bp, Artificial Sequence
  Description of Artificial Sequence: Synthetic coding sequence
atggcaatggactcgagtcttcaggcccggctgttccccggacttgcaattaagatacagagatccaacgggttgatacactctgcaaatgtgcgcactgtgaacctggaaaaatcttgcgtatccgttgagtgggccgaaggcggagcgacaaagggtaaagagatcgactttgacgacgttgcagccatcaacccagagctgcttcagctgttacctctgcacccgaaggacaacctgccactgcaagaaaatgtcactattcagaagcaaaaaaggcgctcggtcaattccaagatacccgctcccaaggagtcacttcgctcgcggagcactcgtatgtcaactgttagcgagctgcggattacagcccaggagaatgacatggaggttgaactgcctgctgccgcaaatagccgaaagcagttcagcgtcccactcaggcggaagtcctgccttgtgaaggaagtagagaagatgaaaaacaaaagggaggagaaaaaggcccagaatagtgagatgagaatgaagagggcacaggagtacgattcatcctttccgaactgggaatttgctcggatgatcaaggagtttcgtgcgacccttgaatgccatccgctgactatgacagatccaatcgaggagcatagaatctgcgtctgtgtgcgcaagcgtcccctgaataaacaggagctggcgaaaaaagaaattgatgtgatttcgattccctcaaaatgtctattactggtacatgagcctaaattgaaggtggatctgaccaagtacttggaaaatcaagccttctgttttgatttcgctttcgatgaaacggcctctaatgaggtggtttatcgctttactgctagacctttggttcaaactattttcgaaggggggaaagcaacgtgcttcgcatacggacaaactggcagtggtaagacccatactatgggcggagatctgtccggaaaagcacagaatgcctccaagggaatctacgcgatggcctcacgggatgtctttctactgaagaaccagccctgttatcggaaactcgggctagaagtttacgtcacattttttgaaatttacaatggcaagctctttgacctcctgaataagaaggccaagttgcgggttcttgaagacggtaagcagcaggtgcaagtggtgggcctgcaggaacacctggtgaatagcgcagatgatgtgattaaaatgatcgacatggggtcagcctgcagaacctccgggcagacatttgccaattccaatagctcgagaagccacgcttgtttccaaattatacttcgcgctaagggtcgaatgcacggaaagtttagccttgttgacctggctggaaatgaacgtggtgccgacacatcatctgcggacagacagacacgaatggagggcgccgaaataaataaatcccttctggctctgaaggagtgtattcgggctctcggccagaataaagcacacacgccctttagagagtctaaactgactcaggtactgcgggactcctttattggcgagaattctagaacctgtatgatagcaactatttctccaggtatcagcagctgcgagtacacgttaaacacactgcgttacgcggaccgagtcaaggaattgagtccacattccggaccttcaggggagcaattgatccagatggagactgaggaaatggaagcatgtagcaatggagctctgatacctggcaacctttctaaagaagaggaagaactttcaagccagatgtcgtcatttaatgaagccatgactcagatccgagaattagaggagaaagccatggaagaactcaaagagatcatccaacagggacctgactggttggagttaagtgagatgactgaacaacccgattatgacctcgagacctttgtcaataaggctgagtcagctctggcacagcaagccaaacactttagtgctcttcgggatgtgattaaagctctccgcctggctatgcagcttgaggaacaagccagccgccaaatctcatccaaaaaacgaccccagtag

SEQ ID NO: 121669 - DNA, 1839 bp, Artificial Sequence
  Description of Artificial Sequence: Synthetic coding sequence
atgtcaaccgtttcagagctgagaattaccgcccaagagaatgacatggaggtggagctgcccgctgctgccaattctcgcaaacaattcagcgtgccccctgccccgactagaccctcatgcccagccgtcgccgagatacccttacgtatggtgagcgaggaaatggaagaacaggtgcattcaatcagaggatctagctcagcaaaccccgttaactccgtcagacggaagagctgtctcgttaaagaggtggaaaaaatgaagaacaagagggaggaaaaaaaggcgcagaattcagaaatgcggatgaagcgcgctcaggagtatgattccagtttcccaaattgggaatttgccaggatgatcaaagaattccgggctaccttagagtgtcaccctttaaccatgaccgatcccatcgaagagcatcgcatatgcgtctgcgtgaggaagcgacctctgaacaagcaggaattagctaagaaagaaatcgatgtcatctcaattccgtccaaatgcctcctgctcgtccacgagccaaagctgaaagttgacctgacaaaatacctggagaaccaagctttttgtttcgacttcgcctttgacgagactgcctccaatgaagtggtgtaccgcttcaccgcccgaccactcgtccagacaatcttcgagggcggaaaagctacatgcttcgcatatggtcagaccggcagtggaaagacacatacgatgggtggtgatttatctggaaaggctcagaacgctagtaagggaatttacgctatggcctcccgggacgtgttccttcttaagaaccagccttgctacagaaagttgggcttggaggtgtatgttacatttttcgagatctataacggcaaactgtttgatctcctgaataagaaagctaagctccgcgtcctggaggacgggaagcagcaagtccaagtggtgggtttacaagaacatctggtgaactcggcagatgatgttatcaaaatgattgacatgggatccgcgtgcaggacgtcaggccagacgttcgccaattctaacagttcccgatctcacgcctgttttcaaatcattctgagagccaaaggtcgtatgcacggcaagtttagcctggtggacctggcaggcaatgaacggggagcagatacctcaagcgcagaccggcaaacccggatggagggggctgagatcaataagtcactgttagcattgaaggagtgcatcagggccctcggacagaacaaggcacatacgcctttcagagagtccaaactcacccaggttctaagggattcctttataggcgaaaactctaggacatgtatgatcgctacaatttcaccagggattagctcgtgtgaatatacgctgaatacactccgctacgctgacagagtcaaggagctctctccccactcgggccctagcggagaacagctcatccagatggagaccgaagaaatggaggcttgtagcaacggagccctgatcccgggaaacctgagcaaagaggaggaagaactctctagtcagatgtcttccttcaacgaggccatgacccagattagagaactggaggagaaggccatggaggaactgaaagaaatcatacagcagggtccggattggttggagctgagtgagatgacagagcagcccgattacgatttagagacctttgttaacaaggcagagagcgcactggctcagcaagccaagcattttagtgccctgagagacgtgataaaagcactgcgactggccatgcagctggaggagcaggcttccaggcagatcagcagtaaaaagcgccctcagtag

SEQ ID NO: 121670 - DNA, 2178 bp, Artificial Sequence
  Description of Artificial Sequence: Synthetic coding sequence
atggctatggattccagcttgcaagccagactgttccctggcctggccattaagatacagaggtccaacggtttaatacactctgctaacgtccgcaccgtcaacctagaaaagtcttgtgtcagcgtggagtgggctgagggcggtgctacaaaagggaaggaaatagacttcgacgatgtcgcagcaataaaccccgaattgctgcagcttcttcccctgcatccaaaagataatcttccacttcaagaaaatgttactattcagaagcagaagaggaggtccgtgaatagtaagatacccgcacccaaggaatccctgcgctcacgctccactaggatgagcacagtgagtgagctgcgcatcactgctcaggagaacgatatggaggttgagttgcccgcagcagcaaacagcagaaagcagttctccgtcccgcctgcccctactcgtcctagctgccccgccgtggccgagatccccctgcggatggtatcagaagaaatggaggagcaggtgcattctattagaggctccagttctgctaacccagtgaacagtgtcagaaggaaatcctgccttgtgaaagaagtggagaaaatgaaaaataaaagagaggagaagaaagcacagaactcagaaatgcggatgaagagggcgcaggagtacgacagcagttttcccaactgggaatttgccaggatgattaaggagttccgcgctacacttgagtgccaccccttgacaatgacagaccccattgaagagcaccgcatttgtgtgtgcgtccgaaagcgaccccttaacaagcaagagctggcaaagaaagaaatagacgtgatctctatccctagcaaatgcctcctactggtccacgagccaaagctaaaggtggacctgacaaagtatttggagaatcaggccttctgcttcgactttgcttttgatgaaaccgctagcaacgaggtcgtataccgatttacggctcgccccctcgtacagaccatcttcgagggcggaaaggcgacctgctttgcatacggtcagacgggatccggtaagacacataccatgggcggggatctctccgggaaggcccagaacgcgtccaagggcatttacgccatggctagtagggacgtgttcctgctgaagaatcagccctgctacagaaaactggggctcgaggtgtatgtgactttttttgaaatctataacggcaagttgttcgatctcctgaataagaaagccaaattacgagtgttagaggacggcaaacagcaggtgcaggtggtcggtcttcaggaacatttagttaatagcgccgatgatgtcataaaaatgattgatatgggcagtgcctgcagaacatcaggacagacctttgctaactcaaatagcagtaggtcgcatgcttgctttcagattatcctgagagccaagggaaggatgcacggcaaatttagcctcgttgatcttgccggtaacgagaggggagccgacacatcctctgcagatcggcagacacgcatggaaggtgcagagataaacaagtccttgctcgcccttaaagaatgcataagggccctagggcagaataaagcacataccccatttagagagtctaagcttacccaggtactgagggatagcttcattggcgaaaactctcgcacatgtatgattgcaactatttcccccggcatctcttcctgtgagtacaccctgaacacactgcgatatgcggacagggtgaaggagctctctccgcacagtggcccctcaggagaacagcttatacagatggagaccgaggagatggaagcttgttccaacggcgcactgattccagggaacctgtcaaaggaggaagaggagctgtcttcacagatgtcgtcatttaatgaagccatgactcaaatcagggagctggaggagaaggccatggaggaactgaaagagattatacagcagggcccagattggctggagctatccgagatgaccgagcagcccgactacgatctcgaaacctttgtcaacaaagccgagagcgctctggcccagcaggctaaacatttttccgccctgagggacgtgatcaaggctctgcgcctggccatgcagctggaggagcaggcgtcccggcagattagcagcaagaagagaccacagtag

SEQ ID NO: 121671 - DNA, 324 bp, Artificial Sequence
  Description of Artificial Sequence: Synthetic coding sequence
taaaaagaatgtattagagcacttggacagaacaaggcacacacccctttcagagagtccaaactgacccaggtgctccgggattccttcatcggcgagaattctaggacgtgcatgattgctaccatctccccgggtatcagctcctgtgaatatacactaaacaccttgagatatgcggaccggcagggatgtcatagtattcccctggaaccacaggcttcaaagccagggcgatgtcacattccactgcttagtaaggaggaagaggagctgtccagccagatgagttctttcaatgaagctatgacacagatcagatag

SEQ ID NO: 121672 - DNA, 1011 bp, Artificial Sequence
  Description of Artificial Sequence: Synthetic coding sequence
atggccatggattcctccttgcaggcccggttgttccccgggcttgctatcaagatacaaagatctaatggcctgatacactctgcaaatgtgcggacagttaatttagaaaagagctgtgtgtcagtggagtgggcggaagggggcgcgaccaagggcaaagaaattgacttcgacgatgtggctgcaatcaaccccgaactgctccagctgctaccacttcaccctaaagataaccttcctctgcaagaaaacgtgaccatccaaaagcaaaaacggcgcagcgttaattctaagatccccgcccctaaggagtcgctcaggtcaagatcaactaggatgagtacagtgtcggaactgagaattacagcccaagaaaatgatatggaggtagagttaccagctgcagctaactcaagaaaacaattcagcgtccccctcagaagaaaatcatgcctggtgaaggaggtcgaaaagatgaaaaacaaacgagaagaaaagaaagcccagaattcagagatgaggatgaaaagagcccaggagtatgattcctccttccctaattgggaatttgcaaggatgataaaagaatttcgggctaccctggaatgccatcccctcacgatgaccgaccctatagaagagcacagaatttgcgtgtgtgtacgcaaaagacccttgaataaacaggaacttgcaaaaaaggaaatcgatgtaatcagcattccaagcaagtgtctgcttcttgtccacgagcctaagttgaaggtggacttaaccaagtatctggaaaatcaggctttctgtttcgatttcgccttcgatgaaaccgcgtccaatgaagtcgtttaccgctttaccgcgcggcccctggtgcagaccatctttgagggcggaaaggccacatgcttcgcttatgggcagaccgggagcggcaagacgcataccatgggcggcgacttgagtggcaaagcacaaaacgcctcaaaaggcatttacgctatggcctag

SEQ ID NO: 121673 - DNA, 864 bp, Artificial Sequence
  Description of Artificial Sequence: Synthetic coding sequence
atggtgaggtccggcgtcccccgaagtaggggcttagtatccgggctgattcactcagccaacgttcgaaccgtgaacttagaaaaaagttgcgtctctgtggagtgggctgaaggtggcgccactaagggcaaggagatcgactttgatgacgtcgccgcaattaatcctgagctgttacagttgcttcccttgcaccccaaagataatttgcccctacaagagaatgtaactatccaaaaacagaagagaaggtccgtaaacagcaaaatccctgccccgaaggagtctctcaggtcaaggagcacccgaatgtcgaccgtctcggagctgagaataacggctcaggagaacgacatggaggtggaactgccagctgccgcaaactccagaaaacaatttagtgtccctcctgcaccgaccaggccctcctgccccgcggttgccgagattccccttcggatggtgtccgaggagatggaagagcaggtccactcaatccgcggatcttcctctgccaatccagtgaactcggtcagacggaagtcctgtctcgttaaggaggtggagaaaatgaaaaacaagcgggaggaaaagaaagcacagaactctgagatgagaatgaaaagagcacaggagtacgactccagctttcctaactgggaatttgccaggatgataaaggaatttagggctacactggagtgccaccctctgactatgactgatcctatagaagagcatcgcatctgtgtgtgcgtgaggaaacgtccactgaacaaacaggagctggccaaaaaagagatcgatgtcataagcattccctccaagtgcctcctgctggtccacgaaccaaaactctag

SEQ ID NO: 121674 - DNA, 2244 bp, Artificial Sequence
  Description of Artificial Sequence: Synthetic coding sequence
atgtcaaagctaaaaagttctgagagtgtccgtgttgtggttaggtgtagaccgatgaatggcaaagagaaagccgcctcttacgacaaggtcgttgacgtggacgtcaaactcgggcaggtgtccgttaaaaatccaaaaggtacagcccatgagatgccaaaaacattcacctttgacgctgtctacgattggaacgctaagcagttcgagctgtatgatgaaaccttccgacctctcgtcgattcggtgctccaagggtttaacggcacgattttcgcatatgggcagactggaactggaaaaacgtacaccatggaaggaattaggggggacccggaaaagcgtggggtcatccccaatagtttcgatcacatctttacccatatctcgcgctcccagaatcagcagtatctggtacgagcgtcttaccttgaaatctaccaggaggagatccgcgacttactgagcaaggaccagaccaaacgactggaactcaaggagaggcccgacacaggagtgtacgtcaaagatctcagttccttcgttaccaagtctgtgaaggagattgaacatgtcatgaatgttgggaatcaaaatcgctccgttggcgcaaccaacatgaatgagcatagttctcgatcccatgctatcttcgtcatcactatagagtgctccgaggtaggtttagacggggagaaccatatcagggttggcaaactgaatttagttgacctcgcaggcagcgagcgccaagccaagacaggtgcacagggggaacgccttaaagaggctactaaaattaatttatcactgtccgccctgggaaacgtgatttccgcactggtggacggcaaatctactcacatcccttaccgcgatagcaagctgacacgtctgctgcaagactcactgggcggcaacgctaaaacagtcatggtggctaacgttggccctgcaagctataacgtcgaggaaacactgacaaccctcaggtacgccaaccgggccaagaatattaagaataagccccgcgtgaatgaggatcccaaggatgccttgctaagggaattccaggaagaaatcgcacggctcaaggcacagctggaaaagaggagtattggtaggcgtaagcgtagggagaagaggagggaggggggggggtctgggggaggcggcgaagaagaagaagaagagggtgaggagggggaagaagaaggagacgacaaggatgattattggcgtgaacaacaggaaaaattggaaattgagaagcgcgctattgttgaggatcattcactagtagcagaggagaagatgcggctgctgaaagaaaaggaaaaaaagatggaagacctcaggcgagagaaggacgcagcggagatgctcggagccaagatcaaggccatggagagcaagctgttagtagggggcaagaacatcgtagatcacaccaatgagcagcagaagatcttggaacagaagcgccaggaaatcgccgagcaaaaaaggagggaaagggagatccagcaacagatggaatcccgagatgaagagacgttagagctcaaggaaacctacagttccttgcagcaggaggtggacatcaagacaaaaaaactgaagaagcttttcagcaagttgcaggccgttaaggcagagatccacgacctgcaggaagagcatattaaggaaaggcaggagctcgagcaaacgcagaacgagttgacccgagagctaaagctcaagcatctcataattgaaaattttattcccctggaagaaaaatcaaagatcatgaacagagctttcttcgacgaggaggaggaccactggaaattgcacccgataacccgactcgaaaaccagcaaatgatgaagagaccagtgagcgcggtgggttacaagcggcctttgtcccagcatgccagaatgagcatgatgatccgtccagaggcgcggtaccgcgccgagaacattgtgctcctggaacttgacatgccatcacgcactacaagagattatgagggtccagctatagcgccaaaggtgcaagccgcgctggatgccgctttgcaggatgaggatgagatacaggtggacgcctcatcctttgaatcaacagctaataagaagtccaaggccaggcccaaatccggaagaaagagtgggtcttccagcagctcttctggtacgcctgcctctcagctttatccacaaagcagaggactcgtccccaaatag

SEQ ID NO: 121675 - DNA, 1122 bp, Artificial Sequence
  Description of Artificial Sequence: Synthetic coding sequence
atggtagctaacgtgggaccagcctcctataacgtcgaagaaacgttgaccacactccgatatgctaacagggctaagaatatcaagaacaaaccccgggtcaacgaggatccaaaggacgcactgttaagggaatttcaggaggagatcgcacgtctgaaagcacagctggaaaaacgatcgatagaagagaagatgcgtctgctgaaggagaaggagaagaaaatggaagatcttcgacgtgaaaaggatgccgccgagatgctgggtgccaagatcaaggcaatggaaagcaaactcctggttggaggaaagaacatcgtcgaccacactaatgagcaacagaagattctcgaacagaagagacaggagatcgcggaacagaaacgcagggagcgcgaaattcaacagcaaatggagagccgagacgaggaaacactggaactcaaagagacgtattcaagcctccagcaggaagtggacatcaagactaagaaactcaagaaactgttctctaaactccaagccgtgaaggccgagatacatgacctgcaggaagagcatatcaaggaacgacaggaactggagcaaacccagaacgagctaactagagaactgaagctgaaacatctaatcatagagaacttcatcccattagaagagaagtcaaaaattatgaatagggctttttttgatgaggaggaggatcattggaaactccaccccatcacaagactggagaaccaacagatgatgaaaaggcccgtgtccgcagttggttataaacggcccctgtcccagcatgctcggatgtcgatgatgattcgtcctgaggctcgatatcgcgctgagaatatagtcctacttgaactggacatgcccagccggactactcgggattatgagggacctgcaatcgcgccaaaagtgcaggccgcccttgacgctgctctgcaggacgaagacgagatccaagttgacgcttcttcctttgagtccacggctaacaaaaaaagtaaagcccgccccaaatccggtagaaagtctgggtctagcagctcttcttccgggactccagcctctcaactgtatccccagtcaaggggtctcgtgccgaagtag

SEQ ID NO: 121676 - DNA, 2382 bp, Artificial Sequence
  Description of Artificial Sequence: Synthetic coding sequence
atggccagcaaaactaaggcgtccgaagctctcaaggtggtggctcgctgtagaccccttagcagaaaggaagaggctgcaggtcatgagcaaattcttacaatggatgtcaagttaggacaagttactcttcggaaccccagggctgcccccggcgaattgccaaaaaccttcacatttgacgccgtttatgacgccagttcaaagcaggccgacctatatgacgagactgtcagacccttaatcgactcagtcttacagggattcaatggcacggtgttcgcctacggacagaccggaacaggcaagacatatactatgcaaggcacgtgggtggagcctgaacttaggggcgtcataccaaatgctttcgaacatattttcacgcacatcagtcgctctcagaatcagcaatatctggtccgcgcaagctatttggaaatctatcaagaggagataagggacctcttatcaaaagagccaggcaagaggctggagttgaaggagaaccccgagactggagtatatattaaagacctgtcctcattcgtgacaaagaatgtgaaggagatagagcatgtgatgaacctgggaaatcagacaagagcagttggcagtacacatatgaatgaagttagcagtcgttctcatgccattttcatcatcaccgtagagtgctccgaacgcggctccgatgggcaggatcacattagggtcggtaaactcaacttagtagatctagctgggtctgagaggcagaataaggcaggacctaacaccgctgggggtgccgcaaccccctctagcggcggcggaggtggaggcggtggctccggtggcggggctggcggcgagaggcctaaggaggcgagcaagattaacctttcactgagtgctttggggaacgtaatcgcagccttagcaggaaaccgctctacccatataccgtaccgtgacagcaagctaacccggttgttgcaagatagcttgggtgggaacgccaaaactataatggtggctacactgggcccagccagtcacagctacgacgagagtctgtccacactccgctttgccaacagggccaagaatatcaaaaacaagcctcaggtgaatgaagatccaaaagacaccctgctgcgggagtttcaggaagagatcgcgcgactcaaggcccaactagagaaacgaggcatgctgggaaagcggccacgccggaagtcttcccgacgcaaaaaagctgtgagtgccccgccaggataccctgaaggccccgtgatcgaggcctgggttgccgaagaagaagatgataacaacaacaaccaccgtccacctcagcccatattagagagcgcactcgaaaaaaatatggaaaactatttgcaagagcagaaggagaggctggaggaagaaaaagcagccattcaagacgacaggtccctggtgagcgaggaaaagcagaagctgctcgaagagaaagagaagatgcttgaggatttgagacgagaacaacaggccacagaattgctggccgccaagtacaaagcaatggagtccaagctgctaataggcggaagaaacattatggatcataccaatgagcagcagaagatgctcgaactgaaacgtcaggagatagctgaacagaaacgccgtgagcgtgaaatgcaacaggaaatgatgctacgcgatgaagagactatggagctcaggggaacttacacctccctgcagcaggaggtcgaggtgaagacaaaaaagctcaaaaaactgtacgcaaaactgcaggccgtgaaggccgaaattcaagatcagcacgacgagtacatcagggtaagacaggatctcgaggaagctcagaatgaacagactagggaactgaaactgaaatacctcatcatagaaaactttatccccccggaggaaaaaaataaaatcatgaaccgcctattccttgattgtgaagaggagcagtggaaatttcagccattagtgcctgcaggcgtgtcaagctcacaaatgaaaaagaggcccacaagtgctgtgggatataagcggcccatcagtcagtacgccagagtcgccatggccatgggatcccaccccaggtacagggctgaaaatataatgttcctggaactggacgtgtcaccacccgctgtgttcgaaatggagttctcacacgaccaagaacaggacccgcgagctcttcatatggaacggctgatgaggttggatagctttctggaacggccaagcacttctaaggtacgtaagtctcgttcttggtgtcaatcaccccagcggccaccccccagtaccacacacgcctccctggccagcgcctcattgaggcctgcaaccgtcgccgatcacgagtag

SEQ ID NO: 121677 - DNA, 2382 bp, Artificial Sequence
  Description of Artificial Sequence: Synthetic coding sequence
atggcttccaaaacaaaagccagcgaagcactcaaggtcgtggccaggtgtcggcctctgagtaggaaagaggaggccgcgggtcacgaacagatactcacaatggacgttaagttgggccaggttacactcaggaaccccagggctgccccaggggagctgcccaagacttttaccttcgatgcagtttatgatgcctcctccaagcaggccgacctctatgacgagaccgtgagacctctaatcgatagtgtccttcaaggattcaacgggaccgttttcgcctatggtcaaaccgggactggcaagacctatacgatgcagggaacatgggtcgagccagagcttcgtggagtcattcccaatgccttcgaacatatcttcacccacatctcacggtctcaaaaccagcaatacctggtccgagctagctatctcgaaatttatcaggaggagattcgggacctactctccaaggaacctggcaagcggcttgagctcaaagaaaaccctgaaaccggagtctatataaaggacctttctagcttcgtgaccaagaacgtgaaagaaattgagcacgtgatgaatctggggaatcagacccgcgccgtgggctcaacacacatgaacgaggtttctagtcgatcccacgccatcttcatcatcactgttgagtgtagcgaaagagggtccgacggtcaagaccatattagggtcggcaagctgaatctggttgacctcgccgggtctgagcgccagaataaagccgggcccaatactgcgggaggagccgctacccctagtagcgggggagggggaggcggtggcggcagcggcgggggagcggggggagaacgccccaaggaagcatccaagatcaacttatcattgagcgcactgggcaacgtgatcgccgcgcttgccgggaacaggagtacccacatcccttaccgagattctaagctcacacgcctcctccaggattcccttggcggaaacgccaagaccatcatggtagccaccctcggcccagcaagccattcttatgatgaatcgctgtctacattgcgcttcgcaaaccgtgctaaaaacataaagaacaagccacaggttaatgaagatccgaaggacacactcctgagagagttccaagaggagattgcaagactcaaggcccagcttgagaagagagggatgctcggcaaacgcccacgcagaaaaagctccagaagaaagaaggcagtgagtgccccccccggctaccctgagggaccagtaatcgaggcgtgggtggcagaggaggaggacgataataataataatcaccgtccaccccagccaattctcgaatccgctctcgagaaaaacatggagaactacctgcaggaacagaaggagagactagaggaggaaaaagcagctattcaggacgaccggagccttgtgtccgaggagaaacagaagttgctggaagagaaggaaaaaatgctcgaggatctccggcgggagcagcaagctacggagctgttggcggcaaagtacaaggctatggaatcgaaattgttaatcggcggtcgtaacattatggaccacaccaatgaacagcaaaagatgctcgagctcaaaagacaggaaatcgcggaacagaagcgccgtgagagagagatgcagcaggagatgatgctgagggacgaggaaactatggaattaaggggaacttacacatctctccagcaagaggttgaggtgaaaactaagaaacttaagaaactgtacgccaaactgcaggcagtaaaggccgaaatccaggatcaacatgatgagtatatcagggtccggcaggatctggaggaagctcagaatgagcagactagagaacttaagctcaaatatctgatcatcgagaacttcattcctccagaggagaagaataaaataatgaatcgcctgtttctcgactgtgaagaagaacagtggaagttccaacctctggttccggcaggcgtcagctcatcgcagatgaaaaagaggccaacaagtgctgtgggctacaagcggcccatatcacagtatgcaagagtggccatggctatggggagccatcctagatatcgagcagaaaacattatgttcctggagttggacgtctctccccctgccgtgtttgagatggagttttcacacgaccaggaacaggatcccagggcattacacatggaacgcctcatgaggcttgactcattcttggagcggccctcaacctcaaaagtgcggaagagtcgcagttggtgtcaaagcccccaaaggcccccaccatcaaccacccacgctagcctggcctcagcatctctgcgtccagctactgtcgcagatcacgagtag

SEQ ID NO: 121678 - DNA, 1800 bp, Artificial Sequence
  Description of Artificial Sequence: Synthetic coding sequence
atgaatttggggaaccagacgagggctgtcgggtccacacacatgaacgaggtcagcagtcgaagccatgctatcttcattataacggtggagtgcagtgaacggggaagcgatggacaagaccatattagagttggcaaactgaacctagtggatctcgccggcagcgagagacaaaacaaggcaggtcctaacaccgctggcggtgcagccaccccttcttccgggggtggaggtgggggagggggcagcggcgggggcgctggcggagagcgcccaaaggaagcaagtaaaattaatctctccctgagtgctttgggaaacgtcattgcagctctcgccggaaatcggtccactcacatcccatatagggacagcaagttaaccaggctactgcaggatagtctggggggaaacgccaaaactatcatggttgccacactcgggcctgcctcccatagttatgacgaaagcctgtcgaccttgaggtttgctaaccgcgcaaagaatattaagaataaacctcaggtcaatgaggatcctaaggacaccctgttgagagagttccaggaagaaattgccaggctaaaggcccagcttgaaaagcgaggcatgctcggaaagcgccctaggcggaaatctagccgtcgaaaaaaggccgtttctgctccaccgggttatcctgaggggccggtcatagaagcttgggttgcagaggaagaagatgataataacaacaaccaccgtcctccccagcccatccttgaaagtgccctggaaaaaaacatggagaattatctgcaggagcagaaggagaggctggaggaagagaaggccgccattcaggacgatagatctctcgtgagcgaagaaaagcagaagctcctagaagaaaaggaaaagatgctggaagacctgcggcgtgagcagcaggccaccgaattacttgctgccaagtacaaggccatggagagtaagctgttgatcggcggacggaacatcatggaccacacaaacgaacagcagaaaatgctagaactcaaacgtcaggagatagccgagcagaaacggcgtgaaagggagatgcagcaggagatgatgctgcgagacgaggaaacaatggagctaaggggcacatacacatcactgcagcaagaggtagaggtgaagactaagaaacttaaaaagctttatgccaagctgcaagctgtgaaagccgagatacaggaccagcatgacgagtacatcagggtacgtcaggatctagaggaagcgcaaaatgagcagacacgcgaacttaagcttaagtacctcatcattgagaacttcattccgcccgaagaaaagaataagatcatgaaccggctctttctagattgtgaggaggagcagtggaaattccaaccactggtcccggctggagtatcatcctctcagatgaagaagcgtccaactagcgctgtgggatacaagagacctatatctcaatatgccagggtggccatggccatggggagccaccctaggtacagagccgagaacatcatgtttttggagctggacgtgagcccgccagccgtgtttgagatggagttcagtcacgatcaggaacaggatccccgggctctccacatggagcgattgatgagactggatagcttcctggaacggcctagtacctcaaaagtacgaaaaagtcgcagctggtgccagtcccctcagcgcccccctccaagtactacacacgcaagcctggccagtgccagcctgcgcccagccacagtagctgaccatgagtag

SEQ ID NO: 121679 - DNA, 3384 bp, Artificial Sequence
  Description of Artificial Sequence: Synthetic coding sequence
atgaaagaggaggtgaaggggatccctgtgcgcgtcgctctcagatgtagaccactagttccgaaagagatttcagagggatgccagatgtgcctgagtttcgtccccggggagccacaggtggttgtgggcacagataaatcttttacatacgatttcgtctttgaccccagtaccgagcaggaggaggtctttaacaccgccgtcgcccctctgattaaaggtgtcttcaaaggatataatgcaaccgtcctggcatacggccagactgggagcgggaagacttactctatgggcggcgcctacactgctgagcaggaaaacgaaccaacggtgggcgtcattccaagggtgatacaactcctgtttaaggaaatcgacaagaaaagtgattttgagtttactttgaaggtgagttacttagaaatctacaacgaagaaattctggacttactgtgtccatctcgagaaaaagcgcagattaacataagggaagatccaaaagagggaattaagatcgtaggcctgacggaaaaaacagttttggtggctttggataccgttagctgtctcgaacagggaaacaattcgcggacagtcgcctcaacagctatgaatagccaaagttcgagaagtcatgccatttttactataagtctcgagcaaaggaaaaagagtgataaaaatagttcttttcgctcaaaattgcacctggttgacctggccggctccgagcggcaaaagaaaactaaggccgaaggcgacagactcaaagaaggtattaatatcaataggggcctcttgtgcttgggcaatgtcatcagcgctttaggtgatgataaaaagggcggattcgtcccctaccgagacagtaagctgactcgcctgctgcaggactccctggggggaaacagccataccctcatgatagcgtgtgtatcaccagccgattccaacctggaagagacactcaataccctcaggtatgcggaccgggccaggaagatcaaaaacaagcctattgtgaacatcgacccgcagaccgccgagttaaatcatctgaagcagcaagtgcagcagttgcaagtcttactactgcaggcccacgggggcacccttccgggtagcatcacagtagaaccctctgagaacctccagagcctaatggagaagaaccagtcactggtggaggaaaatgagaaactcagtcggggcctgagcgaggccgcgggccagaccgctcaaatgcttgaaagaatcatcctgacagaacaggctaatgaaaaaatgaatgccaaactggaggaactgaggcagcacgccgcatgtaagctggacttgcagaagttagtggaaaccttggaggaccaggaactcaaagagaatgtcgagatcatctgtaacctacagcaactcatcacgcagctctccgacgaaactgtggcatgtatggctgccgccatcgacacggccgtggaacaggaggcacaggtggaaacctcaccggaaacctcccgctcgtctgacgcttttaccacgcagcacgcgctgcggcaggcgcaaatgagcaaagaacttgtggaactgaacaaggctctggcgctcaaagaagccctggccaggaaaatgactcagaacgattcccagcttcagccaatacagtatcagtatcaagacaatataaaggagctagagctcgaggttattaacctccagaaggagaaagaggagctggtgctggagttgcagactgctaaaaaggacgccaaccaagccaagttgtcggagaggaggcggaaaagacttcaagagttagagggccaaatcgcagaccttaagaaaaaactaaacgagcagagtaagctgctgaagctcaaagaatctacagagcgcacagtctctaaactgaaccaagaaattcgtatgatgaagaaccaaagagtgcagctgatgaggcagatgaaagaggatgccgagaagttccggcagtggaagcagaagaaggacaaggaggtcatacagctgaaggaaagagaccggaagcggcagtacgagcttctgaaactagaacgaaacttccaaaagcagtctaacgttttacgccgcaagacagaggaggcggctgccgcaaacaaacggctcaaagacgccctgcagaagcagagggaggttgccgataagcggaaagagacgcagtcacgggggatggagggcactgctgccagagtgaagaattggttggggaacgagattgaggttatggtttctacagaagaggctaagcgccaccttaacgacctcctcgaggaccggaaaatcttagcccaggatgtagcccaactcaaagaaaaaaaggagtccggcgaaaacccccctcctaagttgcggaggagaactttcagcttaactgaagtgcgcggccaggtgagtgaatcagaagattcgattaccaagcagatcgaatctttagaaacggagatggagttcagatccgctcaaattgcagatctgcagcagaaactgctcgatgcagagtcagaggatcggccgaaacagcgctgggagaacatcgcaacaattcttgaggccaaatgcgctttaaaatatctcattggagaactcgtgtcttccaagatccaggttagcaaattagaaagtagcttgaagcagagtaagaccagctgtgccgatatgcagaagatgctcttcgaagaaaggaatcacttcgctgaaattgagaccgagctgcaagcggagcttgtcaggatggaacagcaacaccaagagaaggtactgtacctgctgagccaactccagcagagtcagatggctgaaaagcaactggaggagtctgtgtccgaaaaagagcaacaactgctgtccaccttgaaatgtcaggacgaagagctggagaaaatgcgggaagtttgcgaacaaaaccaacagctactgcgagagaatgagataatcaagcagaagcttacgttgctacaagtggcatctcgccagaaacatctgccaaaggacacgctcctctcaccagactcgagcttcgaatacgtgccacccaaacccaagccatccagggtcaaagagaagttcctggaacaatcaatggatatcgaggacttgaaatactgttcagagcactctgtgaatgaacacgaagacggcgacggcgatgacgacgaaggagacgacgaagaatggaagcctactaagctggtgaaggtgtcccgcaaaaacatccagggcgtcctcctattaacacctgtgatcagtgctctctgggaggctgaggcaaggggactcctagaggcacgctctagccgtccggcctgggctacgtggcgggatcctgtgtctactaaaccaaaaaactag

SEQ ID NO: 121680 - DNA, 3699 bp, Artificial Sequence
  Description of Artificial Sequence: Synthetic coding sequence
atgaaagaggaagttaaagggatacctgttcgggtggccttgcggtgtcgacccctggtgccgaaggagataagcgaggggtgccagatgtgcctttcctttgtgcccggcgagccccaggtggtggtgggcaccgacaagtcatttacttacgattttgtgttcgacccttccactgagcaggaggaagtattcaatactgcagtggcgcctttgattaaaggcgtttttaaagggtataatgccacagtgctcgcttatgggcagacaggttccgggaagacatactctatgggtggcgcctatactgcagagcaggagaatgaacctacggtgggggtgatacctcgggtgattcagcttcttttcaaggagatcgataagaagtctgacttcgaattcaccctgaaagtgtcatacctggaaatatacaacgaggagattctggatctgctgtgtccctcgcgggagaaggcccagataaatattcgagaggaccccaaggaaggcatcaagattgtaggcctcacagagaagactgttctcgtggccttggatactgtctcctgtttggaacagggtaataactcccggaccgtcgccagtaccgccatgaattcccagagcagtcggtcgcatgcaatcttcaccatttcgctggaacagcgcaagaaatcagataagaattccagctttcgcagtaagttgcatcttgtcgacttggccggctccgagaggcaaaaaaagactaaggctgagggagatcgcctgaaagaaggtattaacattaataggggcctattgtgcttagggaatgtgatttcggcacttggtgatgataagaagggaggattcgttccttaccgagacagtaagctgacacggctgctccaagactccctgggtggaaatagccacacactgatgatagcgtgcgtgtctcccgccgatagcaacctggaagagaccctcaatactcttaggtatgccgatcgggctcgcaagataaagaacaagccaattgtgaatattgatccgcagaccgctgaattgaaccatctcaaacagcaggtccaacagctccaagtgctgctgctccaggcgcatgggggaaccctgccaggctcgattactgttgagcccagcgagaacctgcagtccctgatggagaagaatcaatcactcgtggaagaaaacgaaaaattgtcccgcggactgagcgaagctgccggtcagaccgcccagatgctcgagcggattattctcaccgaacaggccaatgagaaaatgaacgcgaagctggaggagttgcgtcagcacgcagcctgcaaacttgacctccaaaaactcgtggagaccctcgaagatcaggaattgaaggaaaacgtggagattatatgcaacctgcaacagttgattacacagcttagcgatgagactgtagcatgtatggccgctgccatcgatactgccgtcgagcaggaagcccaggtggagacctcacctgaaacaagcagatcctcggacgcattcactacgcagcatgccttgcgccaggcccaaatgagtaaagaattggtggagctgaacaaggctttagcactaaaggaggctctggccagaaaaatgacgcagaatgactcccagctacagccaatacaatatcaataccaggacaatattaaagagctcgagctggaagtgatcaatctgcagaaagagaaggaggaactagtccttgagctgcagaccgctaaaaaggacgctaatcaggctaaactgagcgaacgccgtcggaaacgcttacaggagctagaggggcagatcgccgacctgaaaaagaagcttaacgaacagtccaagctgctgaaacttaaagagtccacagagagaactgtgagcaaacttaatcaagagatccggatgatgaaaaaccagcgagtgcagttgatgcggcagatgaaagaggacgctgaaaaattccggcagtggaaacagaagaaagataaggaggtgatccagctgaaggaacgcgatagaaagcgtcagtatgagttgcttaaactggaacgcaattttcagaaacagtccaacgtcctccggaggaaaactgaagaggcagccgctgccaacaagaggctgaaggatgcccttcagaagcaacgagaggtggcggacaaaaggaaagaaacacaatcacgcgggatggaaggcaccgcggccagggtgaaaaattggcttgggaatgaaatcgaagtcatggtgtccacggaggaagctaagaggcatttgaatgatctactcgaggatcgtaaaattctcgcacaagatgtggcgcagctcaaggagaaaaaggagagcggcgaaaatcctccaccaaaactgcgtagaagaacgtttagcctgacagaggtcagaggacaagtgagcgaaagtgaagattcaataacaaaacagatagaaagccttgagacagagatggagtttcggtctgcccaaattgccgacttgcaacagaaactattggatgcggaatccgaggaccggcctaagcagagatgggagaatatcgccacaattctagaggccaaatgcgctcttaaatatcttatcggcgagctagtgagtagcaaaattcaagtgagcaagctagagtcctccttgaaacagagtaagacaagttgcgctgatatgcagaaaatgttgttcgaggagcggaaccatttcgcggaaatagagaccgaattgcaggcggagctcgtcaggatggaacagcagcaccaggagaaggtgctgtatctcctgagccagctgcagcagtctcagatggctgagaagcagctcgaggagagtgttagcgagaaagagcagcagcttctgtccactctcaaatgccaggatgaggagttggagaagatgcgggaagtctgcgagcagaaccagcaactgctgagggaaaatgagattatcaagcaaaagctcaccctgctgcaggttgcgtctcggcagaagcatcttccgaaggacaccctgctgtccccggattcaagcttcgagtatgtacctcctaagcctaaaccttcccgggtcaaggagaagttccttgaacaatcaatggatatcgaggacctaaagtactgtagcgaacacagtgtcaacgaacatgaggatggagatggcgacgatgacgaaggggacgacgaggaatggaaaccaaccaagctagtcaaggtctcaagaaagaacatacaggggtgcagctgtaagggatggtgcggcaacaagcagtgtggttgccggaaacagaaatctgactgcggtgtagattgttgttgcgacccgacaaaatgtagaaaccgtcagcaggggaaggactcgctaggtactgtggagaggacacaagattcggaaggctcattcaagctagaagatcctaccgaagttacgcctggtttgagctttttcaatccagtgtgtgcgactccaaactcaaagattcttaaggagatgtgcgatgtggaacaggtcctgagcaaaaagaccccaccagcaccatccccattcgatctgcctgagctcaaacacgtggcaacagagtatcaagagaacaaggcacctggtaaaaagaagaagagagcactggctagcaacacatcatttttctctggctgctctccaatcgaggaagaggcacactag

SEQ ID NO: 121681 - DNA, 1605 bp, Artificial Sequence
  Description of Artificial Sequence: Synthetic coding sequence
atgtgcagcgatgtgaaacgcgaggccgccgcagccaataaacgtctgaaagacgccctgcagaagcagcgcgaagttgccgataagaggaaagaaacccagtccagaggcatggaagggaccgctgctcgtgtaaagaactggctcggtaacgagattgaagtcatggtgagcaccgaggaggccaagaggcatctgaatgaccttctggaagataggaagatactggcccaggatgtcgcccagctgaaagaaaagaaggaaagcggagagaaccctcccccaaaactgcgacgcaggaccttctccttgacagaggtgagaggacaggtgtcagaatccgaagattcaatcactaagcaaattgagtcactagaaaccgaaatggaattcagaagcgcccagatagcggatctgcagcagaaactgctcgacgccgagtccgaagatagaccaaaacagcgatgggagaatatcgcgaccatcctcgaagccaagtgcgcattgaaatatcttattggcgagctcgtgagctctaagatccaagtgagcaagcttgaatccagtttgaagcagagcaagactagttgtgcggacatgcaaaaaatgctttttgaagagcgaaaccactttgcagaaattgagactgagctgcaggctgagttagtgaggatggagcagcaacatcaggagaaggtcctctatctgctatctcagctccaacaatcccagatggccgagaagcaactcgaagaaagcgtttctgaaaaggagcagcagttattgagcaccctcaagtgccaggacgaggaactggaaaagatgagagaagtgtgcgagcaaaaccaacaactgctccgagagaacgaaattatcaaacagaagctcaccctgctccaagtggccagccgtcagaaacatctccctaaagatacccttctcagccctgattcaagtttcgagtacgtgccccctaaacccaaaccgagtcgggtgaaggaaaaatttctggagcagtccatggacatcgaggacctgaaatattgcagcgagcacagcgtgaatgagcacgaagacggcgacggcgatgacgatgagggcgatgacgaggagtggaaaccgactaagcttgttaaggtcagccgcaagaatattcagggatgcagctgcaagggttggtgtggcaataagcagtgtggatgccgcaagcagaaatctgattgcggagtggattgctgttgcgaccctaccaagtgtaggaaccgtcagcagggaaaggactccttaggcaccgtggaacggacccaggactctgagggctcctttaagttggaagaccctaccgaggttacacccgggctgtcgttctttaatccagtgtgcgcaacccccaactcaaagatacttaaagagatgtgtgatgttgaacaggtgctatcaaaaaaaacaccaccagccccctccccttttgacctcccagaactgaagcatgtggccacagagtatcaggagaacaaagccccaggcaagaagaaaaaaagggctctggccagcaacactagttttttctcaggctgctcacccatcgaggaagaagcacactag

SEQ ID NO: 121682 - DNA, 3705 bp, Artificial Sequence
  Description of Artificial Sequence: Synthetic coding sequence
atgaaagaagaggtcaaaggtatcccggtgcgagtggcgttgcgctgccggcctctcgtacccaaggaaatctccgagggctgtcagatgtgtctttcctttgtacctggagaaacccaggtcgtggtcggcaccgataagtcatttacatacgacttcgttttcgacccttgtacggagcaagaggaagtatttaataaagctgtcgccccacttattaaggggatctttaaaggttataacgcgacggtgctggcctacggccaaaccggttctgggaaaacctatagcatgggaggggcttacacggccgaacaggaaaatgaaccaacagtgggaattattccaagggttattcagctgctgtttaaggaaatagataagaagtctgatttcgagttcaccctgaaggtctcatacctggagatctacaatgaagagattctggatctgctgtgcccctcgagggaaaaggcccagatcaacattcgagaagatcctaaagaggggatcaagattgtcggcttgacagagaaaaccgttctcgtcgctctggacacggtgtcctgcctggaacagggtaataactcgcgtaccgtggcctctaccgccatgaattcacagtcctctcggagtcacgccattttcaccatatctatcgaacaaagaaaaaaaagtgacaaaaactgtagctttcggtcaaaactgcacctggtcgacctcgctggaagtgagcgtcagaaaaagacaaaggccgagggagaccgcttgaaggaggggatcaacatcaaccgtggacttctctgtctggggaacgtgatcagcgccctaggagacgacaagaaaggcagtttcgtgccctatagagactccaagcttactaggttacttcaggacagcttgggcggcaactcgcacactcttatgatcgcttgtgtctcaccagccgactccaacttggaagagactttgagcacgctgagatatgcagatcgggcccggaagataaagaacaagcctatcgttaatatcgatcctcataccgctgaattgaatcatcttaaacaacaggtccaacagcttcaggtgttactcctgcaggcccatggcggcacccttcctggtagtattaatgcggagcccagtgaaaacctgcaaagtctcatggagaagaatcagtcgctggtggaagaaaacgagaagctaagccgttgtctgtctaaggccgccggccaaacggcccagatgctcgagcggattatcttgaccgagcaggttaacgagaagttgaatgccaagctggaagaactccgccagcacgtggcttgcaaactggaccttcaaaagttggtggagaccctggaggatcaggagttaaaggagaacgtcgagataatttgtaatctgcagcagctcattactcaattaagcgatgagaccgtggcatgcactgcagccgcaatcgatacagccgtggaggaagaggctcaggttgagacttcccctgaaaccagcagatcgtcagatgcattcacaacacagcatgccttgcatcaggcgcaaatgtctaaggaggtggtggaactcaacaacgccctggctttgaaagaggcactggtgcgcaagatgactcagaatgacaaccagctccagccgatacagttccagtatcaagataatattaaaaacctggaactggaggttatcaacctgcagaaagagaaagaagagttagtcagggagttgcagaccgccaagaaaaatgtgaaccaggctaagctcagcgaacaccggcacaaactcctgcaggaactggaaggccagatagcggacctcaaaaaaaagctcaacgaacaaagcaaactgttgaagctgaaggagtccacagagaggacggtgtctaaattaaatcaggaaatctggatgatgaagaatcagagggtccagctgatgaggcagatgaaagaagacgctgagaaatttcgccagtggaaacagaaaaaggacaaagaggttatccagttgaaggagcgcgataggaaacgccaatatgaactacttaagttggagcggaacttccagaaacagagtagcgttctcaggcgtaaaacagaggaggcagccgctgccaataaacgcctgaaagacgccctccagaaacagagagaggtcactgacaagagaaaagagactcaatcccacggtaaagaaggaatcgctgcaagagttagaaattggctaggcaatgagatagaggtgatggtgtcaactgaggaagctaaacgacatcttaacgacctgctggaagatagaaagattttggcacaggacgtggtgcaactgaaggagaagaaggaatcacgagaaaacccaccacctaaattgagaaaatgcacattctccttgtcagaggtgcacggccaggtgttggaatccgaggactgtatcacaaaacagatcgagagtctcgagacagaaatggaactgagatccgcccagatcgctgatctgcaacagaagctcctcgatgccgagagcgaggatcgcccgaaacaatgttgggaaaacatcgcgacaatcctggaagcgaagtgcgcccttaagtatctcattggagaactcgtctcatcgaagattcacgtgaccaagctcgagaatagtctcagacaatcaaaggcgtcatgtgcggatatgcagaagatgctattcgaggagcagaatcatttttcggaaattgagaccgaactccaggccgagttggtgcggatggaacagcaacatcaggagaaggtgttgtaccttgttagccagctgcaggaaagccagatggctgagaaacaactggagaaaagcgcaagcgaaaaagaacagcagttggtgtctacgctgcagtgccaggacgaggaactggagaagatgcgggaggtctgcgaacagaatcagcagcttctccaggagaatgagataataaaacaaaaactcattctcttgcaggtggcaagtcggcagaaacacctccctaatgacactttattgtcccctgactcttctttcgagtacatccctcccaaaccaaagcctagtagagtaaaggagaagttcctggagcaatccatggatatcgaagacctcaaatactgttctgaacattcagtaaacgaacacgaagatggtgatggcgacggcgattcggatgagggcgatgacgaggaatggaaacctactaaactggtcaaggtttcccggaaaaatatccaggggtgttcttgtaaaggttggtgcggcaataagcagtgcggctgtcgtaaacagaagagcgactgtggtgtggattgctcttgtgacccaacgaaatgccgaaaccggcagcagggcaaagattccctcgggaccgtcgagcagacacaggactctgaaggctcattcaagcttgaggatcctacggaggtcactcctggactgtcattcttcaacccagtctgcgccacacctaatagcaagattctgaaggagatgtgtgatatggagcaggtgttatcaaaaaaaacggcccctgcaccttctcccttcgatctaccagaaagcaaacacggtgccactgaataccagcagaacaagccgccgggcaagaagaaaaaacgtgctctagcctccaatactagcttctttagcgggtgtagtccgattgaggaagaagcacactag

SEQ ID NO: 121683 - DNA, 3099 bp, Artificial Sequence
  Description of Artificial Sequence: Synthetic coding sequence
atggctgagactaacaatgagtgctctattaaagtgctgtgcagattccgccccctgaatcaggccgagatactcaggggcgataagtttatccccattttccagggcgatgacagcgtggtgatcggaggtaaaccctatgttttcgatagagtgtttccacctaatacaacccaagagcaggtgtaccacgcatgcgctatgcagatcgttaaggatgttctggcagggtacaacggcacaatcttcgcatacggacaaacctcttccggcaagacgcataccatggaggggaaactgcatgaccctcagctgatgggtataatccctagaatcgccagggacatcttcaatcacatttattccatggatgaaaacctggaattccacatcaaggtcagctattttgaaatctacctcgataagatcagagaccttctggatgtgacaaaaaccaacctaagcgtccatgaggacaagaatcgcgtgccgttcgtgaagggctgtaccgagcgctttgtgagttcaccggaagaaattctggacgtcatcgatgagggaaaatccaataggcacgtggctgttactaatatgaacgaacattcttctcggagtcattcaatattcctgatcaacataaagcaggagaacatggagacggagcagaagctcagcggcaaactgtatctagtggatctggcagggtctgaaaaagtatccaagaccggagccgagggcgccgtgcttgatgaggcaaagaacataaataagagtctctccgcccttggcaatgtgatctcggccttggccgagggcaccaaatcttatgtcccttaccgcgacagcaaaatgacccgaatcctgcaggactctctgggggggaactgtcggaccaccatgttcatatgctgcagtccatcttcctacaatgatgctgagacaaagagtacattgatgttcggccagagggccaaaaccatcaaaaacaccgcctctgtaaacctggagcttactgcagagcaatggaaaaagaagtatgagaaagagaaagagaaaacaaaggctcaaaaggaaaccattgccaagttagaggcagaactctcacgctggaggaacggggaaaacgtgccagaaaccgaaaggctggctggggaggaggcagctttaggagcggagctgtgtgaggaaactcctgttaacgataactcttcaattgtggtccgcatcgctcccgaggaaaggcagaagtacgaagaggagattaggcgcctgtataaacagctggatgataaagatgacgaaattaatcagcagtctcagcttatcgaaaagctgaaacagcagatgttagatcaggaggagctgttggtatcaacacggggagacaacgaaaaggtgcagcgggagctgagtcaccttcagagcgaaaacgatgccgcaaaggatgaagttaaggaggtactgcaggctcttgaggagcttgctgtcaattacgaccagaaatcgcaagaggtggaagagaaaagtcagcagaaccagctgttagtggatgagctttcacagaaagtggcgacaatgctcagcctggagtctgagttgcagcgccttcaagaagttagtggccaccagagaaagcggatcgctgaagtcttgaatgggcttatgaaagacctgagcgaattttccgtgattgtcggcaacggcgaaattaagctgccagtggaaatttcgggagcaatcgaagaagagttcaccgttgcaaggctgtacatatctaagataaaatccgaagtcaagtcagtggtgaaaagatgccgccagctagaaaacttgcaggtcgagtgtcaccggaaaatggaggtgaccgggagggagctcagctcatgtcaactgttaatttcgcagcatgaagcgaaaattcggtcactcaccgagtatatgcagagtgtggaactaaagaaacggcatctagaagagtcatacgactctctgtccgatgagctggccaagctgcaggctcaggagactgtgcatgaagtggccctaaaggataaggagcctgatacccaagatgctgatgaagtcaaaaaagccttggagcttcaaatggagagtcacagagaggcacatcaccggcaactggcacgactgcgagatgagatcaacgaaaagcagaagaccatagatgagctgaaggatctgaatcagaagctgcagttggaactggaaaagctccaagctgattatgagaagctcaaaagtgaggagcatgagaaaagcaccaagctccaggagctaacatttctctacgagcgacacgagcagagcaaacaagacctgaagggtctggaagagacggtggcacgcgaattgcagacattacacaatcttcgcaagctcttcgtgcaggatgttactacgagggtgaaaaagtctgctgagatggaacccgaagactctggcggtattcatagtcagaaacagaaaattagcttcctagagaataaccttgaacagctcacgaaggtgcataaacaactggttcgcgacaatgccgatcttagatgtgaactcccaaaacttgaaaagaggctgcgagccaccgccgaaagggttaaagccctcgagggagccctgaaggaggcgaaggaaggggccatgaaggataaacgaaggtaccagcaagaggtggatcggatcaaagaggccgtgcgttataaatcatctggaaaacggggacatagcgcccagatcgcaaagcctgtgcgaccagggcactacccggcaagcagtcccaccaatccctatggcacacgttcacccgagtgcattagctatacaaatagcctatttcagaactaccaaaatctctacctgcaggcaacgccatctagtactagtgacatgtactttgctaatagctgcaccagcagcggagccacctcttcaggcggcccccttgccagctaccaaaaggccaatatggataacggaaacgctaccgacataaacgacaatcgctccgacctgccttgcggatacgaggcagaggaccaggccaagctgttcccactgcaccaagaaaccgccgcaagctag

SEQ ID NO: 121684 - DNA, 381 bp, Artificial Sequence
  Description of Artificial Sequence: Synthetic coding sequence
aagtcttctggcaagcgcggacactctgcacaaatcgccaagccagtcagaccaggccattacccggcgtcttctcccacaaatccctatggtacaaggtcgcctgagtgcatttcctacacaaattccctgtttcagaactatcagaatctctatctgcaggcgaccccctcttctacatctgacatgtactttgccaactcttgtaccagctctggggctacgtcaagtggcggacctctcgctagctatcagaaggccaatatggataatggtaacgcaaccgacattaacgataataggtccgacctcccctgcggttacgaagcagaagatcaagcgaagttgtttcccctgcaccaggagactgctgcgagttag

SEQ ID NO: 121685 - DNA, 2892 bp, Artificial Sequence
  Description of Artificial Sequence: Synthetic coding sequence
atggctgatctggccgaatgcaatatcaaagtcatgtgccggtttcggccacttaacgagagcgaggttaatagaggagacaagtacatcgcaaagtttcagggcgaggacaccgtggtgatagcttcaaagccctatgcctttgaccgcgtgtttcagtcctccaccagccaggaacaagtttataacgattgcgccaaaaaaatagtgaaagacgtcttggaaggatacaatggcaccatcttcgcctatggccagacttcatcaggaaaaacccataccatggaggggaaacttcacgatcccgagggcatggggatcattcctcgcatagtacaagacatatttaactacatttactccatggacgagaaccttgagttccatattaaggtgagctatttcgagatttacttagacaagatccgggatctgctggacgtttcaaagaccaacttgtctgtgcacgaagacaaaaatcgagtgccatatgttaaaggttgcactgagagatttgtgtgttctcctgatgaagtgatggacaccattgatgagggcaagtccaatagacacgttgctgtaactaatatgaatgagcacagcagtcggtcacacagcatttttctcatcaatgtgaaacaggaaaatacgcaaactgaacaaaagctatcaggaaaattatatcttgtggaccttgctggttctgagaaggtaagcaaaactggggccgagggggctgtgttagatgaagcaaagaatattaacaagagcctgagtgccctcggtaatgtcatctccgccctagcggagggctcaacctatgtcccctaccgagactcaaagatgacccgaatcctgcaggattcccttggcggcaactgtcggacgacaatcgtcatctgctgctcaccatcgtcctacaatgagagcgagacaaaatcaaccttgttgttcggccagagagctaaaaccattaagaacactgtctgtgttaacgtggaattgactgcggaacagtggaaaaagaaatatgagaaggagaaggaaaaaaataagatactgcgcaacactatccagtggcttgagaatgagcttaatcggtggagaaatggcgagaccgtccccattgacgaacagtttgataaggagaaagctaaccttgaggcttttacggtagacaaagacataaccttgacaaacgacaaacctgcaaccgctattggggtgatcggcaatttcacggacgccgagcgtcgcaaatgtgaggaggagattgccaaactttataagcagctcgacgacaaagacgaggagattaaccaacagtcacagctggttgagaagttaaaaacgcagatgctggatcaggaggagcttttagcgagcaccagacgcgaccaggataacatgcaagctgagctgaaccgtctccaggccgagaacgatgcctcgaaagaggaagtgaaagaagtgctgcaggctctcgaagaattggctgtgaactatgaccaaaagagtcaagaagtggaagataagaccaaagagtacgaactgttgtcagatgagctgaaccaaaaatctgcgacgctcgcaagcatcgacgccgagttgcagaaattgaaagagatgacgaatcaccagaagaaacgggccgccgagatgatggcttccctgctgaaagacctggcggagatcggaatagccgtggggaataacgatgtgaaacagcccgaaggtacggggatgatcgacgaagaattcactgttgctcgcctctacattagcaagatgaaaagcgaggtcaaaaccatggtgaagcgatgcaagcagctggagagtacccaaacggagtcgaataaaaagatggaggaaaatgagaaagagttagcggcttgtcagctgcggatctcccagcacgaagccaaaataaagtccctgaccgaatacctgcaaaacgttgagcagaagaagcgccagcttgaggagagcgtggacgccctgagtgaggaactggttcagcttagagctcaggaaaaggtccatgaaatggagaaagaacacttgaacaaagtgcagaccgcaaatgaggtgaagcaggctgtggaacagcagatacagtcacatcgagagacacatcagaagcagatctctagtcttcgagacgaggtggaggccaaggctaagctgattaccgatctgcaggatcaaaatcaaaagatgatgctggagcaggaacggctgagggtagaacatgaaaagctcaaagccaccgaccaggagaaatcacgcaaacttcacgagctgactgtgatgcaggacagacgagagcaggcccgacaggatctgaagggactggaggagaccgttgctaaggaactccagaccctgcataatctgcggaagctcttcgtgcaggacctggccacccgggtcaaaaaatccgcagagatcgattcagacgacaccggcggttcggcagcccagaagcagaagataagttttcttgaaaataatctggaacaactgactaaggtccacaaacagctggtgcgcgataacgctgacttaaggtgcgagctgcctaaactcgagaaaaggctgcgcgccaccgctgaaagggtgaaggccctggaaagcgctctcaaggaggccaaagaaaacgctagtagggatcggaaacgatatcagcaggaggtcgaccgcatcaaagaagccgttcgctccaaaaatatggccagaagggggcactctgcacagatcgctaagcctataagacccgggcagcaccccgccgcaagccccacccacccaagcgcaataagaggaggcggcgcctttgtgcaaaattcgcaaccagtggcagtccgaggaggcggcggaaaacaggtatag

SEQ ID NO: 121686 - DNA, 2583 bp, Artificial Sequence
  Description of Artificial Sequence: Synthetic coding sequence
ggaaaactccacgaccctcaactgatgggcattatccctcgcatcgcccacgatatttttgatcatatctactctatggatgaaaacttagagtttcatataaaggtgtcctatttcgaaatttacttggataagatcagggacctgctggatgtgtccaaaacaaatctcgccgtacacgaggataagaaccgggtcccttacgttaaaggctgcaccgaacgctttgtctcatctcctgaagaggtcatggatgttatcgatgagggtaaagctaatagacatgtcgctgtaacgaacatgaatgaacacagctccaggagccactccatatttctgatcaatattaaacaggagaatgtggagaccgagaagaagctttcgggcaaactgtacctggtggatctggcaggctctgaaaaagtgagcaagaccggagccgagggagcagtccttgacgaagcaaagaacatcaacaagagcttgagcgccctcggaaatgtgatttccgccctggctgaagggaccaagactcatgtgccttatagggattctaagatgacacggattttgcaggatagcctcggcgggaactgtcggaccacgatagtgatttgctgttctcccagtgttttcaatgaggcggaaacaaaaagcacactgatgtttgggcaacgggccaagacaattaagaacaccgttagcgttaacttagaactgaccgcggaggagtggaagaaaaagtacgagaaggagaaggagaagaacaagacccttaagaacgtgatccaacatcttgagatggagctgaatcgctggagaaacggcgaagccgttcctgaagatgagcagatcagtgctaaagatcagaaaaacctggaaccttgtgacaatacaccaatcatcgacaatatcgcgcctgtggtggcaggaatcagcaccgaggaaaaagagaagtacgatgaagaaatatcttcactgtataggcagttagacgataaagatgatgagattaaccagcagagtcagcttgccgaaaagcttaagcagcagatgttagaccaagatgagttgctggcttctacacggagagactacgaaaagatacaagaagaattaacacggttgcagattgaaaatgaggcagccaaggacgaggtcaaagaggttctgcaggcgctggaggaactggccgtgaattatgatcaaaaatctcaggaggtagaagataagacaagggctaacgagcaactgaccgacgaactggcccagaagaccactactctgacaactacccagcgggaactgtcacaactccaggagctatcaaaccaccagaaaaagagggccaccgagattttaaatcttcttcttaaggatcttggcgaaattggagggattatcgggaccaacgacgttaaaacactggcagacgtcaatggtgtcatcgaggaagaattcaccatggctagactgtacatctcaaagatgaaaagtgaggtgaagtccctcgtgaatcggtcaaagcagttggagtctgctcagatggactccaaccgcaagatgaacgccagtgagagagaattggccgcttgtcagctgctgataagccagcatgaggccaaaatcaagagcttgacggactacatgcagaacatggagcagaagaggcgccaactggaagaatcgcaggatagcttgtcagaggagctggctaagttgcgcgcccaggaaaagatgcacgaggtctcctttcaggacaaggagaaggaacacctgacacgcctccaagacgcagaggagatgaagaaagctttggaacaacagatggagtcacatcgcgaggcgcatcagaaacagctgagcagactccgcgatgagatcgaagagaagcaaaaaattatagatgagatcagggacctcaatcagaaactccagttggagcaggagaaactttcgagcgattacaataaactgaagatcgaagatcaggagcgtgagatgaaactggagaaactactgttactcaatgacaagagagaacaggcccgggaagatttgaagggattggaggaaacagtttctcgcgagctacagacgctgcacaacctgaggaaattgttcgtccaagaccttactacccgagttaaaaagtctgtggagttggacaatgacgacgggggtggatccgctgcgcagaaacagaagatctctttcctggaaaataatttggagcagttgaccaaagtgcacaagcaactagttagagacaacgcagaccttaggtgtgaattgcccaaactggaaaaacgccttcgcgccacggctgagcgggtgaaggctctggaatctgcactcaaggaggccaaggaaaacgctatgcgggaccgaaagcgctaccagcaagaagtcgacaggattaaggaggcagtacgagccaaaaacatggctcgacgcgcacattctgcacagatcgctaagcccatcaggccgggccactaccccgcaagctctcctacagcagtgcacgcaattaggggagggggaggaagttcctccaacagcacccactatcaaaagtag

SEQ ID NO: 121687 - DNA, 2178 bp, Artificial Sequence
  Description of Artificial Sequence: Synthetic coding sequence
atggccacctacatccacgtctcaaagacaggcgccgagggtgctgtactggatgaggcaaaaaacattaacaagtccctttcagcgctggggaacgtgatttctgccttagccgaaggaacaaagacccatgtgccctatagggactctaagatgacacggattctccaggacagtctgggaggaaactgccgcactaccattgtgatctgctgttcccctagtgtcttcaacgaggctgaaactaaatcaacactcatgttcggacagcgcgccaagacaattaaaaacaccgtgagtgtgaacttagagcttactgctgaggaatggaagaaaaaatacgagaaggagaaggagaaaaataaaactcttaagaatgtgatccaacacttggaaatggagctgaatagatggcggaacggtgaagctgtcccagaagatgagcagatctctgccaaagatcaaaagaacctggagccttgcgacaatacacctataatcgataacattgcccccgtcgtcgccggaatatccacggaggagaaagaaaagtacgacgaggaaatcagcagcctctacagacaactggatgacaaggatgacgagatcaaccagcaaagccagttggctgaaaagctgaagcaacagatgctggaccaagacgaattgcttgcttcaacccgtagggactacgaaaaaattcaggaggagctcacacgcctgcagattgaaaacgaggccgctaaggatgaggtgaaggaggtgctgcaagccctggaagaattggccgtcaactatgaccagaagtcacaggaagtggaggacaagactagagcgaatgaacagctcactgacgaactggctcagaaaactaccactctcacgactacccagcgcgagcttagccagcttcaagagctgagcaatcatcaaaaaaagagggccaccgagattctaaatctcctacttaaggatttaggcgagattggcgggattatcggtacaaatgatgtgaaaacactggccgacgtcaatggcgtcattgaggaggagttcactatggcacgcctctatatcagcaaaatgaaatccgaagtgaagtcactcgtcaacagatccaaacagctagaatccgctcagatggatagtaataggaagatgaacgcctcagaacgcgagctggccgcctgccagttactgatttcccagcatgaagctaaaattaagtctctgaccgactacatgcaaaatatggaacagaagaggagacaactggaggagtcacaggatagtctgtctgaggagctggcaaagctgcgggctcaggagaagatgcacgaggtgagcttccaggacaaggaaaaagaacacttaacccgtctccaagacgccgaagaaatgaagaaggctctcgagcaacagatggaatcgcatagagaggcccaccagaagcagctctcccgactaagagacgagatagaggaaaagcagaaaattattgacgagattcgcgatctcaaccaaaaactgcagctggagcaagagaagctctcttctgattataacaaactgaagatcgaggaccaagaaagagaaatgaagctcgaaaagctgctgctgcttaatgacaagagggagcaagcaagagaggatctcaaagggctcgaagagaccgtgagcagagagctgcagacccttcacaatctgcgaaaattgttcgtgcaagacctgacaaccagggtcaaaaaaagcgtggagcttgacaatgatgatggagggggcagtgccgcacagaagcagaagatctcttttttagaaaacaatctcgagcagttgacaaaggtccacaagcagctcgtgcgggacaatgccgacctgcgctgcgaactgcctaaactggagaagaggctgcgcgccactgccgagcgggtgaaagcactggagtccgctttgaaggaggctaaggagaacgccatgagggatcgtaagcggtaccagcaggaagtggatcggataaaggaggccgtgagagcaaaaaacatggctcgacgcgcacacagcgcacagatcgctaagccgatccggcccgggcactacccagcttcctcccccacagccgtacacgccattcgcggcggcggggggtcatcatccaacagtacgcattatcaaaaatag

SEQ ID NO: 121688 - DNA, 2589 bp, Artificial Sequence
  Description of Artificial Sequence: Synthetic coding sequence
atgtggggaaaattgcacgatcctcaactcatgggtatcattcccaggatcgcacatgatatctttgatcacatttatagcatggatgagaatttagagtttcacattaaggtgagctactttgagatttacctcgacaaaataagggacctgctagatgtctccaagaccaacctggccgtgcatgaggacaaaaacagagttccttatgtcaagggctgcacagagagatttgtttcctcccccgaggaagtcatggacgttattgacgaaggaaaggctaacaggcacgtcgccgtgaccaacatgaacgagcacagctccaggagtcatagcatttttcttatcaacattaagcaggaaaacgtggagacggagaagaaactctccggcaaactgtatttagtggacctggctggttctgagaaagtgagcaaaaccggcgccgaaggagcagtgctagatgaagctaagaacatcaataagagcctctcagctttgggaaatgttatctctgcacttgccgaaggtaccaaaacccacgtaccatatagagatagcaagatgaccaggatcctgcaggacagcttaggcggtaattgtagaacgactatcgtgatctgttgttctccttctgtgttcaacgaggctgagacaaaatccaccttaatgtttgggcagagagccaagaccattaagaacactgtcagtgtgaacctagaactgaccgccgaggagtggaagaaaaagtacgaaaaagagaaagaaaagaataaaaccctcaaaaatgtgatacagcatctggaaatggaactgaaccgctggcgtaacggagaggccgtccctgaggatgagcagatttcagctaaggatcaaaagaatttggagccatgcgacaacacacccatcatcgacaacatcgccccggttgtggccgggataagcactgaagaaaaggaaaaatacgacgaggagatctcttcactctatcggcagctggacgataaggatgacgagatcaatcagcagagccagctggctgagaagttaaagcagcagatgctagatcaagatgaactgcttgctagcactcgccgcgactacgagaagatccaggaagagctgacaagactacagatcgagaacgaggctgccaaagacgaggtaaaagaagttttgcaggctttggaagaactggcggtgaattatgaccagaagagccaagaagtcgaggacaagaccagagccaacgagcagctgactgatgaactagcacaaaagacaacgaccctcactaccacccagagagagttgtcgcagctgcaggagctgagtaaccatcagaagaaacgggccactgagatcctgaatcttctgctcaaggaccttggtgagatcggaggcatcatcggcacgaatgacgtgaagacactggccgatgtgaatggtgtcattgaagaggagttcaccatggcccgcctctatattagcaagatgaagagcgaagtcaagtcactggtgaacaggtctaagcaactagaaagtgcccagatggatagcaatagaaaaatgaatgcttctgaaagagagctggcggcatgtcagttacttatcagccaacacgaagctaagataaagtctctcacagactatatgcagaatatggagcaaaaaaggagacagcttgaggagagtcaggattcactgtcggaagaactggcaaagctccgggcacaagagaaaatgcatgaagtgagtttccaggacaaggagaaagagcacttgactcgactgcaggacgccgaagaaatgaagaaggccttggaacaacaaatggaatcgcatcgcgaagctcaccagaagcagctctcccgactccgggatgagatcgaggaaaaacagaagattatagatgaaataagagatctaaaccagaagctgcaacttgagcaggaaaaactcagctcggattacaacaagctcaaaattgaggatcaggagcgcgagatgaaactagagaaactgcttctcctgaacgataagcgcgagcaagccagagaagatttgaaagggctcgaggagaccgttagcagggagcttcaaactctacataacctgcggaaactgttcgtgcaggacctgactacccgagtaaagaaatcagtggagctggataacgatgacggtgggggatccgcagcacagaaacagaagatttcattcttggagaacaatctggagcagctgaccaaggtgcacaaacagctggtccgagacaacgctgatcttcggtgtgaactgcccaaacttgagaaacgtctgcgggccactgcagagcgcgtgaaagcccttgagtcagcacttaaggaggctaaggagaatgcgatgagggatcgtaaacggtaccagcaggaagttgaccgcatcaaagaagccgtgcgcgcaaaaaacatggcaagaagggctcacagtgcccaaatcgctaaacccattcggcccggccactatccagcatcgagtccgacggccgtacatgcgattcgcggaggcggcggaagcagtagtaattccactcattatcagaaatag

SEQ ID NO: 121689 - DNA, 2874 bp, Artificial Sequence
  Description of Artificial Sequence: Synthetic coding sequence
atggccgaccctgccgaatgtagcattaaggttatgtgccggtttagaccactcaatgaggccgagattctacggggagacaagtttattcctaagtttaagggggacgagacagtggtgattggccagggaaagccctacgtatttgaccgggtgctgccacccaacacgacccaggagcaggtctacaacgcgtgcgccaaacagatcgtgaaggacgtgcttgagggatacaatggcacaatcttcgcttatggccagaccagttctggcaaaactcatactatggagggaaaactccatgaccctcagcttatgggtattatccctaggatagcccacgatatcttcgatcatatctactctatggatgaaaatctggaattccacattaaggtctcatactttgagatctacttggataaaattcgggacctgctggatgtgagtaaaacaaacttagcagtccacgaagataagaatagagtgccctacgtcaaggggtgtacggaacgatttgtgagttcacctgaggaagtgatggacgtaatcgacgaggggaaggcaaaccggcatgtcgctgtgacaaatatgaatgagcacagctcgaggagccactcaatctttttgattaatattaagcaggaaaatgtagagaccgaaaaaaaactgagtggcaaactctacctcgtggacttggccggaagtgaaaaagttagcaaaaccggggccgagggggccgtgttggacgaagcaaagaacatcaacaagagtctgtcagctctagggaacgtgatctctgctttggcagagggaaccaagacgcatgttccctatcgcgacagcaagatgacaaggatactgcaagactcactcggtgggaattgcagaacaaccattgtgatatgctgctcccccagtgtcttcaatgaagcagagactaaaagtactctgatgtttggacagcgggctaagactattaagaatacagtatcagtaaaccttgaactcactgcggaggagtggaagaagaagtatgaaaaagaaaaggagaagaacaaaacgttgaagaacgttatccagcatttagagatggagctgaatagatggcgcaacggcgaggcagttcccgaagatgagcaaattagcgctaaggatcaaaagaatctggagccttgcgataataccccaatcattgataacatcgcaccggtcgtcgccggcatttcaaccgaggagaaggagaagtacgatgaggaaattagctccctctaccggcagttagatgataaggacgatgagattaaccagcagagtcagttagcagagaagcttaagcagcagatgctggaccaggacgagctcctggcttctacccggagggactatgagaaaatccaggaggagctgactaggctccagattgaaaatgaagctgccaaggacgaggttaaagaggtactacaagctctcgaggagcttgcagtcaactacgatcaaaaaagtcaggaggtcgaagacaagacacgtgctaatgagcagctgactgatgagcttgcgcaaaagacaacgaccctgaccactactcagcgagaattgtcccagctgcaggaactaagtaatcaccagaagaagcgtgctactgagattctcaacctcctgctaaaggacctgggcgaaattggaggtattatcgggactaacgatgtgaaaactcttgctgatgttaacggcgtcatcgaggaggaattcactatggcaaggctctacatttctaaaatgaagtccgaagtcaaaagcctggtaaacagatctaaacaactggagtcagcccaaatggatagtaataggaagatgaatgcttctgagcgggagctagcagcatgtcaattattgatctcacagcacgaggcgaagattaaaagcctcactgactacatgcagaacatggagcaaaaacgaagacagctcgaggagagtcaggattccttgtccgaagaactcgctaaattacgagctcaagagaagatgcacgaggtatccttccaggataaagaaaaggagcatctaaccaggcttcaggatgctgaagaaatgaagaaggctctcgagcagcaaatggaatcgcacagggaggcccatcagaaacagctgtcccgactacgggatgaaatcgaggagaagcagaagatcatcgacgaaataagggacctaaaccagaaactacagctggagcaagagaagttgtcttcagattataacaagctcaaaatcgaagaccaagagcgggaaatgaagctcgaaaaactcctccttctcaatgataaaagagagcaggctcgcgaggatctgaaaggcctagaagagactgtgtcccgggagctccagaccttgcacaatctaaggaaactcttcgttcaggatcttacgacccgggtaaaaaagtccgtggaactcgacaatgacgacggcggcggctccgcagcccagaagcaaaagattagtttcctggagaataatcttgagcagctgaccaaggtacacaaacaactagtaagagacaacgccgacttgcggtgcgagttgcccaagttagaaaagcggctgcgagccacagccgaaagggtgaaagctctcgaatctgccctgaaagaggctaaggaaaacgctatgagagatcgcaagagatatcagcaggaagtggaccgaataaaagaggctgtgagggctaaaaatatggctcgacgggcccatagtgcacagatcgcaaaacccattcgaccaggccattatcccgcgtcctcccccactgccgtgcacgctatacgcgggggagggggctcttctagcaactccacgcactaccaaaagtag

SEQ ID NO: 121690 - DNA, 219 bp, Artificial Sequence
  Description of Artificial Sequence: Synthetic coding sequence
atggccgaccctgcagagtgtagcatcaaggtgatgtgccggtttaggccactaaatgaagcagagattcttcgtggcgataaattcatccccaagtttaagggagatgaaacagtagttatcggccagggtaagccctacgtgtttgaccgcgtgcttccgcccaacacgacacaagagcaggtttacaatgcttgtgccaaacagattgtgaaatag

SEQ ID NO: 121691 - DNA, 552 bp, Artificial Sequence
  Description of Artificial Sequence: Synthetic coding sequence
atggaacagaggttggccgaattccgcgcagctcgtaagagggctgggctcgccgctcagccacccgctgcatcacagggcgcacagactcctggagaaaaagcagaggccgctgcaacacttaaggctgcacccgggtggctaaagcggttcctcgtatggaagccgcggccagcctccgcccgcgcacagcctggcctcgtgcaggaagcggcccagcctcaggggagcaccagtgaaaccccttggaacaccgctattcctctgccaagctgctgggatcagtccttcctaaccaatatcacatttctgaaggtgttactatggctcgtgctcctgggcttgttcgtggaacttgagttcggcttggcttattttgtgctctctctcttctattggatgtatgtgggcacccgcggtccagaggagaagaaggagggagagaagtcagcttactccgtgttcaaccctggctgcgaagccattcagggtactttaactgccgagcaattggaacgcgagctgcaactgaggcctttggctggcaggtag

SEQ ID NO: 121692 - DNA, 2445 bp, Artificial Sequence
  Description of Artificial Sequence: Synthetic coding sequence
atggtcaagcaaacgatacagattttcgcaagggtgaaacctcctgtaagaaaacatcaacagggtatatatagtatcgatgaggacgaaaaactcattcccagtctggagatcatcctgcctcgtgacctggctgatggcttcgtcaataacaaacgtgaatcttacaaatttaagttccagcggatcttcgaccaggatgctaatcaggagactgtgtttgagaacattgccaaacccgtcgccggatccgtgctggccggctacaatggcacaatctttgcgtacgggcaaactgggtctggtaaaactttcacgattacaggaggagcagagagatacagtgaccggggcattattccacgcaccctgtcctacattttcgaacagcttcaaaaggattcgtccaaaatctacacaacgcacatttcatacctagaaatctataatgagtgcgggtacgacctgcttgaccccaggcacgaagccagcagtctcgaagacctacctaaggtgacaatcctggaggacccagaccagaacatccacctcaagaatctgactctgcaccaggccacaacagaagaagaggcccttaatcttctcttcttgggggacacgaaccggatgattgctgagaccccgatgaatcaggccagcaccaggagtcattgcatctttacaatacacctatccagtaaggaacctggatcggccacagtgcgccacgccaagctgcacctggtagatctggctggctctgagcgggttgctaaaactggagtgggggggcaccttctcacagaggccaagtacattaatctgtcgttgcactatcttgaacaggtcatcatcgccttgtcagagaaacaccggtcacatattccttatcgaaacagtatgatgaccagcgtactgcgtgattctcttgggggaaactgcatgactactatgattgcgacactgtccctggaaaaaagaaacctggatgagtccatatccacctgccgctttgctcaacgggtcgcgcttatcaagaacgaggcggttttaaatgaagagataaatcctcgactcgtaatcaaacggctgcagaaagagatccaggagcttaaagacgaactggcaatggtgacaggcgaacaacgaaccgaagccctgaccgaggcagaactgcttcagctcgagaagctcataacctccttcttagaggaccaagatagcgactcccggctggaggtgggcgccgacatgagaaaagtgcaccactgcttccaccacttgaagaagttgctcaacgacaaaaagatccttgagaataacaccgtctccagcgaatcgaaagatcaggactgccaggaaccgctcaaagaggaggagtaccggaaactgcgagatattctcaaacagcgtgataatgaaattaacattctggtaaatatgctgaaaaaggaaaaaaagaaagcccaggaagccctgcatctggccggcatggatagacgagagtttcgtcagtcccagtcaccccccttcaggttgggaaatcccgaggaaggccagcgcatgcgcttaagtagcgctccgagccaggctcaggacttttcaatcctcggaaagcgtagttcactgcttcataaaaagattggtatgcgcgaggaaatgagcttggggtgccaggaagcattcgagatatttaaacgggaccacgccgattctgtgactatcgacgacaataagcagatcctgaaacagcggtttagcgaggcaaaggcactgggcgagtccattaacgaggcccgcagcaagatagggcatttgaaggaggagatcacccagagacatattcagcaagttgccctgggcatcagcgaaaatatggctgtcccattaatgcccgaccagcaggaggagaagctccgatctcagctggaagaggagaagcgtcgctacaagaccatgtttacccgtctgaaggcactgaaggttgaaattgagcacctgcagctcctgatggataaagcaaaagtgaagctgcagaaagaatttgaggtttggtgggccgaagaggcgaccaacctgcaggtgaattccccagctgtcaactcactggaccacaccaaaccctttttgcagacttccgacagtcagcacgagtggtctcaattgctctcaaacaagtcttcgggcggctgggaggtccaggatcaggggacaggcagattcgatgtgtgcgatgtcaatgcacggaagatcctgcctagtccttgcccctcaccccattcccagaagcagtccagtacctcaacacctctggaggacagcattccaaaaaggcccgtatcttcaatccccctgacaggggatagtcagaccgacagcgatatcattgccttcattaaagccaggcagagcatcttgcagaagcagtgtctggggtccaattag

SEQ ID NO: 121693 - DNA, 498 bp, Artificial Sequence
  Description of Artificial Sequence: Synthetic coding sequence
atgatcgcagaaactcccatgaatcaggcaagcacgcgctcgcactgtatttttactatccatctctctagtaaggagccggggtccgcaacagtaagacacgcaaaactccacctggtcgatctggccggttctgaaagagtcgccaagaccggagtcggcgggcacttactgacggaagccaagtacataaacctcagcctgcactacctggagcaggttattatcgctctttccgaaaagcatcgtagtcacattccatacaggaattccatgatgaccagtgtgctaagagattccttgggagggaactgcatgaccacaatgatcgcaaccctgtcattggagaaacggaacctagacgaaagtattagtacatgtcggtttgcacagcgggtagcgctgatcaagaatgaagcggtgttaaacgaagagatcaacccacgcctgaaagctccatcgagctctgatggcgtgttgttttgccggaaccagtag

SEQ ID NO: 121694 - DNA, 1962 bp, Artificial Sequence
  Description of Artificial Sequence: Synthetic coding sequence
atggcgagcagcctttatgacctcaagaaagttacaattctcgaggaccctgaccagaacattcatcttaagaatcttacgctgcaccaggccaccaccgaagaagaggcccttaacctgctctttttaggagacacaaatagaatgatcgctgaaacccccatgaatcaggcaagcacccggagccattgtatattcactatacatctctcatccaaagaaccgggctcagcaacagtgcggcatgcaaaactccacctagtcgatctggctgggagtgagagagtcgctaagaccggtgtcggaggacatcttctgacggaggccaaatacatcaatttatcgctccattacctggaacaggtgatcatagcactgtccgagaagcatcgatctcatattccttacagaaattcgatgatgacttctgtgctgcgtgatagcctcggaggcaactgtatgacaaccatgattgccaccctgagcctggagaagcggaatttagatgagtctatatcaacttgcagattcgcccagcgtgttgccttgataaagaacgaagccgttctgaacgaagaaatcaatcccagattggtaattaaaagactccaaaaggagatccaggagcttaaggacgagctggctatggtgacaggcgagcagcgcacagaggctttgactgaggctgagctgttgcagctggagaagttaatcactagttttctcgaggaccaggacagcgatagtagactagaggtgggggctgatatgaggaaggttcaccattgttttcatcacctgaaaaagctgctgaatgataagaagatcctagaaaacaacacagtaagtagcgagagcaaggaccaagattgtcaggaaccactgaaagaagaagagtacagaaagctgagagacatccttaaacagagggataacgagattaacattctggttaatatgctcaaaaaggagaagaagaaggcgcaggaagcattacatctcgccgggatggacagacgagagtttcgccaaagccagagccccccctttcgcctaggcaatcctgaggaaggccagcgaatgcggctcagctctgctccgtcacaggcacaggacttttctattttgggtaagcggtctagcctcctccataagaagatcgggatgcgtgaggagatgtcccttggatgccaagaggctttcgaaattttcaaacgggaccatgctgatagcgtgaccatcgatgacaacaagcagattctaaaacagaggttttccgaggccaaagccctcggggagtctattaacgaagccaggagcaaaattggccatttgaaagaggagatcactcaacggcatattcagcaagtggctctgggaatatccgaaaatatggcagtacccctcatgcctgaccagcaggaagaaaagcttcgctcgcagctcgaagaggaaaagcgcagatacaagactatgttcacccgcctgaaggcgctcaaagtagaaatcgagcacttgcaactacttatggataaggcaaaagtaaaacttcagaaagagttcgaggtctggtgggccgaggaagccacaaacctccaggtgaactcacctgccgttaactcactcgaccacacgaagccttttctgcagacctctgattcgcagcacgagtggtctcagctactctccaacaagtccagtggaggttgggaagttcaggaccaaggcacggggaggttcgatgtgtgcgacgtgaacgccagaaagatcttaccttccccatgcccgtcccctcatagccagaagcaatcgagcacttccacacctttggaggactccattccaaagcgccccgtcagttcaatcccactgacaggtgattcacaaacggattccgacataatagcattcataaaggcacgccagtccatcctacagaagcagtgtctgggaagtaattag

SEQ ID NO: 121695 - DNA, 2394 bp, Artificial Sequence
  Description of Artificial Sequence: Synthetic coding sequence
atggtcaaacaaactatccagatatttgcaagggtcaaaccgccggtgcgcaagcaccaacaggggatttattcaattgacgaagatgaaaaactaatcccatccttagagatcattcttccccgcgatctggccgatggattcgtgaacaataaacgcgaatcgtataagtttaaattccagagaatcttcgatcaagacgctaatcaagagacagtgttcgaaaacattgccaagcctgttgcaggctcagtgcttgctggctacaatggaaccatctttgcctacggtcagacaggatccggcaaaacatttactattaccggcggggccgaacgatacagcgatcgaggaattattcctcgcactctgtcctacatttttgaacagcttcagaaagatagttctaagatctacaccacccatatcagctacctggagatctataatgaatgcggctacgacctgctggatcctagacacgaggcaagctcgctggaagatctgccaaaggtgacaatattggaggatccagaccagaatattcacctgaaaaatctgacactgcaccaagcgacaactgaggaagaggccctcaacttattgtttttaggggacactaatcgtatgatcgctgaaactcccatgaatcaggccagtacccggagtcactgtatttttacgatccatctgtcaagcaaagagccaggcagtgccacggttaggcatgcaaaattgcacctggttgatcttgctggatctgagagagtggcaaaaacgggtgtggggggtcacctgctgactgaggcgaaatatatcaatctatcactgcactatttggagcaggtcatcattgcactgtctgagaaacaccgatcccacataccataccgcaattctatgatgacctcggtactgagggattcactgggcggcaattgcatgacaacgatgattgcaaccctgagtctggaaaagagaaacttagatgagtcaattagcacatgccgatttgcgcagcgggtggcgctgatcaagaacgaggccgtattgaacgaggaaattaatcctcgcttagtaatcaaacggctacagaaagagattcaagaactcaaggatgagttagctatggtcacaggtgaacagcgcaccgaagctctgactgaagctgagttactgcagctggagaaattaattacatcttttcttgaggaccaagacagtgactccagactggaggtgggcgcagacatgcggaaggtgcaccactgctttcatcacttaaaaaagcttcttaatgacaagaaaattctagagaataacacagtgtccagcgagagcaaggatcaagattgccaagaacctcttaaggaagaagagtaccgaaaacttcgagacattctgaagcagcgagacaatgaaatcaatattctggtaaatatgcttaaaaaagagaagaaaaaggcccaggaggccctgcatctcgcaggcatggacaggcgcgagttcagacaaagccagagccctcccttccgcctcggaaatcctgaggaggggcagcgaatgcggctttcttccgctccatcccaagcgcaggatttcagcattctcggtaagagaagttcactgctacacaaaaaaatcgggatgcgagaggaaatgagccttggatgtcaagaggcctttgaaattttcaaaagagatcacgccgatagcgtcaccattgacgataacaagcagatattgaagcagcggttcagcgaggccaaagctttaggggagagcattaacgaagcccggtctaaaattggcatttccgagaacatggccgtgcccctgatgcctgatcagcaagaagaaaagcttcgcagtcaactcgaggaggagaagcggcggtacaaaacaatgtttactcgcctcaaagccctgaaagtggagattgagcacctgcaattgttaatggataaagccaaggttaaactgcagaaagaattcgaggtttggtgggctgaagaggccactaacttacaggtgaatagtcccgcggtgaattccctggatcatactaagccttttcttcagacttctgattcacaacacgagtggtcccaactgctgtcaaataagtcttctggcggctgggaggtacaggatcagggaaccggacgattcgatgtgtgcgatgtgaatgcaaggaagattctgccatccccatgtccttcgccacactctcaaaaacagtcctccaccagtaccccactggaggactctattccaaagagacctgtctcctctatccccctgacaggagactctcagacagatagcgacatcatcgcgttcatcaaggcccggcaatcaatcctacagaaacagtgtttaggcagcaattag

SEQ ID NO: 121696 - DNA, 2394 bp, Artificial Sequence
  Description of Artificial Sequence: Synthetic coding sequence
atggttaaacagaccatccaaatctttgcacgggtgaagccccccgtgcggaagcatcagcagggcatatactcgatcgatgaggatgaaaagctgattccgtcactagaaattatacttccccgagatcttgcagatgggtttgtgaacaataagagagagagctacaagttcaagttccaaagaatatttgatcaggacgcaaaccaggagactgtcttcgagaatatagcaaaaccagtggcagggagcgtccttgccggttataatggtacaatctttgcatacgggcagaccggttcgggcaagacatttaccattacagggggcgctgaacgatatagcgatcgcgggattattccacggaccctctcttatatctttgaacaactccaaaaagactcatctaagatttacacaacacatatctcctatctagagatatacaatgagtgcggctacgaccttcttgatccccggcacgaggccagttctttggaagacctgcctaaagtaactatcttggaggatccagaccaaaacattcatttaaagaacctgacccttcatcaggccacaacggaggaggaagcactgaacctccttttcctgggcgacacgaaccgtatgatcgctgaaactccaatgaaccaagcctctacccggtcacattgtattttcactattcaccttagctctaaggaacccgggtccgccaccgtgaggcacgccaaattacatcttgtggacttggccggcagcgaaagggtcgcgaagacaggagtcggtggacatctcctaactgaggccaagtatatcaacctcagcctgcactacctagagcaggtcataatagccctgtctgaaaaacacaggagtcacataccatatcgcaattcaatgatgacttccgtgctgagagacagcctcggcggcaattgcatgaccactatgatcgcgacgctaagcctggaaaaaaggaatcttgacgaaagcattagcacctgccgcttcgcccagcgagtggcacttatcaaaaacgaggctgtgctcaacgaggaaatcaatcctagattggtgatcaagcgccttcagaaagaaatacaggagttgaaggacgaactagctatggtcacaggagagcagcggaccgaggcattgacagaggccgaacttttgcaactggagaagctaatcacctcgtttctggaagatcaggatagtgattcccgattggaagtaggcgcggatatgaggaaagtccaccattgctttcaccatctcaagaaactcttgaatgacaagaaaattctggagaacaatacagtaagttcagagtcgaaagaccaagactgtcaggaacctctgaaagaggaagagtatagaaagctacgcgatatcttgaaacaacgggacaacgaaattaacattctggtgaatatgctcaagaaagagaaaaaaaaagcacaggaggccctgcacttggcgggcatggaccgcagggaatttagacaaagccagagcccacccttccgccttggaaatccagaagaaggccagcgcatgcggctctcctccgctccaagccaagcgcaagattttagcatactgggcaagcgcagtagtcttctacacaagaaaatcggaatgcgggaagaaatgtcccttgggtgtcaagaagccttcgagattttcaagcgggaccacgctgattccgttacaattgacgataacaagcagatattgaaacagaggttctctgaggcaaaggctctcggagaaagcataaatgaggcaaggtcaaaaatcggtcatctcaaagaggagattacacaacgccatatccaacaggtggcccttgggataagcgagaacatggctgtaccgcttatgcctgaccagcaggaggagaaactgagaagccagttggaagaagagaagcgcaggtacaaaaccatgttcacgaggctgaaagcacttaaagtggaaatcgaacacttgcagctgctgatggacaaagccaaagtaaagctgcagaaggaatttgaggtatggtgggccgaagaggccactaacctgcaagtgaactctccggccgttaatagtctcgaccatactaaaccgttcctgcaaacgtccgatagtcagcacgaatggtcccaactgttgtctaataagtcggacgtgaacgctcgcaaaatactcccctctccctgccctagcccacactctcaaaagcaaagctcaaccagtaccccgctggaggactccatacctaagagaccagtctcgtctatccctctcacgggtgacagccaaacagattcagacatcattgccttcattaaggcaaggcagtccatcttacagaagcagtgccttggaagcaattag

SEQ ID NO: 121697 - DNA, 747 bp, Artificial Sequence
  Description of Artificial Sequence: Synthetic coding sequence
atgagagaggaaatgagcctcggctgtcaggaggccttcgagatctttaagagggatcatgccgactcggttaccatcgacgataataagcaaattttgaagcaaagattctcagaagctaaagccctgggggaatctatcaacgaggcacggagtaagatcggccatcttaaggaagaaataacacagcgtcacatacagcaggtggccctcggaatttccgagaacatggctgtcccccttatgcctgatcagcaggaagagaaactgcgcagccagcttgaggaggaaaaaaggaggtacaaaacgatgtttacacggttaaaggctctgaaagtggagatagagcacctccaattactgatggataaagcgaaggtgaagctgcagaaggaatttgaggtttggtgggccgaggaggctaccaacttacaagtgaactcccctgccgttaattcactggaccacactaagcccttcctacagacctccgacagccaacacgagtggtctcagctgttgtcgaataaatcggacgtaaacgctaggaagatcttgccttccccatgtcctagcccacacagccagaaacagtcttcaacctctacacctttagaggattctattccgaagcgacccgtttcaagcatacctcttacaggtgattctcagacagacagcgacattatagcttttattaaagccagacagtcgatactccagaaacagtgtttaggctcaaactag

SEQ ID NO: 121698 - DNA, 486 bp, Artificial Sequence
  Description of Artificial Sequence: Synthetic coding sequence
acaccaatgaatcaagcttcaactcggtcgcattgcattttcaccattcaccttagtagtaaagaacccggctcagctacagtgagacatgctaagctgcatttagttgatttggccggtagcgaacgggttgcgaagactggcgtgggaggacacctcctcacggaggctaagtacataaatctcagtcttcattatctcgagcaggtgattatcgccctgtctgagaaacatcggtcccatatcccatacaggaacagcatgatgacatcagtcctgcgagacagtctgggcggcaactgtatgaccaccatgatcgctactctcagtctcgagaaacggaatctggatgagagtatttcaacctgtcggtttgcccagcgcgtcgcgctcatcaaaaatgaagcagtgctaaatgaagagatcaacccccggctgaaagcaccttcctcctctgacggcgtgcttttctgcagaaatcagtag

SEQ ID NO: 121699 - DNA, 2070 bp, Artificial Sequence
  Description of Artificial Sequence: Synthetic coding sequence
tgaggagcagaaaggtattccgatcgcggtattataccccgcactctcagttacatctttgaacaattacaaaaagactcctctaaaatttacaccactcacatttcttacctggaaatctataatgagtgtgggtatgatcttttagatcccaggcatgaagcatccagcctggaggacttgcctaaggtgacaatccttgaagacccagatcagaacatccacctgaagaacctcaccctgcaccaggctactacagaagaagaagcactgaaccttcttttcttgggggataccaataggatgattgctgagacccccatgaaccaggcgagcacacgctctcattgtatattcactatccacctaagctcaaaggagcccggcagtgctaccgtgcggcatgccaaactccatttggtggatctggccggctcagagcgggtggccaaaactggggtgggggggcaccttctcaccgaggccaaatacattaacctcagccttcattatctcgagcaggtgataatcgctctatctgagaaacacaggagccacatcccttacaggaatagtatgatgaccagtgtgctgcgggactccctcggtggcaactgtatgaccacaatgattgcaaccctgtctttagaaaaacgaaatctcgacgagtccatctccacttgcagatttgcccaacgagtagccctcatcaagaatgaagccgtgcttaatgaagagatcaacccgagattagttattaagcgactgcagaaagagatccaggaattaaaggatgagctggctatggtgactggcgaacagcgaaccgaggccctcactgaagcagagctcctgcagctggagaaactgattacgtcttttctcgaggatcaggactctgacagccggcttgaggtgggcgcagacatgcgaaaggtgcaccattgctttcaccaccttaaaaagctgctgaacgacaagaagatcttggaaaacaacactgtgtcctccgagagtaaggaccaggactgccaggagccgctcaaagaggaggagtacagaaaacttcgggatattttgaaacagagagataacgagatcaacatcctcgtgaatatgctgaagaaagagaaaaagaaggctcaggaggcgttgcatctggctgggatggataggagagagtttagacagagtcaatcccctccgtttcggttgggtaaccctgaagagggacagcgcatgcgactttcctcagcaccttcccaggcccaagacttcagcatcctgggtaagagaagtagcctgctacacaagaagataggtatgagggaggagatgagcttaggatgtcaggaggccttcgagattttcaaacgcgaccatgcagattcagtcaccattgacgacaataagcaaatactcaagcaaagattttcagaggcgaaggccctgggtgagagcatcaacgaagctcggagtaaaattggtcatctgaaggaagaaatcacccagcgtcatatccagcaggtagctcttggcatctctgagaacatggcggtgcctctgatgccagatcaacaggaggagaagctcaggagccagctcgaagaagaaaaaagacggtacaaaactatgtttacccggttaaaggccctaaaagtcgagatagagcacctccaactcctgatggacaaggcaaaggtgaaactgcagaaagagttcgaagtctggtgggcagaagaggcaacaaatttgcaggtcaactctcccgcagtgaatagtctggatcatacaaagcccttcttgcagacttctgactcccaacacgaatggagccagttgctgtctaacaagtcagacgttaacgctaggaaaattttgccttctccctgcccgtctccccattcacagaaacaatccagtacctctactccattggaggattctatccccaagcgacccgtcagctccatccccctcaccggtgactcacaaacagatagtgatatcattgcttttatcaaagcacgccagtccattctgcagaaacagtgcttggggtcgaattag

SEQ ID NO: 121700 - DNA, 2277 bp, Artificial Sequence
  Description of Artificial Sequence: Synthetic coding sequence
atggtgaagcagactattcaaatttttgctagggtaaaaccccctgtgcgtaagcaccaacaaggcatttactccatcgacgaagacgagaagctcatcccaagtctcgaaattatcctcccaagagacctcgcagacggcttcgtaaataacaagcgagaatcctataagtttaagttccagaggatatttgaccaagatgccaaccaggaaactgtgttcgaaaatatcgctaagcccgtggccggatcggtgttagcaggttacaatggaacaatcttcgcctacgggcagaccggtagtggaaagacttttacgattaccggcggtgctgaacggtattccgatcggggaatcatcccacgcaccctgagttatatctttgagcaactccagaaagacagcagcaagatctacaccacccacatttcatatcttgaaatctataacgaatgtggctacgatctgcttgatcccaggcacgaagctagcagtctggaggatctgcccaaggtcaccatcctcgaggatccagaccagaatatccacctgaagaatctgactctgcaccaggccacgaccgaggaagaagctttaaacctgctgttcctaggtgatacaaatagaatgatcgcagagactcctatgaaccaggcatccactcggtcccactgtatttttacaatacatctgtcttccaaggagcccgggtcagcaacagtcagacatgccaaattacacttggtggacctggctgggtcagagcgcgttgcgaagaccggagtgggcggtcacttgctcaccgaggccaagtatataaacctctccctccactacctggagcaggtaataattgctctgtctgagaaacaccgaagccacattccttataggaacagcatgatgaccagcgttctacgcgattcacttggtggcaattgtatgaccacaatgatcgccacgctgagcctggagaaaagaaacctcgatgaatctatcagcacctgtcgcttcgcccagcgcgtggctttgattaaaaacgaggcagtgctgaatgaagagatcaaccctaggctcgttataaaacggctacagaaagagattcaagaactaaaagacgaattggccatggtgactggcgaacagagaacagaagctttgacagaagccgaactcctccagctggagaaactgattaccagctttctggaggaccaggatagcgacagtagactcgaagtgggcgcagacatgcgaaaggtccaccattgcttccaccacttgaaaaagttgttgaatgacaagaagatcttggaaaataacaccgtgtcatctgagtcgaaagatcaggactgtcaggagccactaaaagaggaagaatacagaaaactgcgtgacatactgaagcagagagataatgaaattagcattcttagcgaggtgatgaaaaagctcccactctcctggttcgaacgcgggatgcgcgaagaaatgagcctgggctgccaggaagccttcgagatctttaaaagggaccacgccgattcggtgaccattgacgacaacaagcagatcctgaagcagagattctcagaggctaaagctttgggggaatctatcaacgaagctcgtagcaagatcggccacctcaaagaggagattactcagaggcatattcaacaggtggcgctgggtatcagtgagaatatggcggttcctctaatgcccgatcagcaagaggagaagctgcgctcccagctggaggaggaaaagcgaaggtataaaaccatgttcacccggctaaaggctctcaaagttgaaatagagcacctccaattgttgatggataaggccaaagttaagctgcagaaggagttcgaggtgtggtgggctgaggaggctaccaacctccaggttaactcacccgcggttaattccttagatcacactaagccctttttacagaccagtgatagtcagcacgagtggagccagcttctttccaataaatcatcaggtgggtgggaggtgcaggatcagggcaccggccgcttcgatgtttgtgatgtcaacgctcgaaagatccttccttccccttgcccttcaccccactcccaaaagcagtcttcgacttccacgccactggaagatagtatccccaaaagaccggtcagcagtatccctttgaccggagattcccagactgacagcgacatcatagccttcatcaaggcacgacagtccattttacagaaacagtgcctcggcagtaattag

SEQ ID NO: 121701 - DNA, 516 bp, Artificial Sequence
  Description of Artificial Sequence: Synthetic coding sequence
atgcgagaggaaatgagcctaggctgccaggaggccttcgagatttttaagcgagatcatgctgattcggtcaccatcgatgataacaagcagatactcaagcagagattttctgaagctaaagccctgggggaatcgatcaacgaggcccgaagcaagatcggccatttgaaagaggaaatcacacagcggcacattcagcaggttgctcttggcatttccgagaacatggccgtgccgctgatgcctgaccagcaggaggagaaattaaggagccaacttgaagaagaaaagcgcagatacaagacaatgtttacccgcctcaaggctcttaaggtggaaatagagcacctccaacttcttatggacaaagccaaggtcaagctacagaaagaatttgaggtgtggtgggccgaggaggccaccaatcttcaggtaaatagtcctgccgtgaatagtctcgatcacaccaaaagcaaaatcaaagcactggccgacagcatgtccgggttatag

SEQ ID NO: 121702 - DNA, 882 bp, Artificial Sequence
  Description of Artificial Sequence: Synthetic coding sequence
atgcgggaagagatgagcctggggtgtcaggaggcattcgaaatcttcaaaagggatcatgctgattcagttacgattgatgataacaaacagatactgaagcaaaggttttcagaagccaaagctcttggcgagtccatcaacgaagcccggagcaagataggtcatctcaaagaggagatcactcagcggcacattcaacaggtggccctgggcatctcagaaaacatggctgttccattaatgccagaccaacaggaagagaagctccggagtcagctggaagaagaaaaaaggaggtacaaaacaatgtttacaagactaaaggctctcaaggttgagatagagcacctgcaactattaatggacaaagctaaagtgaagctgcagaaagaatttgaggtgtggtgggccgaggaagccacaaacctgcaggtaaacagcccggccgtcaacagtctggaccacaccaagcctttccttcagacttcagactcccaacacgaatggagccagctgctgagtaacaagtcttcgggcggttgggaggtacaagaccaggggacaggcagatttgacgtgtgcgacgtgaacgctcggaagatccttccgtctccctgcccgagtccccacagtcagaagcagagttccacgtctactcccttggaagactctattccaaagcgtccggtgagttctattcctctcaccggggacagtcagacagattcagacatcatcgcctttattaaggcacgacaatccatcctccaaaaacagtatctgcagctcctctgcagcctttttcccaaatctgcagtgtcctctgctcaggcctccacaaaccggaaaggcctttctgacgtgctcgtcacacggtag

SEQ ID NO: 121703 - DNA, 4032 bp, Artificial Sequence
  Description of Artificial Sequence: Synthetic coding sequence
atgggcctggaagctcaacgactgcctggcgctgaagaagccccagttagggtcgccctgcgcgtgcggcctctgttgccaaaagaactcctgcacggccaccagagctgcctgcaagtagaacctggcttggggcgggtaacattgggcagagaccgtcacttcggatttcacgttgtgctcgcggaggatgccgggcaggaggctgtttaccaggcctgtgtccagcctctgctggaggctttcttcgaaggatttaatgccacagtgttcgcatatggccaaaccgggagcggaaagacctacacaatgggtgaagcgtccgtggcctcccttctggaagacgagcaaggtatcgtcccccgagccatggctgaggctttcaaactgatcgacgagaacgatcttctggattgtctggttcacgtgtcttacctggaagtctataaagaggaattccgggacctgcttgaggtaggcacagcatctcgcgacatccagcttcgcgaggatgagcggggaaatgtggtcctttgtggggtgaaagaagtagatgtcgaaggcctcgatgaggtgctgtccctgctggaaatggggaacgctgcgcggcataccggcgcaacgcatctgaatcacctgtctagtagaagtcatactgtttttaccgtgactctcgagcaacgcggccgggcaccatctcgcctcccacggccagcaccgggccaactcctggtatccaagttccactttgttgacctcgctggtagcgagcgggtgttgaagaccggatcaactggagaaaggctgaaggaaagcatacagataaacagttctctcttagccctgggcaacgtaatctccgccctcggggatccacagcggcggggtagtcatattccctaccgagattctaagataaccagaatcctcaaggacagcttaggaggtaatgctaagactgtcatgatcgcttgtgtctctccaagcagcagcgattttgacgaaaccctcaataccctcaactatgcctccagagcccagaacattagaaatcgcgccaccgttaactggaggccagaggcagaaaggcctcccgaggagacggctagcggcgcaagagggccacccagacatcggtcagaaaccagaatcatccacagaggtagaagggccccagggcccgcaacagctagtgctgctgcagccatgcggcttggggctgagtgcgctcggtacagagcgtgcaccgatgctgcgtacagtctcttgcgagagctacaagcagagccgggacttccaggcgcggccgcgagaaaggttcgggactggctatgtgccgtagagggggaacggagcgcactgtccagtgcctcaggcccggactcagggatagagagcgcctccgtagaggatcaagcagcacaaggcgcaggtgggcgtaaagaggatgaaggcgcccagcagcttctgacgctgcagaaccaggtggctcgtctggaagaagaaaaccgcgactttcttgccgcccttgaggacgctatggagcagtacaagctacagtctgaccgtctgcgggagcagcaggaggagatggtggagcttcgccttaggctagaactcgtgcggcccggatggggtggtcccaggcttctaaacggactgcctcccggctcgtttgttccgcggccccacacggcccccctggggggggcccatgcccatgtgctgggtatggtgccacccgcttgtctgccgggcgacgaggtggggtccgaacagaggggggagcaggtgacgaacggtagggaagcaggtgcagaactattaaccgaagtgaaccgtttaggctccggctcttcagctgcctccgaagaagaagaagaggaggaagaacctcctagacgcactttgcatctgcggcgcaatcggatcagcaactgtagccaacgcgcaggcgcgcgtcctggttcccttccggaacgcaaggggcctgaactctgcctcgaggagttagacgccgcaattccaggtagtagagctgtaggcgggagcaaggcacgcgtgcaagctagacaggtcccaccggcaaccgcctctgagtggagattggctcaggcacagcagaagattcgagaactggccatcaacattagaatgaaagaagaacttatcggcgaattagtcagaacaggaaaggcagcccaggctctgaaccgccaacactcccagcgcatccgtgagctggagcaggaagctgagcaggtcagagcagagctttcagagggccagcgccagctgcgcgagctggagggaaaagagctacaggacgccggcgaacgaagtcgtttgcaagagttcaggagacgagtggccgctgctcagagccaggtgcaggtgttgaaggagaaaaagcaggctaccgaacggctggtttcactgagcgcgcagtccgagaagaggctgcaggagttagagcggaatgtgcagctcatgcgacaacagcagggacaattacagagacgtctccgggaggagaccgagcaaaagaggcggctagaggcggagatgtcgaagcggcagcaccgggtcaaggaactggagctcaagcatgaacagcaacagaaaatcttaaaaataaagacagaggagatcgctgcattccagcggaagcggagatcaggaagcaacggatccgtggtgagcctggaacagcagcagaaaatcgaggagcagaaaaaatggctggaccaggaaatggaaaaagttctgcagcagaggcgtgcacttgaagagctgggagaagagctgcataagcgggaggctattctagctaagaaagaagccctgatgcaagagaagaccggcttagaaagcaaacgcctgagaagctcccaagccttaaacgaagacatcgtgcgcgtttccagtcggctggagcacctggaaaaggagctgtcggaaaagagtggccagctacgacaggggagtgctcaaagccagcagcagatccgcggggagatcgattctcttaggcaggagaaagattccttgcttaaacagcgcttggagattgatggcaagctgagacaaggctctttgctgagtcctgaagaggagaggactctgttccagctagatgaagccatcgaggccctggacgccgctatcgagtacaagaatgaggctataacttgtaggcaaagagtgttgcgcgctagcgcctcccttctttctcagtgtgagatgaacctgatggctaagctcagttacctgtccagttctgaaacccgggccctgctatgcaagtattttgacaaggtggttactttgcgcgaggaacagcaccagcagcaaatcgccttctcagaactggaaatgcaactcgaggaacagcagagacttgtgtactggttggaggtggcgctggagagacagagactggaaatggaccggcagctcacccttcagcaaaaagagcacgagcaaaatatgcagttgctactgcagcagtctagagatcatctgggcgaagggttggctgactcccggagacaatacgaggctaggatccaggcactggagaaagaactgggaaggtacatgtggattaaccaggagctgaagcagaagctaggcggagtcaatgcagtcggacactcaaggggaggcgaaaagagaagcctgtgcagcgagggccggcaagcccctgggaacgaggatgagcttcatctggcaccagagttgctgtggctgtcccccctgacagagggcgctccacgaactcgggaagagacccgtgacctggtgcatgcaccccttccattaacctggaagagaagcagtctgtgcggcgaagaacaggggagccccgaagaactgaggcagcgcgaggccgctgagccgcttgtggggagagtgctgccggttggcgaggctggattgccatggaatttcggacccctgtccaaaccccggagagaactgcgcagggcaagcccaggtatgatagatgttcgaaaaaaccccctgtag

SEQ ID NO: 121704 - DNA, 2022 bp, Artificial Sequence
  Description of Artificial Sequence: Synthetic coding sequence
atggacccacagcgcagccctctgctcgaagtgaaggggaacattgagcttaagcgcccgttgataaaggccccctcccagttaccactatctggaagtcggcttaaaagacggcctgaccagatggaagacggcctggaacctgagaaaaaaaggacacgaggactcggagccacaactaaaatcaccacaagccaccctagagtgccttccctcacaactgtccctcagacgcagggccaaactacagcacagaaagtcagcaagaagacaggacccagatgttccaccgccatcgcaactgggttgaaaaatcagaagccagtgcccgccgttcccgtgcagaaatcaggcaccagcggggtcccacctatggcgggaggaaagaaaccaagtaaaagaccagcctgggacctgaagggtcagctgtgcgatttgaatgctgaactgaagcgctgtcgcgagagaacccaaactctggaccaggagaaccagcagctgcaggaccagctgcgggacgcgcagcagcaagtgaaggccctgggcacagagcggaccactcttgagggccatctcgctaaggtacaggcccaggctgagcaggggcagcaggaacttaagaatcttcgggcctgtgtgctggaattagaggagcgattgagtacgcaggaaggattggtgcaagagctgcagaagaaacaagtcgaactccaagaggagaggcgggggctgatgagccagctggaggaaaaggagcggcggctccaaacctctgaggcagcactctcctcaagccaggccgaggtggcgtccctaagacaggaaacagtggctcaagcagcattgctcaccgaacgtgaagagcggctacatggactggagatggaacgcaggcgcttgcacaaccaattacaggagctcaaaggaaatattcgcgtgttttgcagggtgcgccccgtgctgccgggggagccaactcctccaccaggactgttgctgttccccagtggaccggggggcccaagcgaccctcccacgcgcttgtccttgtccagaagcgatgaacgcaggggcactctgtcaggtgcaccagccccccctacccgtcatgactttagcttcgatcgggtatttccccctggatctggccaggacgaggtattcgaagaaattgcgatgttagtccagtccgcgcttgatggataccccgtgtgcatctttgcctacggccagacgggctcgggtaaaactttcacaatggaagggggccctggaggcgacccccagctcgagggcctaatccccagggctctccgtcacctgtttagtgtcgcacaggagttgtctggccaaggatggacttattcctttgttgccagttacgtcgaaatctataacgagaccgtccgcgatctactggccactggcactcgtaaagggcaaggtggagaatgtgagatccggcgggcaggaccaggttccgaagaactgacagtgactaacgctaggtacgtaccggtaagttgcgaaaaagaggtggatgccctcttgcacctggcccgccagaatagagctgtggccaggacggctcagaacgaacgcagttcccgttctcactctgtcttccaactgcaaatctctggggaacacagcagccggggactgcagtgcggggcacctctgagccttgtggaccttgcagggtccgaaaggcttgacccaggactggcactgggtcctggggaacgagaaaggcttcgcgaaactcaggctatcaattccagtttatctactctgggtctcgtgattatggccctttcaaacaaagaatcacatgtcccctatagaaattccaagctgacatatctgctccaaaactccctagggggttcagcaaaaatgttaatgtttgtcaatatttcacccctagaagaaaacgtctcagagtctctcaactctctaaggtttgctagtaaggtgaatcagtgtgtgattggtaccgcccaagcaaacaggaagtag

SEQ ID NO: 121705 - DNA, 612 bp, Artificial Sequence
  Description of Artificial Sequence: Synthetic coding sequence
atggatccccaacgcagtccccttctggaagtgaaagggaatatcgagctgaagcgccctctgatcaaggctccttcccagttgccgctgagcggaagccggttgaaaaggcgtccagatcagatggaagacgggctcgaacccgaaaagaagagaacacgcggactgggcgctaccactaagatcacaacaagtcatcccagggtgccgagcctgactaccgtaccccagacacagggccagacaactggcccaagctcccatccactcccatggcagtgccatcaccaacctttcttagtcacagatccaggcggtaggagctggggtcccggccagaagtggcacaggctccatctgtggtgtacctccgcccagaaagtgtctaaaaagacaggcccccgatgttctactgcaattgctacaggactgaagaatcagaaacctgtgccagccgtgccagtacagaagtctgggacgtcaggagtgccaccaatggctggaggcaaaaagccatccaaaagacctgcttgggacctcaaaggccaactctgcgatctgaatgcggaactgaagcggtgtcgggagagaactcaaacgttagatcaatag

SEQ ID NO: 121706 - DNA, 612 bp, Artificial Sequence
  Description of Artificial Sequence: Synthetic coding sequence
atggacccccagcggagccctctgctggaagttaagggcaatattgaactgaagcggcccctgatcaaggctccatcccagttaccacttagcggcagtcgcctaaagcgccgacccgaccagatggaagatggcctcgagcccgaaaagaaacgtacccggggactcggtgctaccactaagatcacaaccagtcaccctcgtgtgccctctctgactactgtgcctcaaacacaaggtcagacaaccggaccctcttcacacccccttccttggcagtgtcaccaccagcccttccttgagacagatccaggcggaagatcctggggtccaggccagaaatggcatcgtctgcatctatggtgcacgtctgcccagaaggtgagcaaaaaaactggaccgcgctgcagtacagctatcgcaacaggcctcaagaatcaaaagcccgttccggcagtcccagtacagaaaagtggaaccagcggagtgcccccaatggcgggcggcaaaaaaccaagcaaaaggccagcttgggatcttaagggccagttgtgcgacctgaacgcggaattaaagagatgcagggagcgcacccaaacccttgaccagtag

SEQ ID NO: 121707 - DNA, 2022 bp, Artificial Sequence
  Description of Artificial Sequence: Synthetic coding sequence
atggacccacaacggagccctttgctcgaggtgaaggggaacatcgaattaaagagacctctcatcaaagcccctagccagctgcccctgtctgggagcagactgaagagacgtcctgaccagatggaagacggcttggagcccgagaagaagcggaccagggggctcggcgccacaactaaaattacaacctctcacccaagggttccctctctgacaacagtgcctcagacgcagggacagactacagcacagaaagtgagtaagaagactggccccaggtgttcgaccgctatcgccaccggcctgaagaatcagaaacccgtgcctgccgtgccagtgcagaaaagtggcactagcggagtcccaccgatggccggtgggaaaaaaccatcaaagaggcccgcctgggatttaaaaggtcagctgtgcgacctgaacgcggagctgaagcgctgcagggagcggacccagacactggaccaagaaaatcaacaactccaggaccaactgcgcgatgcccagcagcaggtcaaagccctcggcacagaaaggacgactcttgaaggccatctggcaaaggtgcaagcccaggcagagcagggacagcaggaactgaagaatctgcgcgcctgtgttttagagctggaggaacgcctgagcactcaagagggcctcgtccaagagttacagaaaaaacaggtcgagctccaggaggagaggcgcggccttatgagtcagctagaggagaaggaacggagactgcagacctccgaagccgccctcagttcgtcacaggctgaggttgcaagcctgaggcaagagaccgtcgcacaggcagcattgctcactgagcgcgaggagcgcctgcacggcctggagatggagcgtaggaggctccacaatcaattgcaggagctgaaaggaaatatcagggtgttttgcagggtccgccccgtgctgcctggtgagccaacccctccccccggcctgctgttattcccgtctgggcccggcggcccttcagatcctccaacccggctaagcctttctcggagtgacgagcgtcgaggaacattgagtggagcccctgctccgcccacacgtcacgatttttccttcgacagggtttttcccccgggctccggccaagacgaggtcttcgaggaaattgccatgctagtccaaagcgccctggatgggtaccccgtctgcattttcgcctatggacagacgggctcaggcaagacctttaccatggaggggggaccaggcggtgaccctcagctggaggggctaatccccagagccctccggcacctcttttccgtggcgcaggaattgtccgggcagggatggacgtattctttcgtcgcttcctacgtggaaatttataacgagacggtgagagacctcctcgccactggtacgcgcaagggccaaggcggcgagtgcgagatccgtagggcaggtccgggcagcgaggagttgactgtgacaaatgcacggtacgtgcctgtcagttgcgaaaaagaggtcgatgctctgctgcatctggcgaggcagaacagagccgtggccaggacggctcagaacgaacgctcttcacgctcccattccgtcttccaattgcaaataagcggggagcacagctcccggggtcttcagtgtggtgcacccctctcgctagtagatttggccgggagtgagcgccttgatcctggcctcgcgcttgggcctggcgagcgcgaaaggctcagggagacccaagctatcaattctagtttaagcacattgggactagtcattatggccctatctaataaggaatcccatgttccgtacagaaattctaagttgacgtatctacttcagaactcgctggggggctccgcgaagatgctcatgttcgtgaacatatccccactggaagaaaatgtgagtgagtcactcaactctctgaggtttgcttcgaaggtcaatcagtgtgtcatcggtacagctcaggcaaaccggaaatag

SEQ ID NO: 121708 - DNA, 2022 bp, Artificial Sequence
  Description of Artificial Sequence: Synthetic coding sequence
atggatccccagagaagccctctgctggaagttaagggcaacatcgaactgaaacgtcccctgattaaggctcccagccagctgcctctttcggggagccggctgaagcgccgacctgaccagatggaagacggcctcgaaccagagaaaaagagaacccgcgggcttggagccactaccaagattaccacatctcatcctagagtgccaagcttaaccaccgtgccccaaacacagggccagacaacggcgcagaaagtcagcaagaagaccggccctaggtgctctactgctattgctaccggtcttaagaatcagaaaccagtgccagctgtgccagtgcagaagagcgggacctctggagttccaccaatggctggaggcaagaagcccagcaagcgccccgcgtgggaccttaaggggcagctgtgcgacttaaatgccgaactgaagagatgtcgcgagcgaactcagactctggaccaggaaaatcagcagctgcaagaccagttacgggacgctcagcagcaggtgaaagctctggggaccgaacggaccaccctggagggccaccttgcgaaagtgcaagcccaggcagaacagggccagcaggagctgaagaacctgagggcctgtgtgcttgagctggaggagagattgtccacgcaagagggcctggttcaggagctccaaaaaaagcaggtagaactgcaggaagaacgcaggggactgatgtctcagcttgaggaaaaagaacgtaggctccagaccagcgaggctgccctctcatctagccaggcggaagtggcttctctgaggcaagagaccgtggcccaggcggccctactgacggagcgagaggagaggctgcatggactcgaaatggagcgacgtaggctgcacaaccagctccaagagctgaagggaaatatacgggtgttttgcagggtgcgtccagtacttcccggcgagcccaccccccctccaggcctcctgctgtttccctcgggcccgggaggcccatctgaccccccaacgcgcctgtcactgagccggtccgatgaacggcgcggcaccctatccggcgcaccagcccctcctactcgacacgatttcagttttgaccgtgttttccctcctggcagtggccaagacgaagtcttcgaggaaatcgccatgctggtgcagtctgcgctcgacggctatcccgtctgcatatttgcatacggccagacgggcagtgggaaaaccttcacaatggaaggaggtcctggcggcgatccacagctggaggggctgatccccagggctctgcgccatctcttctccgtggcccaggagctttccggtcagggatggacgtacagtttcgtcgcatcatacgtcgagatttataatgagacagtccgcgatctgctagcaacagggaccaggaaaggtcaggggggagagtgcgagatccggcgcgccgggccgggtagcgaagagttgaccgtaacaaacgcaagatacgtgcccgtctcctgcgaaaaagaagtggatgcgttacttcacctggctagacagaatcgggctgtagcgcggacagcgcagaacgagagaagtagcagatcgcatagtgttttccagttacagattagtggggaacattccagcagaggcctccagtgcggagctcctctgtccctggtggacctggcaggatccgaacgtctggacccaggcctcgcactggggcccggagagagagagaggctgagagaaacccaggcaattaattcatcactatcaacacttggtctcgtcattatggcactgtcgaataaggagtcacacgttccatacaggaacagtaagctgacttatcttcttcagaatagcctgggggggtccgcgaaaatgctgatgttcgtaaacatctcaccactcgaagaaaatgtttctgaatctctgaacagccttcggtttgcctctaaggtgaaccagtgcgtgattggaacggcccaggccaataggaagtag

SEQ ID NO: 121709 - DNA, 612 bp, Artificial Sequence
  Description of Artificial Sequence: Synthetic coding sequence
atggacccacagcgcagccctctgttggaggttaaaggaaatatagagctcaagaggccgctgatcaaagccccctcccaactgcctctgagcggcagccggctaaagcgccgccctgatcagatggaagacggtttagaaccagagaagaaacgcacaagaggtttaggtgccaccaccaaaatcaccaccagccatcctcgggtacccagccttacaacggtcccacaaacgcaaggacagaccacgggaccctcctctcatccccttccttggcagtgtcaccatcagcctttcctcgagaccgaccccggaggaagaagctgggggccaggacagaagtggcaccgtctgcacctctggtgcactagcgcacagaaggtcagcaaaaaaactggaccgcgctgtagcacagccattgctacggggcttaagaaccaaaagcccgtgcccgccgtccctgtgcagaaatctgggacttccggcgtgcctcctatggcaggtggcaaaaagcccagcaagagaccagcttgggatttgaaaggtcaactgtgcgacctgaatgctgagcttaagcggtgtcgtgaaagaacccaaacgctggatcagtag

SEQ ID NO: 121710 - DNA, 2502 bp, Artificial Sequence
  Description of Artificial Sequence: Synthetic coding sequence
atggtaccttcgagacgaacttggaatttgggcgcgactccgagtttgaggggactgtggcgtgtgggcagagctcctgagcccgagccgggaatggccaggccagcccccgccccagcctcacctgccgcccgcccctttccccatactggacccgggaggctgagaacaggaaggggaaaggacacccctgtttgcggggatgaggattcttctgcgagatcggcggcccgaccagcacttgcccagtgcagggcattgtctgtcgactgggctggacccgggtctccccatggcctctatcttacactacaggtagagcatcttaaagaaaaactaatctcccaagcccaggaagtatcacggcttcggagcgaattaggcgggaccgatttggaaaagcaccgcgacctcctgatggtggagaacgaaagattgaggcaggaaatgcgcaggtgtgaggcagagttgcaggaattacggactaagcctgctggaccttgccccgggtgtgagcattctcaggaatcagcgcagcttcgtgataaactgtctcagctgcagctggagatggccgaatccaaaggtatgctctccgagctgaatctggaggtgcagcagaagacagaccgcctggcggaggtggaacttagactcaaggattgcctggcagagaaggcacaggaggaggagagactttcccgacggctgcgggactctcacgaaacaattgccagcctcagagctcagagccctcccgtaaagtatgtgataaagacagtggaagttgagtctagtaaaaccaaacaagcgctgtccgagtcacaagcgagaaaccagcatctgcaggagcaagtcgctatgcagcgtcaggtcttgaaggagatggaacagcagctccaaagctctcatcagctgaccgctagactccgggctcaaatagctatgtacgagagtgagctcgaacgcgcgcacggacagatgctcgaggaaatgcaaagtttggaagaggacaagaacagggctatcgaggaggcgttcgccagagcacaagtggaaatgaaggccgtgcatgagaacttagcaggggtcagaaccaacttactgacgttgcaacccgccctcagaaccttgacaaacgactataatggccttaaacgacaggtgcggggattcccattattgctgcaggaagccctgcgaagtgtgaaggctgagattggccaggctattgaagaggttaatagtaacaaccaggaactgttgaggaagtacaggagggagcttcaacttcgtaaaaaatgtcataacgaactcgtgaggctgaagggtaatataagagttattgcgcgggtgagacctgtgactaaagaagatggagaaggacccgaagctaccaacgccgtgacttttgatgctgatgacgactccatcatccacctcctacacaaaggtaaaccagtgtcgtttgaactcgacaaggtgtttagtcctcaagctagccagcaagatgtgttccaggaggtgcaggccctggtgaccagttgtatcgatggtttcaatgtgtgtatctttgcctatggtcaaacaggtgctgggaagacatataccatggaaggcactgcggagaatccaggtattaatcagagagccctacaactgcttttctctgaagttcaggagaaagcctctgactgggagtacactatcactgtgtctgcggcagagatctacaacgaagtcctcagagacctgctgggtaaagaaccgcaggagaaactggagattaggctctgcccggacggatctgggcagctgtacgtgccaggactgacagagtttcaggttcaaagtgtggacgatattaacaaggtctttgagtttgggcacaccaatcggacaaccgagtttactaatttaaacgaacacagctccaggagtcacgccctccttatcgtgaccgtgcgtggcgtagattgttcaactggactgcgtaccactggaaaactcaacctcgtggatctggctggctccgagcgtgtcggcaaatctggtgccgaaggctcccgcctgagggaggcccagcacatcaacaaatctcttagtgctctaggcgatgtgatagcagcactgaggtctaggcagggtcacgtgccttttagaaacagtaagctgacatacctgctgcaggattccctatcaggcgattccaagacgcttatggttgtgcaagtatcaccggtcgagaaaaatacatccgagaccctgtacagtctgaaattcgcagaacgcgtccggtcagtggagctgggacctggacttagaagagccgagcttggcagttggagtagtcaagagcacttagaatgggagccagcttgccaaactccacagccctcagctcgggctcattctgcccccagtagcggaacaagcagtagacccggttccatccggaggaaactccagcccagtggcaagtcacgaccgctgccagtgtag

SEQ ID NO: 121711 - DNA, 2064 bp, Artificial Sequence
  Description of Artificial Sequence: Synthetic coding sequence
atggtggagaatgagcgactccgtcaggaaatgagacgatgcgaggctgaactccaggaactcaggactaagcctgctggaccatgtccgggttgtgaacactctcaggaaagcgcccagctgcgcgataaactctcccagctccagttggagatggccgaaagtaaaggcatgctcagcgagctgaatttagaggttcagcagaaaactgaccggctggccgaagtggagctgcggctgaaagactgtctggccgagaaggcccaagaggaagagcgactaagccggaggctccgggactcacatgaaaccattgcatccttgagagctcagagtcctcccgtgaagtacgtcatcaagactgttgaggtggagtcctctaagaccaagcaggccttgagtgaaagccaggccagaaaccaacatctgcaagagcaggtggctatgcagcgacaagtactgaaggagatggagcaacagttacagagctcccatcagctcaccgctcggcttcgtgcgcagatagctatgtatgagtctgagctggaacgggcacatgggcagatgctggaagagatgcagtcactggaggaagataaaaatagggctatcgaggaggcgttcgcacgtgctcaggtagaaatgaaggctgttcatgagaacctggcaggtgtgcgcacaaacctgctgacccttcagccagccctgcggactctgaccaatgactacaatggtttgaaaagacaggtgaggggcttccccctgcttctgcaggaggcactgagaagcgtcaaagccgagatcggccaagccattgaagaggtcaattccaacaaccaggaacttctccgcaaatatagaagagaactgcagctcagaaaaaagtgtcacaacgagctggtcagattaaaaggcaacatacgagtcattgctcgggtccggcccgtcaccaaggaggacggcgagggcccagaagcaacgaatgctgtcacgttcgacgcggacgacgacagcatcatccatctgctgcataagggtaaacccgtgagctttgaactggacaaagtgttttctcctcaggccagtcagcaggacgtgttccaggaggttcaagcccttgtgacctcttgtattgatggtttcaatgtttgtatttttgcctacggtcagacaggggcgggtaagacctataccatggagggcacagccgagaatccagggattaatcagagggctctacagctcttgttctcagaggtccaggagaaggcatccgactgggaatacactatcactgtttccgcagcagagatttacaatgaggtcctcagagacttactggggaaggagccccaggaaaagttagaaatccggctatgtccggatggaagtggccagttgtacgtgcccggcttgaccgagttccaggtgcaatcagtggatgacattaacaaggtgttcgagtttggacacacaaaccggacaaccgagttcacgaacctaaatgaacacagctctagatctcacgcactgctgatagttaccgtgaggggcgtagactgctcgactggactgcgtacgacaggtaagctgaatcttgtcgacttagcagggtctgaaagagtgggaaagtcaggggctgaagggtcccggcttagagaagctcagcacatcaataagagcctgagtgctctgggagatgtcatcgctgcactgaggtcgagacaaggccacgtgccttttcggaattcaaagctcacatacctgctgcaggactctctttctggcgattcgaagactttgatggtcgttcaggtgtcaccagtcgagaaaaatactagcgagacactctacagccttaagttcgccgaacgcgtgcgatcagtggaactcggtcccggcctgcggcgcgccgagttgggctcatggtcgtcacaggagcatctcgagtgggagcccgcttgccagactccacagcccagtgcgagagcacactctgccccaagttccgggaccagcagtcgcccgggctccattcggcgcaaacttcaaccaagtgcctag

SEQ ID NO: 121712 - DNA, 2481 bp, Artificial Sequence
  Description of Artificial Sequence: Synthetic coding sequence
atggttcctagtcgcagaacctggaacctgggggctactccttcgctccgcggcttatggcgggtgggccgggcgccagagcccgaacccggaatggccaggccggcaccagccccagcgagccccgctgctcgccctttcccccacacaggccccggccgactgagaaccggtcggggcaaagatacacccgtgtgcggagatgaggattcaagtgctaggtctgcagcccgaccggctctggcacagtgccgcgccctttctgtagactgggcaggccccggttccccacacggattgtatctcacgctgcaggtcgagcatctgaaggagaaactgatctcgcaagcccaagaagtcagtagattaaggagcgagctcgggggaacggatctcgagaaacaccgggacttactcatggtagagaatgagcgcctgcgtcaagagatgagacggtgtgaggccgagcttcaggagctgcggacaaagccagcagggccttgcccgggttgtgaacattcgcaggagagcgcacaacttagggataaactgtctcaactgcagctcgagatggctgaaagcaagggcatgttgagtgagctgaacctcgaagttcaacagaaaaccgaccgcctggccgaggtagaactgcgactgaaagattgtttggctgaaaaggctcaggaagaagaaagactcagtcgccgcctgcgagactcgcacgaaaccatagcctccctgcgggcgcagagcccaccagtgaaatatgtgattaagaccgtcgaggtggagtcaagcaaaaccaaacaggccctgtctgagtcccaggcacggaatcagcacctccaggaacaggtcgcgatgcagagacaggtgctgaaagagatggagcagcagctgcagtcctctcatcagctgaccgcaaggctccgcgcccagatcgccatgtacgaatcagaactcgaacgagcccacggacagatgcttgaggagatgcagtccctggaagaagacaagaacagggcaatcgaggaagcattcgctagggcccaggtcgaaatgaaagctgtgcacgagaatctcgccggagtgcgaaccaatcttcttacacttcagccggccctgcgcaccctcacgaacgattacaatggcttaaagcgacaggtgagaggtttccccctgctgctgcaggaagctctcagaagcgttaaagccgaaatcggtcaagccatcgaggaagtgaatagcaacaatcaggagttactaaggaaataccgacgggaactccagctccgcaaaaagtgccacaatgaactagttagacttaaaggtaatatacgagtaatagccagggttaggccagtgaccaaggaggacggggagggtccagaagctacaaacgcagtaacattcgatgccgatgatgactcgatcatccacctgctgcataaaggcaagcccgtgtccttcgaactggacaaggtgttttctcctcaagcctctcagcaagatgtcttccaagaagtccaggcgctcgttacgagctgtattgatgggtttaacgtctgcatatttgcctacggtcagaccggcgctgggaagacatataccatggaaggcacagccgagaatccaggtatcaatcagcgggccctccagctgttattctcagaagtacaggagaaggcaagcgactgggaatacacaattactgtgtctgccgccgaaatttataatgaagtcctgcgcgacctcctgggaaaggagccacaggagaaactggaaatacggctctgtccagatgggtctgggcagctgtacgtgcctggattaactgaatttcaggtgcagagtgtagacgatattaacaaggtatttgagttcgggcataccaacagaactacagagtttacaaatctcaacgagcactcatccaggtcccacgccctgctcattgttaccgtcaggggcgtggattgtagtacaggcctccgaacaaccggcaaactcaacctggtggaccttgccggctccgagagagtgggaaaatcaggagctgagggatctcggctgcgagaggcgcagcacataaacaagtctctctctgcacttggtgatgtgatagcggctttgcggtccaggcagggccatgttccattccgtaattccaagctcacctatctgctacaggactctttgagcggggattccaagactctgatggtggtccaggtctctcccgtggagaaaaatacctcagagacactctactcactcaagttcgccgagcgtgtgaggtctgtggagcttgggccaggtctgaggcgagcagagcttggctcctggtcctctcaggagcacttggaatgggagcccgcgtgtcagactccgcagccctccgcccgtgcccattcggcaccttcaagtggtacaagcagcaggccagggagtatccgacgtaagctgcaaccctcagcctag

SEQ ID NO: 121713 - DNA, 2307 bp, Artificial Sequence
  Description of Artificial Sequence: Synthetic coding sequence
atggttttaaggatggtggaggcaatgtcccaactgcaggacgagaagactcaactgcaggaggagctggtcgtgcttcaagagcggctcgccctgagagactccgatcaacaggccacgtccactcagctgcagaatcaggtggagcaccttaaagaaaagcttataagtcaagctcaggaggtttcaagactgaggtcggagctagggggaacagatctagagaagcatcgggacttattgatggtcgaaaatgagagactgagacaggagatgcggcgctgcgaggccgaactccaagagcttcgaactaaacccgcaggaccctgcccaggctgcgagcactcgcaggagagcgctcagctgagagataaactaagccagctacaactcgaaatggccgaaagcaaaggaatgctttctgagcttaacctcgaagtgcagcagaagaccgatcggttggctgaagttgagctgagactcaaagattgcctggccgaaaaggcacaggaagaggagcgactgagccggcgcctacgagactctcacgaaaccatagctagccttagggcacagagcccaccagttaaatatgttataaaaaccgtagaagtggagagttcaaagacaaaacaggccctgtccgaaagccaggctcgcaatcagcacctccaggagcaggtggcgatgcagcgacaggtactgaaagagatggaacagcagctgcagtcaagtcatcagctgactgcccgattaagagcccagattgctatgtatgagtccgaattggagcgggcacatggacaaatgctggaagagatgcaatccctagaggaggacaagaaccgtgccatcgaggaggcctttgcacgtgcccaggtggagatgaaggccgtccatgagaatctggctggagtcaggaccaacctgctgacgctccagcccgcactccggacgttgaccaacgactacaatggcctcaaacgtcaggtccggggctttccattgctgctccaagaggctttaagaagcgtgaaagctgaaattgggcaggccatcgaggaagttaatagtaataatcaggaactgctccgaaagtataggcgcgagctccagctgcgcaagaagtgtcataacgaattggtgcgcttgaagggcaatattcgagtcatcgccagagtgcgacctgtgactaaagaagacggagaggggccagaagccacgaatgcggtgacattcgacgcagacgacgattcaataattcacctgttacacaaaggcaagcctgtgagctttgaactagataaggtattcagtcctcaggccagtcagcaagacgtctttcaggaggtccaagccctcgtgacctcttgtatcgacgggttcaacgtgtgtatctttgcctacgggcaaacaggggcagggaagacctacaccatggaaggcactgctgaaaatcctggcattaatcagcgtgcgctgcagcttctgttttccgaggtccaggaaaaggcctcagactgggaatatacaatcaccgtgagtgctgcagaaatctacaatgaggtgttgagagatctgctcgggaaagagccacaggagaagctggagatccgcctatgcccggacggaagtggacagttgtatgtgccaggcctgacagaatttcaggtgcagtccgtagatgacattaataaggtgttcgagttcggacacaccaatagaaccaccgaattcacaaatctcaatgaacatagctcccggtctcatgcgctgctaatcgtaaccgttagaggggtggattgtagcacaggtcttcggaccaccgggaaactgaacctggttgacctggcaggctctgagagggttgggaagtcaggcgctgaaggctcccgcctgagagaggcccagcatattaacaagtccttgtctgctcttggggacgtgatcgcagccctccgctcccgacagggccacgtgccgtttcgcaactccaagctgacatacctgttgcaggatagtctgagcggagactctaagacgttaatggttgtgcaggtgagccctgttgagaaaaacacctctgagacactgtacagcctgaaattcgccgagcgagtgagatcagtggaattgggacctggcctgcgacgcgccgaactgggcagctggtctagtcaggaacacttagagtgggagcccgcatgccaaaccccccagccctccgcccgggcccattcagctccttctagcggcacctcttctagacccgggtctatcagacgaaaactgcagccatcagcctag

SEQ ID NO: 121714 - DNA, 2175 bp, Artificial Sequence
  Description of Artificial Sequence: Synthetic coding sequence
atgataaaagttgaacatctgaaggaaaaactgatcagtcaggctcaggaggtcagcagactgcggtccgaactgggtggaaccgacctcgaaaagcacagagatctgctcatggtcgagaacgagaggctgagacaagagatgcgcaggtgtgaagccgaactccaggaactccggacaaagcctgcggggccctgtcctggttgtgagcatagtcaagagtctgcccagcttagggacaaactgtctcaacttcaactcgaaatggccgagtcgaaaggcatgctttccgaactgaacctggaggtccagcagaaaaccgatcggctggcagaggtagagctccggctaaaagattgccttgctgagaaagcccaagaggaggaaagattgtctagacgacttcgggattctcatgaaacgatcgcctcactgagggcccagagcccccccgtcaaatacgttattaagaccgtggaggttgagagctcaaagacgaaacaggcactttcagaatcccaggcccggaaccagcacctgcaagagcaggttgctatgcagcgccaggtgctgaaagaaatggaacagcagctgcagtcgtcacaccagctcacagctcgcctacgagctcaaattgccatgtacgagagtgagttagagagggcgcacgggcaaatgcttgaagaaatgcagtccctcgaagaggacaagaaccgggccattgaggaggccttcgctcgagctcaggttgagatgaaggccgtacacgaaaacttggccggtgtccgtacaaatttgctgaccctacagccagccctgcgcaccctgacaaatgattataatggtttaaagcgccaggtgcgaggatttcctctcctcctgcaggaggcgctgagaagcgtcaaagctgagatcgggcaggcgatagaagaggttaattcaaataaccaggaacttcttcgcaagtacaggcgcgaacttcagttacggaaaaaatgtcacaatgaactagtacgtctgaagggaaatatccgggtgatagccagagtacgcccagttactaaggaggacggagagggccccgaagcgactaacgccgtgacatttgacgccgacgacgactctattatacatctgttgcacaaaggaaagcccgtgagtttcgagttggacaaggtctttagcccccaggcatcccaacaggacgtctttcaagaggtacaggcccttgtcacctcttgcatcgatggattcaacgtctgcatcttcgcttatggacagaccggagccggtaagacctataccatggagggaaccgccgaaaacccaggcataaatcagcgcgcacttcagttgcttttctctgaagtacaggagaaggcctcagattgggagtataccatcaccgtgagtgctgctgaaatctataacgaggtactgagggatttattagggaaagaaccccaggaaaagcttgaaatcagactgtgcccagatgggtcaggccagctgtatgtgccaggcctcactgaattccaggtgcaaagcgtggacgacataaacaaggtctttgaattcgggcatactaaccggactaccgaatttacaaacctaaacgagcactcttctcggtcacacgccctcttgatcgtgacagtgcggggagtcgactgctccacaggtctccgcaccaccggtaagttaaatctagtggatctggccggttcagaaagggttgggaaatcaggagctgaaggcagccgcctgagagaagcccagcacataaacaaaagtctcagcgctttaggagacgtgatagccgctctaaggagccgccaaggtcatgtgcccttccggaactccaaactgacgtatttactgcaggattcgctctccggggattcaaaaacacttatggtcgttcaagtctctcctgttgaaaagaacacctccgagaccctgtactctctaaagttcgccgagcgggttaggtccgtggaacttggacccggcctgaggcgtgcagagctggggagctggtcctcacaggagcaccttgaatgggaacccgcctgccaaaccccccagcccagcgccagggcccattctgcgccgagcagcggcaccagtagtcgtcctggtagcatcaggagaaaactccagccttccgcgtag

SEQ ID NO: 121715 - DNA, 2547 bp, Artificial Sequence
  Description of Artificial Sequence: Synthetic coding sequence
atgtgtgcttcagcatgtaaagacacagctgcatggtgtcccgaggaagctgcagaaccccaggccatggtgccatcccggagaacttggaatctgggtgctacgccttcgcttcgggggctttggagggtcggacgggcccctgaacccgagcctggaatggctaggcccgcccctgcccctgctagcccggcagcgagaccttttccccacacaggtcccggtagactccggaccggtcgggggaaggacacaccggtatgcggggacgaagatagctccgccaggtccgctgcacgccccgcgctggctcagtgccgggctctgtctgtagactgggcgggacctggctcccctcatggactttacctcacactccaggtcgagcaccttaaggaaaaattgatcagccaagcccaggaggtcagccggttaaggtccgaactgggaggaacagatctggagaaacaccgggacctgctaatggtggaaaacgaaaggttgcgccaagagatgcgaagatgcgaagccgagcttcaagagcttcgcacaaagcctgccggcccctgtccaggttgcgagcactctcaggagagcgcccaactcagggacaagcttagccaactgcagttggaaatggcagagagcaagggtatgttaagtgagctgaatctggaggtgcaacagaagacagacaggctcgcagaggtcgagctgcgcctgaaagactgtctggccgaaaaggcacaggaggaggagcgcctctcccgccggctgagggacagccacgaaaccatcgcttcccttagggctcagtccccccccgtgaaatatgtcattaagacagtggaagtggagagtagcaagaccaagcaagccctgtcggagtcccaggcacggaatcagcatctgcaagagcaagtggccatgcagaggcaagtgctgaaagaaatggaacaacaacttcagtcatcacatcagttgacagccagactgagagcccagatagcgatgtacgaatctgaactggagcgggcccacgggcaaatgctggaggaaatgcaatctttggaggaagacaagaaccgggcaatcgaggaagcattcgccagagcgcaggtggagatgaaagctgtccatgaaaacctcgccggcgtgagaaccaatctgctcacactgcagcctgctctgaggactttaacaaacgactataacggcttaaaaagacaggtgagaggattcccactactgctccaggaagcgctccgtagtgtgaaggccgagatcgggcaggccattgaggaggtcaattccaacaatcaagaacttttgcggaagtacagaagggaactgcaactcaggaagaaatgccacaatgaattggtccgcctcaaagggaatatacgcgtcatagcccgggtgcgccctgtaactaaggaggacggggaaggacccgaagccaccaacgccgttacttttgacgccgatgatgacagcatcattcatctgctccacaaggggaagcccgtgagcttcgaactcgacaaagtgttctcccctcaggcctcacagcaggacgtatttcaagaggtccaggccttagtgaccagttgcatcgatggattcaatgtgtgcattttcgcatatgggcagaccggcgctggcaagacatacacgatggaggggaccgctgaaaacccgggaattaaccaacgggccctgcagcttttgttttccgaggtgcaggagaaggctagtgactgggagtatactatcaccgtttctgcagcagagatctacaacgaagttttacgggatctgctgggcaaggaaccccaggagaaactggagatcaggttatgcccagacggatctgggcaactgtatgttccagggctgacggagtttcaggtgcagagcgtcgatgatattaataaagtgtttgaattcggtcacaccaacaggactacagaattcaccaaccttaacgagcactcttcgaggtcccacgctctgctcatcgtgacagtgcgcggggtcgattgcagcactggactgcggacaacagggaagctcaatctagtggatctggccgggagtgaacgtgtcgggaagtccggagctgaggggtcccgactgagagaggcccagcacattaacaaaagtctctctgctctcggcgatgttattgccgctttacggtcccgccaaggtcacgtgccattcaggaatagcaagctcacatacctgttgcaggactcattatcaggggattcgaagactctgatggttgtgcaggtttctcccgtagagaaaaacacaagcgagactctttactccttaaagtttgccgaacgcgttcgttccgtggagctggggcctgggctgcggcgcgcagaactgggcagttggtccagtcaggagcacctggagtgggagcctgcctgtcagacgccccaaccatcagctagagcccacagtgcgcccagctccggcacctcaagtcggcccggctcaattcgaagaaaactacagccctccgcgtag

SEQ ID NO: 121716 - DNA, 2055 bp, Artificial Sequence
  Description of Artificial Sequence: Synthetic coding sequence
atggtagaaaatgagcggctgcgccaggagatgcggaggtgcgaagccgaactccaggaactgagaactaagcccgccggtccctgccctggctgcgaacactctcaggaatccgcccaactgcgagataaactctcgcagctacagttggagatggctgaatcaaagggaatgctaagtgagcttaatctggaggttcaacagaagacagacaggctcgcagaagtcgagcttagattgaaggattgtctcgccgaaaaagcgcaagaggaggaacgactctcccggaggctgagggactctcacgaaaccatcgcctccctgcgtgcgcaatctcctccagtaaaatacgtcataaaaaccgttgaagtcgagtcttctaagacaaaacaagcgttatcagaaagtcaggccagaaaccagcatctgcaggaacaggtagccatgcaaaggcaggtgttgaaggaaatggaacagcagcttcaatcctcacatcaactgactgcgagattgagggctcagatcgcgatgtacgagtcggagctcgaacgcgcccacgggcagatgctggaggaaatgcaaagtctcgaagaagacaagaacagggcaatcgaggaggccttcgcccgcgctcaggtggaaatgaaagctgttcatgagaaccttgcaggtgtccggaccaatttactgactcttcagcctgcactgaggacacttaccaatgactacaacggacttaagagacaagttagggggtttccccttctcctccaggaggctctcagaagtgttaaagccgagataggacaggccatcgaggaagtgaactcaaacaaccaagagctgctgcgcaagtaccgcagggaactccagctccgaaagaaatgtcataacgagttggtcaggctgaagggtaatatacgggtgatagccagagttagaccagtcaccaaggaggacggggaaggtccggaagccacgaatgcagtgacatttgacgccgatgacgactctatcattcacttgctacacaaaggcaaacctgttagtttcgagctggacaaagtattctcacctcaggcatcacagcaggacgaggtgcaggcactggtgactagttgcattgatggttttaatgtttgcattttcgcctatggccaaacaggcgctggaaagacctataccatggaaggcacggccgaaaatccaggcatcaaccaaagagctctgcagctgctcttcagcgaagtacaggagaaagcttccgactgggagtatacaattacggtgtccgctgccgagatttataacgaggtgctgagagacctgctggggaaggagccccaggaaaaacttgagatcaggttgtgccctgatggctctggccaactgtatgtgcccgggttaacagagtttcaggtacagtctgtcgacgacatcaataaagtctttgaatttggccatacgaacaggaccacagagttcactaacctgaatgaacactccagcagatcgcatgccttactgattgtgacagtgcggggagtcgattgctccactggcttgcggacgactggtaaattgaacctagtggacctcgccggatccgagcgggtgggtaagtccggtgctgagggcagtaggctgcgcgaggctcagcacattaacaaatccttgtcagccctgggggacgtgattgctgccctgcggagtaggcagggtcacgtcccgttcagaaactcaaagctaacttacctgcttcaagactcactgtccggggactccaagactcttatggtagtacaagtttctcccgtggagaaaaacacgagcgaaaccttatactctttgaaattcgcagaacgcgtgcggagtgtcgagctaggaccaggactgagacgcgcagagttgggatcttggtcctctcaagagcaccttgaatgggagcctgcatgtcagaccccccagccctcggcccgtgctcactctgctccttctagcgggacgtcttcaaggccaggctccattcgccgcaaactccagcctagcgcttag

SEQ ID NO: 121717 - DNA, 1914 bp, Artificial Sequence
  Description of Artificial Sequence: Synthetic coding sequence
atgtacgacaatatgtcgacaatggtgtatattaaagaggataaactggagaagcttacacaggatgaaattatcagtaagaccaagcaggttattcagggactggaggcactaaaaaatgagcataactcaatcctccaatcattgttagaaacgctgaagtgtctgaagaaggatgacgaatctaatctagttgaggaaaaatcaaatatgatccgcaagtccttggaaatgctcgagctgggcctgtccgaagctcaggtaatgatggctctctcaaatcacctgaacgccgtggagagcgagaagcagaagttgcgcgcacaggtacggcgcttgtgtcaggaaaatcagtggctacgggacgagctcgctaacacgcagcaaaaactgcagaagagtgagcagtctgtagcacagcttgaagaagagaaaaagcatctggaattcatgaatcagctcaagaaatatgatgacgacatatctccctctgaggataaagacacagatagcaccaaggagcccctggatgacctattccccaacgacgaagacgaccctggtcagggaattcagcagcagcactctagcgcagccgctgccgcacagcaaggcgggtatgaaattccggctaggctgaggaccctccacaacctggtcatccagtacgcatcgcagggacgatatgaagtggccgtacccctgtgtaaacaggccctggaagatctggagaagactagcgggcatgatcaccccgacgtcgccactatgctgaatatcctggcattggtataccgtgatcagaacaagtacaaagacgccgccaacctgctcaacgatgcacttgccattagagaaaagactcttggaaaggaccaccccgccgttgcagccaccctcaacaatctggccgtgttgtacggcaagagagggaagtacaaagaggccgaaccactgtgtaagcgggcacttgagataagggagaaggttctcggcaaggaccatcctgatgtggcgaagcagcttaataacctagccttgctctgccagaaccaaggaaagtatgaggaggtggaatactattaccaacgagctctggaaatctatcaaactaagctgggacctgacgatcccaatgtcgctaaaaccaagaacaaccttgctagttgttacctcaaacaaggcaagtttaagcaagcagagacattgtacaaggaaattctcactagagcgcacgaaagagaattcggtagcgtggatgatgagaacaaacctatctggatgcacgccgaagaacgggaagaatgtaagggtaaacagaaggatgggactagtttcggtgaatatggtggttggtataaggcatgcaaggtggactcccccacagtgaccactactcttaagaacctcggcgctctttatagaagacaaggaaagttcgaggccgcagaaactcttgaagaagctgccatgagaagcaggaaacaagggttagataacgtccataagcagcgggttgccgaagtattgaatgatcccgaaaacatggaaaaaagacgctctcgggagagcctcaatgtggacgtggtgaaatacgaatcagggcctgatggcggtgaagaagttagcatgtcggtagaatggaacggcgatggcacaggctccctgaaacgctctggatcctttagcaagctgcgggcatcaattcgcaggtcttccgaaaaacttgtcaggaaactaaaaggagggtcttcacgggagtccgaacccaagaatccagggatgaagcgagctagctcgttgaacgttttgaacgtgggtggaaaggccgccgaggatcgttttcaggagcgaaacaattgtttggcagactcacgggccctgtcagcttcccacactgatttggcacactag

SEQ ID NO: 121718 - DNA, 1920 bp, Artificial Sequence
  Description of Artificial Sequence: Synthetic coding sequence
atgtatgacaatatgagcactatggtatatattaaggaggacaaactagagaagttgactcaggatgagatcatcagcaagaccaaacaagtgattcagggcctggaagcgcttaagaatgaacacaactcaatcctccagtcgttactggagaccttgaaatgcttgaagaaagatgatgaatctaacttggtggaagagaagtcaaacatgatcagaaaaagccttgagatgctcgaacttggactgagcgaagcacaggtgatgatggccctcagcaaccaccttaacgccgtcgaaagtgagaaacagaagctgcgagcccaggttcgaaggctgtgccaggagaaccagtggctgagggacgagctggccaacactcagcagaagctgcaaaagtccgaacagtcagtcgcccagctggaggaggaaaaaaagcacctcgagttcatgaaccaattgaagaagtatgacgacgatatatctccaagtgaggataaagacaccgattccactaaggagccacttgacgacctcttcccgaacgatgaggacgatccagggcagggcatccagcagcagcattcctccgccgccgccgccgcgcagcagggcggctatgaaatcccagcccgactccggaccttgcataatctggtgattcagtatgccagtcagggacggtatgaggtcgccgtgccgctctgtaagcaggctctcgaagacctggagaagacatcaggccacgaccatcccgacgtcgccacaatgttgaacatcttggccctggtctatcgcgatcagaacaaatacaaggatgccgcgaacctgctgaacgacgcccttgccattcgcgagaagaccctgggcaaggaccaccccgccgtggcggccacgctgaacaatttggctgtgctatatggcaagcgaggtaagtacaaagaggccgaacccttgtgcaaaagggcacttgagataagggaaaaggttctgggaaaggaccaccctgacgttgctaaacaactcaacaacttggccctcctgtgccaaaatcagggaaaatacgaagaggttgagtattattaccagcgcgctcttgagatatatcagacaaagctcgggcccgacgaccctaacgtggccaagaccaaaaacaatctggccagctgctatctgaagcaaggaaagtttaagcaggcagagacgctgtacaaggagatcctcacacgggcgcacgagcgagagttcggctcagtggatgacgagaacaagccaatctggatgcacgccgaggagcgcgaagagtgtaagggcaaacaaaaggacgggacatcctttggagaatatggcggctggtacaaagcctgcaaggtggattcaccgacagtcactacaaccctgaagaacttaggagccctttatagacggcaaggaaagtttgaagctgccgaaactctggaagaagccgcgatgcgtagcaggaaacagggactagacaacgtacacaagcagcgggtcgcagaggtgttgaacgaccccgagaacatggaaaagaggaggagtagagagtccctaaacgtcgatgtggtgaaatatgagtcagggccagacggcggtgaggaagtgagtatgagtgtagaatggaacggggatggcactgggtctctcaaacggagcggttctttttcaaagttacgggctagcatccgcaggagcagtgaaaaactggtgaggaagctgaaaggcggcagctcaagggagagtgagcccaaaaaccccggaatgaaaagagccagctctctgaatgtgcttaacgtgggtggaaaggcagcagaggatcggtttcagggcgtctcagggcgtgcctccttctgcggcaaaagacaacagcagcagtggcccggccgcagacatcggtag

SEQ ID NO: 121719 - DNA, 1887 bp, Artificial Sequence
  Description of Artificial Sequence: Synthetic coding sequence
atgtacgataatatgtctacaatggtctatattaaggaggacaagctcgagaagttaacgcaagacgaaatcatctccaagactaaacaggttatccagggtctggaggctctgaaaaacgagcacaattcaatcctccagtcactgttggaaacactgaaatgcctgaagaaggacgatgagagcaatctggtagaagagaagtcaaatatgattagaaagtctttagagatgcttgaactgggtctcagtgaggctcaggttatgatggcacttagtaaccaccttaacgctgtcgaatctgagaagcagaagctcagagcgcaggtgaggcggctgtgccaagagaatcaatggctgcgggacgaacttgccaacactcaacagaaactgcagaaaagcgaacagagcgtggcccagcttgaagaggaaaagaagcacttagagttcatgaaccagcttaagaagtatgatgacgatataagtccctctgaggacaaggacaccgatagtacaaaagagccactcgatgatctgttcccgaacgatgaggacgatcctggtcaggggattcaacagcagcacagctccgctgccgccgcggcccagcagggtggctacgagatccccgctagattacgaacacttcacaatctggtgattcaatatgcatcacagggtagatacgaggtggcagtgcccttgtgcaaacaagcgctggaagatctggaaaagacgagtggtcacgatcaccccgatgtggccaccatgctgaacattctcgctttagtgtatagggaccagaacaaatacaaggacgcggccaatttgctgaatgacgcccttgccattcgggaaaagaccctgggcaaagaccatcctgcggtggctgccaccttaaacaatctggccgtgctgtatggcaaaaggggcaagtacaaggaggccgagccgctctgtaagcgggcactggagatacgtgaaaaggtgctgggaaaggatcaccccgatgttgctaagcaactaaacaatctagccctgctttgtcaaaatcaggggaagtatgaggaggtcgaatactattatcaacgggcccttgaaatttaccaaactaaactgggcccagacgatcccaacgtggcaaagactaagaacaatctggcctcctgttacttgaagcaaggcaaatttaagcaggcggaaactctgtataaggaaatactgacacgtgcccacgagagggagtttggatctgtcgatgacgagaataaaccaatttggatgcatgcagaagagagggaagagtgcaagggcaagcaaaaagacgggacgtcattcggcgaatacggaggctggtacaaagcatgcaaggtcgatagtcccactgtgactaccactttgaagaatctcggggccctttaccgtcgccagggcaagttcgaggccgccgaaaccctggaggaggcggccatgaggtcacgcaaacagggccttgataatgttcacaaacagcgtgtggcagaggttttgaatgatcctgaaaacatggaaaaaagaagaagcagggagtccctgaacgtggacgtcgtcaagtatgagtcagggccggacggcggcgaggaagacggaaccggatccctgaagcggtcaggcagtttttccaaacttcgggcctctatccgacggagcagcgagaaattagtgagaaagctgaagggtggtagctctcgggaatctgaaccgaaaaacccggggatgaaacgggccagttcacttaatgtgctcaacgttgggggcaaagcagctgaggaccggttccaagaacggaacaattgtttagccgacagccgggcgctttcagcgagccataccgacctagcccactag

SEQ ID NO: 121720 - DNA, 1722 bp, Artificial Sequence
  Description of Artificial Sequence: Synthetic coding sequence
atgtacgacaatatgagcacaatggtctacattaaagaagacaaattggagaagttaacgcaggacgagattattagtaaaacgaaacaagtaatccagggcctagaggcgcttaaaaatgagcacaatagcatcctgcaatccctcctggagacgcttaagtgcctgaagaaagacgacgagtcgaatttggtggaggagaagtctaatatgataagaaaaagtttagaaatgctcgagctcggtttgtcagaggcgcaggtgatgatggccctaagcaaccacctaaatgccgtagagtccgaaaaacaaaagttgagggcccaggtccgccgcctttgccaggaaaaccaatggctgcgcgacgagctggcgaatacacagcagaagttgcagaaaagtgagcaatcagtggctcaactagaggaagagaaaaaacatttggaatttatgaaccaactgaagaagtatgatgacgatatctctccctccgaggataaagataccgacagcacaaaggagccactcgacgatctgtttccgaacgacgaagacgaccccggccaggggattcagcagcagcactcttcagctgctgctgcagctcagcaaggcggctatgaaatccctgcgaggttgcggacacttcacaacctggtgatacaatacgcatctcaggggagatacgaagtcgctgtccctctgtgtaaacaggccctggaggatctcgagaaaacaagtggccatgatcatccggacgtcgccaccatgcttaatatattggctcttgtctatcgcgaccagaacaagtataaagatgccgccaacctgctgaatgacgccttggctatccgcgaaaaaactcttggcaaagatcacccagcagtcgcggccacactgaataacctggccgttttgtatggaaaacgaggtaaatacaaggaagctgagcctctttgcaagcgcgctcttgagattagagaaaaggtcctcggcaaggatcatccagatgtcgctaagcagctcaataatctggccttgctgtgccaaaaccagggaaaatacgaggaggtggaatactactaccagcgggccctggaaatttaccagaccaaattaggcccagatgatccaaatgtggccaaaacaaaaaataacctggcctcttgctacttgaaacaggggaagttcaaacaggctgaaaccctctacaaggaaatcctaaccagggcacacgagagggagttcggaagcgtggacgatgaaaacaaaccaatttggatgcatgctgaggagcgggaagagtgcaagggtaagcagaaggacggcacctcatttggggagtacggaggctggtacaaggcttgcaaggtcgactccccgaccgtcaccacaacgctcaagaacctcggggctctttaccgtcggcaggggaagtttgaagccgcagagaccctcgaggaggcagctatgaggtctcgcaagcaagggctggacaacgtacataagcagcgggtcgctgaggtgctcaatgatcccgagaacatggaaaagaggcgatctagagagtccctgaacgtagacgtcgtaaaatatgagtccggcccagacggcggtgaagaggtgtccatgtccgtggaatggaatgggggggtgagtgggagagcttcgttctgtggcaaaagacagcagcagcagtggccaggccggaggcaccgttag

SEQ ID NO: 121721 - DNA, 1731 bp, Artificial Sequence
  Description of Artificial Sequence: Synthetic coding sequence
atgtatgacaatatgagtaccatggtgtacattaaagaagataaactggaaaagctaacacaggatgagatcatttcaaagacgaagcaggttatacaaggccttgaagctctaaagaacgaacacaatagcatcctgcagtcgttactggagacattgaagtgccttaaaaaggatgatgagtccaacctcgtagaagaaaagtccaacatgatcaggaagtctttggagatgctggaactcgggttgtctgaagcccaggtcatgatggcgctctctaaccatctgaacgcggtggagagcgaaaagcagaaactgcgggctcaggtgaggaggttgtgccaggaaaatcagtggctaagggacgaattggctaacacacagcagaagttgcaaaagtcagaacagtctgtggctcagctcgaagaggagaagaaacacctggaatttatgaaccagttaaaaaagtacgacgatgacatctctccatcagaggataaagataccgacagcactaaagagcccctcgatgatttatttcccaacgacgaagatgatcccgggcaaggaatccagcagcaacattcatctgcggcggcggctgcacagcagggcggttacgagatccccgcccgtctgcgtacactgcataacttagttatccagtatgcatcccagggcaggtatgaggtggcagtacccttgtgtaagcaggccctggaggatctcgaaaagacttcaggacacgatcaccccgatgtcgctaccatgctaaatatcctggccctcgtgtatagggaccagaataaatacaaggatgccgcaaacctgctgaacgacgccctagcaataagggaaaagactctgggcaaagatcacccagcagtggccgctaccctaaacaacttggccgtgctctatggaaagcggggcaaatacaaggaggcagaaccactttgtaaacgagcactggagatccgggagaaggtgttaggaaaagaccaccccgatgtcgccaagcagttaaataatcttgcattactctgtcagaatcaaggaaagtacgaagaggtagagtactattatcagagggcgttagagatctaccagactaaactcggtcccgacgatccaaacgtggccaagacgaagaataatctggcatcatgttatcttaagcagggaaaattcaaacaggccgagactttgtacaaggagattctgacccgtgcgcatgaacgcgaatttggatctgtggatgatgagaataagccgatttggatgcatgcggaggagcgcgaagagtgcaaggggaaacagaaagacggcacctccttcggggaatatgggggatggtacaaggcatgcaaggtcgattctccaaccgtgactaccacattgaagaaccttggggccttgtatagaaggcaggggaagttcgaagcagcggagacactcgaggaggccgccatgcgttcccgcaagcagcgcagcattagtgaaattccaaaaaagatactgtctgcgaatggttcaaatcactttccattgcccggttcccaggggctcgataatgtacacaagcagcgggtggctgaagtactgaatgaccctgagaacatggagaagcggcggagcagagagagcctcaacgtcgatgtggtaaaatacgagtctggccctgacgggggggaagagatgcgcaagatgaagctcggcctggtgaactag

SEQ ID NO: 121722 - DNA, 1683 bp, Artificial Sequence
  Description of Artificial Sequence: Synthetic coding sequence
atgtacgataacatgagcaccatggtatatattaaagaggataagctggagaagctcacacaggatgagatcatctctaaaacgaaacaggttatccagggactcgaagccctgaagaatgaacacaattcaattcttcagtccttgttagaaactctgaagtgtctgaaaaaggatgacgagtccaatttggtggaagaaaaatctaatatgattagaaagtccttagagatgctcgagcttggcctgagcgaagcccaagtcatgatggccctctctaaccacctgaacgccgttgagtctgaaaagcagaagctgcgggctcaggtgagaagattgtgccaggaaaaccaatggctgcgagacgagcttgccaacacccagcaaaaactgcagaaaagcgagcaaagtgtggcacagctagaggaggagaagaaacacctagaatttatgaatcagctcaagaagtacgatgatgatatatcaccttcagaggataaggacacagactcgaccaaggaaccccttgatgacctgtttcccaatgatgaggatgaccctggtcaggggattcaacagcagcattcatccgcagcagctgctgcccaacaaggcgggtacgagatccccgcccgcctcagaactttgcacaacctggtgatccagtatgcctctcagggacgttatgaagtcgccgtgccactctgcaagcaggctctcgaggatctggaaaagactagcgggcatgatcatcctgatgtggcaacaatgctcaacatcctcgctcttgtctatagggaccagaacaagtacaaggacgctgccaatctgctgaacgatgcactggcaataagggaaaaaacactagggaaggaccatcctgcagttgccgccaccctaaacaatctggccgttctgtacgggaaacgcggaaagtataaagaagccgagcccctttgcaagagggctttggagattcgtgagaaggtcttgggaaaggatcatccagacgtcgccaaacagcttaataatcttgccttgctgtgccagaaccaaggtaaatatgaggaggtggagtactattaccagcgggctttagaaatctaccagactaaattagggcctgacgaccctaacgtggctaagaccaagaataatcttgccagttgctatttgaagcagggcaagtttaagcaggcagagacgctctataaggagatcttgacaagagcccacgagcgtgaattcggtagcgtggatgatgaaaataagcccatctggatgcatgcggaagagcgggaagagtgcaagggcaagcagaaggatggtacatcttttggagagtacggagggtggtacaaggcatgtaaggtggacagtcctaccgtaactacaacgcttaagaatttgggggctctgtaccggagacaggggaaatttgaggccgccgaaaccttggaggaggccgctatgcggtcccggaagcagggcctggacaatgttcacaagcaacgcgtcgcagaagtgctgaacgaccccgagaatatggagaaaaggaggagtcgcgagtcgctcaatgtggacgtagtcaagtatgaatctgggcccgatggaggagaagaagtaagcatgtctgttgagtggaacggaatgcgtaagatgaaactgggactggttaattag

SEQ ID NO: 121723 - DNA, 1755 bp, Artificial Sequence
  Description of Artificial Sequence: Synthetic coding sequence
atgtacgataacatgagcaccatggtgtacatcaaggaggacaagctcgagaaactgactcaggacgagattatttccaagaccaaacaggtcatacagggtctggaggcattgaaaaatgagcacaattcaatactacagagcttgttagagacgttgaaatgtctaaagaaggatgatgaaagcaacctggtggaagaaaagtctaacatgatcaggaagagcttggaaatgctggaactgggccttagcgaagcacaagtgatgatggccctatccaatcacctcaacgccgtggagagtgagaagcagaagctgcgggctcaggtcagaagactgtgccaggagaaccagtggctccgcgatgagcttgcaaacacacagcagaaattacagaagagcgagcagagtgtcgcgcagctggaagaggagaaaaaacatctggagttcatgaaccagctgaagaagtatgacgacgatatctccccgagtgaggacaaggacaccgatagcacaaaagaacccctggacgatctgtttccaaatgacgaggatgatccagggcagggtattcaacagcagcacagctcggctgccgccgcagcacagcaggggggttacgagattcctgcccgtctccgaactctgcataacctggtgattcagtacgcatcgcagggtaggtatgaagtggcagtccctctgtgtaaacaagccctagaagatctcgagaaaactagcgggcacgatcacccggatgtggccaccatgctaaacattcttgcacttgtttacagagaccagaacaaatacaaagatgctgctaatcttctcaacgatgcccttgcgattagggaaaaaacgctgggaaaagaccaccctgctgtcgcagccaccctgaataatctcgctgtcttgtatggcaaaaggggaaagtacaaggaagcggagcccttatgtaagagggcactggagatccgggaaaaggtgctgggcaaggaccacccagacgtggcgaaacaactgaataatcttgctctcctttgccagaaccaagggaagtatgaggaagttgaatattactatcagcgggcgcttgaaatctaccagactaaactgggccccgacgaccccaatgtcgcaaaaacaaaaaacaacctggcctcatgctatctgaagcagggcaagtttaagcaggcagaaacactatataaggaaattctgacccgggcacacgagagagaattcggctcggtcgacgatgagaacaaaccaatttggatgcacgcggaggagcgagaggaatgtaagggtaagcaaaaagatggcacatctttcggagagtacggcggttggtataaagcttgtaaggttgactccccgaccgtgacaacgacccttaaaaatctgggagccctctaccgcagacagggcaagttcgaggctgccgagacgctggaagaggcagcaatgcggtcaaggaaacagggccttgacaatgtgcacaagcagagggtcgccgaggtgctaaatgatccagaaaacatggaaaaaagacgctctagagaatccctcaatgtggacgtggtaaaatatgagtcaggccccgatggcggagaagaaatgaagagagcatccagtctgaatgtactgaatgtcggcgggaaggctgcagaagacagatttcaggagagaaacaactgtctggccgactcgagggctcttagcgcaagccataccgatctagcacactag

SEQ ID NO: 121724 - DNA, 1857 bp, Artificial Sequence
  Description of Artificial Sequence: Synthetic coding sequence
atgtacgacaacatgagcaccatggtgtacattaaggaagataaactggaaaagctgacacaggacgagattatttccaagactaaacaagtcattcagggactggaggccctgaagaacgaacataactccatactgcaatccttactggaaacattgaaatgtctgaaaaaagatgacgagagcaacctcgtggaagaaaagtctaacatgataaggaagagtctcgaaatgctcgagctgggcctcagtgaggcccaggtgatgatggccctgtcaaaccacctcaatgcagtcgaatccgaaaagcaaaagctgcgagcacaagtgaggcgtctgtgtcaggaaaaccagtggctgcgcgacgagctagcaaatacacaacagaagttgcagaaaagtgaacagtccgttgcccagctggaagaagaaaaaaagcatctggaatttatgaatcaactgaaaaagtacgacgatgacatatccccctccgaggataaggacacagatagtacaaaggaaccgctcgatgacctgttcccaaatgatgaagatgacccaggacaaggaattcagcagcagcactcatctgctgccgcagctgcccagcagggcgggtatgagatacctgctaggctccgcacactgcacaaccttgtaattcagtatgcttcccagggacggtatgaagtcgccgtgcccctgtgcaaacaagcgttggaagatctcgagaagactagcgggcacgatcatccagatgtcgctactatgctgaatatcctcgcactcgtgtacagggaccagaataaatacaaggatgcagccaacctgctgaatgatgctcttgctataagagaaaagaccctgggaaaagaccaccctgctgtggctgccacgctcaataatctcgccgtcttgtacggtaaacggggcaaatataaagaagctgaacccctgtgtaaacgcgctctggaaattagggagaaggtcctcggaaaggatcacccggatgtcgcaaagcagttgaataacctggcactgctgtgccagaatcagggcaagtacgaggaggttgagtattactaccagagggccctggaaatttatcagaccaagcttgggccagatgatcctaacgtagcaaaaactaaaaataatttagcctcttgctatcttaaacagggaaagtttaaacaggcagagaccctctacaaggagatactaacaagagctcatgaacgcgagttcggttccgtagacgacgagaataaacccatctggatgcacgccgaggagagggaagagtgtaagggaaaacagaaggatggcacgtcatttggagagtatgggggctggtataaggcttgcaaggtggactcgcccacagttacaacgacattgaaaaacctgggagcactgtatcggaggcagggtaaattcgaagctgccgagacgctggaagaggctgctatgcgctctcggaagcaaggcctcgacaatgtacataagcaaagggtggccgaagttttaaacgacccagagaatatggaaaagcgacggtcaagggagagcctcaacgtggacgtggtgaagtacgaatcggggcccgacggcggtgaggaagtaagcatgtcagtcgaatggaatggtgatggaactggctccctcaaacggtctgggtctttctccaaactcagagcttccatacgtcgctcaagcgagaagctcgttcgcaaactcaagggtggcagttcaagagagagcgagccgaaaaaccccggcgcttctctggcggagccactcttcgtggagaacgactctagttcatcagggctggaagatgccacagccaattag

SEQ ID NO: 121725 - DNA, 1683 bp, Artificial Sequence
  Description of Artificial Sequence: Synthetic coding sequence
atgtacgataatatgagtaccatggtctacatcaaagaggataagctcgaaaagctgacacaggacgaaattattagcaagacgaagcaagtgattcagggcctggaggccctgaaaaacgaacacaattctattctgcagtcgttattagaaacccttaagtgcctgaaaaaagatgacgaaagcaatctggttgaagagaagtccaacatgatcaggaagtcactggagatgctggaactgggccttagcgaagctcaggttatgatggctctttccaatcatttaaatgctgtagaatccgagaagcaaaagctgcgcgctcaggtgcgtcggctgtgtcaagaaaaccaatggttacgagatgagctcgccaacactcaacagaagttgcaaaagtctgagcaatctgtcgcacagctggaggaggaaaagaaacatctggagtttatgaatcaactcaagaagtatgatgatgacattagcccatcagaggataaggacacagactccacaaaggaaccactcgacgacttgttcccaaatgacgaagatgatccaggtcaagggattcaacagcagcacagctccgctgcggcagccgcccagcaagggggatacgaaatccccgctaggcttcgaacactccacaacctggtcattcaatacgccagccaaggcagatacgaagtagcagtgcctctttgtaagcaggctttggaagatttggagaaaacgagcggacacgatcaccctgacgtcgcgaccatgctaaacatactagccctggtgtaccgcgatcagaataagtacaaagacgccgccaatctgcttaacgacgcactggcaatccgagagaagactctagggaaagatcacccggcagtcgcagccactctgaacaatctggctgtgttatacggtaaaagaggaaaatacaaggaggctgaacctttgtgtaagcgcgctctcgagattagggaaaaggtgctcggcaaagatcaccccgacgtggccaagcaattaaataatcttgccctgctgtgtcagaaccagggaaaatatgaagaggtggaatattactatcagagagccctggagatataccagaccaagctcggcccagacgacccaaatgtcgctaagacaaaaaacaacctcgcctcatgttatctcaagcagggcaaatttaaacaggccgagaccctgtataaggaaattctgaccagagcgcacgagcgggaattcggaagcgtggatgacgagaataagcctatttggatgcacgcagaagagagagaggagtgcaaaggcaagcagaaggacgggacatcctttggcgaatatggcgggtggtataaggcttgtaaggtcgactccccaacggtcactacaactctcaagaacctgggcgctctgtatagacgtcagggcaagttcgaggccgccgaaaccctggaagaggcggccatgcggagtaggaaacaaggtctagacaatgtacacaagcagcgcgtggctgaagtactcaacgatcctgaaaatatggaaaagaggcggagtcgggaaagccttaatgtcgacgttgtgaagtatgaatcagggcctgatgggggtgaggaggttagcatgtctgtggagtggaatggcatgagaaaaatgaagctcggcctggtgaattag

SEQ ID NO: 121726 - DNA, 396 bp, Artificial Sequence
  Description of Artificial Sequence: Synthetic coding sequence
tgagaaaacaaacctatatggatgcacgccgaagagcgcgaagaatgtaagggaaaacagaaggatgggacaagcttcggcgagtacgggggatggtataaagcgtgtaaggttgattctccaacagtgactaccacattaaagaacctcggtgcactgtatcgacgacaggggaaatttgaggcagcagaaacactcgaggaagccgcaatgcggagccgcaagcaaggtttggacaacgtgcacaaacagcgggttgcagaggtgcttaatgatccagaaaacatggagaaaaggcgctcccgggaatcactgaacgtggacgtggttaagtatgagtcaggccctgatggtggggaggagatgaggaagatgaagttgggactggtgaactag

SEQ ID NO: 121727 - DNA, 1893 bp, Artificial Sequence
  Description of Artificial Sequence: Synthetic coding sequence
atgtatgataacatgtccactatggtgtatatcaaggaagacaaactcgaaaaactgacgcaggacgaaattattagtaagacaaagcaggtgatccaaggtctcgaggctttgaaaaatgaacacaattccattctgcagagcctgctggaaactctcaagtgtctgaagaaggatgatgaatccaacctcgtcgaagaaaagagtaatatgatcaggaaaagccttgaaatgctcgagctgggactctctgaagcacaggttatgatggcattaagcaaccatcttaatgccgtcgaatcggaaaaacagaaacttagggcgcaggttcggcgactatgccaagagaaccaatggctcagagacgagctggcgaacacacaacagaaactgcagaaaagcgagcagtccgtggcccaattggaggaagaaaagaagcacttagagtttatgaatcaactcaaaaagtatgacgacgatatttcaccgagcgaagacaaggacactgattctacaaaggaaccactagacgacctctttccaaacgacgaagatgaccctgggcagggcattcagcaacagcacagctcagcggccgccgcagcccagcagggggggtacgagatacccgcccgtctccgcacgttacataaccttgtaattcagtacgcctcacaaggtagatacgaggtggcagtccctctgtgcaaacaggctctggaagatttggagaagacaagtgggcatgatcacccagatgtcgccaccatgttgaacatcttggcgctggtttatcgcgatcagaataagtataaggatgcagccaatttgttaaatgacgccctcgcaattcgtgagaagaccctgggaaaggaccacccagcagttgctgctaccctgaataacctggcagtgttgtatggcaagcgcggaaaatacaaagaagcggaaccgctctgtaagcgggcgttagaaatcagagagaaggttctggggaaggaccacccagatgtagcgaaacagttaaataatttggcacttctctgtcagaatcaagggaagtacgaggaagtggagtattactatcaacgcgccctcgagatttatcaaaccaagcttgggccagacgacccgaacgtcgcaaaaaccaagaataaccttgcgagttgctaccttaagcaaggcaagttcaagcaggccgagactctttacaaagagatactcaccagggctcacgagcgcgaattcggatctgtagacgatgaaaataagcctatctggatgcacgctgaggaaagggaagaatgcaagggcaaacagaaggacggaacctcattcggagaatacggagggtggtacaaggcctgcaaagttgattcccccaccgtcacgacgacactgaagaatcttggcgctctgtacaggaggcaggggaaatttgaggctgctgaaactctggaagaggctgcgatgagaagcaggaaacaggggctagacaatgtgcataaacagagggtggctgaagttcttaatgatccagagaatatggagaagcgaagatctagggagagtctgaatgtggacgtcgtcaagtatgaatctggccctgacggaggagaggaggacggaactgggtcgctgaagcgctctgggagtttttctaaacttcgggcatctatcagacgcagttctgaaaagctcgtgcgtaaattgaaaggaggaagcagtcgggagtcagagccaaagaaccctggcatgaaacgcgcgagctccctgaacgtgttgaatgtggggggaaaagccgcagaagacagattccagggggtttccggaagagcttccttttgcggaaaacgccagcaacagcaatggcctggcagacgccacagatag

SEQ ID NO: 121728 - DNA, 453 bp, Artificial Sequence
  Description of Artificial Sequence: Synthetic coding sequence
atgtacgacaatatgtcaaccatggtttacataaaggaagacaaacttgagaaactgacccaggacgaaattatttcaaagactaagcaggtaattcagggtctggaggcacttaagaatgagcacaactctatcttgcagtccctgctggagactttgaagtgtttaaagaaggacgatgagagcaatctggtggaggaaaagtctaatatgatccggaagagtctcgaaatgctagaactcggactgagcgaggcccaggtgatgatggccctgtccaaccatctcaacgccgtcgaatccgagaagcagaaactacgtgcgcaggtgcggcggctctgccaggaaaatcagtggcttcgcgacgagcttgccaatacacaacaaaaactgcaaaaatccgaacagtcagtcgctcagcttgaagaggaaaaaaaacatctagaattctag

SEQ ID NO: 121729 - DNA, 1695 bp, Artificial Sequence
  Description of Artificial Sequence: Synthetic coding sequence
atgtatgataacatgtcaaccatggtgtacatcaaggaggacaagctagaaaaacttactcaggatgagatcatatccaaaaccaagcaagtcatccagggcctggaggcactcaagaatgaacataattctattctgcagtccctgctggagaccttgaaatgtctgaagaaagacgacgagtccaacctcgtggaagagaaaagtaatatgatccgaaaatcacttgagatgctcgagctggggttaagcgaagctcaggtgatgatggcattgagtaaccaccttaacgcggtggagtcggagaagcaaaagctgagggctcaagttcggcggctctgccaggagaaccagtggctgagggacgagctggctaacacccaacagaagctgcagaaatccgagcaatccgttgcccagcttgaagaagagaagaagcatctggagtttatgaatcaactgaaaaagtatgacgatgatataagcccctccgaggacaaagacaccgacagcactaaggaaccgttagacgacctgtttcctaacgatgaggatgatccagggcagggcattcagcagcaacattcatctgctgcagccgcagctcagcagggcggttacgaaatcccggcccggctgcgaactttgcacaatctggtaatccagtacgcctcccagggtcgctacgaagtcgccgtgcccctttgtaagcaggcgctcgaggacttggaaaagacttctggccacgatcatcctgacgttgcaaccatgcttaacatcctcgccttggtttaccgcgatcagaataaatataaggatgccgctaatcttctgaacgatgctctggccattcgcgagaagactctcggcaaggatcatccagcagtcgccgcgacattgaataacctggccgtcctgtacgggaagagaggaaagtacaaagaggcagagcccctgtgtaagcgtgcccttgagatcagggagaaggtgctcggaaaagatcaccctgatgtcgcgaagcagttgaacaatctcgcactgctttgccaaaaccagggcaagtatgaggaggtggaatactattatcagcgtgctctggaaatataccaaactaagctgggacctgacgacccaaacgttgcaaagaccaaaaataatctcgcctcatgctacctcaagcaagggaagtttaaacaagccgagactttgtataaggagatcctgacacgcgcccacgaacgcgagtttggatcagtcgatgatgagaataagccaatctggatgcatgctgaagaaagagaggagtgcaagggaaaacagaaagatggtacctcattcggcgagtatggcggttggtacaaggcgtgcaaggttgactctcccacagtcaccacaacactcaagaatctgggtgctctctacaggagacagggaaagtttgaggctgcagagacacttgaggaggcagccatgcgatcacggaagcagggcctcgacaatgtgcacaagcagcgtgtggcagaagtgctcaatgaccccgaaaacatggagaagcggcggtcacgtgagagcctcaacgtagacgtggtgaaatacgagtctggtcctgacggtggggaagaaggagtcagcggacgagctagcttctgtggtaagaggcagcagcagcagtggccagggcgtcgccacagatag

SEQ ID NO: 121730 - DNA, 1869 bp, Artificial Sequence
  Description of Artificial Sequence: Synthetic coding sequence
atggcaatgatggtgttccctcgcgaagagaaactaagtcaggatgaaatcgtgctaggcacaaaagctgtgattcaaggtctcgaaaccctcagaggcgagcacagggccctgctggctcccctggtagcaccagaggcaggggaggccgaacccggtagtcaggaacggtgcatcctactcagacgttccttggaagcaattgaacttggactcggggaggcccaagtcatcctggccctttcatcccacctcggggctgtcgagtccgaaaaacagaagctgcgcgcccaggtgcggaggctcgtgcaggagaaccagtggctccgggaagagcttgccggcacacagcagaaactgcagagatctgagcaggctgtcgcgcagctggaagaagagaagcagcacctcctgttcatgtcacaaatacggaagctagacgaagatgccagtccgaatgaggaaaaaggtgacgtcccaaaagacactctggatgacctgtttcccaatgaagatgaacagtctcccgcgcctagcccgggcgggggagatgtttcaggtcagcacggcggctacgagattcccgccagactgcgaactttacacaacctggtcatccagtacgcgtctcaagggagatacgaagttgcagtacccttgtgtaagcaggcgcttgaagatctcgaaaagacctccgggcatgatcaccctgatgtggccaccatgctgaatatcttggctctggtgtatagagatcagaataaatacaaggaggctgcccatctgcttaatgacgcactcgccatacgcgagaagacactcggaaaggatcaccccgcagtagcagcgacgttgaacaatctggccgtcctttatggtaaaaggggcaagtataaagaagccgagcctctctgtaagcgtgccctcgaaattagagagaaagtgctcggtaagttccacccagatgtggccaagcagctgtctaacctggcactactgtgccagaatcaaggcaaggccgaggaagtcgagtactactatcgcagagccctggagatatacgctacgcgcctgggccctgatgatcccaatgtggccaagaccaagaataacctcgctagttgctatctgaagcaaggcaaataccaggatgctgaaactttatataaggagatcctgacacgcgcccatgagaaggaattcggaagcgtgaacggcgacaataagcctatatggatgcacgctgaggaaagagaagaaagtaaagacaaaaggcgggactccgccccatacggcgaatatgggtcatggtacaaggcttgtaaggtggactcaccaacggtaaacactacactccgttctctcggggctctatatagaagacagggcaaattggaagccgcacacacattagaggattgcgcttctcgtaatcggaaacagggcctcgatccagcatcgcagaccaaagttgtggaactgctcaaggatggcagcgggcgtcgaggtgacagaaggtcgagccgagacatggctggcggagccggacccaggagcgaatctgacctggaagatgttggccccactgccgagtggaatggagacggcagtggcagtcttaggcgtagtgggtccttcggcaagcttcgagatgccctgagaagatcatctgaaatgctggtgaagaagttgcaaggcggcacaccccaagagccccctaaccctaggatgaaacgcgcctcaagcctgaatttcttgaacaaaagcgtggaggaacccactcagccaggcggtactggcctgagtgatagtcgtaccctgtcaagcagcagcatggatctgagccgccgctcctcattggtcggctag

SEQ ID NO: 121731 - DNA, 1638 bp, Artificial Sequence
  Description of Artificial Sequence: Synthetic coding sequence
atggccatgatggtttttccccgcgaggagaagttaagccaggacgagattgtgctgggtaccaaagcagtgattcagggcctcgagaccctgagaggagagcaccgggccctgctggcacccctggtggcaccagaggccggtgaggcagagcccggtagtcaggaaaggtgtatcctccttagaaggtccttagaagcgatagagttgggattgggtgaggcccaggaagagaagggagatgttcctaaggataccctcgatgacctgttccccaacgaggatgagcaatcccccgcaccttctccggggggcggagacgttagcggccagcacggcgggtatgagattcccgccaggctccgaaccttgcacaacttggttatccaatatgcgtcccaggggcgctacgaggtggccgtgcctctttgcaaacaggccttggaagatttggagaaaacgtccgggcacgaccatccagatgtggccaccatgctgaacattctggctctggtgtatcgcgatcagaacaaatataaagaggccgcccatctgcttaacgacgcccttgctattagggagaaaacgcttggcaaggatcacccggctgtcgcggctacactgaataacctcgcagtgttgtatgggaagcgcgggaagtacaaggaggctgagccactgtgcaaaagggccctggaaattagagagaaggttctgggaaagtttcacccagatgtggcaaagcagctctccaacctagctctactgtgtcagaaccaagggaaagccgaggaggtggaatattattaccgaagagcgctggagatttacgccacccggctgggtcctgacgaccccaacgtcgccaaaacgaaaaacaacttggcaagctgttatctgaaacagggcaaataccaggatgcggaaacgctgtacaaggaaattctgaccagggcccacgagaaagaattcggttccgttaacggggataacaagcctatctggatgcatgccgaggaaagagaagaaagcaaggataaaagacgggacagcgcaccatacggagaatatggctcttggtataaagcctgcaaggtggattctccaacagtcaatacgactttgagatcattgggcgcactctaccggcgtcagggtaagttggaagccgcccacactcttgaagattgcgcctccagaaaccggaaacagggcctggaccccgccagccagaccaaagtcgtcgagctgctgaaagacggctctgggcgacggggagacaggcggtcaagccgtgatatggcaggaggcgcaggccctcgatctgaaagcgatttggaggatgtcgggcccactgcggaatggaacggagatggaagcggatcacttcggaggtctggatccttcgggaagctgcgggatgcccttagacggtccagcgaaatgctggtgaagaagttacaagggggcactccacaggagcctcctaatccaagaatgaaacgagccagcagccttaacttcctgaacaagtctgttgaagagcccacacagcctggcggcacaggactgagtgatagccgcaccctttcatcttcttctatggatctctccaggcggtcctccctagtgggatag

SEQ ID NO: 121732 - DNA, 1869 bp, Artificial Sequence
  Description of Artificial Sequence: Synthetic coding sequence
atggctatgatggtctttcctcgggaagaaaagctatcccaggatgagattgtcctggggacaaaggccgtgatacaggggctcgaaaccttgagaggcgaacaccgcgcacttttagctcctctggtggcccccgaagccggagaggctgaaccagggagccaagagcgctgcatactcctcaggcgatcgttggaggctatcgaactcggcttgggggaagcacaggttatcttggcattaagcagccatctgggtgcggtcgaatcagaaaagcaaaaactccgagcacaagtgcgcaggctagtacaagaaaaccaatggctgagagaggaactggctggcacccagcaaaaactgcagagatcagagcaagcagtagcacagctcgaggaggagaagcagcatctgctgttcatgagtcaaatcaggaaattggatgaagacgccagccctaacgaagaaaaaggcgacgtgccgaaggacactcttgacgacctgttcccgaacgaagacgagcagtcacctgctccctcaccaggaggaggggacgtcagtggccagcacggggggtatgaaatacccgcacgacttaggacccttcacaacctggtgattcagtacgcgagtcaagggcggtacgaggttgctgtgcctctgtgtaaacaagcccttgaggacctggaaaagaccagtggacacgatcacccagatgtcgccaccatgctcaacatactggctcttgtctatagggaccagaacaagtacaaagaggcagcccaccttctgaacgatgccctggctatccgagagaagacgctggggaaggaccaccccgcggtcgcagccaccctgaataatttggcagtattgtacggtaagcggggaaagtataaagaagcagaacccctctgcaagagggccttggagattcgcgaaaaggttctgggcaaatttcacccagacgtagccaaacagcttagcaacctcgccctgctttgtcaaaatcagggcaaggccgaagaggtcgagtattactaccgccgagcgttggaaatctacgcgaccagactggggcccgacgatcccaacgtagccaaaaccaaaaacaaccttgcctcctgctatcttaagcaggggaaataccaggatgcagagaccttatataaggaaatacttaccagagcccatgagaaggagttcgggtccgtaaacggtgataataagcctatttggatgcacgcagaagagcgagaagaaagcaaagataaaaggcgtgattcagccccctacggggagtacgggagttggtataaagcgtgcaaggtagacagcccaacagtcaacacaacgctgagatcactgggggcactctacaggaggcaaggaaaactggaggccgctcacaccctcgaagattgcgcgtctcggaatcggaagcagggattggatccggccagtcagacgaaggtggttgaacttctgaaggatggaagtgggcgaagaggagatagacgctcctcccgggatatggctggcggggctgggcctcgctccgagagcgatctggaggatgttggacctaccgctgagtggaatggagatggtagcggatccttacggcggtccggctccttcggtaaattaagagatgccctgcgcagaagctccgagatgctggtaaagaaactccaggggggcaccccccaggagcctcctaatccacgaatgaagcgggcttccagcttgaacttcttgaacaagtcagtggaggagccaacacaacctggtggtacaggtctttccgacagtcgtacattgtctagctcctccatggatttatctagacgcagttctctggtgggttag

SEQ ID NO: 121733 - DNA, 1869 bp, Artificial Sequence
  Description of Artificial Sequence: Synthetic coding sequence
atggccatgatggttttcccccgcgaggagaaattaagtcaggatgaaattgtgttaggcacaaaagccgtcatccagggactagagaccctcagaggggagcatcgagcactgcttgcacctcttgtggcccctgaagccggtgaagcggagcccggttcacaagagaggtgtattcttctaaggcgctccttggaagccatcgagctgggcctgggtgaagcccaagtgattctggccctgtcgtcacacctaggcgccgtggagtccgagaaacagaaactacgggcacaggtcagacggctggtgcaggaaaatcagtggctgagggaggagctggcagggacccaacaaaaactgcaaagaagcgagcaggctgtggcgcagcttgaagaagaaaagcagcacttattgttcatgtcgcagatccgcaaattagacgaagatgccagcccaaatgaggaaaagggtgatgtgccaaaggacaccctggatgatctgttccccaacgaggacgagcaatcccctgccccaagtcccggcggaggcgatgtgagtggtcagcatggagggtacgagatcccagcccgactccggacactgcacaacctcgtgatacaatatgcctcccaagggagatatgaagttgccgttcctctgtgcaagcaggcgctggaggacctggagaaaaccagcgggcacgatcacccagatgtggcaactatgctgaacatactggccctcgtgtaccgggatcagaacaagtacaaggaggcagcccaccttctgaatgatgcacttgctatcagagagaaaacactcggaaaggaccatccagcagtggctgctacactgaataatttggccgtattatacgggaaacgtggcaagtataaggaggccgaacccctgtgcaaaagagcgctggagatcagagaaaaggtactcggcaagtttcacccagacgtggcgaaacaactgtcgaatttggctctcctttgtcagaatcagggaaaggctgaagaggtcgagtactactacagacgagccctggaaatttacgctaccaggctcggcccagacgatccaaacgtggccaaaacaaagaacaacttagcatcctgctaccttaaacagggaaagtaccaagacgcagaaacgttatataaggaaattttgactagggcccatgagaaagagttcggctctgtgaatggggacaacaagcctatctggatgcatgcggaggaaagggaggaatcaaaagacaaaaggagagactccgcaccatacggcgagtacggtagctggtacaaagcctgtaaagtagattccccaaccgtgaacacaacactacggtcccttggtgctctgtatcgtaggcaggggaaactggaggcagctcatacgctcgaggactgtgcgtcacgcaaccgaaagcaggggctcgaccccgctagccagacgaaggtagtggaactgctaaaggacgggagcggcaggcggggtgataggcgttcatctagagacatggccggtggcgcaggccccaggtctgaaagcgatctcgaagacgtgggccccaccgcagagtggaatggcgatgggtctggttccctccgcagatccggctcattcggaaagctaagagacgctctcaggagaagctcagagatgctggtgaagaagctccagggcggcaccccccaggaacccccaaatcctcggatgaagcgcgcttctagtttaaatttcctgaacaagtcggtggaggaacccacccagcccgggggcacagggttatctgatagcagaaccctttccagttcatcaatggatctcagtcgccgcagttccctggtggggtag

SEQ ID NO: 121734 - DNA, 1638 bp, Artificial Sequence
  Description of Artificial Sequence: Synthetic coding sequence
atggcgatgatggtgttccccagagaggaaaaactgtcacaagacgagattgttctggggactaaggcggttatccaaggccttgagacgctgcgcggggagcaccgagcactgcttgcaccactggtggccccagaggccggagaggctgaaccaggctctcaagaacgatgtattctgctgcgccgctcactggaagccatcgagctgggcttaggagaggcccaggaggaaaaaggggatgttcccaaagacacgcttgacgaccttttccctaacgaggacgaacaaagtcctgcaccgagcccgggaggtggcgacgtctctggccagcatggcggctatgaaatcccagctcgcctgcggacgttacacaatctggtgatccagtacgctagtcagggcagatacgaggtggcggttccactgtgcaagcaggctctcgaggacctggaaaagactagtggtcacgaccatccggatgtggcgacaatgttgaacatcttggctcttgtgtacagggaccaaaacaagtacaaagaagccgctcatttgctcaacgatgccttggcgattagagaaaagactctggggaaggaccatccagccgttgctgccactctgaacaacctcgcagtactctacgggaagagggggaagtataaggaggctgaacccctgtgcaaaagggctctagagattcgtgagaaggtcctcgggaagtttcaccccgacgtggcaaaacagctgtctaatctggctctgctgtgtcaaaatcagggcaaggccgaggaagtcgagtactactaccgacgcgcattggaaatttatgctactaggctgggcccagacgaccccaacgtggcaaagacaaagaataatctggctagttgctaccttaagcagggaaaatatcaggatgctgagaccttgtacaaggaaatcctgacacgtgcgcacgagaaagagtttggttcagttaacggcgataataaacctatctggatgcacgctgaagagagggaagagtctaaggacaaacgtagagactctgccccctacggcgaatatgggtcctggtataaagcctgcaaggtggactcacctacggtaaataccacgctgcgatctctgggagccttataccgcagacagggaaagttggaagccgcacacactcttgaggactgtgcctcgagaaacagaaaacagggcctggatcctgcatctcagaccaaagtcgtggaactgctgaaagacgggtcaggtcgaaggggtgatagacgctcttcccgggacatggccggcggtgcaggccctcgtagcgagtcagacctggaggacgtgggtcccaccgctgaatggaacggggacggttccggcagtctgcggcggtccggatcctttggaaagctgagggatgccttaagacgatccagcgaaatgctcgtgaaaaagctgcagggaggcacacctcaggagcctccaaacccacgtatgaaacgggctagttcactcaatttcctcaacaaaagcgttgaggaacctacgcagcccggcggcactggcctcagcgactctaggacgctaagctctagcagtatggacctgtcacgccggagctctctggttggttag

SEQ ID NO: 121735 - DNA, 501 bp, Artificial Sequence
  Description of Artificial Sequence: Synthetic coding sequence
atggcgatgatggtctttcctcgggaggaaaaactgtcccaggatgagattgtcctgggcactaaagcagtcatacaaggactagaaaccctcagaggggagcaccgcgcactgctggcccctctggttgcccccgaggcaggtgaggccgagcccggaagtcaggagcggtgcatcttattgcgaagaagcttagaagctatcgaactgggtctcggcgaggctcaggtgatcttggccctgtctagccacctgggagcagtggagtcagaaaagcagaaattacgagcgcaggttcgaaggttggtccaggaaaatcaatggctgcgagaggaactcgctggcacccagcaaaaactgcaacgctctgagcaggctgtggctcaacttgaggaggagaaacaacacctcttgtttatgtctcagatacgtaagctggatgaagatgcttcacctaatgaggagaagggggatgttcccaaagacactctggatgactag

SEQ ID NO: 121736 - DNA, 570 bp, Artificial Sequence
  Description of Artificial Sequence: Synthetic coding sequence
atggccatgatggtcttccccagagaggagaagttatcacaggacgagatcgtgctcggaaccaaagccgtgatacagggactcgagaccctccgcggagaacatagggccctgctcgcccctcttgtggctcccgaggcaggtgaagccgaacctggtagccaagagcgctgcatcttgctcaggcgctctctagaagccattgaactgggattaggagaggcccaggaagaaaagggcgacgtgccaaaggacacgctggacgacctgttcccaaatgaggacgagcagtcccccgcacctagtccaggcggaggcgacgtatcaggccagcacggtggctatgagatacctgcaagattacggaccctccacaatctcgttattcagtacgcttcacagggacgctatgaggtcgctgtccctctgtgtaaacaggccctcgaagatttggaaaagacgtctggtcatgaccaccccgacgtagccactatgctgaacattctggcgctggtttaccgtgaccaaaacaagtataaagaagctgcacatctgctgaacgacgcatag

SEQ ID NO: 121737 - DNA, 516 bp, Artificial Sequence
  Description of Artificial Sequence: Synthetic coding sequence
atggcgatgatggtatttccccgggaagagaaactgtctcaggatgagatcgttctgggcacaaaggcagtcattcagggattagaaacacttcgcggtgaacacagggcccttctggcgccactggtggctccggaagccggtgaggcagaacctggctcacaggaacgatgtattctgttacgccggtccctggaagccatcgagcttgggttgggtgaggcccaagtgattctcgccctgtcaagccacctcggcgctgtggagtctgaaaagcagaagctgagagcacaagtgcgtagattggtgcaagagaatcaatggctgagagaggagctggccggaacccagcagaaactacaaagaagcgagcaggccgttgcccaattggaggaagagaaacagcacctcttatttatgtctcagatacgcaaactggacgaggacgcctctcctaacgaagagaaaggagatgtcccaaaggatacgctcgatgatctgttcccgaatgagtag

SEQ ID NO: 121738 - DNA, 438 bp, Artificial Sequence
  Description of Artificial Sequence: Synthetic coding sequence
atggcgatgatggtgtttcccagggaagaaaagttgagtcaggatgagatagtgttgggaacaaaggcagtgatccaggggctggagactctgcgtggagagcaccgcgccctgctggcaccactggtagctccggaagcaggtgaggccgagccgggctcccaggagagatgcatcctgctacgccgctctctcgaagcgatcgagcttgggctaggcgaagctcaggtcatacttgctttaagctctcatctcggagctgtagagagcgaaaaacagaaattacgcgcacaagtcaggagactggtgcaggagaatcagtggttgagggaggaacttgccggtacacagcagaagttacaaagatcggagcaagccgtggcccagctggaagaggagaagcagcacttgctgtttatgagtcagattaggaagtag

SEQ ID NO: 121739 - DNA, 318 bp, Artificial Sequence
  Description of Artificial Sequence: Synthetic coding sequence
atggccatgatggtgtttcctcgggaggaaaaattgtctcaggacgagatagtgctcggaactaaagctgtgattcagggcctcgaaaccctgaggggcgaacaccgcgcattgttagcgcctttggtggccccggaagccggcgaggccgaacccggaagtcaagagcgctgtatcttgctgcggaggagtctggaagccattgaactggggctgggcgaggcccaagtgatccttgctctatctagtcacttgggtgccgtcgaatctgaaaagcagaagcttcgtgcacaggtacgccgactggtgcaggaatag

SEQ ID NO: 121740 - DNA, 1515 bp, Artificial Sequence
  Description of Artificial Sequence: Synthetic coding sequence
atgtctgttcaggtcgcagcaccgggatctgccggactaggacctgaacggctgtctcccgaggaactggtcagacagacacgccaggtggttcagggcttggaggctcttagagcagaacaccacggcttagcagggcatcttgccgaagcgctggctgggcagggccctgccgctggtctggaaatgcttgaggaaaaacagcaagtagtctcacactccctagaagccattgagcttggtctgggtgaggctcaggttttgctggctttatctgcacatgttggggcattggaggccgagaagcagcggttgaggagtcaggcccgcaggctcgctcaggagaatgtgtggctgagagaggagctggaggagacacaaaggcgcctgagagcgtcggaggagtccgtcgcccagctcgaggaagagaagcgccacctggagttcctggggcaattaaggcagtatgacccccccgctgagtcccagcagtcggagtctccccctaggagagattccttagcgagtttatttccgtccgaagaggaagagaggaaggggccggaggccgctggggccgccgcagctcaacaggggggttacgaaatacctgcaaggctaagaacccttcataacttggtgatccagtacgctggacaaggacgatatgaggttgccgtacccctgtgtcgccaggccctcgaggatctcgaaaggtcgtctggacactgtcacccagacgtggctacgatgttaaatattttggctctggtataccgcgaccagaacaaatataaagaggcgactgacttgctgcatgatgccctgcagatacgcgaacagacattgggtccagagcacccagccgtggcggccactttaaacaatcttgcagtgctctacgggaaaaggggaagataccgggaagctgaaccgctgtgccagcgcgctttggaaattagagagaaagtgcttggcgctgatcaccccgatgttgctaagcagctcaataacttagcccttttgtgtcaaaatcaggggaaattcgaagatgtcgagcggcactatgctcgcgccctatcgatttatgaagcacttggcggaccccacgaccccaacgtggcgaaaacaaaaaataacctcgcgagtgcgtatctgaagcagaacaagtatcagcaagcggaagagctctataaagagattctgcacaaggaggacttgccagcacctctcggagcacccaacaccggcactgcgggcgatgccgagcaggccctgcggcggagcagcagcctgtcgaaaatccgtgagagcatccggagaggtagcgagaagctggtgagccgtcttcggggcgaggctgccgcgggcgcagctggtatgaagagagcaatgagtctgaatactctgaatgtggacgcgccaagagctccaggtacacagttcccctcgtggcacctagataaggctcctcggactttgtcagcttcgacccaggatctgagtccccactag

SEQ ID NO: 121741 - DNA, 1557 bp, Artificial Sequence
  Description of Artificial Sequence: Synthetic coding sequence
atgatcccacagacgcctcatcattgcagtcccggggcggccatgagcgttcaagtggcagccccaggcagcgctgggcttggcccagagcgactgtccccggaggagttggttcgccaaacacgtcaggtcgttcaaggactggaggcactaagagctgagcaccatgggttggctgggcacctcgcggaggcactggccggacagggcccagccgcggggctcgaaatgctggaggaaaagcagcaggtcgtgagtcactctttagaagctattgagttgggactgggtgaggctcaggtgctgcttgccctatcagctcacgtgggcgctctggaggccgagaagcagaggctgcgctcccaggcccgcagattagcacaagagaatgtgtggctacgagaagaacttgaagagacgcagcggcggttacgcgcctctgaagagtccgtggctcagctggaggaggagaaaaggcatctggagttccttggtcaactccggcagtatgacccaccagcagagagccagcagtccgagtcgccaccacggcgggactccctcgcctcactctttccgagcgaagaagaggagaggaagggacccgaggcagcaggcgccgcagctgctcagcagggagggtacgagataccagctagacttagaaccctccataacctggttattcagtacgccggccaggggaggtacgaggtggccgtcccgttgtgcagacaggcgctcgaagacctcgagagatcttctggacactgtcatccagatgtcgccaccatgcttaatattctggccctggtatatcgggatcagaataagtataaagaggcgactgacttgctccatgatgctcttcagatccgagagcagaccctaggtcctgaacaccctgcagtggctgctacccttaacaacttggctgtcctgtacgggaaacggggccgctaccgggaggcagagcctctgtgccaaagggccctggaaatccgagagaaggtcctgggcgcggatcacccagatgtcgccaagcagctcaacaacttagcactcctctgtcagaatcaaggcaagttcgaagatgtcgaacgccactatgccagagcccttagtatttacgaagcgcttggagggcctcacgacccaaacgtggctaagacgaaaaataacctagcctctgcatacttgaagcaaaacaagtatcaacaggccgaggaactgtataaggagatcttgcacaaagaggatttgcccgcccccttgggagcgccaaatacaggaacggccggtgatgccgagcaggcccttcgacgatcatcttcattatctaagattcgtgaatccattcggcgcggcagcgagaagctcgtcagtaggttacgtggagaagccgcagccggagcagcgggcatgaagcgcgccatgtctctgaataccctgaacgtggatgctccccgcgctccgggcacccagttcccctcctggcacctggacaaagcccccaggaccctctcagctagtacacaggacctttccccccactag

SEQ ID NO: 121742 - DNA, 2379 bp, Artificial Sequence
  Description of Artificial Sequence: Synthetic coding sequence
atgcaaggagaggatgcccggtatcttaagaggaaagttaaggggggaaatatcgacgttcatccttccgaaaaagctctgatcgttcactatgaagttgaggctaccatcttgggtgaaatgggcgaccctatgttgggcgagcgcaaagaatgtcagaagatcatcagattaaagtccctgaatgcgaacaccgatatcactagtcttgcccgaaaggtcgtggaagaatgtaagctgattcacccttcgaagctgaatgaagtggagcagcttttgtactacttgcagaataggagagattccctgtcaggcaaggaaaagaaagagaagtccagcaagcctaaggaccccccgccttttgaaggcatggagatagacgaggtggctaacataaacgacatggacgaatacatagagttgttgtatgaagacattccagacaaggtgcgggggagcgccctaattctgcagctggctcgcaatccggacaatctcgaggaattgctgctcaacgaaacagccctcggcgccctcgcgcgggttctccgagaggactggaagcaaagcgtggaacttgcaacgaacatcatctacatcttcttctgtttcagctccttctcccagttccatgggctcattacccactacaaaatcggcgcgctctgcatgaatataatcgaccacgaactcaaaaggcacgagctctggcaggaggaattgagtaaaaaaaagaaggccgtcgacgaggatccagagaaccagactctgaggaaagactatgaaaaaacctttaaaaagtaccaggggctggtggtcaaacaggaacagcttctgagggtggccttgtaccttttgctcaatctggctgaggatacccgtactgaactgaaaatgcggaacaaaaatatcgttcacatgctggtcaaagctttagaccgcgacaacttcgagctgctgatcttggtcgtgagcttcctcaaaaagctctcaatttttatggagaataagaatgacatggtagagatggatattgtggaaaagcttgtgaagatgattccctgcgaacacgaggacctacttaatatcacactacgcctcctgttaaatctctctttcgacacagggctcagaaataagatggtccaggtgggactgcttcccaaactgacagcgcttctgggaaatgataactacaaacagatcgccatgtgtgtgttgtaccatatttcgatggatgatcgatttaaatctatgtttgcctataccgattgcatcccgcagctgatgaagatgttgtttgagtgtagcgatgaaaggatcgacctggagcttatttcattctgtattaacctagccgccaataagaggaatgtccagctcatatgcgaggggaatggcctgaagatgctgatgaagcgggccttgaagttcaaagatccactcctaatgaagatgatccggaacatctcccagcacgatgggccaaccaagaacctattcattgattacgtgggcgacctcgcggcccagatttcaaacgacgaggaggaagagttcgtcatcgaatgcctagggacactggccaacctgaccattcccgacctagactgggaactggtcctgaaggagtataaactcgtcccttacctcaaggataagctgaaacccggggcagcagaggatgacctggtgcttgaggtcgttatcatgatcggaaccgtgagcatggatgactcgtgcgcggccttgctagccaaaagtgggattattcctgcgctaatagagctcttgaacgcacagcaagaagatgatgagttcgtgtgccaaattatctacgtattctatcagatggtattccaccaggctactcgcgacgtcatcatcaaagaaacccaggcccctgcgtatctaatcgacctgatgcacgacaaaaacaatgaaattagaaaggtgtgtgacaacaccctggacatcatagctgaatatgacgaagaatgggccaagaagattcagtccgagaagttcagatggcacaacagccagtggctggagatggtcgagtctaggcaaatggatgagtcagagcaatatctgtatggggacgacagaatagagccctacatccacgaaggagacattcttgagcgtcccgacctgttctataactccgatggacttatcgctagtgagggtgccatctccccggacttttttaatgattatcatttgcagaacggagacgtcgtcggccagcattcattcccaggatctctaggcatggacggatttggccagcccgtgggcattcttggccggccagctacagcttatggatttagaccagacgaaccatattattatggatacggatcttag

SEQ ID NO: 121743 - DNA, 2259 bp, Artificial Sequence
  Description of Artificial Sequence: Synthetic coding sequence
atgggcgatccaatgctcggggagagaaaagaatgccagaagataatccgcctcaagtcgctcaacgctaacaccgatatcacatccctcgcacggaaagtggtcgaggagtgcaagctcattcacccgagcaaactcaacgaggtggaacagctgttgtactatctccagaatcggcgagatagcctttcagggaaggagaaaaaagaaaagtcttccaaacctaaagacccaccaccattcgaggggatggagattgatgaagtagcaaatattaacgacatggacgagtatattgaacttttgtatgaggacatacctgacaaagtgcgcggtagtgctctgattctccagttggcaagaaatcccgataatctggaagaacttctgcttaatgagacggccttgggcgctcttgcccgcgttctgagagaagactggaagcaaagcgtcgagctggccacgaacattatctacatttttttctgtttctcctctttttcgcaattccacggacttatcacgcattacaagatcggagcactgtgcatgaacattatcgatcatgagcttaaacggcatgagctctggcaggaagagctgtctaaaaaaaaaaaagccgtcgatgaagatcccgaaaaccagactctacgaaaggactatgaaaaaacctttaaaaaataccaggggctcgtggtgaaacaggagcagctgttacgtgttgccttatacctcctgctaaacctggcagaggacactcgcactgagttaaagatgcgaaacaaaaatatcgttcacatgctagttaaggccttagaccgcgacaacttcgagctgctgatccttgtggtcagttttcttaaaaagcttagcatttttatggaaaataaaaatgatatggtggagatggacatcgtggagaagctcgtgaagatgattccttgcgagcacgaggacctgctgaatattacactcaggttactcctcaacctatcctttgatacgggtctgagaaataaaatggtgcaggtgggcctgctacctaagctgacagctctgctggggaatgataactataagcagatagccatgtgtgtgctatatcacatttccatggacgaccgctttaaaagtatgtttgcttatacagactgcattccccagctcatgaagatgttattcgaatgttcggacgagaggatagatttggaattaataagcttttgtatcaacctggccgctaataaaagaaatgtgcaactgatatgcgaggggaatggattgaagatgctcatgaaaagagcgctgaagtttaaggatcctttactaatgaagatgatccgcaatatttcgcagcacgatggaccaaccaagaacctcttcatcgattacgtcggagacctcgccgcacaaataagcaatgacgaggaagaggaattcgtcatcgaatgccttgggacgctcgccaatctcacaataccagaccttgactgggagctggtcctcaaagagtataaactggtcccatacctgaaagacaaactgaagcctggagcagccgaggatgatctggtgctagaggtggtgatcatgatcgggaccgtgtctatggatgactcttgtgcagcgctcctggccaagtctggaattatcccagctctaatcgagctcttaaacgcccaacaggaggatgacgaattcgtttgccagatcatctatgttttttatcaaatggtttttcaccaagccacacgggatgtgatcatcaaggaaacgcaagcgcccgcctacctcattgatctaatgcacgacaaaaataacgagattaggaaggtgtgcgataacacccttgacatcatcgctgaatatgatgaggagtgggccaaaaagattcaaagcgagaagtttagatggcacaactcccaatggctggagatggtggagtctcggcagatggatgagagcgagcagtatttgtatggggacgatcgcatagaaccgtatattcatgagggcgacatcctggaaagaccggatctgttctacaatagcgatggcctgatagccagcgaaggcgccatctccccggactttttcaatgactaccacttacagaacggtgatgttgtgggccaacactcgttcccaggaagtctggggatggatggcttcggccagcctgtgggcattctggggcgccctgccacagcctatggcttcagaccagatgaaccatattactatggttatggttcttag

SEQ ID NO: 121744 - DNA, 2247 bp, Artificial Sequence
  Description of Artificial Sequence: Synthetic coding sequence
atgcagggagaggatgccagatatttgaagagtatcaggttaaaatccctgaatgctaacacggacatcacgtctctcgcgagaaaagtggtggaagaatgcaagttaattcaccccagcaaactgaatgaggtggagcaactgctttactacctgcagaacaggagggactctctcagcggcaaggagaaaaaagaaaaaagttcaaagccaaaagacccaccacctttcgaaggcatggaaattgacgaggtcgctaatattaacgatatggatgagtacattgaactgctgtacgaggacatcccagacaaggtcaggggcagcgccctcatattgcagctggccagaaacccagataatctggaggagttactgctgaatgagacggcactcggggctctggctcgggtcctgcgcgaggattggaagcagagcgtcgagctcgcgaccaacattatctatatatttttttgtttcagcagcttctcacagtttcacggactgataacccattacaagataggggccctatgtatgaacatcattgaccatgaattaaagcgccacgagctctggcaggaggagctcagcaaaaagaagaaagcagtggatgaggaccctgaaaatcaaactttgagaaaggactacgagaagaccttcaaaaagtatcagggactcgtcgtgaagcaagagcagctgttgagggttgccctctatctgctgctgaacctggctgaggacaccaggaccgagctgaaaatgcgaaacaaaaatatcgtgcatatgctggttaaggcactcgaccgagataacttcgagctacttatcctggttgtgtcattcctgaagaaactgtccatcttcatggaaaataaaaatgacatggtagagatggacatagttgaaaagcttgtgaagatgatcccctgtgagcacgaggacctcctgaatattacactgagactgctgctgaacctgtcctttgacacaggacttaggaataagatggtccaggttggactcctgcccaagctgactgcactgttgggaaacgacaactacaaacagatagccatgtgtgtcttgtaccatatctctatggacgacagatttaaaagtatgtttgcttacacagattgtatcccccagctaatgaaaatgctgttcgagtgttcagacgagcgcatcgaccttgagttgattagcttctgcattaaccttgctgccaacaagaggaatgtgcagctgatctgcgagggaaatggcctcaagatgctcatgaagagagcacttaagttcaaggacccacttctgatgaagatgatccggaacattagccaacacgatgggccaacaaagaatctattcatagattatgtcggcgacctggctgcacaaatctccaacgatgaggaggaagaattcgtcattgagtgtctgggcactctggccaacctgactatcccagatctggattgggagctggttctcaaagagtataaactcgttccctatttaaaagataaactaaaacctggcgccgcggaagatgaccttgtacttgaagtggtgataatgataggaactgtgagcatggacgattcctgcgccgccctgctggctaaatccgggataattccggcgctgattgaactcttgaatgcgcagcaggaagatgacgaattcgtctgtcagattatatacgttttctatcaaatggtgtttcatcaagccactagagacgtcattatcaaagaaacacaggctccagcctatctgatcgacctaatgcatgataaaaataacgagatcaggaaggtgtgcgataatacactggatattatcgccgagtatgacgaggagtgggccaaaaaaatccagtccgaaaagttccggtggcacaacagtcagtggctggagatggtggaatctagacagatggatgagtcagaacagtatctctatggagacgataggatcgaaccatatatccatgaaggtgacatcctcgagcgtcctgacttattttataattcagatgggttaattgcaagtgagggcgctatatccccagacttctttaatgattaccaccttcagaacggagatgtggttggccaacacagcttccctgggtctctcgggatggatgggttcggccagcccgtgggaatcctaggacgaccggcaacggcctacggttttcgtcctgacgagccgtactattacgggtacggatcttag

SEQ ID NO: 121745 - DNA, 2145 bp, Artificial Sequence
  Description of Artificial Sequence: Synthetic coding sequence
atgtctattgccctaggcaatacataccgaagaagtctcagtgatagtgaaactgtctctgttctgcaggcgtccctgtgcgaagagaagaaggagaagagtagcaaaccaaaagaccctccgccctttgaagggatggagatagacgaagtggccaatatcaacgacatggacgagtacatagagctgctatatgaggacattcctgacaaagtgcggggtagcgcacttattctgcagctggcccgtaaccctgataacctggaagagctgctgctgaacgagacggctctaggggctctggcgagggtcctgcgtgaggattggaagcaatctgttgagttggcaacaaatatcatctacatatttttctgtttctcctcatttagccagtttcacggactgattacccactataagatcggcgcactatgcatgaacatcatagaccacgagctcaagcgacacgagctgtggcaggaagaactgtcaaagaagaagaaggctgtggatgaggacccggaaaaccagacccttcgaaaagactacgagaaaacgtttaagaagtaccagggcctggtggtcaagcaggagcagctattgagggtagccctctacctgcttctcaacctggcggaggacacccggaccgagttaaaaatgcgcaacaagaatattgtccatatgttggttaaggcactagacagggataacttcgagctgttgattcttgtcgtgtcttttctgaagaagctcagcatttttatggaaaacaagaacgatatggttgaaatggacattgtggaaaagctcgtgaagatgataccatgtgaacacgaagatttgctgaacatcactttgcgcttactgctgaacctcagtttcgatacagggttaaggaacaaaatggtgcaggtgggcctgcttccaaaactaacggcactacttggtaacgacaactataagcagatagcgatgtgtgtgttataccacatttcaatggatgacagattcaaatccatgttcgcctatactgactgtatcccacagctgatgaaaatgctgtttgagtgctctgatgagcgtatcgacctcgaattaatctccttttgtatcaatcttgccgccaacaaaaggaatgtacaattaatttgtgagggtaacggcttgaagatgctgatgaaaagggcgctcaagttcaaggatcctctgctgatgaagatgattcggaatatctcacagcacgacggacctaccaaaaacctgtttattgactatgtcggcgacctcgcagcccaaatctcaaatgacgaggaggaggagtttgtgattgaatgccttggaacgttagccaatctcacaatcccagatctggattgggagctggtcctcaaagagtataaacttgtcccttatttgaaagataaactcaagccaggtgccgccgaggacgacctcgttttagaggtagttatcatgatcggaacggtcagcatggatgactcttgtgctgcattgctggcaaagtcagggattatcccggccctgatcgagcttttaaatgcacaacaggaggacgatgaatttgtgtgccagataatttatgtgttttaccaaatggtgtttcaccaagccacccgagatgtgatcattaaggaaacacaagcgccagcctatctcatcgatctgatgcatgataagaataacgagatacggaaagtttgtgataataccttggacatcatagcagaatatgacgaggagtgggcgaaaaaaatacagtccgaaaaattcagatggcacaattctcagtggctggaaatggtggagtcgcgacagatggacgaatctgaacagtacctctatggcgacgacaggattgaaccatatattcacgaaggtgatatcttggagaggcccgacttgttttacaactctgatggtctgattgcctccgaaggggccatcagccccgactttttcaatgattaccacctacaaaatggggatgtggttggccagcactctttccctgggtcactaggcatggatggcttcggtcagcctgtcggaattctaggcagacccgctactgcttacggattccgccccgatgagccttactattatggttatgggtcctag

SEQ ID NO: 121746 - DNA, 1485 bp, Artificial Sequence
  Description of Artificial Sequence: Synthetic coding sequence
atgaggaataaaaacattgtgcacatgctcgtcaaagccttggatcgcgataattttgagcttttaatattagtggtgtcgtttcttaaaaagctttccatttttatggaaaataaaaatgatatggttgagatggacattgtggaaaagctggtgaagatgatcccgtgtgagcacgaggatttactgaatatcacactgcgtcttctgctgaacctgtcattcgacaccggcctgagaaacaagatggttcaggttggactgctgcccaaattaacagcactattggggaatgacaattacaaacagattgcaatgtgtgtgctgtaccatatatctatggacgaccgattcaaatcgatgtttgcgtataccgattgcattcctcagctcatgaaaatgctgttcgaatgctctgatgagcggatcgatctggagctcataagcttctgtataaatctcgccgcaaataaaagaaatgtgcagctgatctgtgagggaaacggtttgaagatgctaatgaagagggcgctgaaattcaaagatcccctactgatgaaaatgatccggaatatcagccagcacgacggtcccactaaaaacctttttattgattacgtaggggatctggcagcacagatctctaatgacgaggaggaagagttcgtgatcgaatgcctgggtacattggccaacctaactatccctgatctcgactgggagctcgttctcaaggagtataagcttgtgccctacctcaaggacaaactgaagcctggagcagctgaggatgacttggttctggaggttgtgatcatgattgggaccgtgtccatggacgactcatgtgcagccctgctcgccaaatccggcattatacctgctcttatcgagttactgaacgcccagcaggaagatgacgaatttgtgtgtcagataatttacgtgttctaccagatggtctttcatcaggccacaagagatgtgattattaaagaaactcaggcccctgcctacctgatcgacctgatgcatgataagaataatgaaattcgaaaagtctgtgataacacactcgatataattgcagaatacgatgaagagtgggccaaaaagattcagtccgagaaatttcgctggcataattctcaatggttggaaatggtagaatcaagacaaatggacgagtctgagcagtacttatatggggacgaccgtatcgaaccgtacatccatgaaggtgatattttagagcggccagatttgttctataactccgacggcctgatcgcctcagagggggcgatctcaccagattttttcaacgactaccacctgcagaatggggatgtggtaggtcagcatagctttcccggaagcttagggatggacggcttcggccaaccagtaggcatcctgggccgaccagcaacggcctatggatttaggccagacgagccctattactacggctacgggagctag

SEQ ID NO: 121747 - DNA, 1935 bp, Artificial Sequence
  Description of Artificial Sequence: Synthetic coding sequence
atgaagttaataactatcctgttcctgtgttcaaggctcctgctgtctttaacacaggagtctcagtcagaggaaatcgactgtaacgataaggacttgttcaaagctgttgacgcagcgctcaagaagtacaactcacaaaatcagtcaaataaccagtttgtgctgtaccggattaccgaggccactaaaactgtaggatccgacacattttactccttcaaatatgagataaaggaaggcgactgtcctgtgcaatcaggaaaaacttggcaggattgtgaatacaaggatgccgcaaaggccgctaccggcgagtgcacagccactgtcggaaaacgatcctcaaccaaattctcagttgctacacagacatgccagatcacccctgccgagggccctgttgttaccgcacagtatgattgcttgggatgcgtgcaccccatcagtactcagtccccagacctggagcccattctccgtcatggaatccaatattttaacaataacacccagcacagctctctttttatgttgaacgaagtcaagcgtgctcagcgtcaggttgttgcaggcctgaacttcaggattacgtattctatagttcagaccaattgtagtaaggagaatttcctctttctcaccccagactgcaagtccctgtggaatggggacactggcgaatgcactgacaacgcctacattgatattcagctcaggatcgcaagcttctctcagaattgtgacatttaccccggaaaagatttcgtccagccacccacaaaaatctgcgtgggttgtccgcgggacatacccaccaacagtccagaactcgaggaaacgctgacccacaccattacgaagctaaacgctgaaaacaatgctaccttttattttaagatagacaacgtaaaaaaggcccgggtccaggtggtggctggtaagaaatatttcattgacttcgtggcccgcgagactacctgttcaaaggaatcaaacgaagagcttaccgaaagctgcgaaacaaaaaagctcggtcagagcctggattgcaatgctgaagtgtacgtagtcccctgggagaagaaaatctatccaaccgtcaactgccagccgctgggcatgatctcgttaatgaagaggcccccgggtttcagcccatttcggtcctctcgtatcggggagataaaagaagagacaactgtatccccaccccatacttccatggctccagcccaagatgaggagagagactctggtaaggaacagggtcataccaggcggcacgattggggtcacgagaagcagcggaaacacaacctagggcacggccacaaacacgaacgcgaccagggacatggacatcagagagggcacggtcttgggcacggtcacgaacagcaacacggcttgggccacggacacaaattcaagcttgatgatgatctggagcatcagggtggacatgttctcgaccatggccataagcacaagcatggtcatggacatggcaagcataaaaataaaggtaaaaaaaacggtaagcataacggatggaagaccgagcacttggcgtctagctccgaggattctactacaccatccgctcaaacccaggaaaagactgagggtcccacacctatcccttctctggcgaagcctggtgtcaccgtaacattcagtgattttcaggacagtgacctgattgcgacaatgatgcccccaatatcacccgccccaattcagtctgatgatgactggattccggacatacagattgacccgaacgggctctccttcaacccaattagcgactttcctgatacgacgtcccccaaatgccctggtcgtccatggaaatcagtcagcgagattaaccccactactcagatgaaagagagctactattttgatctcacagacggattgtcctag

SEQ ID NO: 121748 - DNA, 1284 bp, Artificial Sequence
  Description of Artificial Sequence: Synthetic coding sequence
atgaaactgatcacaatactgtttttatgttctcgtttattgctgagtcttacccaggagtctcaatcggaagagatcgactgcaacgataaagatctgtttaaagcagtggatgctgccctgaaaaagtacaattctcagaatcagagcaacaatcagtttgtactgtatagaatcactgaggcaaccaaaactgtaggctccgatacgttttactcttttaaatatgagataaaagagggcgattgcccagtgcagagcggaaaaacttggcaagactgcgagtacaaagatgcagcaaaagcagcgacaggtgagtgcaccgctaccgtgggaaagcgtagtagtacaaagttcagcgtggcaacccagacatgccagatcactccagctgaaggccccgtggtgactgcccagtatgattgccttgggtgtgttcaccccatctcaacccagtccccagatctggaacctatactccgccacgggatccagtatttcaacaataatacacagcacagctctttgtttatgctgaacgaagttaagagggcacagcgacaggttgtagcggggctcaatttccggatcacatactctatcgtgcagacaaattgtagcaaagagaatttcctgtttctgaccccagactgcaagagtctgtggaacggtgataccggcgagtgtactgacaatgcctacatcgacatccaactgcgcatagcttccttcagccagaattgcgacatttatcctggcaaggacttcgtgcaacccccaaccaaaatctgcgtagggtgtcctcgggacatccccacaaattctccagagctggaggagactctgactcataccatcacaaaactgaacgccgaaaataatgctaccttctacttcaagattgataatgtgaaaaaggctagggttcaggtcgtggcaggcaagaaatacttcatcgactttgttgcgcgggaaacaacttgctccaaagagagcaatgaggagttgacagaatcctgtgaaacgaagaagctgggccagtccctggattgcaatgccgaggtgtatgtggttccatgggagaaaaagatctacccaaccgtcaactgccagcctctgggaatgatctctttaatgaaacgtccccccggcttctcccccttccgctcatctcgcataggtgagatcaaagaagagaccacttcacatctgcgtagctgtgagtataagggcagaccaccaaaagcaggcgctgagcccgcttccgagagagaggtctcatag

SEQ ID NO: 121749 - DNA, 1248 bp, Artificial Sequence
  Description of Artificial Sequence: Synthetic coding sequence
atgaagttatccctgactcaggagtctcagtctgaagagatagactgcaacgacaaggatctatttaaagcagttgacgctgccctcaaaaagtataactcacagaaccaatccaacaatcagttcgtgctttaccgcataaccgaagccacgaagacagtgggcagcgataccttctattcttttaagtatgaaatcaaagagggagactgtcccgtccagtcaggcaaaacatggcaggattgtgaatacaaagacgctgcaaaagccgcaaccggcgaatgtaccgccactgtgggcaagcgctcatccactaaatttagtgtagctacacaaacatgtcagataacacccgccgaaggtcccgtggtcaccgctcagtacgactgccttggctgtgtgcacccaatctcaacccaatcacctgacctcgaacctatactccgacacggcatacagtattttaacaataatacacagcatagtagtctgtttatgctcaatgaagtaaaaagggcccagaggcaggtggtggctggcttaaacttccgtattacttactctatcgtacagaccaactgttccaaagagaattttctattcctcacgccggattgtaaatctttgtggaatggagacacaggagaatgtacagacaacgcgtacatcgatatccaattaagaatagcctcatttagtcaaaattgcgatatctacccggggaaggacttcgtgcagcctcccacaaagatctgcgtgggctgcccccgtgatataccaactaacagtccagagcttgaggagacactgacacacactatcaccaaactaaacgccgagaacaacgctactttctacttcaagatcgataatgtcaaaaaagcccgagtgcaagtggtcgctgggaaaaagtatttcattgactttgtggcccgggaaaccacatgttccaaggaaagcaacgaagaactcaccgagtcctgcgagaccaagaaacttggacagtcattagactgcaatgctgaggtgtacgttgtcccctgggagaagaagatttatcctactgtgaactgccagcccctcggcatgatatcactcatgaagcgacccccgggcttcagtcccttcaggagctcccggatcggagaaattaaggaggaaacaactagtcacctcagatcctgcgagtataaggggcgtccaccgaaagctggcgcagagcccgcgtccgaacgtgaagtatcctag

SEQ ID NO: 121750 - DNA, 1176 bp, Artificial Sequence
  Description of Artificial Sequence: Synthetic coding sequence
atgaagctgattacaatattgtttctgtgctcacgcttactcctgtcactcactcaagaaagccagtctgaagaaattgactgtaacgataaggacctctttaaagccgtggatgcagctctgaagaagtataactcgcagaatcagtcaaataaccagttcgtgctatatcgcatcaccgaagccacaaaaaccgttggttccgatactttctatagttttaagtacgagatcaaggagggggactgcccagttcagtccggaaagacttggcaggactgtgagtacaaggatgcagccaaggccgctactggggagtgtaccgccacagttggtaaacgtagctctacaaagttctcagtcgcaacacagacttgtcagattactcccgcagagggacctgtggtcacggcacaatatgactgtctgggatgcgtgcacccaatctcgacgcagtctcctgacctcgagcctatccttaggcacgggatccaatacttcaataacaatacacaacattcctctctgttcatgctgaatgaggttaaaagggcccaacgccaggataccggagaatgtactgacaatgcttatatagacattcagctgcgcattgctagtttcagccagaactgcgatatttacccgggaaaagactttgtgcagcctcctactaaaatatgcgtagggtgtccccgcgatattcccactaacagtccagagctggaagagaccctgacccacacgattactaagttgaacgccgagaacaatgcaaccttttactttaaaatcgataatgttaaaaaggcacgtgtgcaggttgtagcgggcaaaaaatacttcatcgacttcgtggcacgagagactacgtgttctaaagagagcaatgaagagctaacggagagctgtgagaccaagaagttaggccagagtctggattgtaatgcagaggtttacgtggtgccctgggagaagaagatctatccaacggtgaactgccagccattggggatgatctctttaatgaagcgcccccccggcttcagtccgttcaggagtagcagaattggggagatcaaggaagaaacaacctcccacctgagatcatgcgagtataagggtaggccacctaaagcaggtgcggagcctgcctctgagcgagaggtatcctag

SEQ ID NO: 121751 - DNA, 306 bp, Artificial Sequence
  Description of Artificial Sequence: Synthetic coding sequence
atggacatcccaatttcatccagagattttagaggcctccagcttgcctgcgtggccttggggctggtggccggcagtattatcattggtatctctgttagtaaggccgcggctgcgatggggggggtcttcataggcgctgccgtgcttggaagtttacgcatccacccacacccaggagcagatcacggggagggtaggtcctccacaaacgggaataaggaaggcgcaagatctagcctgtccacagtgagccggacattggagaaattgaagccagggactaggggggcagaggagtgctag

SEQ ID NO: 121752 - DNA, 375 bp, Artificial Sequence
  Description of Artificial Sequence: Synthetic coding sequence
atggatatccccatatctagccgcgacttcaggggcctgcagcttgcctgcgtagcactgggcctggtggcaggcagcattattatcggaatctcagtgtctaaggccgccgcagctatgggaggggtttttattggtgctgccgtgttaggactgttaatcctcgcatatcctttccttaaggcccggttcaacttggaccatatacttcctacgatcggatctctgcggatacacccacatcccggcgcagatcatggcgagggccggagttctacaaacgggaataaggagggtgctcgctcatctctgtctactgtgtcacgcaccctggaaaagctcaaacccggcacccggggggctgaggaatgctag

SEQ ID NO: 121753 - DNA, 3135 bp, Artificial Sequence
  Description of Artificial Sequence: Synthetic coding sequence
atgaagcctggctgcgcagccggctctcccggtaacgaatggatcttcttctctacggatgaaataactactagatatcggaacaccatgtcgaatggcggactacagcgctcggtcattctcagtgccttaattctgttaagagctgtgaccggttttagtggggacgggcgggccatatggtccaagaatcccaacttcacacctgttaatgagtcccagttgtttctttacgacactttcccgaagaacttcttctggggtatcgggaccggcgccctgcaagtcgagggaagctggaaaaaagacgggaagggaccaagcatttgggaccactttatccacacgcatctgaagaatgtcagctccacgaacgggtcgagcgacagttacatttttctcgagaaggatctgagcgctctggactttattggcgtctctttctaccagttttcgattagctggcctcgcctttttcccgatggtatcgttaccgtcgctaacgctaaaggattacaatactactcaacactgctggatgccctggtcctaaggaacatcgagcccatcgtgaccttgtaccactgggacctgccccttgcccttcaggaaaagtacggtgggtggaagaacgacacgattattgacatattcaacgactacgcaacttactgctttcagatgttcggtgatcgggttaagtactggatcacaattcataatccttacctggtggcctggcacggatacggaactggcatgcacgccccaggagagaagggcaaccttgccgcggtgtacaccgtaggccataacttgatcaaggcccacagcaaggtgtggcacaactacaacacccactttcgcccccaccagaaggggtggttaagtattactctgggaagtcattggatagagccgaaccgaagtgaaaacactatggacatattcaagtgccagcagtctatggttagcgttctagggtggttcgcaaacccgattcatggggatggagattaccccgaaggtatgcggaagaaattgttctccgttctgccaatcttctctgaggctgaaaaacatgagatgaggggcaccgctgatttttttgcattttccttcggaccaaataactttaagcccctgaataccatggctaaaatgggtcagaacgtgtctcttaacctgcgcgaggcactgaactggattaaactagagtataacaacccacggatccttatcgcagagaatgggtggtttactgatagccgcgttaaaacagaggatactacggccatctacatgatgaagaactttctgtcacaggtactgcaggccatacgtctggacgaaattagggtctttggatacaccgcctggtctctgctggacggattcgagtggcaggatgcctacactatcaggcgtggattattttacgtcgacttcaacagcaagcaaaaagagagaaaacctaaatcctcagcccactattacaagcaaattattcgcgaaaacggattctctctcaaagaatctacgcccgacgtccagggacagtttccctgcgattttagctggggagtcaccgaaagcgtgctgaaaccagagagcgtggcctcatcccctcagttcagtgatccccacctgtatgtctggaacgctaccggtaaccggctgctgcatagggttgaaggggttcgtctaaagacccggccagcccaatgcacagacttcgttaatattaaaaaacagctggaaatgttagccaggatgaaagtgacccactataggttcgctttggactgggctagcgtgctccctaccggcaacctgtcagctgttaaccgacaggcactgcgatactatcggtgcgtggtctctgaagggcttaaactgggcatttcggcaatggtgacgttgtactatcccacccacgcccacctcggcctacctgaaccccttttgcatgcagacggctggctgaacccaagtacagccgaagcttttcaagcatatgccggcctgtgtttccaggaattgggcgatctggtcaagctatggattaccatcaatgagcctaaccgactgagcgacatatacaatcgctctgggaacgatacatacggcgcagcccacaatctgctcgttgcccatgctctggcttggcgcctttatgacagacagttccggcccagccagagaggggccgtctcactgtctttacatgctgactgggctgagcccgccaatccctacgccgatagccattggagagcggcagaacggtttctacaattcgaaatcgcctggttcgcggagcctctgtttaagacgggcgattaccccgccgcaatgagggagtatatcgcctcgaaacatcgccgtggtctgagcagctccgcccttccccgcctgactgaggccgagcgtcgcctgcttaagggcactgtggatttctgcgctctgaatcatttcactacccgctttgtgatgcacgagcagctggcgggctcccggtacgatagtgatagagatatccagttcctccaagacattacccgcctgagcagccccactcgtcttgccgtgattccttggggcgtcagaaaactgttacgctgggtgcggagaaattatggcgatatggacatctatattacggccagcggaatcgatgatcaggcacttgaggatgataggctgagaaagtactatctgggcaagtacctccaggaggtgctaaaggcttatctgattgataaggttcgcatcaaaggatattacgcgtttaaattggccgaggaaaagtcaaagccacgttttggattcttcacctccgactttaaagccaaatcctccatccagttttataacaaagttatttccagccgggggttcccattcgagaacagctctagccggtgctcccagacacaggaaaacactgaatgcacagtgtgtctgtttttggtgcagaaaaagcctctgatattccttgggtgctgctttttcagcaccttggtcctgctgctttccatagcaatatttcaacgccagaagcgaaggaagttttggaaagccaagaatttacagcatatccccctgaagaagggaaagcgggtcgtcagctag

SEQ ID NO: 121754 - DNA, 1389 bp, Artificial Sequence
  Description of Artificial Sequence: Synthetic coding sequence
atgggcactcaggctttgcaggggttcctgtttcttctgtttcttccactgttacagccgcggggtgcctctgccggctccctgcactctccaggcttgtccgaatgttttcaggttaacggagctgactaccgcggccaccagaacaggactggtccacgcggtgctggccgaccctgtttgttctgggaccagacacaacaacattcctactcttccgctagcgacccccacggtagatggggcctcggtgctcacaatttttgccgcaatcccgacggagatgtgcagccttggtgttacgtggccgagactgaggaagggatttattggcgctactgtgacatccccagttgccatatgccaggctacttgggatgtttcgtggactcaggtgcgcctcctgccttaagcgggccctctggaacctcaactaaattaacagtccaggtatgccttaggttctgtcggatgaaaggctaccagctcgccggggtggaggccggatatgcgtgcttctgcggtagtgagtccgacttagcccgcggccgcctggctccagccaccgactgcgaccagatctgtttcgggcaccccggccaattatgcggcggggacggccgcctgggggtttatgaggtatccgttgggagctgccaggggaattggactgcgccacagggcgtaatctactctcctgattttccggatgaatatgggcctgaccggaattgcagctgggcactgggcccgcccggagccgccctagaactcacctttagacttttcgaactggctgaccccagagaccgccttgaactgcgagatgctgcctctggcagtctgctccgtgctttcgacggcgctagaccgcctcctagtggccctctgaggctgggcacagcggccctgcttctgacgttccggagtgatgctcgtggacacgctcaaggtttcgcactcacctatagagggttgcaagacgcagccgaggaccccgaggcccctgaagggtccgcgcagacccctgcggcgcccctggatggcgccaacgtgtcctgcagtcctagacctggcgcacctcccgccgcaatcggcgccagggtcttctccacagtgaccgctgtctcagtgttattgctgctgctcctaggactcctgcggccactgcgaaggaggtcttgtttgctggctcccgggaagggccctcccgctctgggcgcatcgcgcgggccaagacgcagttgggccgtgtggtatcaacagcccaggggtgtggcacttccatgttcccctggagatcctcaggcagagggttctgctgctggctatcggcctttatcggcctcctcacagtcctcactcagaagcctgatctctgccctctag

SEQ ID NO: 121755 - DNA, 1263 bp, Artificial Sequence
  Description of Artificial Sequence: Synthetic coding sequence
atgggcactcaggcactgcagggcttcctttttctcctgttcttgcctctgttacagcccagaggggcttccgcaggctctctccatagtcctgggctgagcgaatgcttccaggtaaatggagctgattataggggccaccagaaccgaactgggccaaggggcgctggtcgcccctgcttgttttgggaccaaactcagcagcacagctacagctctgcctccgatcctcatggtcgctggggactgggagcccacaatttctgtagaaatccagatggggacgtgcaaccctggtgttacgtggcggagacagaggagggcatttattggaggtattgcgacattccatcctgccatatgccaggatatctgggctgttttgtagactccggagctccccccgccttgtcaggcccaagtggcacttccactaaattgactgtgcaggtgtgcttgcgcttttgtcggatgaaaggctaccagttagctggcgtggaggcaggctatgcctgcttctgtggcagcgagtccgatcttgcaaggggacggctagcgccagctacagattgtgaccaaatctgctttggacaccccggtcagctttgcggaggggacgggcgcctcggggtgtatgaggtttctgtcggaagctgtcagggcaactggacagcaccccagggagtgatctatagcccagactttcccgatgaatacggccctgacaggaactgctcatgggctcttggccccccaggggccgcactcgagttgaccttcagactctttgagctagctgatcctcgcgatagactggaactcagagatgccgcctccggatctctgctgagggcatttgatggcgcccgcccacccccatcagggcccctccggctcggtactgccgccttgctgctgaccttccggagtgatgcacggggccatgcacaaggtttcgctttaacttaccgcgggctccaggacgccgccgaggacccagaagccccagaagggagtgcccaaactcccgccgctcctctggacggtgctaatgtcagctgcagccccagacctggggcccctccagcggctataggaggagcagtttgttggctgagggagaagggccctaggcgctgggggcttcccggtgcgccaggtgaagctggattgtgcgggactaattctcctgaaggttggccatgcccggccccaccagggacaccacggctaagggtgctcccgagggccacagggttatag

SEQ ID NO: 121756 - DNA, 1272 bp, Artificial Sequence
  Description of Artificial Sequence: Synthetic coding sequence
atgggaacgcaggccctccagggtttcttatttttactgtttcttccgctgttacaacctcgtggtgcctctgcggggtccctgcattcgccaggactctctgagtgcttccaggtgaacggcgccgattatcggggccaccagaacaggacaggaccacggggcgcaggcaggccatgcctgttttgggaccagactcagcagcattcttatagctctgctagcgacccccatgggagatggggccttggagcccacaatttttgtagaaatcctgacggggacgtgcagccatggtgctacgtcgcagagactgaagagggcatttactggaggtattgtgacatcccaagctgtcacatgcctggatatcttgggtgcttcgtggattccggagcaccaccggctctcagcggaccatccggcacatcgacaaaattaaccgtgcaggtatgtttaaggttttgtcgcatgaagggttaccaactgtgtggtggagatggcagactgggcgtgtacgaagtgagcgtggggtcctgtcagggaaactggacagcgccacagggagtcatatactccccagatttcccagacgaatacgggcccgaccgtaattgttcctgggccctggggccacccggggccgccctcgagctgacatttcgcttgttcgagttagccgaccctcgtgatcgcctggagttgagagacgccgctagtgggtccctgctcagagcctttgatggtgctcggccaccaccgtccgggccattgagactcggtacagctgccctgctcctgacctttcgatctgacgctagaggccatgcccagggattcgctctgacatatcgcggactccaggatgccgccgaagatccggaagcacctgaaggatctgcccagacccccgccgctccgttagacggcgccaacgtatcctgttcaccaagaccaggtgcgccaccagcagccattggcgcccgcgtattctccaccgtcactgccgtttctgtgctattactcctcctcctcgggctcttgaggcctctccgacggcggtcatgcctcctggcaccagggaaggggcctcccgccctgggcgcatcacgggggccccgcaggagctgggcagtctggtatcagcagccccggggcgtagctctgccgtgcagcccgggcgatccacaggcagagggctcagcagctggatatcgccctctatctgcaagctctcagagtagcctgaggagcctgatttcagcgctgtag

SEQ ID NO: 121757 - DNA, 1146 bp, Artificial Sequence
  Description of Artificial Sequence: Synthetic coding sequence
atgggtacccaggctctgcagggcttcctatttttactgtttttgccccttctccagcctagaggggcctccgctggtagcctgcatagtcctgggctctccgagtgcttccaggtcaacggggcagactaccgtgggcaccaaaatagaaccggccccagaggtgccgggaggccttgcctgttctgggatcaaacgcagcagcattcctactcaagcgcttcagatccacacggacgttggggcctgggtgcacacaacttttgcaggaaccccgatggggacgtgcagccttggtgctatgtagccgagacggaggaaggcatctattggcggtactgtgatattcccagctgccacatgcccggctacttgggatgttttgtggactctggcgctcctcccgcattgtcggggccttcaggtacctctaccaagctcactgtgcaagtgtgcctgaggttctgcagaatgaaaggttaccaactgtgcggcggcgatggtaggctaggcgtctacgaggtgtccgtgggcagctgtcaggggaactggacagcccctcagggcgtgatctattcgcccgattttccagatgaatatgggccggaccggaattgttcttgggcacttggacccccaggggccgccctggagctcacttttcgattgttcgagctcgcggaccctcgtgacagactggaattgcgggatgcggcgagcgggagcctgctgcgtgcctttgacggagcccggccgccgccgagcgggccgctccggttgggaaccgctgccttattgttaacttttcgctcagacgccagaggtcatgcccagggattcgcacttacgtatcgggggttgcaggatgctgcagaggacccagaggcccctgaaggtagtgcccagacccccgctgccccattagatggagcaaacgtttcatgctcacctagacccggagctcccccagccgctattggtggagcagtgtgctggttgcgggagaaaggacctcgccgctggggcctgcctggcgccccaggtgaggcggggctgtgcggcaccaactcgcctgagggctggccctgccctgcccctcctggaacgccccgccttagggtgctccccagggccacaggcctgtag

SEQ ID NO: 121758 - DNA, 2211 bp, Artificial Sequence
  Description of Artificial Sequence: Synthetic coding sequence
atggggaaccctgaaaacattgaggacgcatacgtggctgtcatccggcctaaaaacactgcctccttaaatagccgcgaatatcgtgccaaatcctatgagattctcctccatgaagtgccgattgaaggccagaagaagaagcgtaaaaaagtcctcctcgagactaagctccaggggaattccgagatcacacaagggatcctggactatgtcgtcgaaactactaaacccatctcgcccgccaatcagggaattcgagggaaaagagtagtcctcatgaagaaattccccctggatggcgaaaaaatgggacgggaggcgagcttgtttatcgtgcccagcgtcgtcaaggacaacacgaaatacacgtacacgcctggttgccccatcttttattgtctccaagatataatgagggtgtgttccgagtcctctacccacttcgcgaccctgacagcgaggatgttaattgctctggataaatggctggacgaacgccatgcacagtcacacttcatcccagctctgttccgcccctctcctttagagcggattaagactaacgttattaatcctgcatatgcaacagagagtggacaaacagaaaatagtctacacatgggatactccgccctcgagattaaatctaagatgttagcactcgaaaaagccgacacatgcatctacaatcccctgtttggttcagatctgcagtacaccaatagggtggataaggtggtaatcaatccatactttggcctgggggctcctgattactccaaaatccagatccctaaacaggagaagtggcagcggtccatgtcttcagttaccgaagataaagagagacaatgggttgacgactttccccttcatcgatcagcttgcgaaggagattctgaactgctgagcagactcttgagcgagcgtttctcagtgaatcagctcgactccgatcactgggctcctatacactacgcatgttggtacggcaaggtcgaggcaacgaggattttactggaaaaagggaagtgcaatcccaaccttctgaacggccagctgagctcaccactccacttcgccgcaggaggcggtcacgctgagattgtgcaaattctattgaatcatccggagacggatcggcacatcaccgatcaacaaggaagaagcccactgaacatctgcgaagagaacaaacagaacaactgggaagaggccgcaaaactgctgaaggaggcgatcaacaaaccgtacgagaaagttcgaatctatcgcatggacgggtcttaccgctccgtcgagttgaaacatggtaacaatacaacagtgcagcaaatcatggagggcatgcgacttagtcaagaaacccaacagtatttcactatttggatctgttcggaaaatttatctctccaactcaaaccataccacaaaccattacagcacgtgcgagactggccggaaattttggcagagctcacgaatctggatcctcagagagaaacccctcagctattcctcagaagggacgtccggctccctttggaggtcgaaaaacagatcgaagatccattagcgattctgatcctgttcgacgaggctcgttataatctcctgaagggcttttataccgccccagacgccaaattaatcacacttgcatcgctcctgctccagatcgtgtacggaaactatgagtcgaagaagcataagcaggggtttctgaacgaggagaatctcaagagcatcgtccccgtgaccaagctgaagtccaaggctccacactggacaaatcgaatcttacacgaatataagaacttatcaacatcggaaggcgtcagcaaggaaatgcaccaccttcaaaggatgttcctgcagaactgctgggagatccccacttacggcgcagctttctttacagggcagatctttaccaaggcgtctcctagtaaccacaaggtgatcccggtatatgtgggcgttaatatcaaagggctgcacttgctgaacatggagacgaaggccctgcttatttcgttgaagtatggatgcttcatgtggcaacttggggatacagatacatgcttccaaatccacagcatggagaataagatgagttttatagtccacactaagcaagctggactggtcgtgaaattgttgatgaagctcaatggccagctcatgcctacggaacggaattcgtag

SEQ ID NO: 121759 - DNA, 3624 bp, Artificial Sequence
  Description of Artificial Sequence: Synthetic coding sequence
atggaccttcatatgatgaactgcgagctgctggctacatgctccgcacttggatatttggagggcgatacttaccacaaagagccggattgcttggagagcgtgaaggacctcatccgctatcttcgccacgaggatgaaactcgcgacgtgaggcaacagcttggtgccgctcaaatcttacagtctgacttgttgccgatcctaacacagcatcatcaagataaacccctgtttgatgcagtcattaggttgatggtgaacctaacacagcctgccctgctctgcttcggcaacctccccaaagagccctctttcagacatcatttcctccaggtcctgacttacctccaagcatataaggaagcatttgcctccgagaaggccttcggagtcctcagcgagacgctgtacgaactactccagcttggatgggaagaaaggcaggaggaagacaatctgctcattgaaagaatcctgctgctcgtgagaaacattttacacgtcccggccgatctagaccaggagaagattgacgacgatgccagcgctcacgaccaactgttatgggcaattcacctctctggcctggatgacctgttactgtttctcgcatccagttctgccgaggagcagtggagtctccatgtgctcgagattgtgagtctgatgttccgcgatcagaatcccgaacagctcgccggcgtcggtcaggggcgcctcgcacaagaacgcagcgccgattttgcagagctggaggttctccggcagcgcgagatggccgaaaagaaaacacgggcgctgcagaggggaaatagacacagtagatttggaggaagctacattgtacagggcttgaaatcaattggcgagagagacctgatctttcataaagggctgcacaatctgcgaaattactcaagtgatctggggaagcagcccaaaaaagtcccaaagcggcgacaggccgcccgagaattatcgatacagcgtcgttctgcattgaatgttcgattattcctccgcgatttttgcagcgagtttttggagaattgttataaccgactcatgggatcagtgaaggatcatctgctgagggagaaggcccagcaacacgacgagacatattatatgtgggccctggccttctttatggcgtttaaccgtgccgcttcatttagaccgggcctagtctctgaaacactgagtgtcagaaccttccactttattgagcagaacctcacaaattattacgaaatgatgctgactgatcgaaaggaggccgcgtcgtgggccaggagaatgcacctagctctcaaagcttatcaggagctccttgcaaccgttaatgaaatggatattagtccagatgaagcagtgagagagtcctcaaggataatcaaaaacaacattttctacgtaatggagtacagagagctattcctggcactgtttagaaaattcgacgagagatgccagccacgctctttcctgagggacctagtggagacaacccatctatttctgaagatgctggaaagattttgtcgatcgcggggcaatctagtggtgcagaacaagcagaaaaagcgcaggaagaaaaagaagaaagtgctcgatcaggccattgtgtctggcaacgtgcctagctccccagaggaggtcgaggcagtgtggccagctctggcagaacaactccaatgctgcgctcagaatagcgagttgagcatggacagcgtcgtcccctttgatgcggccagcgaagttccggtggaggagcagcgcgccgaagcaatggtccgcatccaggattgtctgctcgccgggcaggcacctcaagcccttactctgctgaggtctgcgcgagaagtgtggccggaaggagacgtgtttgggtcacaggacatcagcccagaagaggaaattcaactgctcaaacagattttgtccgctcccctgccacgacagcagggtccggaggaaagaggggctgaggaggaagaggaggaggaagaagaagaggaagaagaactccaagtggtgcaggtttctgagaaggaattcaactttctggactatctgaagaggttcgcttgtagcaccgtggtccgagcatacgtgcttctcctacgttcctatcagcagaattccgcccacacaaaccactgtatcgtcaagatgctacatagactggctcacgaccttaaaatggaggcactgctgtttcagctgtctgtcttctgtctgtttaaccgactgctgtccgaccccgccgcaggtgcatacaaagagttagtaacatttgcaaagtatatcctggggaaattctttgcgcttgctgcagtgaatcagaaagcgttcgtggaactgctcttttggaagaataccgcggtggtccgggagatgaccgagggctacggctccctggacgacagaagtagctctcgccgcgccccaacttggtcccctgaggaagaggctcatctgagagaactctacttagctaacaaagatgttgagggccaggacgtcgtcgaggccatcctggcccacctgaatacagtgccacgaacccgcaagcagattatccatcaccttgttcagatgggactggcagattccgtgaaggacttccagcggaagggtacacacattgtgctgtggacaggagatcaggagcttgagttacagcgcctcttcgaggagttccgtgacagcgacgacgtcttgggtcacattatgaagaacatcacagccaagcgctctagggccagaattgtggacaagctcctcgcacttggtctcgtcgcagagcgcagggaactttataagaaacgccagaaaaaattggcaagctcaatactccccaatggagctgagagcctgaaagatttctgtcaagaagacctggaggaagaggaaaacttaccagaggaagactcagaggaagaggaggaaggcggctctgaagccgaacaagttcagggaagcctcgtcttgagcaacgaaaacctcggacagtctcttcaccaagagggcttcagtattcctttactgtggctgcaaaactgcctaatcagggccgcagacgaccgcgaagaggatgggtgtagccaagctgtacctttggttccactgactgaggaaaatgaagaagccatggagaatgagcagttccagcagctgctccggaagctgggggtcaggccaccggcgtctgggcaggaaaccttttggagaattcctgcaaaactcagtcccactcaattacgcagagccgccgcgagtctctcccagcctgaggaagaacaaaagctacagcccgaactccaaccaaaagttcccggggaacagggaagtgacgaagagcattgcaaagagcaccgggcgcaggccctgcgcgctctgctcctggcccataagaaaaaagctggactggctagtccagaagaagaggatgcagtgggaaaggagcccctcaaggcagcaccaaagaaacggcagctcctggatagcgatgaagagcaggaggaggatgagggccgcaatagagctccagagttgggagccccagggattcagaaaaagaagcgataccagattgaggatgacgaggacgattag

SEQ ID NO: 121760 - DNA, 1539 bp, Artificial Sequence
  Description of Artificial Sequence: Synthetic coding sequence
atgcacaccccagatttcgcgggccccgatgacgccagagcagtcgatataatggatatttgtgagtctatccttgagcgcaagagacacgactcagaacgttctacatgtagcattctagaacagaccgacatggaggcagttgaagccctcgtctgcatgtccagctggggccagcgctcccaaaagggcgacttgctgaggattcgcccgcttactcctgtgtctgattccggcgatgtgaccaccaccgtccatatggacgcagccaccccagagctacccaaagattttcatagcttgagcacactgtgcatcacaccaccacaatcaccagacttggtggagccttctacacggacccccgtatcaccgcaagtgactgactccaaggcctgtaccgcgacagacgtcctacagagcagtgcagtggttgctcgggctctctctgggggagcagaacggggattgctcggcctggaacccgtgcctagttcaccttgcagagccaaaggcaccagtgtgattcgccataccggagagtctcctgccgcctgcttccccacaattcagacacccgattgtaggctctcagatagtcgcgaaggggaggagcagcttctgggacattttgagacactacaagatacgcacctgactgactccctgctgtccactaatctggtcagctgccagccttgcctccacaagtcaggaggcctgctgctgacggataagggacagcaggctggctggccaggggccgtgcagacctgctcccctaagaactatgagaacgatcttccaagaaagacgaccccacttatttccgtgagcgtgcccgcaccacctgtcctatgccagatgatccctgtcactggccagagcagcatgctccccgcattcttaaagccgcctccacaactgtcagttggaactgtgcgccccatcctggctcaggccgccccggctccacagccagtatttgttggcccagcagtcccccagggggcagtcatgctggttcttccccagggggcgctacctcctccggcaccgtgcgcagctaacgtcatggccgccgggaacactaaactgcttccacttgccccagctccagtattcattacctcttcgcagaattgtgtgccccaggtggacttctctcgccgtcggaactatgtgtgctcttttcctggatgtcgcaagacctattttaaaagttcacatctaaaggcacacctgaggactcacacaggcgagaaacccttcaactgtagctgggatgggtgtgacaaaaaattcgcacgcagcgatgaactaagccgacatcgcaggacccacacgggggagaaaaagtttgtttgtccagtctgtgatagaaggtttatgaggagtgaccacttgacaaaacatgccagaaggcacatgacgacaaaaaaaatccctggatggcaagctgaggtcggaaagcttaaccgcattgcctccgctgagagcccaggcagtccgttggtaagcatgccggccagtgcctag

SEQ ID NO: 121761 - DNA, 1488 bp, Artificial Sequence
  Description of Artificial Sequence: Synthetic coding sequence
atggatatttgtgagagcatcttggagcgtaaacgtcacgacagtgaacggtctacatgttctatattggaacagaccgacatggaggctgttgaagctttggtgtgcatgagctcttggggtcagaggagccaaaagggcgacctccttcggatccgtccgctcacgcccgtttctgattctggcgatgtcacaactactgtgcacatggacgctgcgaccccggaattgcccaaagatttccatagcctcagtacactttgcatcacacccccccaatcccctgatctggtcgagccatccactcgcacccctgtgagcccacaggttactgattctaaggcctgcactgctacggacgtgctccaaagttctgctgttgtggcacgagcgctttcaggcggcgccgaacggggattactgggactggagccagtgccctcttccccatgccgtgccaagggaaccagtgtgatcaggcatactggcgagagccctgctgcttgttttcctacaattcagacacccgactgtaggctgtccgactctcgcgagggcgaggagcagcttctagggcactttgagaccttgcaggatacgcacctgacagactcactattgagtacgaatctcgtatcctgccagccatgccttcacaaaagtgggggtctcctgctgaccgacaagggacaacaagccgggtggccgggggcagtacaaacatgttccccaaagaactatgagaacgacttgcctcggaaaacaacacccttaatttcagtatccgtgcctgccccacctgtgctgtgtcagatgattcctgtaacaggtcaatctagtatgctgccagccttcttaaaacctcctccacagctgtcagtcggtacagtccgacccattctcgcacaggcagcccccgccccgcaacctgtgtttgtcggaccagcggtaccccagggtgccgtcatgttagtacttcctcagggagccctgccaccccctgctccatgcgcggcaaatgtgatggctgccgggaacacaaagctcctgccactagcgcccgctccagttttcattacatcctctcagaactgtgtcccgcaggtggacttctcccggagacgcaattatgtctgcagctttcccggctgtcgcaagacgtattttaaatctagccacctgaaagcacacctgaggacccatacaggcgaaaagccctttaactgctcatgggacgggtgcgacaagaagtttgctcggtcagacgagctcagcagacaccgcaggacacacaccggggagaaaaaattcgtgtgccccgtttgtgaccgccgattcatgagaagcgaccacctcacaaagcacgctcggaggcacatgacgacaaaaaaaatccccggctggcaagctgaggttggaaagctgaatcgaatcgccagcgccgagtcacccggatcccctctcgtgagcatgcccgccagtgcctag

SEQ ID NO: 121762 - DNA, 1488 bp, Artificial Sequence
  Description of Artificial Sequence: Synthetic coding sequence
atggatatttgtgaatcaatcctggaaagaaagcggcatgattctgaacgatcaacatgtagcattcttgagcagacagatatggaagccgtggaggccctggtgtgcatgagttcttgggggcagagatcacagaagggtgacctgctccgcattcggccccttacgcctgttagcgacagtggggacgtcacaactaccgtccacatggatgccgcaactccagaattgccaaaggattttcatagcctctccacactgtgtatcacgccgccccagagtccagacctagtggaaccctccacacgcacacctgtgtccccccaggttaccgacagcaaggcttgcacagctactgatgtcctgcagtcttccgccgtggttgccagagctcttagcggcggcgccgagagaggcctgttgggcctcgagcctgtgcccagttcaccttgccgtgctaaaggaacctcggtcattcgccatactggcgaaagccctgcggcatgttttcccacaattcagacccctgactgtagattatcagactcccgcgaaggagaagagcagctcctgggccattttgaaacccttcaggacacgcaccttactgactcactcctctcaaccaacctggtctcttgccagccctgcctgcacaagtcaggcggcttgctcctcaccgacaaggggcagcaagcgggatggcctggtgccgtgcagacctgctcccccaagaattacgagaacgacctaccgaggaaaactaccccgctgataagtgtcagcgttcccgccccccctgtgctctgtcagatgatccctgtgacaggccaatccagtatgctccccgcctttctgaaacctcctcctcaactatcggtgggcactgtacgaccaatacttgcacaggccgctcccgccccacaacctgtgtttgttggccctgcggtaccacagggagccgtaatgctcgtcctcccccaaggggccttaccaccccccgctccatgtgctgctaacgtcatggccgctggaaacaccaaactcctaccgttagcccctgctcctgtttttataaccagttctcagaactgtgtccctcaggtcgacttttctcgtaggagaaactatgtgtgttcattcccaggctgcagaaagacctattttaaatctagtcacctgaaagcccacctgcgcactcataccggcgagaaaccattcaattgctcctgggacggttgcgataagaagttcgcaagatccgacgagctgagccggcatcggagaactcacaccggggaaaagaaatttgtctgtccagtgtgcgatcggcgatttatgcgttcagaccatctgactaaacatgcacgtaggcatatgacaaccaagaagatccccggctggcaggccgaggttgggaagttgaacaggatcgcctcagccgaatcacctggatctcctttagtgtcaatgccggcctcagcgtag

SEQ ID NO: 121763 - DNA, 1209 bp, Artificial Sequence
  Description of Artificial Sequence: Synthetic coding sequence
atttcggttcaccttatgcggaagcacgtgaagaatattaatactttcgaaaacagaatgctgatgctggacgggatgcccgcagttagggtgaagacggagcttctggagagtgagcagggttcaccgaacgtgcataactacccagacatggaggctgtccccctgctacttaataacgtcaaaggagagccacctgaagattctctttcggttgatcattttcagacccaaaccgagcccgtggacctgagcatcaataaggctcggacctcccccacggccgttagctcctcacccgtcagtatgacagcgtctgcctctagcccaagcagtacttccacttcttcatctagctcatcgcgacttgcgagctctcctactgtcatcaccagtgtctcctccgcctcctcgtcatctactgtactgacccccgggccgctggtggcttcagcgagtggggtgggcggccagcagttccttcatataatacatcccgtgccgcctagcagcccaatgaatcttcaaagtaataaattgagccatgtccatagaatccctgtagtcgttcagtccgtaccagtggtctataccgctgtgagatccccgggcaatgtgaacaatacaattgtcgtcccactcctggaagacggacgcggccacggtaaggcccagatggacccgcgcggcttgagtccccgccagtccaagtcagactccgatgatgacgatttacctaacgtaactctggattcagtgaatgagacgggttcgaccgccctcagtatagctcgtgcggtgcaggaggtccatccatcccccgtgtccagggtccggggcaatagaatgaataatcagaagttcccctgtagcatttccccattctctattgagagcaccaggcggcagcgtcgctccgaatctccagacagccggaagcgacgtatacacagatgcgatttcgagggctgtaacaaggtttacaccaagtcctcacacctgaaggcacaccggcggacccacacgggcgagaagccctacaagtgcacgtgggaagggtgtacgtggaagtttgcccgcagcgacgagttgacaaggcactatcggaaacacacaggggtgaagccctttaagtgtgccgactgtgatcggtcattctcacgctcagaccatctggcattacacaggagacgccacatgcttgtgtag

SEQ ID NO: 121764 - DNA, 1209 bp, Artificial Sequence
  Description of Artificial Sequence: Synthetic coding sequence
atgaacatacatatgaagaggaagacgattaagaacattaatacattcgaaaaccgaatgttaatgttggatggaatgcctgcggttcgcgtgaagacagagctgctagaaagcgagcaggggagccctaacgtgcataactatccagatatggaagccgtccccttactgttgaataatgtaaagggggagcctccagaagattctctgtcagttgatcactttcagacccagactgaaccagtagacctttccataaataaagcgaggacctcccccactgccgtgtcctccagcccggtctctatgaccgcatctgccagcagcccttcgtccaccagtacctcaagctcatcctccagccgactagcctcatcgcctacagtaataacaagcgtgagctctgctagttcgtcctccactgtgctgactcctggccctttggtggcatcggcctccggagtcggcgggcagcaattcctgcacataatccacccagtaccaccttcttctccaatgaatctccaaagtaacaaactctcccacgtgcatcgcatccccgtggttgtccagagtgtgcctgtagtctacacggccgtgagaagtccaggaaacgtcaataacacaattgtggtacctttgctcgaggacggtcgcggccacggtaaagcccagatggacccacggggtctcagtccaaggcagtccaagtccgactcagatgacgacgacctgcctaacgtgaccttagatagcgtgaacgaaacgggctccacagctttgtcaatcgcccgggcggtccaagaagtgcatccgagccccgtctcacgggtgcggggcaatcgcatgaataatcaaaaatttccttgttctatcagcccattttccatcgagtccacccggcggcagagaagatccgagtcccctgatagccgcaagaggagaatacataggtgcgactttgaggggtgtaataaagtgtatacaaaatcctcacacctgaaggcccaccgcaggacgcacaccggagaaaagccatacaagtgcacttgggaaggctgtacatggaaattcgcacggagcgacgagctcacaagacactacaggaagcacacaggagtaaaaccgtttaagtgtgccgactgtgaccgatccttcagcaggtctgaccatcttgctcttcaccggaggcgccatatgctggtctag

SEQ ID NO: 121765 - DNA, 1209 bp, Artificial Sequence
  Description of Artificial Sequence: Synthetic coding sequence
atgaacatccacatgaagaggaaaactatcaaaaacatcaacacgttcgagaatcggatgcttatgctggatggcatgcctgcagttcgagtgaagactgaacttctggagagtgaacagggatctcccaatgtgcacaattatcccgacatggaggctgtaccactgctgctgaataatgtgaagggggagcccccagaagacagtttaagcgtagaccatttccagactcaaaccgaacctgtggacctaagcatcaacaaggctcgaacgtctcctacggcagtgtcctctagccctgtttccatgaccgcatctgcaagctcgcccagttctacttcaactagttcctcctcttcctcccgtcttgccagttcgccgactgtaatcacttctgtgtcctcagctagcagctcgtccacagtactgactccggggcccttggtcgcttcagccagtggcgtggggggccagcagtttttgcatattatccaccctgtccctccttcctcaccgatgaacctgcagtccaacaagctgtcccacgtgcatagaatcccagttgtggtgcagagcgttcctgtagtctacaccgctgtccggtcccccgggaatgtcaacaatacaatcgtggtacccctgcttgaggatggtagaggacacgggaaggcacagatggaccccagaggcctgagccccaggcaatctaagtccgattccgatgatgacgacctacccaatgtcactctggattcagtaaatgagacaggaagcacagccctatccattgctagagctgtacaggaagtgcaccctagccccgtgagcagggtccgaggaaaccgcatgaacaatcagaaattcccgtgcagtatatctcccttctccatcgagagcacaaggagacagcgccgatctgaaagtcccgactcccgcaagcgcaggattcacagatgcgattttgaaggctgtaataaggtctatactaaatcctcacatctaaaggcccacaggagaacacatacgggagaaaaaccctacaagtgcacctgggaaggctgtacatggaaatttgcaagatctgacgaattgacacgtcactatcgcaaacacactggcgtgaaaccattcaagtgcgctgattgcgacaggagcttctcgagatccgaccatttggccttgcaccgcagaaggcatatgctggtctag

SEQ ID NO: 121766 - DNA, 867 bp, Artificial Sequence
  Description of Artificial Sequence: Synthetic coding sequence
atggcagcagctgcttacgtggaccactttgccgctgagtgcctcgtgtctatgagcagcagagccgtagtgcatggaccgagggaaggtcctgagtctagacctgaaggagccgcagtagcggccacgccaactcttccacgagtggaagaacgaagggacggtaaggacagcgcatccctgtttgtcgttgccaggattctggctgatctaaatcagcaggccccagcccctgctccggccgagcgtcgagagggagccgcagctcggaaggcccggaccccctgccgcctccctccccccgcgccagaaccgaccagcccaggagccgaaggcgcagctgcagcccccccaagccccgcttggagcgaacctgagccagaggctggtctcgagcctgagagagagcctggccctgccggctcgggcgagccaggcttaagacagagggtgaggcggggcagaagcagagctgacctggaatctccccagcgcaaacacaagtgtcattacgctgggtgcgagaaggtctatgggaagagttctcacctgaaagcgcatctgaggactcacacgggagagcggcccttcgcttgctcctggcaggactgtaacaaaaagtttgctcgcagcgacgaacttgcccgccattatcggacacataccggggagaagaagttcagctgccctatatgcgaaaagcgattcatgaggtccgatcatctgactaaacacgcaaggcgccatgccaattttcaccccgggatgctgcagaggcggggggggggaagccgcacagggtctctttctgactactctaggtcagacgcgtcgagcccaaccatctctcccgcttcctcaccttag

SEQ ID NO: 121767 - DNA, 1251 bp, Artificial Sequence
  Description of Artificial Sequence: Synthetic coding sequence
atggtggaccatctcctcccagtagacgagaacttctcctcccctaaatgtcctgtgggctacctcggagaccggctggtgggaagaagggcctaccacatgctcccaagcccagtctcggaggacgacagtgacgccagcagcccgtgcagctgctctagtccagatagccaggcgctttgcagctgttacggtgggggattaggaacagagagtcaggatagcattctggacttcctgctgtctcaagctacacttggttccggcggaggcagtgggagctctatcggcgcatcgtccggccctgtcgcatgggggccttggcggagagccgctgcccctgttaagggggaacacttctgtcttcccgaattccctcttggagatcctgatgatgtgcccaggcccttccaacccacgcttgaggaaattgaggaattcctcgaagagaatatggagcccggagtgaaagaagtgcctgaaggtaattcaaaagatttggatgcctgcagtcaactcagcgccgggcctcataagagccatttgcacccagggtcctccggaagagagcgttgttccccacctccaggtggagcttccgccggcggtgcacagggacccggaggggggcctaccccggacgggccaatcccagtgttacttcagattcaaccggtgcctgtgaaacaagaatccggcactgggcccgcctctcccggccaggcgccagagaacgtgaaagtagcccagctgctcgttaacatccagggacagacatttgcattagtcccacaggttgttccatcctcaaacctgaacctgccctcaaagttcgtgcgcatagcccccgtacctatcgctgccaagccagtgggtagtgggccactgggaccaggccctgctggcctgttaatgggacagaagttccccaaaaaccctgccgccgagctcataaaaatgcataaatgcactttcccggggtgctcgaagatgtacacgaaaagctctcacctgaaggcccatcttagacggcatactggggagaaaccctttgcctgtacttggccgggatgtgggtggcggttctcccgaagcgatgagctgtccagacatcgtagaagtcactccggcgtgaagccctaccagtgccctgtgtgtgagaaaaaatttgctcgctctgatcatctgtccaaacatatcaaggtgcatcggttcccacgatcctctcgatccgtgcgatctgtgaactag

SEQ ID NO: 121768 - DNA, 1068 bp, Artificial Sequence
  Description of Artificial Sequence: Synthetic coding sequence
atggcactgagcgagccaatcctgccttcttttagtacatttgcttcaccgtgtcgtgagagaggattacaagaaagatggccacgcgcagaacccgagtccggcgggaccgacgatgatcttaatagcgtgctggactttatcctgtctatgggtctggacggcttaggcgccgaagccgcaccggaacctcctcctccacccccacctccagcattttactacccagaacccggcgcacctcctccatactctgcaccggcaggtggtctggtttctgaactcctacggcctgaactggatgctccgctgggacctgcattgcacggtcgatttttactggccccacccgggaggcttgtaaaagcagagcccccagaggcagatggaggtggggggtatggttgtgcgccggggctgacccgcggaccacgtggacttaaacgagagggggctcctggccccgcagcgtcttgcatgcggggccccggcgggcgtccgcctccaccacctgacacccctcccctgagccccgacggccccgccagactccccgcacctgggcccagagcctcttttccacccccatttgggggccccggcttcggcgccccgggcccgggattgcattacgcccctccggcacccccagcttttggtctgttcgacgatgccgctgccgctgccgcggctctaggattggctcctccagccgcacgcggactgctcacccctccagcatcacccctggaactactcgaggcgaaacctaagagaggaaggcgcagctggccgcggaagcgcactgcaacccatacttgctcttacgcgggctgcggaaagacctacaccaagtctagccatctgaaggcgcatctcaggacccatacaggggagaagccataccactgtaactgggacggctgtggatggaagttcgcccgctctgatgaattgacacgccactacaggaaacacaccgggcacaggccattccagtgccatctgtgcgaccgagcttttagtcgtagtgatcacctggccctccatatgaagagacatatgtag

SEQ ID NO: 121769 - DNA, 234 bp, Artificial Sequence
  Description of Artificial Sequence: Synthetic coding sequence
atggatgtgctacccatgtgtagtatattccaggaactccagatcgtgcatgagacaggatacttctcggcgctcccctctctggaagagtactggcaacagacctgcttagagctagagagatacctgcagtctgagccctgctatgtaagcgcgagcgagattaaattcgacagccaagagagtgtcgatcagaaccactggctgggccgcaaacgccgcaaccctaattag

SEQ ID NO: 121770 - DNA, 846 bp, Artificial Sequence
  Description of Artificial Sequence: Synthetic coding sequence
atggatgtactgccgatgtgcagcatcttccaggaactacagattgtccatgaaactggctactttagtgccctgccaagcctggaggaatactggcagcagacttgcctagagctagaacgctacctacaatcagaaccgtgttacgtgtcagctagtgaaatcaagttcgacagccaggaagatctgtggactaaaattatactggctcgtgaaaaaaaggaagagtcagagttaaagataagctcgtcacccccagaagacaccttgatcagtccatcattctgctacaacctagagactaatagcttaaacagcgacgtgagctctgagtcatccgacagctcagaggaactatcccctacagcgaagtttacctccgaccctatcggcgaggtgctggtttcctcagggaagctaagcagctctgtaacgtctacgccaccttcctctcccgaactttcacgagaaccctcgcagctctggggttgcgtgcctggcgagctgccctctcctgggaaagttagatcaggcactagcggaaaacccggagacaaaggtaacggcgatgccagtcccgatggtcgaagaagggtgcataggtgccattttaatggctgtaggaaagtgtatacgaagtcctctcacttaaaagcccaccagcgcactcatacaggacagtgtccacggggccctagaagagcagctgcaggaggccggcattgtattgctcctgccctggagggggctggaccaggttgcactggctgcggccagggccgtcaaatcctgacttcatctgacgtcttccaccagtctatacgctccttctggtcaagcgagtag

SEQ ID NO: 121771 - DNA, 852 bp, Artificial Sequence
  Description of Artificial Sequence: Synthetic coding sequence
atggatgtccttccaatgtgttccatctttcaggagctgcaaatcgttcacgagactgggtacttctctgctctacccagcctggaggagtactggcagcagacctgcctcgaactggaacgctatctgcaatctgagccatgctatgttagtgcatcggaaattaaatttgactctcaggaggacctgtggaccaagatcattctcgcgagagaaaagaaggaggagtccgagctgaaaatctcttcctctccccctgaggacactctgatctcgcccagcttctgttacaacctggaaaccaacagtttaaactccgatgtgtccagcgaatcatctgactcttccgaggagctctcgcctactgcaaaattcacatccgaccccattggcgaagttctggtgtcttctggcaagctctccagtagcgtgacgagcactcctccttcttcccccgagctttcccgcgagccttcccagctgtggggctgcgtgcccggcgagctgccgtcccccggcaaggtgagatcagggactagtgggaagcccggtgacaagggtaacggcgatgcctcaccagacgggcgcaggcgtgtgcatagatgccacttcaacgggtgcaggaaagtctatactaaatcatcgcatctgaaagcccaccaacgcacgcataccggtgaaaagccctaccgctgcagctgggaaggatgtgagtggcgcttcgctcggtcagacgagctgacgcgccactttcggaagcataccggtgctaagccattcaagtgttctcattgtgacagatgcttctctcggtctgatcacctggctctacatatgaagaggcatctgtag

SEQ ID NO: 121772 - DNA, 714 bp, Artificial Sequence
  Description of Artificial Sequence: Synthetic coding sequence
atggatgtcttacctatgtgcagcatctttcaagagctgcaaattgtccatgaaaccggatacttctcagccctgcccagcctcgaagaatactggcagcagacctgcctggagctggagaggtatctgcaatctgagccatgttacgtgtctgctagcgaaattaaattcgactcacaggaggatctctggacaaaaattatactcgctcgggagaagaaggaggagagtgaactcaaaatctctagcagccccccggaggacaccctgatctccccttccttttgttataatctggagaccaattcacttaactcagatgtcagctcagagtccagcgacagcagcgaggagctttccccaactgccaaatttacgtcagatcctataggcgaggttctcgtctctagtgggaaattgagttcgagcgtgacttccacacctccatcatcaccagagctgagtcgcgaacccagtcagctctggggttgcgtcccgggggaactccctagccccggtaaagtgcggtccggtacgtctggcaagccaggcgataaaggtaatggtgacgcaagtcccgatggtaggcggcgcgtacatcggtgccacttcaacggctgcaggaaagtgtacactaagagcagccatctaaaggcccaccagcgaacccacacaggagtgtttcctggtcttactacatggccatgcacctag

SEQ ID NO: 121773 - DNA, 909 bp, Artificial Sequence
  Description of Artificial Sequence: Synthetic coding sequence
atggacgttctggcctcatactcaatcttccaggaacttcaactggtacatgacaccggttatttttcagccctgccctcactcgaagagacctggcagcagacctgcctagagctggagcggtatctccaaacagagccacggagaatatccgagacattcggtgaggacttggactgttttctgcatgcctccccacccccttgcatagaggaatcctttagacgtcttgacccactgcttctgccggtggaggccgccatttgcgagaagtcctcagccgtggacatcttgttgtcccgcgacaagctgttgtcagaaacctgcttatcccttcagccagcctctagtagcctggactcctacaccgcggttaatcaggctcagctgaatgcggtgacctccctgacaccaccttcctctccagagttgagtcgccacctcgttaagacctcacaaactctgtcagctgtcgatggtactgtcaccctgaagttagtggctaaaaaagccgccctttctagtgttaaagtcgggggcgttgcaaccgccgccgccgccgttacagctgctggagcagttaaaagtggccaatctgactctgatcaaggggggcttggagcagaagcatgcccggagaacaaaaaacgggtgcaccggtgtcaattcaacgggtgtaggaaagtgtatactaaaagtagccatctgaaggcccatcaacgaacccacactggcgaaaagccgtacaaatgttcctgggaaggttgcgagtggcggttcgccaggtctgatgaactgactcgtcattatcgcaagcataccggcgccaagccttttaagtgcaaccactgcgatagatgcttctcaaggtccgaccaccttgcacttcacatgaagcggcacatttag

SEQ ID NO: 121774 - DNA, 825 bp, Artificial Sequence
  Description of Artificial Sequence: Synthetic coding sequence
atgttcccaagttggccaacatgcctggaactggaaagataccttcagacggagcctcgacgaatctccgagactttcggggaggaccttgattgtttcttacatgcttctcccccgccctgcatcgaggaaagtttccgcaggttggaccctttactgttacctgtcgaggccgcaatatgtgagaaaagctctgcagtggacatcctgctgagcagggataagctgctgtccgagacatgtctgtctctgcagccggcctcctctagcctagattcttacaccgcagttaatcaagcgcagttgaacgccgtgacttccttgacccctccaagctcacccgaactaagcaggcacttggtgaagacatcacagactcttagtgcagtcgatgggaccgtcactctgaagctggttgccaaaaaagctgctcttagctctgtcaaagtcggcggcgtcgccaccgccgcagccgccgtcactgcagccggagcggtcaagagcggacagtctgattctgatcagggagggctcggagctgaagcttgtcccgagaacaaaaaaagagttcatcgatgccagtttaatggctgtcggaaagtgtatacaaaatcttcccatttaaaggcgcaccagcgaactcatactggagagaagccctacaagtgttcttgggaaggctgtgaatggcgttttgctcgaagtgacgaactgactaggcattaccgtaagcacaccggtgcgaagccattcaagtgtaatcattgtgaccggtgcttctctcgctccgaccacctggctcttcatatgaaacggcacatctag

SEQ ID NO: 121775 - DNA, 810 bp, Artificial Sequence
  Description of Artificial Sequence: Synthetic coding sequence
atgacctgtctggaactcgagcggtacctgcaaactgaaccccgcaggatatccgagacgttcggcgaggatttggactgttttcttcacgcttcacctcctccctgcatcgaggaatcctttaggagactagatcctctcctgctgcctgtggaggccgcgatctgcgagaagtcaagcgctgtggatatcttgctctctcgcgacaagttattgagtgaaacttgcctgtcccttcagccggcctcctcatctcttgacagttacactgccgtgaatcaggcgcagctcaatgccgttacctccctgacaccaccgtcttctccagaacttagtagacatctcgtcaagacgtcccagactctcagcgctgtcgatggcaccgttaccctgaaactcgttgcaaaaaaagctgccctaagcagcgtgaaggttggcggcgtcgcgactgctgctgcagccgtgacagctgccggagctgttaaatcaggccagagcgacagcgaccagggaggcctcggcgcagaggcatgtccagagaacaaaaaacgggtccacaggtgccagttcaacggatgccgcaaggtgtataccaagagtagccacctgaaagcgcaccagcggacgcatacgggagaaaaaccatataagtgctcctgggagggatgcgagtggagattcgcgaggtcagacgagctgacacgtcactatcgaaagcacacaggtgccaagccgtttaagtgtaaccactgcgacaggtgtttctctcgaagcgaccatctggcactgcatatgaagaggcatatctag

SEQ ID NO: 121776 - DNA, 339 bp, Artificial Sequence
  Description of Artificial Sequence: Synthetic coding sequence
atggatgttctggcatcctactctatattccaggagttacagctggtgcatgacacaggctactttagcgctttgccaagcttagaagagacttggcaacaaacctgcctagaactggagcggtatcttcagactgagccccgccgcatttctgagacttttggagaggacctggactgctttcttcacgcttccccccccccttgcattgaagagtcatttagaaggctggatccactgctactcccggtagaggccgccatctgcgaaaagagctcagccgtggatattctcctctctagagacaaactgctatccgagacctgtctaagcctgtag

SEQ ID NO: 121777 - DNA, 183 bp, Artificial Sequence
  Description of Artificial Sequence: Synthetic coding sequence
atggacgtgctggctagctactctatatttcaggagctgcaactagtgcacgacacgggctacttttccgccctaccctccctggaagagacctggcagcaaacttgcctggagttagaacggtatctccagacagagccgcgtcgcatttccgagacttttggcgaggatctggactgttag

SEQ ID NO: 121778 - DNA, 339 bp, Artificial Sequence
  Description of Artificial Sequence: Synthetic coding sequence
atggatgtgttggcctcatacagcatttttcaagagctacaattggtgcacgatacaggctatttctctgcccttccatcacttgaggaaacctggcagcagacgtgcctcgaactggaacggtatctgcagaccgagccgcgccgcatttccgagaccttcggcgagaaaccatacaagtgctcatgggagggatgcgagtggcgcttcgccagatccgatgagttaacaagacattacaggaaacatactggggctaaaccattcaaatgcaatcactgtgaccgatgtttctccaggtctgaccatctggcccttcatatgaagcgccacatttag

SEQ ID NO: 121779 - DNA, 774 bp, Artificial Sequence
  Description of Artificial Sequence: Synthetic coding sequence
atggtggacatggataagctgattaacaatttggaggtacagctaaattcggagggtgggagcatgcaggtgttcaagcaggtgacagcttcggtgcgtaaccgcgatcctccagagatagagtatcggtcaaacatgacaagccccaccctgttggacgcaaacccaatggaaaaccccgccctgtttaatgacataaagatcgagcctcctgaggaattgttagcctctgattttagcctgccacaggtggagcccgtagacttgtccttccataaacccaaagctcctctgcagcccgccagtatgttacaggcgcctattagacctcccaaaccccaaagcagtccgcagacgttagttgtcagtacctccaccagtgacatgagtacaagtgcgaatattcccaccgtcttgacaccaggctccgtgttgacaagttcgcagtcaactggcagtcagcagatcctccatgtgatccacaccattcctagcgtttctctgcccaacaagatgggagggttaaagaccattcccgtcgttgtgcagtctctgcccatggtgtataccacgctccctgccgacggcggccccgcggcaattactgtacccctgattgggggtgatggtaagaacgcggggtccgttaaagtggaccctacctcaatgagcccccttgagattccatctgatagtgaggaaagcaccattgaatctggtagctcagcactccagtccttgcaaggtctccagcaggagagagaggcactctag

SEQ ID NO: 121780 - DNA, 1080 bp, Artificial Sequence
  Description of Artificial Sequence: Synthetic coding sequence
atggtagacatggacaaactcatcaataatctggaggttcagctaaacagtgaggggggctccatgcaggtttttaaacaggtgacagcgtccgtcaggaaccgggacccaccagaaatagagtaccgatcaaatatgacatctcctacacttctggatgctaaccctatggagaaccctgcattatttaacgatataaaaattgagccccccgaggagctgcttgccagcgacttcagtttgccacaggtcgaaccggtggatttgagcttccacaagcctaaagcgccccttcagcccgctagcatgctgcaagcacctatacgaccccccaaacctcagtcgtctccccagacactcgtggtgtcgacttccaccagcgacatgagcacatcagcaaatatcccaacagtgctgacaccgggcagcgtactaactagctctcagtccactggatcccagcagatcttacatgtaatccacacaataccctctgtgagcctgcctaacaagatgggaggccttaagaccatcccagtggttgtgcagagccttcctatggtctataccaccctgccagccgacgggggccccgccgccatcaccgtgcctcttatcggtggtgatggaaaaaatgcagggtccgtcaaggtggaccctacaagtatgtcccctctcgaaatcccatccgactcagaagagagcactattgaaagcggaagtagtgccctgcagtccctccaggggctgcaacaggagccggctgcgatggcccagatgcaaggcgaggagagtctggacctgaaaaggcgtcgcatccatcagtgcgacttcgccggatgttccaaagtgtatacgaaatcctctcacctgaaagcacatcggagaattcataccggggaaaagccttacaaatgtacttgggacgggtgctcttggaagtttgctagatccgatgagctcactcgacacttccgtaagcacactggtatcaagccctttcgatgcaccgactgtaacaggagtttttccaggagcgaccacctgtcgctgcatcgccgccggcacgacacaatgtag

SEQ ID NO: 121781 - DNA, 771 bp, Artificial Sequence
  Description of Artificial Sequence: Synthetic coding sequence
atgcagcctgccaaggaggtgacaaaagctagtgatggttctctgcttggggatctcgggcacactcctctgagcaagaaggaaggaataaagtggcagcgccctcgactgtcccgacaggcgttgatgcggtgctgcctggtgaaatggattctgagttccacagcaccccaaggctcagacagcagcgacagcgagcttgaactttccaccgttcgccatcagccggaaggattagaccagttacaagcgcaaactaagttcacaaaaaaggaactccagtcattgtatcggggtttcaaaaatgaatgtcccaccggtctagttgacgaggacacttttaaactcatttatgcccagttcttcccacagggtgacgcaaccacgtatgcccatttcctgttcaatgctttcgacgccgacggtaatggagccatccactttgaagacttcgtcgtgggcctgagtatcctgctcaggggtacggtgcatgagaagctcaagtgggccttcaacttgtacgatataaataaagacggttacattactaaagaggagatgctggccatcatgaagtcaatctacgacatgatgggaagacatacctacccaattctccgcgaggacgctccagccgagcatgtcgaacgctttttcgagaagatggaccgcaaccaggacggtgtcgttactatcgaagaattccttgaggcttgccagaaagacgaaaatatcatgagctcaatgcagctgtttgagaatgttatctag

SEQ ID NO: 121782 - DNA, 705 bp, Artificial Sequence
  Description of Artificial Sequence: Synthetic coding sequence
atgcaacccagaaaagaagtgacaaaggcttcagatggatcacttctcggggatctcggacatacgccgttgagtaagaaggaagggatcaaatggcagaggcctaggctgtctagacaagccctaatgcgttgctgcttggtgaaatggattttgagcagtactgctccacaggggagtgactcctccgactctgagctggagctctccacggttcggcaccagcctgaggggctggaccaactgcaggctcagaccaagtttaccaagaaagagctccagtccctgtacaggggttttaagaacggggacgccacaacttatgcccacttcctgttcaacgccttcgacgccgatgggaatggcgccatacactttgaagactttgtggtgggcctgtcgattctgttacgagggacggtgcatgagaagcttaagtgggcctttaacttgtacgatataaataaggacggctatataaccaaagaagaaatgctggctatcatgaaatctatctacgatatgatgggcaggcacacataccccatcctgcgggaggacgcgccagctgagcatgtggagaggttttttgaaaagatggacagaaatcaggacggagttgttaccatcgaagagttcctggaggcttgtcagaaggatgaaaacatcatgtcctccatgcaactgttcgagaacgtcatctag

SEQ ID NO: 121783 - DNA, 693 bp, Artificial Sequence
  Description of Artificial Sequence: Synthetic coding sequence
atggggattcaggggatggaactgtgcgcgatggcagtggtggtcctcctctttatagccgtgcttaagcagttcgggatcctcgaacccatcagcatggaagattcaagtgacagtgagctggagctgagcacggtccggcatcagccggaggggctggatcagctgcaggcccaaaccaaatttactaagaaagaactccagagcctgtaccgaggttttaagaacgaatgcccaaccggtctggtcgacgaggataccttcaagctgatctatgcacaattttttccacagggtgacgcaaccacctacgcgcactttcttttcaacgccttcgacgcagacggaaatggtgcaatccactttgaagactttgttgttggcctgagtatcttacttcgaggtaccgtccacgaaaagctaaaatgggcgtttaacttgtacgatattaacaaagatggctatataacgaaggaggaaatgctcgccattatgaaaagtatttacgatatgatgggtcggcatacttatcctatcctgcgcgaagacgcaccggcagagcacgttgagcggttttttgaaaagatggatcgaaatcaggatggcgtggttacaatcgaggaattcttggaggcatgccaaaaagatgaaaacatcatgagttctatgcaactgttcgagaacgtgatctag

SEQ ID NO: 121784 - DNA, 567 bp, Artificial Sequence
  Description of Artificial Sequence: Synthetic coding sequence
atggccaccgtgaggcaccgccccgaagccctggagctgttggaggcccagagcaagttcacaaagaaggagctccagatcctgtacaggggatttaaaaatgaatgtccctcgggagtggttaacgaggagacatttaaagagatttattcccaattcttccctcagggagatagcactacctatgcgcactttctgttcaacgcattcgataccgatcacaacggagccgtatcatttgaggatttcatcaagggattgagcatactgttaaggggcactgtgcaggagaagctgaattgggcatttaatctttacgacattaataaggatggatacattacaaaggaagaaatgcttgatatcatgaaggccatttacgacatgatgggcaaatgcacctacccggtgctcaaagaggatgcacctagacagcatgtcgagactttctttcagaaaatggataaaaacaaagacggagttgtaactatcgacgagttcattgagagttgccagaaggacgaaaacattatgagatcaatgcaattgttcgagaatgtaatttag

SEQ ID NO: 121785 - DNA, 678 bp, Artificial Sequence
  Description of Artificial Sequence: Synthetic coding sequence
atgtcgggttgtaggaaaaggtgtaaacgggaaattcttaagtttgcccaatacctgctgcgacttttaactgggagtctgcacaccgattccgtcgaggacgagctcgagatggccactgtgcgccaccggccggaggcactagagttgctggaggcccaatccaagttcaccaaaaaggaactccagatcctctacagaggatttaaaaacgagtgtcctagcggagtcgtcaacgaggagacgtttaaagaaatttatagccagttcttccctcaaggagattctaccacgtacgctcactttctgtttaatgctttcgatacagaccacaacggtgccgtgtcttttgaagattttatcaaggggttaagtatattgcttaggggaacggtccaggagaagctgaattgggcattcaacctgtacgacattaataaggacggctatatcaccaaggaagaaatgctggatataatgaaggccatttatgatatgatgggcaaatgtacgtaccccgtcctgaaagaagacgctccaagacagcacgttgaaaccttttttcagaaaatggacaagaataaggatggagtagtcactatcgacgaattcatagagagctgccaaaaggatgagaacatcatgagatccatgcagctgttcgaaaacgtcatttag

SEQ ID NO: 121786 - DNA, 690 bp, Artificial Sequence
  Description of Artificial Sequence: Synthetic coding sequence
atgaatttagaggggttagaaatgatcgctgtgctcatcgtaatcgtattgtttgtcaaactcctggaacaatttggcctgattgaggcaggcttggaggattctgtggaggacgaactggaaatggctacggtcaggcatagacctgaagctctggaacttctggaagcacagtctaaattcaccaaaaaggagctccagattttgtaccgcgggtttaaaaatgagtgcccatctggggtggtgaacgaggaaacattcaaagagatctacagccagtttttccctcagggtgatagcaccacgtacgcacatttcctgttcaatgcctttgacaccgatcacaatggcgctgtgagctttgaggatttcataaaggggttaagtatccttctgcggggcaccgtacaggagaagttgaactgggcctttaacctctacgatattaacaaagacggttacatcacgaaagaagagatgcttgacattatgaaggcaatttacgacatgatgggaaagtgcacatatcctgtcctgaaggaggacgcaccccgccagcacgtagagaccttttttcaaaaaatggataaaaataaagacggcgtagtcaccatcgacgagttcatcgaaagttgccagaaggatgaaaacataatgagaagcatgcagctgtttgagaacgtgatttag

SEQ ID NO: 121787 - DNA, 753 bp, Artificial Sequence
  Description of Artificial Sequence: Synthetic coding sequence
atgaacgtgcggcgcgtcgagtctatcagtgcccagctggaagaggcctcatcgacgggcggcttcctgtacgcccagaacagcaccaaacgctccattaaggaacggctgatgaaactactcccatgttctgcagctaaaacaagtagtccagcgattcagaattccgtcgaggatgaactggaaatggcaacagttcggcataggccggaggcgctggaactcttagaggcacagagtaaattcacaaagaaagaactgcagatattgtacaggggattcaaaaatgagtgccctagtggagtggtcaacgaggaaaccttcaaagagatttacagccagtttttcccacagggggatagtacaacttacgcccacttcctcttcaacgcgtttgatacagaccacaacggggccgtgagctttgaggactttataaaagggctgagcatactgctgcggggaacagtccaagagaagcttaactgggcattcaacctgtatgacattaataaggacgggtatattaccaaagaggaaatgttggatattatgaaagcaatctacgacatgatgggcaagtgcacttaccctgtgcttaaggaggacgcccctcgccagcacgtggaaaccttcttccaaaagatggacaagaataaagatggcgtggtaactatagacgagttcattgagtcctgccaaaaagatgaaaatattatgagatctatgcagttgttcgagaacgtgatttag

SEQ ID NO: 121788 - DNA, 567 bp, Artificial Sequence
  Description of Artificial Sequence: Synthetic coding sequence
atggccactgtgaggcatagaccagaggccctggagctgctggaagcacaatcaaaattcacaaagaaggagctacagatcctttacagaggttttaagaatgagtgcccatccggggttgtgaacgaggaaaccttcaaagaaatctactcccagtttttccctcagggagattccactacctacgctcattttctcttcaatgcgttcgataccgaccataacggtgctgtttcatttgaggattttataaaaggactgagcatcctactgcgtggaaccgtacaggagaagctgaattgggcgtttaatctgtatgacattaataaggatggatacatcaccaaggaagagatgctcgacatcatgaaggctatctacgacatgatgggtaagtgtacctatccggtgctgaaagaggacgccccaaggcagcacgttgaaacatttttccagaaaatggacaaaaataaagatggcgttgtgacaattgatgagttcattgagagctgccagaaagacgaaaacataatgcgatcaatgcagctgttcgagaatgtgatctag

SEQ ID NO: 121789 - DNA, 651 bp, Artificial Sequence
  Description of Artificial Sequence: Synthetic coding sequence
atgaacgtgcgcagggtcgagtcaataagtgcacagttggaagaggctagcagcacgggcgactctgtggaggatgagttggagatggctaccgttcgtcatcgcccggaagccctcgaactactggaagcacagagcaaatttacaaagaaagagctccagatcctctacagaggtttcaagaatgagtgtcctagtggcgtggtgaatgaagaaaccttcaaggaaatatactcacaattttttccacagggtgattccaccacatacgctcatttcttatttaatgcattcgacaccgatcataacggagcagtgagcttcgaagatttcatcaaaggactgtcaattttgctccgcgggacagttcaggagaagttgaattgggcattcaatctctacgacataaataaggatggttacattacaaaagaagaaatgctcgatataatgaaagcaatttatgacatgatgggaaaatgcacttatcctgtgctcaaggaggatgctccgcgtcagcacgtggagactttttttcagaagatggacaaaaataaggacggagttgttaccattgatgaattcatcgagtcttgtcagaaagacgaaaacatcatgcgaagcatgcaattgtttgagaacgtgatttag

SEQ ID NO: 121790 - DNA, 567 bp, Artificial Sequence
  Description of Artificial Sequence: Synthetic coding sequence
atggccactgtgaggcaccgccctgaggccttagagttactggaagcccagtccaagtttactaaaaaggagctgcaaatcctgtacaggggattcaagaatgagtgtccgtctggggtggtaaatgaggagactttcaaggaaatctacagccagtttttcccacagggagattctaccacatacgctcatttcttgtttaacgcattcgacacggatcacaatggagccgtatccttcgaggatttcattaaagggctctcaatactcctgagaggaacggtgcaagagaagctgaactgggccttcaatttgtacgatattaacaaggatggctacattactaaagaggaaatgttagacattatgaaagcgatctatgatatgatgggcaagtgtacttaccccgtgctgaaagaggatgccccgcgtcagcatgtggaaactttctttcagaaaatggacaagaataaagacggcgtggtgaccatagatgagtttattgagtcctgccagaaggacgagaatatcatgcgctcaatgcaattattcgaaaacgtcatatag

SEQ ID NO: 121791 - DNA, 549 bp, Artificial Sequence
  Description of Artificial Sequence: Synthetic coding sequence
taaggaatgaacgcaggattcgaagattgtttagtttttgacgaactcatggataagttctctaatgacctgtctctgtgtttgccggtgttttctcgcctacgtattccggatgaccatgctattagcgacctgagcatgtataattatattgagatgagagctcatgtgaacagctcttggtttatcttccaaaagaatatggagcggttccttcatgccattatgccctccaccttcattcctctctatacgatggtcaccttttcaagaattcgctaccatgaggcagtgcagcggtggcactggcagaagaaagtgattaacaaaggacttttttttctgggaagcctcattgctatctcgtccacctacctacttatccattacatgagcccacgttcctttttaagattaaggaggccctggaattggattgcccattttaggaacacgacctgcttccctgctaaagccgtcgacagcttggagcagatttcaaatttgatcagccggttattaagccactccgaaattcttcagacttag

SEQ ID NO: 121792 - DNA, 1359 bp, Artificial Sequence
  Description of Artificial Sequence: Synthetic coding sequence
atggatagttctgtgattcagcggaaaaaggtcgccgtcattggcggtggattagttggctcactccaggcgtgcttccttgccaaaaggaattttcagattgatgtgtacgaggccagggaagatacccgcgtggctactttcacacgcggcagaagtataaaccttgccctttcacatcggggtcgccaagccctgaaggcagtgggactggaagaccagattgtgtcccaaggaatcccaatgagggcccgtatgattcattctctgtcggggaaaaaatccgccattccgtacggaacaaaatcccaatacattttgtctgtaagcagggagaacttgaacaaagatcttctcactgcagcagagaaatacccgaatgtcaagatgcatttcaaccaccggctgctcaaatgcaaccctgaagagggcatgatcacggttctcgggagcgacaaagtgcccaaggacgtgacatgtgatctgatcgtgggatgtgacggcgcctacagcaccgtaagaagccaccttatgaagaaacctaggtttgattattctcaacagtacatcccccacgggtatatggagttaaccatcccaccaaagaacggcgactatgccatggagcccaattatctccacatatggcctagaaatacatttatgatgatagccctcccaaacatgaataaaagtttcacatgcactttgttcatgccgttcgaggagttcgagaagctcctgacctcaaatgacgttgtcgattttttccagaaatactttccagacgccattccgctgatcggagaaaagctgctcgtgcaggatttctttttgttgcccgcccaacctatgatctcagtcaagtgctctagttttcacttcaaatcccactgtgtattgctcggagatgcggcccatgccatcgtgccattcttcggacagggcatgaacgccggattcgaagattgcctggtgttcgatgaattgatggataagttttctaacgacctcagtctttgtcttcccgtgttctcgcgtctgcggatcccagacgatcacgctattagtgatctttctatgtacaactatattgaggtgactttctcacgcatcaggtaccacgaggccgtgcagaggtggcactggcagaagaaggtgatcaataaaggcctcttctttctcggtagcctgatagccatctcgtccacctacctgctgattcactatatgtcgcccaggtccttcttgagactccgccgtccttggaactggatcgctcattttaggaatactacctgcttccccgctaaggctgtggattcccttgaacagatctctaatttgatttcaagatag

SEQ ID NO: 121793 - DNA, 1422 bp, Artificial Sequence
  Description of Artificial Sequence: Synthetic coding sequence
atggattctagcgttatccagcgaaaaaaagtcgccgtgataggtggggggctggtaggtagcctccaggcctgtttcctggccaagagaaacttccagatcgacgtatatgaagccagagaagatactagggtggctacgttcacgcgcggacggtccatcaatctcgccctaagccataggggccgtcaggcactcaaggcagtgggcttagaggatcaaattgtgtctcaagggattcctatgagagccaggatgatccactcactctctggaaagaaatccgccattccctacgggactaagtctcagtatatcctttctgtcagtcgggagaaccttaacaaagatctgctgacagccgcagaaaagtatcctaacgtgaagatgcacttcaaccacagactacttaagtgtaacccagaggaaggcatgattaccgtactcggctccgacaaggtacctaaagatgtcacctgcgacctgattgttgggtgcgacggcgcctatagtaccgttcgaagccatttgatgaagaaaccccgttttgactactcccagcaatacatcccacatggttacatggaacttaccataccccctaagaatggggattacgccatggagcctaactacctgcatatctggcccaggaataccttcatgatgattgctttgcctaacatgaataaaagcttcacgtgtacgctttttatgccttttgaagaattcgaaaaattgctgacaagcaatgacgttgtggacttctttcagaagtacttccccgacgcgatccccctcattggcgagaagctgctggtgcaagacttctttctcctgcccgctcagcccatgatttctgtgaagtgttcttccttccactttaaatctcactgcgtgctgctcggagatgccgcccatgcaattgtcccatttttcggccagggtatgaacgctgggtttgaagactgtctggtttttgacgagctcatggataagtttagcaacgacttgtccctgtgtttgccagtgttctcccggttaagaatacccgacgaccacgctatttctgacctgtctatgtacaactatatcgagaagaacatggaacggttccttcatgcgatcatgcctagtacattcataccactctacacaatggtgacatttagccgaatcaggtatcatgaggccgtacagagatggcactggcagaagaaggtcatcaataaaggactttttttcctgggtagcttaatcgctatctcttctacctaccttctcatacactacatgtccccacgctccttcctcaggctccggaggccttggaactggatcgctcacttccgaaacacaacttgtttcccggctaaggccgtcgacagcctggagcaaatcagcaacctgatctccaggtag

SEQ ID NO: 121794 - DNA, 1461 bp, Artificial Sequence
  Description of Artificial Sequence: Synthetic coding sequence
atggattccagcgtgattcagcggaaaaaagtggccgtgattggaggaggtctggtgggctccctccaggcttgctttctggccaaacggaattttcaaatcgatgtttacgaggcaagagaggacaccagagtggccacattcacccggggacggtccataaaccttgctttatcgcatcggggccggcaggccctgaaagccgtgggcctggaggaccagattgtctcgcaggggatacctatgagggcacggatgattcattctttatcaggcaaaaagagcgccattccctatggtaccaagtcccagtacattttgtccgtttctcgcgagaatctgaacaaagacctgctgactgccgccgagaaatacccgaacgtgaaaatgcattttaatcacaggctgttaaagtgtaaccccgaagagggcatgatcactgtccttgggtccgataaggtccctaaggacgtcacatgcgatctcatcgtggggtgtgatggtgcctactctaccgtgaggtcacacctgatgaaaaaacccaggtttgattatagccagcagtacattccacacggatacatggagctgacgattccaccaaagaatggagactacgccatggagcctaattatctgcatatttggcccaggaatacattcatgatgatcgctctcccgaacatgaacaagtccttcacgtgcaccctgttcatgccattcgaagaattcgaaaaattgctcacctcaaacgatgtcgttgacttcttccaaaaatatttccccgacgccatccctcttattggagagaagttgctggtgcaggattttttcctgctgcccgcccagccaatgatcagtgttaaatgctccagttttcactttaaaagtcactgcgttctcctgggagacgccgcccacgcgattgtgcctttttttggacaggggatgaatgcggggttcgaggactgcctggtgttcgacgagctgatggacaagttctccaacgacctcagcctctgtctgcctgtattctcacgactcagaatccctgacgatcacgccatttcagatctgagtatgtacaactacatcgaaatgcgggcccatgtcaacagttcatggtttatctttcagaagaatatggaaaggttccttcatgccattatgccaagcacattcattcccctatatacaatggtgacattttcgagaatccggtatcatgaggccgttcaaaggtggcactggcaaaaaaaggtgattaacaaggggctgttctttctcggaagcctcatcgctatctcctccacctatctgctaatccactacatgagtccacgaagctttctcagacttagaaggccctggaactggattgcacatttccgtaacacgacttgcttccctgcaaaggccgtcgattccctcgaacagatcagcaacctcatcagccgctag

SEQ ID NO: 121795 - DNA, 1689 bp, Artificial Sequence
  Description of Artificial Sequence: Synthetic coding sequence
atggagcttaagaaggatattaacgctgtctccatcgatatgctgctgatcgtacattcagagaaaagacgggcagcccagggtaccctgagcgatcaacaagccaaccctagtagcctgctgcagaggggcggcggcttccagggcgtcggaaacggggttcgtaggtggcaaaaactggagggcaatgatttccacgaaaatctcgtggagaagcagcatccacagcagcctcaggtaatcacatcctacaattcacagggcacacagttaactgttgaggtgcaccccagggatgcaatgcctcagctcctgaagaagtttagtttagccaaaaggttgcagggtgacaagaacggaaataccagacctcgccagcccggcggaaaggacgctcacgcctatccatgggaccggtccagtttgaaatccatgtcactcgatctccagcagttcgagaagctggacatctatgcctctcaggtgacagcgaaatcggggctagacgagttggtgagcgacctcctgcaggaagcccatacagatctagagcgcgttagagccatctggatctggatctgccatcacattgaatatgacattgctgctgcccaggagaaagatcgccaggccttcaaaccgacggatatcctgcgtactcagaaaactaactgcgatggctatgccggcctgtttgagcgaatgtgcaggctagcgggcgtacagtgcatgacagttcctggctacagcaaaggcttcgggtaccagaccggccaaagttttagtggtgaattcgatcatgcttggaacgcagtctatcttgagggccggtggcacctggtggattccacatggggatctggcttggttgacacgataactagcaagttcacattcctgtacaacgagttttactttctgacacaccctgccttgtttattgaggatcacttccctgacaataagaactggcagctgctgaaaccaccgcaaagtctgagacagtttgaaaacaatatgtaccacaaaagcgagttttacaataagggaatgctcagcgcccacccggagacctcaatgatccggaccgtaaatggcaaggccacagttaccattgagagctgcgccccgactttatttatgttcatgctgaacgggaaacaggagcacgggctgctgtctctgcgtaaaaatggtatgaaactggaagtgtacccccccacgatggggactcataagctgcagatctttgcgaagggtaattctgacatatattctagtgtcctggagtataccctgaaatgtaactacgtcgacatgggtgttcagctgcccgccgaactccatcaacccgttgggccctcttggttttccgagcagatggggattatgaagccttcacacccggaccctataatccatacctccgatggaaggtgctccatctcattctcggtggaggaaggaatcaatgtcctggcctctctgcacggcgacgatgggcccatcactgaggaaacacagagaagatatatattccagttgcacagagaaaagcaaacagagctgaaggtacagctcccccacgcaggaaagtttgcactgaaggaagtgtacgtcatggtgttggagaacgccaatcacaatttctattcttatatcctcaaatacaaggtaaatgcccaatag

SEQ ID NO: 121796 - DNA, 1986 bp, Artificial Sequence
  Description of Artificial Sequence: Synthetic coding sequence
atggaattaaaaaaggacatcaatgcagtgtcgatcgatatgctgctcattgtccacagcgagaaacgaagagccgcccagggaaccctaagcgaccaacaggcaaacccctcctccttactacagagggggggcggctttcagggggttggcaacggcgtgcgtcgctggcagaagcttgaaggcaacgattttcatgaaaatttggtcgagaaacagcatccacagcagccacaggtcatcacctcgtacaactcccaggggactcaactcacagtcgaagtccatccccgtgacgcgatgccgcagctgctgaagaaattcagcctggccaagcggttgcagggagataagaacgggaacaccagaccccgccagcccggaggtaaggatgcccacgcttatccatgggatcggtcgagcctgaaatcaatgagtctggatctccagcaattcgagaagcttgacatttacgcttcacaggtgaccgccaagtctggacttgacgaactggtcagtgacctcctgcaggaagcccacaccgatctggaacgcgtccgagctatctggatttggatttgccaccacatcgagtacgatatcgccgccgctcaagagaaagatcgtcaagcatttaaaccgactgatatattacgtacccagaagacaaattgcgacggttatgccggcctgttcgaacgaatgtgtagattggccggcgtgcaatgtatgactgtgccaggatactcaaagggattcggctaccagacaggtcagtccttctctggcgaattcgatcatgcatggaacgccgtgtaccttgagggacgctggcatcttgtggactccacgtggggatccgggctcgtcgataccattactagcaaattcacctttctttataatgagttttatttcctcacccaccctgccctgtttattgaagaccactttcccgacaacaaaaattggcaactgttaaagcctccgcaatcattacgccagtttgagaacaatatgtatcataagtctgagttctacaacaaagggatgctgtcggcacacccggaaacctccatgatccgaactgtgaacggaaaagcaaccgtcaccatcgaaagctgcgcacccacactcttcatgttcatgctcaacggtaaacaagagcacggactgttgtccttacggaaaaatggtatgaaattggaggtgtacccaccaactatgggcactcataaacttcagatctttgccaagggtaactctgatatttacagttcagttctcgaatacacactgaaatgtaactacgtcgatatgggagtgcagcttcccgcagaactccatcaacctgtcgggcccagctggttctctgaacagatgggcatcatgaaaccaagtcacccagatccaatcatacatactagtgatggaagatgctcgataagcttttccgtcgaggaaggcattaatgtcctggctagtctgcatggagacgacggaccaatcactgaagagactcagcggcggtatatcttccagttgcaccgcgaaaaacagaccgaactgaaagtgcaactcccccatgccgggaagtttgccttgaagattttcgttaaaaaacggcaggagccaggtaactatattttcgtgtttaactacctggtgtgttgcgccaacacgaaagtaaattggccgatgttcccagagtctttcgggaattggggacaggataacgaattgttagagcccctctcaggggtgctccctgcgaaccgtaacgtgccattcaaactcaagctgcacggcattgctaaggtcctagtcaagggccaggacacatggccactcacactgaaccacgagggttattgggagggctcctgctccacagctggatgccaggaagtttacgtcatggtgctggaaaacgctaaccataacttttactcttacatcttaaaatacaaggtgaacgctcagtag

SEQ ID NO: 121797 - DNA, 1173 bp, Artificial Sequence
  Description of Artificial Sequence: Synthetic coding sequence
atgaagctggaagccgtggaccggatgaacccatcccttgtttgcgtcgcctctgtgactgacgtggtggactcccggtttctggtccatttcgacaattgggatgacacgtatgattattggtgcgatccttcttctccttacatccacccagttggctggtgccagaagcaggggaagcctctcaccccccctcaggattatcctgaccctgacaacttttgttgggaaaagtatcttgaagagaccggagcatctgccgtgccaacatgggcatttaaggtccgaccgccgcacagcttcttggtcaatatgaagttagaggcagtggacagaaggaatcccgctctgattcgcgtggcctccgtggaggacgtggaagatcaccgcattaagatacatttcgacggatggtcccatgggtacgatttctggatcgacgctgaccatcctgacattcatcctgctggctggtgttctaaaacggggcatccgctacagcccccactgggaccgagagagccctcaagcgcttcaccgggcggctgtccccccctctcctatcggagcctcccgcacactagaacaagtaagtattctttccaccataggaaatgtcctacacctggttgtgatgggtccgggcacgttacgggcaagttcaccgcccaccactgtctgtctggatgcccgctggcggagcgtaatcaaagtcgcctcaaggccgagctttctgattcagaggctagcgctagaaaaaaaaacctttcaggtttctcgcctagaaagaaaccgcgccaccatggcagaataggtcggccaccaaaataccgaaagattcctcaggaagacttccagacattaaccccagacgttgtccaccagtccctgttcatgtccgccctgtctgcccatcctgataggagtctgtccgtttgctgggaacagcactgtaagcttctacctggagtggctggaatcagcgccagcaccgtggctaagtggaccatcgatgaggtgtttggatttgtccagaccctaacgggctgtgaggatcaagcgcggttgtttaaagacgaagtaaggtgtaagtgccgagtaggcgacagagccggggttaccgtgctgaagactgctggctcccggtgcccgccacagagacatttctgctag

SEQ ID NO: 121798 - DNA, 2232 bp, Artificial Sequence
  Description of Artificial Sequence: Synthetic coding sequence
atgcgcagacgagagggccatggcaccgactccgagatgggacagggccccgtgcgagagtcacaatcttctgatccaccagccctccaattcaggattagtgaatataaacccctgaacatggccggagtggagcagcccccgtctccagagctccggcaggagggcgttacagaatatgaggacgggggggcccccgcaggtgatggcgaggcaggaccacaacaggccgaagaccatccccagaatccacccgaagaccccaaccaggatccaccagaggatgactcaacctgtcagtgccaggcatgtggcccacaccaggcagccgggcccgatttgggaagctccaatgacggctgtcctcagctgttccaggaaaggtcagtgattgttgaaaatagcagcggaagcaccagtgcttcagaactgttgaaacctatgaaaaaacggaaacgaagggagtaccagagtccgtctgaggaagaatccgaacccgaggcaatggagaaacaagaagaaggcaaggacccagagggccagccaaccgctagcaccccagagtccgaggagtggagctcatcccagcctgccacaggcgaaaaaaaagagtgttggagctgggagagctacctcgaggagcagaaggctataacggccccagtgagtctctttcaggactcgcaggcagtaacacataacaaaaatggattcaagctcggaatgaagctggagggcatagaccctcaacacccctctatgtatttcatcctgactgtggccgaggtatgcgggtatagactgagacttcattttgatggatacagtgagtgccatgatttctgggtcaacgctaacagcccagatatccatccagctgggtggtttgagaagactggccacaaactgcaacctcctaaaggatacaaggaagaggagttttcgtggtcccagtatctacgttctacacgggcccaggccgccccaaagcacctgtttgtttcacagagtcattcacccccacccctggggtttcaggtcggcatgaaacttgaagcggttgatcgtatgaatccatccttagtgtgcgtcgcatcagtgaccgacgttgtggatagtcggttcctcgtccatttcgacaactgggatgatacctacgactattggtgtgatccctcttccccgtacatccaccccgtgggatggtgccagaagcaaggtaagccactcacacctccacaggactaccccgatcctgataatttttgttgggagaagtatcttgaggagactggcgcgtccgcagtgccaacctgggcatttaaggttcggccgccccattccttcttggtgaatatgaaactggaggccgtggatcggagaaatcctgctcttattagagtggctagcgtggaggacgtggaagatcaccgtattaaaatccacttcgatgggtggtcccatggatatgacttttggatagatgccgaccacccagatatacacccggccgggtggtgttctaagacagggcatccactccagcccccactgggaccccgggagccatcatccgcaagccccgggggatgtcctcctctgagctaccgctcactgcctcacacgagaacgtctaaatacagctttcaccacaggctgttctttcctaggaagtgtcctacaccagggtgtgacggaagcggccatgtcaccggcaaattcactgcccaccattgccttagcgggtgtcctctggcagagaggaatcagtcaagacttaaggcggaactgtccgatagcgaagcttcagctaggaagaagaatttgtcaggtttttctcctcgcaagaaaccccgacaccacggccgaatcggtcggccccccaagtatcggaagatcccacaggaagacttccagaccctgacaccagacgtggtgcaccagtccttgtttatgtctgccttgtctgcccatcccgatcggtccctttcagtttgctgggagcaacactgtaagctgctgcctggagtggccggtatatctgcatctactgtggcgaagtggacaatcgacgaggtatttggcttcgtgcaaactttgaccggctgtgaggatcaggccaggctgttcaaggacgaagtgagatgcaaatgcagggtgggggatagagccggtgtgacagtgctcaaaaccgcaggtagtcggtgtccacctcagcggcacttctgttag

SEQ ID NO: 121799 - DNA, 2319 bp, Artificial Sequence
  Description of Artificial Sequence: Synthetic coding sequence
atgcggaggagggagggccacggaacagactccgagatggggcagggcccagtgcgtgagtcccagagctccgatccccccgcactccagttccgtattagtgagtacaagccactcaatatggcaggtgttgagcaaccaccctcacccgagttaagacaggagggcgtgactgagtacgaagatgggggagctccagcaggggatggggaggccggaccccagcaggcagaggatcaccctcagaatccccctgaagaccccaaccaagaccccccagaagacgattctacctgccagtgtcaggcatgcggaccgcatcaggccgcagggccggacctcggatcttccaatgatgggtgcccgcaactgttccaagaacgctcggtgatcgtcgaaaatagcagtggctccacctccgcaagtgagctccttaaacctatgaaaaagcggaagagaagggaataccaatccccgagcgaggaagagtcagaacccgaagcgatggaaaagcaggaggagggaaaagacccagaaggccaaccaaccgcatcgactccggaatccgaggaatggagcagcagccagccagccaccggtgaaaaaaaagaatgctggtcctgggaatcttacctggaggagcagaaggcaatcacagcacccgtaagcctcttccaagacagccaagccgtaacacataataagaatggcttcaaactgggaatgaaattagagggtatcgatccccagcaccctagcatgtactttattctcaccgtggctgaggtgtgtgggtaccgactccgactgcattttgatggatattccgagtgtcacgatttctgggttaacgcgaactcgcctgacatccaccccgccggatggtttgagaagacagggcataagctgcagcctccaaaaggatataaggaggaagaatttagctggagccaatatctaagatccacacgggcgcaggcagcccccaagcacctgtttgtctctcaatctcacagtccaccccccctggggttccaggtgggcatgaaattggaagccgttgaccggatgaaccccagcctggtctgcgtggcgagcgtaactgatgtggtggattcacggtttctggtacatttcgacaactgggatgacacatatgattattggtgtgacccatcgtcgccctatatccatcctgttggatggtgtcagaagcagggaaagcccctgacacctccacaagattaccccgacccagacaatttctgttgggagaaatatctggaagagacgggcgcttctgccgtgcccacctgggcctttaaggtgcgtcccccccattcctttctcgtaaatatgaaactcgaagccgtggataggagaaaccctgcattgattcgcgtggcttcagtggaggacgtggaagaccaccgtattaagatccacttcgacggatggagccatggatacgatttttggattgacgctgatcatcccgatattcaccctgcagggtggtgttcgaaaactggccacccactgcaacctcctctggggccgcgcgagccttcgagtgcgtccccaggggggtgtcctcctctatcgtatcggagtctccctcataccagaacctccaaatattccttccaccatagaaagtgtcccactcccggctgtgacggaagcgggcacgtgactgggaaattcacagcccatcactgcctttctggatgtcccctggctgagcgaaaccaatctaggctgaaagccgaattaagtgatagcgaggcgagcgccagaaaaaagaatctgtctgggttctctccacggaaaaaaccccgccaccatggcaggatcggtcggccaccaaaatacaggaaaataccgcaagaggactttcaaacactcactccggacgtggtccaccagtctttattcatgtctgcattgtcagcgcaccccgaccgctccctctccgtctgttgggaacagcattgcaaactgctcccaggggtggccggaattagcgcgtcgaccgtggcaaagtggaccattgatgaggtctttggcttcgtccagacactaaccggctgcgaggaccaagccaggctcttcaaagacgaggcacgcattgtccgagtgacccacgtttctgggaagaccctcgtgtggacagtggctcagctgggagatctggtgtgctctgatcacctgcaggaaggcaaaggcattctcgagaccggagtgcacagcctgttatgttcactgcctacccacttattagccaaactgtccttcgccagtgactcgcagtattag

SEQ ID NO: 121800 - DNA, 2523 bp, Artificial Sequence
  Description of Artificial Sequence: Synthetic coding sequence
atgcatctcgtggcaggagactctccaggttcaggcccacatctgcccgctaccgctttcattattccggcaagctccgcaactcttggtctgccctcctcagcactggacgtgtcttgtttccctagagaaccgattcatgttggagcccccgaacaggtcgcaggttgtgaacctgtttctgctaccgtattaccacaactgtctgccggaccagcgtcctcttcaaccagcacagtgagactgcttgagtggaccgaggccgcggcaccaccacccggcgggggcctgaggttcaggatctcagaatataagccgctaaatatggccggtgtggaacaacctccctccccggagctgagacaggagggtgttaccgagtacgaggacgggggtgcccccgctggcgacggcgaagcagggcctcagcaggcagaggatcacccacagaatccccctgaggatccaaaccaggatccccctgaggatgactccacatgccaatgtcaagcatgtggcccacaccaggcagcggggccagatcttggaagtagcaatgatggttgccctcagttgttccaggagaggtccgtcatagtagaaaatagcagtggctcaacttcagcgagcgaattgctgaaacccatgaagaaacgcaaaaggcgtgaatatcagtcaccttctgaagaagaaagcgagccggaggcaatggaaaagcaggaagagggtaaggacccagaaggtcagcctactgcctccacgcctgagagcgaggaatggtcatcctctcagccagctactggcgagaagaaggaatgctggtcctgggagagctatctggaggagcaaaaggccataacagctcctgttagcctatttcaggactcccaagcggtcactcacaacaaaaatggttttaagcttgggatgaaactggagggtatagacccacagcacccgagcatgtatttcattctgaccgttgccgaggtgtgcggctacaggctgaggttacactttgacggctacagtgaatgtcatgacttctgggtcaatgccaacagtcctgacatccatcccgcaggatggtttgagaaaactgggcacaaattgcagccccctaaaggctacaaggaagaagaattcagctggtcccagtatctgagatctaccagagcccaggctgcacccaaacatctatttgtctctcaatcccactccccaccacccttgggtttccaggtcgggatgaaactggaggcagtggataggatgaaccccagcttggtgtgcgtggcttcagtcacagacgtggttgactcccggtttctggtccacttcgataattgggatgatacttacgattattggtgcgatccatctagcccctatatccatcccgtgggctggtgtcagaagcagggcaagccacttactccgccccaggattacccggaccccgacaatttctgctgggagaaatatctcgaagaaactggggcctccgcggtacctacttgggccttcaaggtgcgcccacctcactcgtttcttgtgaacatgaagttggaagcagtggaccgtagaaatccagcgttgatcagagtcgcttccgtagaagatgttgaggaccacagaattaagattcacttcgatggttggtctcacggctacgacttctggattgacgcggatcacccagatattcatcccgcaggctggtgtagtaagactggtcaccccttgcagccccccttaggcccaagggagccatccagtgcctcccctggggggtgcccacccctttcttacagatcactgcctcatacccggaccagcaagtatagctttcatcatagaaaatgtcccacccctggttgtgacggcagcgggcatgtcaccggcaagttcaccgcccatcattgtctgtctgggtgcccattagcggaacggaatcagtccagactgaaggccgagctcagcgacagcgaagctagtgcacggaaaaagaacctctccggattttcacctcgtaagaagcccagacatcatggcagaatcggacgacccccaaagtataggaaaatccctcaggaagattttcagacactgactcccgacgtcgtccaccagtcgttattcatgtccgccctaagtgctcatcctgatcgctcactatccgtgtgttgggagcagcactgcaagttattgcccggcgtggcaggtatcagcgcaagtacggtcgcgaaatggactatcgacgaggtttttggtttcgtgcagaccttgactggctgcgaggaccaagccaggctattcaaagacgaggcccgcatagtcagggtcacacacgtgagcggaaaaaccttggtctggactgtagcacagctaggggatcttgtttgctctgatcaccttcaggaggggaagggaattttagaaactggcgtgcattccctgctttgtagcctcccaactcatctactggctaagctgagttttgcctccgattcgcagtattag

SEQ ID NO: 121801 - DNA, 1617 bp, Artificial Sequence
  Description of Artificial Sequence: Synthetic coding sequence
cagaaagcaataacagcccccgtgtcattattccaggactcccaggccgtgacgcacaacaagaacggctttaagttaggcatgaaactcgaggggattgaccctcaacacccctcaatgtacttcatacttactgtggccgaagtgtgcggataccgactaaggttgcactttgatggatactccgagtgtcatgatttttgggtgaatgccaattcccccgacattcatcccgctgggtggtttgagaaaactgggcataagttgcaaccccccaagggttacaaggaggaggaattctcctggtcccagtacttgagaagcacccgggcccaggcagcacccaagcacctgtttgtgtcccagtcccatagccctccacctctgggcttccaagtgggaatgaaactggaagcagtcgaccgcatgaacccttctctggtgtgtgtagcctccgtcacggacgtcgtcgacagccggtttctcgtgcacttcgacaattgggatgacacttatgattactggtgcgacccttctagcccttacatccatccggttggatggtgtcagaagcaggggaagcccctcacgccacctcaggactacccggatccagacaatttttgttgggagaaatatcttgaggagacgggggccagtgccgttcccacatgggcttttaaggttcgtcctcctcacagttttcttgttaacatgaaacttgaagccgtcgacagaaggaatccagccctgatcagggtcgcctccgtggaggacgttgaggaccacagaatcaaaatccatttcgatgggtggagccacggctatgacttctggatcgatgccgaccatccagacatacaccccgcgggttggtgctctaagaccggtcaccccctgcagcccccactaggccctagagagcccagttctgcgtcgccaggtggatgcccacccctttcataccggtcccttcctcacaccagaacttccaagtacagcttccatcacagaaagtgccccacacctggctgtgatggatcggggcacgtgactggtaagttcacagcacatcattgcctgtcgggctgcccactggcagagcgaaatcagagccgactgaaggcagaactgagcgacagtgaggccagtgctcggaaaaaaaacctgtctggcttcagtccgcgaaagaaaccccggcaccatggtaggatcggaaggccccccaagtatcgcaagattccacaggaagacttccagactctgaccccagacgttgtgcaccagtcccttttcatgagcgcactgtccgcacatcccgatcgatcattatctgtgtgctgggaacagcactgcaaactgctccccggtgtggccggcatctccgcttcaacagttgcaaaatggacaattgatgaggtgttcggttttgtgcagacgctaacaggctgcgaggatcaggcgagactatttaaggacgaaatgattgacggcgaagcctttttgttgttgactcaggccgatatcgtcaagatcatgagcgtaaaattgggtcccgcgctgaaaatctacaatgctatcctcatgttcaaaaatgcagatgataccctgaagtag

SEQ ID NO: 121802 - DNA, 2523 bp, Artificial Sequence
  Description of Artificial Sequence: Synthetic coding sequence
atgcacctggtcgcaggagattctcctggcagtggaccccacctacccgctacagcttttatcattccagcatcctctgccacactgggcctgccatcatctgcactcgatgtcagttgtttccctcgcgagccaatacatgtgggtgcaccagaacaggttgcaggctgcgagccagtgagcgccaccgtgcttcctcagttgagcgctgggccagcgagctcctctacatctactgttcgcctgctagaatggactgaggccgcggccccaccgccaggaggggggctccgctttagaatttcagaatataagccccttaacatggccggcgttgagcagcctccatcacccgaattgaggcaagagggggtgacggagtatgaggacggaggtgcacccgccggcgacggggaggcagggccacagcaggccgaagaccatcctcagaatcctcccgaggatccgaaccaggaccccccagaggatgactcaacttgccagtgccaagcctgtggaccacaccaagccgcagggcccgatctgggatcttcaaacgacggctgcccgcagctgttccaggagcgctccgttattgtggagaattcgagcggtagcacttctgccagcgaactactgaagcccatgaaaaaacgaaagcgccgcgaatatcagagtccctccgaagaagagagtgagccagaggctatggaaaaacaggaagaaggaaaagaccccgagggccaacctacagcgagtacgcccgaatccgaagagtggagtagctcccagcctgctacgggagagaaaaaggagtgttggtcctgggagtcctacctggaagagcagaaggccattaccgcccccgtgagtctctttcaggattctcaggctgtcacccacaataaaaacggattcaagttgggaatgaagttagaaggtattgatccccagcatccatctatgtactttatcttgacagttgcggaagtctgcggttataggctgcgcctgcatttcgatggttatagcgagtgtcacgacttttgggttaatgccaatagcccagacatacatcctgctggatggttcgaaaaaactggccacaagctgcagccacctaagggatataaggaagaggagtttagctggtctcaatacctgcgctccaccagagcccaagccgcacctaagcacttattcgtgtcccagagtcacagccctcctccactaggtttccaagtaggaatgaagcttgaggcagtagaccgtatgaacccttcacttgtgtgcgttgccagcgtaacggatgttgtggatagtcgatttcttgtccacttcgacaattgggatgacacctatgactattggtgtgatcctagttctccttatatccaccctgtagggtggtgtcagaagcagggcaagcctctgactcccccgcaggactacccggatcccgataatttttgttgggaaaagtacctcgaggagactggcgcaagcgccgtgccaacatgggcctttaaggtacgtcccccccatagcttcctggttaatatgaaactggaggctgtggatcgccgcaatcccgccttgattagagtcgccagcgtcgaggacgttgaggaccataggatcaagattcacttcgatggatggagtcacggctatgacttctggattgatgccgatcaccccgacattcatcccgcaggctggtgttccaagactgggcatcctctccagccccccttaggtcctagagagccaagctccgccagtccaggcggatgtccccccttgagttacagaagtttgccgcacactcgcacaagcaagtactctttccatcaccggaaatgcccaacaccaggctgcgacggtagtggacatgtcacgggcaagttcaccgctcaccactgtctaagcggctgtccactggctgagcgaaaccagtctcgcctcaaagctgaattgtcagattccgaggcctcagctcggaaaaagaatctgtcaggtttcagccccagaaagaagccacggcatcacggccgcattggccgcccccctaagtatcggaaaataccccaggaggatttccagacacttactcccgacgtcgtacaccagagtctcttcatgtctgccctctctgcacaccctgatcggagcctttccgtgtgctgggagcagcattgtaagcttttgccaggagtcgccggtatctcagccagcactgtggcaaaatggactatcgacgaagtgttcggattcgttcagacactgaccggctgcgaagaccaagctcggctttttaaggacgaggccaggatcgttcgggttacccacgtgtcaggcaagacacttgtgtggacagtggctcagctcggggacctggtgtgctccgaccacctccaggaaggcaagggcatccttgagaccggggtccatagtttgttatgcagtctgccaacacacctgctcgcgaagctgagcttcgcgagcgatagtcaatattag

SEQ ID NO: 121803 - DNA, 255 bp, Artificial Sequence
  Description of Artificial Sequence: Synthetic coding sequence
atggccggagtggaacagcctccatcccctgaactgaggcaggagggagtaacagaatatgaagatggaggtgcccccgctggggacggggaggctgggccccagcaggccgaggaccatccccagaatcctcctgaggatcccaatcaggacccccccgaggatgactcaacctgtcagtgccaagcctgcggacctcaccaggcagcaggcccagatttgggtagctctaatgatggttgccctcagctctag

SEQ ID NO: 121804 - DNA, 417 bp, Artificial Sequence
  Description of Artificial Sequence: Synthetic coding sequence
atgcacctcgtagccggagattcccccggtagcggcccgcatctgcccgcgactgctttcataatcccagcgagttcggcaacactcggactgccctcctccgccctcgacgtgtcttgctttccccgggagccgatccatgtgggcgcccccgagcaggtggctgggtgtgagcccgtgtctgcaaccgtgttgccacagctaagcgctgggccagcatcttcctcgacttccacagtgaggctccttgagtggacagaagctgcagccccgccccctggcgggggcctgaggttccgaatctctgagtataaaccactgaatatggctggcgtggaacagccaccaagcccagaacttcgacaggagggtgtgacagagtatgaagatggaggagcccctgcgggagacggatag

SEQ ID NO: 121805 - DNA, 2217 bp, Artificial Sequence
  Description of Artificial Sequence: Synthetic coding sequence
atgcggcgccgcgaaggacatggcacagattctgaaatgggacagggaccagtaagagagtctcagtcttccgatccgcccgctttgcaatttcgtatctctgaatataaaccgctgaacatggctggagtcgaacagccacccagtcccgagctccgacaggagggcgttactgagtatgaagacggtggagcccctgccggagatggagaggccgggcctcagcaggccgaagaccatccccagaatccacccgaagatcctaaccaggatcctccagaagatgacagcacttgccaatgtcaagcttgtggtccccatcaggcagctggcccggacctgggcagctccaacgatggctgtcctcaactctttcaggaaaggtcagtgatcgtggagaatagttcaggatccacgtccgcctcagaactattgaagcccatgaaaaagagaaaacgacgagaatatcagtccccatcagaggaagagtccgagcctgaggccatggagaaacaggaggagggcaaggaccctgaggggcaacccacagcatcaacccctgagtccgaggaatggtcctctagccaaccggcaacaggggaaaagaaggagtgttggtcttgggagtcttacctggaagagcagaaagcaattacggcgcccgtgagcttgtttcaggattcccaggctgtgacgcacaacaaaaacgggtttaagctaggcatgaagctcgagggaatcgatccccagcaccccagtatgtacttcattctgaccgtggcggaggtttgcgggtaccgcttacggctacatttcgatggatactctgagtgtcacgacttctgggtgaatgccaattcccccgacattcatcccgcaggctggttcgaaaagaccggccacaaactacagcctccgaaaggttataaggaggaagaattttcgtggtcccagtacctgagaagcacccgcgcacaggccgcacctaagcacctgttcgtgtcccagtcccattctccgccaccacttgggtttcaagtaggcatgaaacttgaggctgtagacaggatgaaccctagtctcgtgtgcgtcgcatcagtgaccgacgttgtcgactcacgcttcttggtgcattttgacaactgggacgacacatatgattactggtgcgacccatccagcccatacattcaccccgtgggttggtgccagaagcagggcaaacctctcaccccgcctcaggattacccagatcctgacaacttctgttgggaaaaatatctggaagagacaggggcatcggctgtacctacctgggcctttaaagtgagacctccccacagtttcctggttaacatgaagctcgaagctgtagaccgccgtaatcccgccctgataagggtcgccagcgtggaggacgtggaagaccaccgaataaaaatccattttgatggatggagtcacggctatgatttttggatagatgctgaccatccagatatccaccctgcaggctggtgctcaaaaaccggccatccattgcaaccccccttgggtcccagagagccctcttctgcgagccccgggggctgccccccgctgtcgtacaggagcctcccacacactcggaccagtaagtactcttttcatcatagaaagtgccccacacctggctgcgatgggagcggtcatgtaaccggaaaattcactgctcatcactgtctttcaggctgcccactggccgaaaggaaccagagtcgcctgaaggcagaactatcggatagcgaggcctccgcgcgcaagaaaaatttatcaggcttttccccccggaagaagcctcggcatcacggccgaattggtcggccgcccaagtaccgcaagattccgcaggaagacttccaaacactcaccccagacgttgtgcatcagagtctattcatgagtgcgctatctgcccatcctgaccggagtctgagcgtttgctgggaacagcattgtaaactgcttcccggcgtcgccggtatttctgcctcaactgtagccaagtggacgatcgatgaagtattcggattcgtccagacattaactgggtgtgaagatcaggcaagactgtttaaagacgaggtcagatgcaagtgccgagtgggcgacagggccggtgttaccgtgctgaagactgctggctcccgttgcccgccccaaaggcatttctgctag

SEQ ID NO: 121806 - DNA, 870 bp, Artificial Sequence
  Description of Artificial Sequence: Synthetic coding sequence
tagaccagcggcagcatgccaacaccgttaactttcacgctactcgccggctccaggcgacgggcgacatcctgtagcttacctaaaagcccccctcccctgggattccaagtgggtatgaaattggaggctgtcgacaggatgaatccctctctcgtttgtgtggcttccgtgacagacgttgtagatagtcgatttctggtccatttcgataattgggacgatacctacgactattggtgtgaccctagttccccgtacatccatcctgtgggatggtgccagaagcagggcaagcctttaaccccgccacaggactatccggacccggacaatttttgttgggagaagtacctagaagaaactggggcaagtgctgtccctacatgggcgttcaaggtccgccccccacacagttttctggtcaatatgaagctagaagcagttgaccggcgcaaccccgccctgatccgggttgctagtgttgaggatgttgaagaccacaggattaaaattcacttcgatggctggagccatggctatgatttttggattgatgccgaccacccggacattcaccccgccggatggtgcagtaaaactggccatcccctgcaacctcctctgggcccccgggagcctagttctgcctctccagggggctgtcccccacttagctatcgctcacttccccacacccgaacctccaaatactcattccaccaccgcaagtgtcctacccctggttgcgacgggtctggccatgttacaggaaagtttacggctcaccactgcctttcaggctgtcccttggctgaacgtaatcaatcccgtctgaaggctgaactttcggactctgaagcgtcttag

SEQ ID NO: 121807 - DNA, 327 bp, Artificial Sequence
  Description of Artificial Sequence: Synthetic coding sequence
atggccgccgcgatggacgtggacaccccctcaggaacaaactccggcgccggtaagaaacggttcgaagtgaaaaaatggaatgcggtggccctctgggcctgggacatcgtagtggacaattgcgctatctgcagaaaccacatcatggatctgtgtatcgagtgtcaggcaaaccaggcttctgccacatcggaggaatgtactgtggcctggggcgtctgtaatcacgccttccactttcattgcatttcacgatggttgaagacacggcaagtgtgccctttagataatcgcgagtgggagtttcagaaatatggccactag

SEQ ID NO: 121808 - DNA, 867 bp, Artificial Sequence
  Description of Artificial Sequence: Synthetic coding sequence
taaagaccacacctgcagaatcagtggcgtaagagaaagatgactacttggtcttgcctcgtcgctatgatcgtctccggcgttattaccgccgtatgggccgtgcgtgctgcccccatttggagaagccaggtgaagcagaagatgcgaattggaaaacaaggcaattgtcgccctccacggtgcatctgtagcgccctgggtctgttagcaccatggatggccgtggtgctcagccagggaaagccaccgaccaaaaaagccaaggtcttacataaggccgcctggtcagccaagatcggagcctttctacattctcagggaacaggccagttagccgatggcacgcccacggggcaagacgcgcttgtcctcggttttgactggggaaaattcctgaaggaccattcttataaagccgcccctgtgtcttgcttcaaacacgttcctctgtatgatcagtgggaagacgtgatgaaagggatgaaggtcgaggtgttgaacagtgacgccgtgttaccttctagagtttactggatcgcatctgttattcagaccgccggttaccgggttctgcttcgatatgagggatttgaaaatgacgcaagccatgatttttggtgtaatctaggaacggtggacgtccacccgattggatggtgcgctatcaattcaaaaatcctggtaccaccccgcactattcacgccaagtttacagattggaagggatacctgatgaagcgcctggtcgggagccgtacgctgccagtggatttccatataaaagttggatctgagccactgaccgacgtgccgccatctgccctgccctttttctgtatcctccacgccacccactggtcttag

SEQ ID NO: 121809 - DNA, 3762 bp, Artificial Sequence
  Description of Artificial Sequence: Synthetic coding sequence
atggtagtggccctgcggtacgtgtggccgcttttattatgctccccatgcctgctgattcagatccccgaggagtatgagggacaccacgtcatggaacctcctgtgatcacagagcagtcccccaggcgtctggtagtttttcctaccgatgatattagcctcaagtgcgaggcaagcggtaaacccgaggttcagttccgatggacacgcgacggcgtgcacttcaaacctaaggaggaactgggggtcactgtatatcagtctcctcatagcggcagctttactattactggcaacaattcaaacttcgcccagcggttccagggcatctatcggtgttttgcatcgaataagttgggtacagctatgagtcacgaaatccggttaatggccgagggggcccccaagtggcctaaggaaacagttaagcccgtggaggtggaagaaggagagagcgtggtcctcccctgcaatcccccgccatcagccgagccactgcggatctattggatgaattccaagatcctgcacattaagcaggacgagcgcgttacaatgggccaaaacggcaacctgtactttgctaacgtcctcacgagcgacaatcactccgactacatctgccatgcacactttccaggcaccaggaccatcatccaaaaagagccgattgatctacgcgttaaagcgacgaactccatgattgataggaagccccggctgctctttccaacaaattcaagctcccatttagtagccttgcagggccagcccctggtgcttgaatgcatagccgagggctttcccactccgaccattaaatggcttagacccagcggcccaatgcctgccgaccgggtcacttaccaaaatcataacaagaccttacagttattgaaagtgggcgaggaagacgacggagagtatcgctgtctggcagaaaattccctgggttctgcccggcacgcatactacgtgaccgtcgaggctgccccgtactggctacacaaaccacagtctcatctatacgggcccggcgaaactgcgaggctggattgccaggttcagggtaggccacagcccgaggtcacatggagaatcaacgggattccggtggaagaactggccaaggaccagaaatatagaattcagagaggtgcactgatcctttccaacgtacaacccagcgacaccatggttacgcaatgcgaggctagaaacaggcacggcctgctcctggctaacgcttacatctacgtcgtgcagctccctgccaagatactgactgcggataaccagacctatatggccgtgcaaggctctaccgcctatctgctgtgtaaggcgttcggcgccccagtgcccagtgttcagtggctggacgaagatggcacaaccgtcctccaggatgagagattcttcccctacgccaacggaactttgggaatacgtgacttgcaggccaacgacacaggacggtacttttgcctcgcagctaatgatcagaataacgtaacaatcatggcaaatttgaaggtgaaagatgctacccaaatcacgcagggcccacggagcaccatcgaaaagaagggctcacgagtcaccttcacatgccaggcctctttcgacccttccctgcaaccctcaataacatggaggggggacggccgcgatctgcaggaactaggcgacagtgataagtatttcattgaagatggaaggctggtgatccattctcttgactacagcgatcagggcaattactcttgcgttgctagcaccgagcttgatgtggtagaatcgagagcccagctcctagtggtcggtagccccgggccagttcctcggttggttctgtccgacctgcaccttctaacccagagtcaagtcagagtctcctggagtcctgccgaggatcacaatgccccaattgagaagtacgatattgaattcgaggacaaggaaatggctcctgaaaagtggtacagcttgggtaaagttcccggaaatcagacctcgaccaccttgaaattgtccccctatgtccattatacatttcgcgttactgccattaacaaatacggaccaggcgagccttctccggtgagtgagaccgtggttacacctgaggccgcccctgagaagaatccagtggacgttaagggcgaaggcaacgaaaccactaatatggtgatcacttggaaacctctccggtggatggactggaacgctcctcaggtccagtaccgcgtgcagtggcggcctcaggggacacgaggaccctggcaggaacagattgtgtctgatccattcctggttgttagcaacacctccacattcgtcccttacgagatcaaagtccaggcagttaactcacagggaaagggacccgaacctcaggtcaccattgggtattccggagaagactatccccaggctattcccgagctcgagggtatcgagatcctgaactcctccgctgtacttgttaagtggcggccagttgatttggcccaggtcaaaggacacttacgcggctataatgtgacttattggcgtgagggtagccaaaggaagcactcaaaaaggcacatacacaaggatcacgtagtcgtgccagccaacacaaccagcgtgatcctgtctggccttcgcccatatagttcttaccacctcgaggtgcaagccttcaacggtcggggttccggccccgcttctgaatttaccttcagcactcccgagggcgtgccagggcatccagaagcgctgcacctcgagtgtcagagcaatacatctctgcttttgcggtggcagcccccactgtcccataacggcgtcctaaccggatatgtgttgtcctaccacccattggacgaaggcgggaaagggcagctgagtttcaatctcagggatcccgagttgaggacccataatctgaccgacctctctcctcacctgaggtatcgctttcagctccaggccactaccaaggaagggcccggcgaggccattgtcagagaaggtggtacaatggcgctgagcgggatctcagactttgggaatattagcgctacagctggagagaattactctgtcgtgtcttgggttcctaaggaggggcagtgcaactttcggttccatatcctgttcaaggcccttggcgaagagaagggcggtgccagtttaagcccccagtacgtatcttacaaccaaagtagctacacccagtgggacctgcagcctgataccgattacgaaattcatttatttaaagaacgcatgtttaggcaccagatggctgtgaaaaccaatgggacgggacgagtaaggctaccgcctgctgggttcgccaccgaaggatggttcattggcttcgtatccgccataattctgttgcttctggtgttgcttatcctgtgtttcattaagaggtctaagggtggtaaatactctgtgaaagacaaagaggacacccaggtggattccgaggccaggcctatgaaagacgagaccttcggggagtatagcgacaacgaagagaaggcgtttggttccagccaaccttcactcaatggggatatcaaacccttagggtcggatgatagtctggccgattatggcgggtcagtggatgtccagttcaacgaggatggatcctttattgggcaatattcaggaaagaaggagaaggaggcagccgggggaaacgattcaagcggcgccacttctccaatcaatcctgccgtggccttagaatag

SEQ ID NO: 121810 - DNA, 3747 bp, Artificial Sequence
  Description of Artificial Sequence: Synthetic coding sequence
atggtagtagccttacggtatgtgtggcccctgctcttgtgtagcccatgcctcctcatccagatcccagaggagttgatggagccgcccgtgataacagagcaatccccacgacgcctggtggtcttccccactgatgacatctctctcaaatgcgaagcctcaggcaagcctgaagtacagttccgctggacaagggacggagtgcacttcaaaccgaaagaggaactgggagtgactgtctatcaaagtcctcacagcggtagctttacaattaccgggaacaacagtaatttcgctcagcggtttcagggcatttaccggtgcttcgcttccaacaaacttgggaccgccatgagccacgaaattaggctgatggccgaaggagctccaaaatggccaaaggaaaccgtcaagcctgtggaggttgaggaaggagaatcagttgtcttaccttgtaatccccctccgtcagccgaacccttgcgtatttattggatgaactctaaaatcctgcacattaaacaggatgaaagggtgacaatgggccagaacgggaatctttacttcgccaacgtgttaacttcagataatcactcggactatatctgtcacgcccactttcccggaactagaactatcattcaaaaggagcccattgacctacgggttaaagctactaatagcatgattgatcggaagcctcgtctgctgttccccactaactcaagctcccacctagtggcactgcagggccaacccctggtcttagagtgtattgcagagggcttcccaacccctacaataaagtggctgcgcccttcgggcccaatgccagccgatcgtgttacctaccagaaccataataagactctgcaactgctgaaggtaggagaggaggacgatggagagtatagatgcctggcagaaaactccctgggctccgcccggcatgcgtactatgtaacagttgaggccgctccctattggctgcataaacctcagtcccatctgtacggccctggagagacagcccggttagactgccaggtgcagggacgcccccagccagaggtgacttggcggattaacggcatcccagttgaagaactggccaaagatcagaaatacagaattcagcgcggcgcactgatcctgtccaacgttcagccaagtgacacaatggttacgcagtgtgaggccaggaatcggcacgggctccttctagcaaatgcctacatttacgtagtgcagctacccgctaagatcctcacggcagacaatcagacttatatggccgtgcaggggagtacagcataccttttgtgcaaagcctttggcgctcccgtaccaagcgtccagtggctcgatgaggatggtaccacagtgctgcaagacgaacggttctttccttatgccaacggcaccctcggtatccgggatctgcaggcgaatgatacagggcggtacttttgtctggctgctaacgaccaaaacaacgtgaccattatggctaaccttaaggtgaaagacgctacacagatcacacagggccctcgttcaaccatcgagaaaaagggtagcagagtgacattcacctgccaggcttcttttgacccttcactgcaaccgtctatcacatggagaggggacggcagagacctccaggaactgggagattccgataagtactttatcgaagacggccgactggtcattcattcactagactatagcgaccaaggcaactacagctgcgtggctagcaccgagctcgatgtggtggagtccagggctcaattactcgttgtcggaagccccgggcccgtgccaagacttgtgctctccgatcttcatctcctgactcagtcccaagttagggtgtcctggtcacccgccgaggaccataacgctccaatcgagaagtacgacattgaatttgaagataaagagatggcacccgagaaatggtattctctcggtaaagtaccagggaaccagacctccacgaccttaaaattgtccccatatgtgcactacacgtttcgggttactgccataaataaatatggccccggcgagccttcaccagtttcggagactgttgtcacacccgaggctgcaccggagaaaaatcctgtggatgtgaaaggtgaggggaatgaaactactaatatggtgataacctggaagcctctccgatggatggactggaatgccccacaggtgcagtatcgcgtccagtggcggccccagggcaccagaggcccctggcaagagcaaatagttagtgacccattcctggtcgtcagcaatactagcacctttgtgccttatgagattaaagtccaagcggtgaattcacagggcaaaggtcccgagccccaggtgaccattgggtattctggcgaagattacccccaggctatcccggagttggagggcatcgagatacttaatagctcagccgtcttagtcaaatggaggcctgtagacttggcccaggtgaaaggtcatctgaggggctacaacgtcacgtactggagggaaggatctcaacgtaagcacagcaaacgccatatacacaaagatcacgttgtggtgccggccaacactaccagtgtcatactatctggcttgagaccatatagctcttaccacttggaggtgcaggctttcaacggccggggatccgggccggcaagtgagtttacctttagcacacctgaaggagtccccggacatcctgaggcactgcacctggagtgtcaatccaacacctctctgttgctacggtggcagcctcccctctcgcacaatggggtgctcacaggctacgtcctgagctaccaccctctcgatgaagggggaaagggtcagctgtcatttaatctcagagacccagagctcaggacccataacctgacggacctgtctccgcatcttcggtaccggtttcagctgcaggccacgactaaagagggcccaggagaagcaatagtgagggagggtggaactatggctttgtctgggatatctgacttcggcaatatctccgctacagccggcgaaaattattccgtggtctcatgggtccctaaggagggccaatgcaactttagattccacattctgttcaaagccctgggtgaagaaaaggggggcgcctccctctcgccacagtacgtatcttataatcagtctagctacacccagtgggatctacagccagacacagactatgagatacacctgttcaaggagaggatgttccgacaccagatggccgtcaagacaaatggtaccggacgggtccgtctgccaccagctggcttcgctacagaaggctggttcattgggttcgtgagcgcaattatattacttctgttggtgttgctgatactttgtttcatcaaaaggagtaagggcggtaagtactccgtgaaagataaggaagatacccaggtggactccgaggctagacccatgaaagatgagaccttcggcgagtactctgacaacgaggaaaaggccttcggctcctcccagccatccttgaatggcgacattaagcctctgggctctgacgattcgctggccgactatggcggttccgttgacgtccagtttaacgaggatggctccttcatcggacagtactcgggcaaaaaggaaaaggaagcagctggtgggaatgacagttctggcgcaaccagtccaattaacccagctgttgcattagaatag

SEQ ID NO: 121811 - DNA, 3747 bp, Artificial Sequence
  Description of Artificial Sequence: Synthetic coding sequence
atggtggtcgccctaagatacgtctggccactgctgctgtgttcaccctgcctgctgattcagattccggaggagctgatggagcctcctgttattacagagcagtctccacgaaggctagtcgtctttcccaccgacgatatctcattgaagtgtgaggcaagcggaaagcccgaggtccagttcagatggactcgcgacggagtgcatttcaaacccaaagaagaactcggagttaccgtataccagagccctcatagcggctccttcacaatcactggcaacaactccaatttcgcacagcgattccagggaatttatcggtgcttcgcctcgaataagctcggcacagcaatgagccacgaaattcgcctgatggcagaaggcgccccaaaatggccgaaggagacagtgaagccggtggaggtggaagagggtgaatctgtcgtgctgccctgcaatcccccgccttctgctgagccacttcgcatttactggatgaactctaaaatcctgcatatcaagcaggatgagagagttactatgggacagaatggtaatctgtattttgctaacgtgcttacttcggacaaccattccgactatatttgccacgctcactttccaggtactaggacgatcattcagaaggaacctatagacttacgtgtaaaggccacaaatagcatgatagaccgcaagccccgactgttgttccctaccaattcttccagtcatctggttgccttgcaagggcaaccactggtgctggaatgcattgccgaaggtttccccaccccaacaataaaatggctccggccaagcgggccgatgcccgccgaccgagtgacgtaccaaaatcacaacaaaaccctgcagctgttaaaggtaggcgaggaggacgatggcgagtatcggtgcctggcagagaatagtttgggctcagctcgccatgcctactatgttacagttgaggccgctccctactggttacacaagccccagagccatctgtatggcccaggggagacagccagacttgactgtcaggtgcaaggtagacctcaacccgaggtcacctggagaataaacggcatccccgtggaagagctggccaaggaccagaaatatcgcatacagaggggagctctcatactgagtaatgtccaacctagtgacactatggttactcagtgcgaggctcggaaccggcatggactcctcctagctaatgcttatatttatgtcgtgcaactacccgcaaagattctgaccgccgataaccagacttacatggccgtgcaggggagtacggcttacttgctttgtaaggccttcggagctccagtcccctccgtccagtggcttgatgaagacggcacgaccgtgctgcaggatgagcggttcttcccatatgctaatggtactttagggatccgggatttgcaggccaacgataccggccgctacttctgcctagcagcgaatgaccagaataacgtgaccatcatggccaacctcaaagtgaaggacgccactcaaataactcaagggcctcgttctactatcgagaaaaagggcagccgtgtaactttcacttgtcaagcaagctttgatcctagtctccagccgagcattacttggaggggggacggacgcgacctgcaagagctaggcgacagtgataagtacttcatcgaagacgggcgcctggtaatccactctcttgattatagcgaccagggtaactattcatgcgttgcctctaccgagttggacgtcgtggaatccagagcccaactgcttgtcgtcggcagccctggccctgtgcctcgtctagtcctatctgatcttcatttactgacacagagtcaggtcagggtcagctggagtccggcagaggaccacaacgcccccatcgagaagtacgatatcgagttcgaagacaaagaaatggcgcccgagaagtggtacagccttggaaaggtgccagggaaccagacctctaccacccttaaactttctccctacgtgcactatacatttcgtgtgaccgcgattaataaatacggcccaggagaaccatcacctgtgtcagagaccgtggtgacacccgaggccgcgcctgagaagaatccggtggatgttaaaggagaaggcaacgagactacgaatatggtgattacttggaagccactgagatggatggattggaatgctcctcaggtgcaataccgagtgcagtggcgtccgcaaggcactcgggggccatggcaggagcagattgtgtcagacccttttctcgtagtgtccaacacatcgacctttgtgccgtacgagatcaaggttcaggccgtcaatagccaaggcaagggacccgagccgcaagttaccatcggctattcgggtgaagactatcctcaggccattcctgaactagaaggcatcgagatcctaaactcttccgccgtgcttgtgaagtggcgtccagtagacttggcccaggttaagggccatttgcgcggatacaatgtgacctactggcgcgaggggtcgcagcgcaagcactccaagagacatattcataaagatcatgtggtggttccagctaacacaacgtcagtgattctgagcggtctcaggccatattcttcctaccacctggaggtgcaggcctttaacggaaggggcagtgggcctgcctcagagtttaccttcagcacaccggagggcgtgccagggcatccagaagcactgcatctggagtgtcagtctaacaccagtctgcttctccgttggcagccccccctatcgcacaatggggttcttacaggctacgtgctttcttaccaccctctggacgaggggggaaaaggccagctttcattcaacttaagggatccagagttaagaacccataaccttacggatttgagtccccacttaagatatcggttccagctccaggccactacaaaagaaggcccaggcgaagccatagttcgcgaaggcgggacgatggccctcagtggaatcagcgacttcggtaatatttccgccactgctggagagaattactctgtggttagctgggtaccaaaggagggacagtgcaatttccgcttccacattctgttcaaagccctcggggaagaaaaaggcggagccagcttgagcccccaatacgtgtcctataaccaaagttcctacacccaatgggacctgcagcccgacactgattacgaaatacacctcttcaaggagcgcatgtttaggcaccagatggcagtcaagactaacggcacaggtcgggtcagactgcctcccgccggatttgctactgaaggctggtttattgggttcgtatccgctattatactgctgttgctcgtcctgctgatcctgtgcttcatcaagcgctcaaagggaggaaagtactctgtaaaggacaaggaggatacacaggtcgacagtgaggcaagaccgatgaaggatgaaacgtttggcgaatactccgacaacgaggagaaggccttcggtagttcacagccctcattaaacggggacattaagccgttggggagcgacgactccctggctgactacggcggtagcgtggacgtccagttcaatgaggatgggagctttatagggcagtattccggcaaaaaggagaaggaagccgctggggggaacgattcatcaggagccacatcccccattaatccagccgtagccctagaatag

SEQ ID NO: 121812 - DNA, 3774 bp, Artificial Sequence
  Description of Artificial Sequence: Synthetic coding sequence
atggtggtggcccttcgatacgtttggcccctgcttctttgttccccatgcctcctgatccagataccagaagagtatgagggccaccatgtaatggagcctccagttatcacagagcagtcccccaggcggctggttgtgtttccgactgacgacattagtctgaagtgcgaggccagcggcaaacctgaagtacagtttcgatggaccagggacggggtgcatttcaaacccaaagaagaactgggagttacagtctaccaatccccacattcgggctctttcacgatcactggcaacaactccaatttcgcccagaggttccaaggcatctatcggtgctttgcatctaataaactcggcaccgccatgtcccacgagattcgtctgatggctgagggcgccccaaagtggcccaaagagaccgttaagcctgtggaagtggaagagggggagtctgtggtgttgccatgcaatccacctccaagcgcagagccgctgcgtatctactggatgaattccaagatcctgcatattaaacaggacgagagagtgacaatgggccaaaacggcaacctgtactttgcaaatgtgctgactagtgacaatcattcagattatatttgccacgcacattttcccggcacgcgcacaattattcagaaagagcctatcgaccttcgggtcaaggcgaccaactctatgattgatagaaaaccgcggctgttattcccaacaaactcatcatcacacctggtggctttgcagggccagcctttggtcctggagtgcatcgcggagggattccccacacctactataaaatggctgcgccccagcggtccaatgcccgctgacagagtcacttatcagaatcacaacaagaccctgcagctgctcaaggtaggggaggaggacgatggtgagtatcggtgcctagctgagaatagtctggggtctgctcgccatgcctattatgtgaccgtggaggccgcaccctattggttgcacaaaccccagagtcacttatacggtcctggggagaccgcccgcctcgattgtcaggtccaagggagaccgcaacccgaggtgacttggaggattaacggaatcccagtggaagaattggccaaggaccagaagtatcgcatccagcgcggggcgctgatcctatctaacgtgcaaccctcagatacaatggtgacccagtgcgaagcccggaacaggcacggactgctactggccaacgcctatatctacgtcgtgcagctgcccgcaaagatcctaacagccgacaatcagacatacatggccgtgcaggggagtacggcttatctcctgtgtaaagcgttcggcgcccccgtgccgagcgttcagtggctggacgaagacggcaccactgttctgcaagatgagcgtttctttccgtacgccaacggaacacttggaatcagagatctacaggccaatgacaccggcaggtatttttgcctggccgcaaacgaccagaacaacgttacgatcatggccaacctgaaggtaaaggatgcaacgcagatcactcaaggcccaaggtcgacaatagaaaaaaagggatctcgggtgacattcacatgccaggcttcattcgaccctagccttcagcctagtatcacttggcgcggggacgggagggacctacaggagctgggcgattctgacaaatactttatcgaggacggtcgacttgttatacattccctggattatagtgaccaggggaactattcctgtgtcgctagtacagagctagatgtcgtagaatcaagggctcagcttttggtggtggggtcaccgggacctgtgccccggctagtgctcagcgacctgcacctcctgacacaaagccaagtgagggtttcctggtccccggctgaggaccacaatgcacccattgaaaaatatgatattgagttcgaggataaagagatggcgccagaaaaatggtatagtctgggaaaggtgccagggaatcagacaagtacaacgcttaagctgagcccctacgtgcactatacctttcgggtaaccgccatcaataaatatggtccaggcgaaccgtctcctgtgtcggaaaccgtcgtaacccctgaggccgcacccgaaaaaaatcccgttgacgtcaagggtgagggaaatgagacaactaatatggtaatcacatggaaacctttgcggtggatggactggaacgcccctcaggttcagtaccgggtgcagtggcgccctcagggtacacgagggccatggcaggaacagattgtgtccgacccattccttgtggtctctaatacctcgacctttgtcccgtatgagattaaggtccaagccgtgaactctcaggggaaagggcctgagccccaagtaacgattggatactcaggcgaagactacccccaggctatcccagaactcgaaggaatcgagatcctcaactctagtgccgtgctcgtcaaatggcgccctgtggatcttgctcaggtgaaaggacacctaagggggtacaacgtgacctattggcgcgagggttcacagcgtaaacattccaaacgccatatccacaaggatcacgtcgtggtccctgcaaacacaactagtgtcattctgagtggcctacggccgtacagcagctaccatctggaggttcaagcgtttaatggaaggggttccgggccagctagcgagttcacgttctccactccagaaggagttccaggacatcccgaagcgctgcacctggaatgtcagtcaaacacaagcctgctcttacggtggcaacctcctctgtctcacaatggggtactaacggggtacgttcttagttaccacccattagatgagggcgggaaagggcagctctccttcaatttgcgcgatcccgaattgcggacgcataacctgactgacctgagcccccacctgcgctacaggtttcagctgcaagctacgaccaaagaaggtcccggtgaagcaatagtccgtgaggggggcactatggctttatcgggcatatccgacttcggaaacatcagcgcaactgccggcgagaactacagtgttgtgagctgggttccaaaggagggacagtgcaactttcggtttcatatcttgttcaaggctctcggcgaggagaaaggtggcgcgtccttgagcccccaatatgtgagctacaaccagtccagttatacccagtgggatcttcagccagatacagactacgaaatccacctgttcaaggaaaggatgttccgacaccagatggccgtgaagaccaacggcaccggacgcgtcagattgccgcctgccggcttcgcaactgaaggatggtttattgggttcgtttctgcgattattttactgctgctggtcctgcttattctgtgctttataaagcgatctaagggcggcaaatactcagtcaaggataaggaagacactcaggtggactccgaggcgagaccaatgaaggatgaaacttttggcgagtaccggtctctggaatctgacaatgaggagaaggctttcggctcatcacagcctagcctaaacggggacattaagccattgggctcagatgattcactggcagattatggtggcagtgtggacgttcagttcaacgaagatggcagttttatcggacaatacagcgggaagaaggagaaggaggccgctggcgggaacgattcttccggcgccacaagcccaatcaaccctgccgtcgcgctcgagtag

SEQ ID NO: 121813 - DNA, 3774 bp, Artificial Sequence
  Description of Artificial Sequence: Synthetic coding sequence
atggtggtggcactgaggtacgtttggccactcctgctgtgttctccttgtctactgatacaaatcccagaggagtacgaaggccatcatgtcatggagcccccagtgattaccgagcagagcccccgacggctggtcgtgttcccaaccgacgacatctctctgaagtgtgaggcaagtgggaagccagaggtgcaattcaggtggaccagggatggtgttcacttcaaacccaaggaggaactcggtgtgacagtctatcagtcacctcacagtggctcttttaccattacaggtaataattcaaactttgcccaaagattccaggggatctatcgatgctttgcttcgaacaagttagggactgcaatgagccatgagataaggcttatggctgagggcgccccaaagtggccaaaggagaccgtgaagccggttgaagtcgaagaaggcgagagcgtagtgctgccttgcaatccgccgccatcagccgagccactgagaatctattggatgaactcaaagattcttcatattaagcaggatgaacgagtcactatgggtcaaaacggcaacctgtacttcgctaacgtgctcacatccgacaaccactcagactatatatgtcatgcccactttcctggaacgagaacgattatacaaaaggaaccaattgatcttcgggtaaaggctactaacagcatgatagaccggaaacctcgccttctctttccgaccaacagctcaagccacctggttgccttgcagggccagcctcttgtgctggaatgcatcgccgaagggttcccaacccctacaattaagtggctgcggcctagcggccctatgccagctgaccgagtcacctaccagaatcataataagactttgcagctgctgaaggtcggcgaagaagatgatggagagtaccgttgtttagccgaaaattcactgggttcagcacgtcacgcatattacgttacggtcgaagctgccccgtactggctgcacaagccacaatcacatctatatggccctggagagactgcccggctggactgccaggtgcagggccggccccagcctgaagttacatggcgaatcaacggtatccccgttgaggaacttgcaaaggatcagaaataccggatccagcgaggggctctgatccttagtaacgtgcagccaagcgatactatggtgacccagtgcgaagctcgtaatagacacggcctgttactggcgaacgcttatatctacgtcgttcaattacctgccaagatcctaacagccgataatcaaacctacatggcagtacaaggatccaccgcatatctgctctgtaaggcattcggagctccggttccttcggtgcagtggctggatgaggacggaactactgtcttgcaggatgaacggttttttccttacgctaatggtactctaggtattagggatttgcaggcaaatgacactggccggtatttttgcctggccgcaaatgaccaaaataacgtgacaatcatggctaatctgaaggtgaaagatgctactcagattacacaggggcctcgctcaaccattgagaaaaagggaagccgggttacgtttacatgtcaggctagctttgacccctcactccaaccttctatcacgtggagaggggacggaagagatctgcaggaactcggtgatagcgacaagtactttattgaggacggccgattagtaatacatagcctggactacagtgatcagggcaattactcctgcgtggccagcaccgaacttgatgtggtggaatcacgcgctcagttgcttgtcgtgggttcgccaggtccagtgccgaggctggttttgtctgacttacatttactgacacagagccaggtgcgagtttcatggtcccctgctgaggaccataatgcaccaatcgagaagtacgatatcgagttcgaggacaaggagatggcacctgaaaagtggtatagcttagggaaagtaccaggcaaccagacaagcacaacgctgaagctgagtccgtatgtgcattacacattccgggtgacggctatcaataagtacggcccaggtgagcccagcccagtgagcgagaccgtcgtgacgccggaggcggcgcctgaaaagaatccggtggatgttaaaggagaaggaaacgagacgacaaacatggtcataacctggaagccactgaggtggatggattggaacgccccccaggtgcagtatagagttcagtggagaccccaggggaccaggggcccctggcaggaacagattgtttcagacccgttcctcgtggtatcaaatacaagcacattcgtaccctacgaaattaaagtgcaagcagtcaactctcaaggtaagggacccgagccccaggtgactatcggctacagcggagaagattaccctcaggctatccctgagctcgaaggaatagagattcttaactcgagcgccgtgctggttaaatggcggcccgttgatttggcacaggtgaaaggccacttgagggggtacaacgtaacgtattggagagaggggagccaaaggaaacattcgaagcgccatattcataaagaccacgtggttgtgcctgctaacactacttctgtcatcctgagtggccttcgtccctatagtagctatcacctggaggtgcaagctttcaatggccgcgggtccggccctgctagcgaatttaccttctctacccccgaaggagttcctggtcatcccgaggccttgcacctcgaatgccagagtaatacttctctgctgctcaggtggcagccccccttgagccacaacggggtactaacgggctacgtgctatcatatcatcctctggatgaggggggtaagggccagctcagtttcaatctcagggaccctgagcttagaacgcacaatctgactgacctgagccctcacctgcgctatagattccaattgcaggctaccactaaggagggaccaggggaagcaattgtccgcgaaggggggacaatggcactgtctggaatctccgactttggaaacatcagtgccactgcaggggagaactattctgtggtaagctgggtgcctaaagaggggcagtgcaactttcgcttccacattctgttcaaagcccttggggaagagaagggaggagcgagtttgtcccctcagtacgtttcctataatcagtcttcctacacccagtgggatctgcagcccgacacagactacgagatacaccttttcaaggaaaggatgttccgccatcaaatggctgtgaaaaccaatggaaccggccgggtcagattgccccccgccggatttgcaaccgaagggtggttcatcggatttgtaagcgccatcatccttctgctcctggtgttgctgattctctgttttatcaaacgctccaaagggggcaagtactccgtcaaagacaaagaagatacacaggtggactcagaggctcgtccaatgaaggatgaaacttttggtgaatatcgaagtctagaatcagacaatgaggagaaggcctttggaagctcccagcctagtctgaacggagacatcaagccactcggttcagacgactcgttagcggattacggcgggagtgtcgatgtgcagttcaatgaagacggcagctttataggccaatactctggcaagaaggaaaaggaggccgcaggtgggaatgacagctctggagccaccagccccatcaaccccgcagtcgccctcgagtag

SEQ ID NO: 121814 - DNA, 456 bp, Artificial Sequence
  Description of Artificial Sequence: Synthetic coding sequence
atggtcgtggctctaaggtatgtctggcccttgctcctgtgttcaccatgcctgctgattcaaatcccagaggagtacgagggacatcatgtgatggaacctcctgttatcacggagcagagccccaggagattggttgtattccccactgatgatatttctctgaaatgtgaggcttccgggaagccagaagtccagtttagatggacccgggacggtgtgcacttcaagcccaaggaggaactcggggttactgtttaccaaagcccacacagtggatcgtttactattactggcaataactcaaattttgctcagagatttcaaggaatttacaggtgttttgcgtctaacaagctggggaccgctatgagccacgaaatcagactgatggccgagggagctccaaagtggccaaaggaaactgttaaacccgtggaggtggaggaaggctag

SEQ ID NO: 121815 - DNA, 255 bp, Artificial Sequence
  Description of Artificial Sequence: Synthetic coding sequence
atggtagtggccttgcggtacgtatggcccctattattgtgcagcccctgtttattgatacagatccccgaagagtacgagggacatcatgtgatggagccgccggtcataactgaacaaagtcccaggcgactcgtggtattccccacagacgatatttcactgaaatgcgaggccagcggtaaacccgaggtgcagttccgttggactcgggacggcgtgcactttaaacctaaggaggaacttggagtctag

SEQ ID NO: 121816 - DNA, 3768 bp, Artificial Sequence
  Description of Artificial Sequence: Synthetic coding sequence
atggtggtggccttgcggtatgtgtggccccttctgctttgctcaccctgtttgctaattcagattcctgaagaaagttttcctggacaccgagtcgtaatggagccacccgtaatcacagagcagtctccccgccgattggtggtgtttccaacagacgatataagtttgaagtgtgaagctagtggtaagcccgaggtacagtttagatggaccagagacggtgtacatttcaaaccaaaggaagagctcggtgtgaccgtctatcagagtcctcattccgggtcatttactattactggcaataacagcaacttcgcccagagattccaaggtatttacaggtgcttcgctagtaacaaactagggactgcgatgtctcacgagattaggttgatggccgagggtgcacccaagtggccaaaagagacagtcaagccagtggaggttgaggaaggagagtccgtggttttaccttgcaatcctccacctagtgccgagcctctgaggatctattggatgaacagcaagatactccatatcaaacaggatgagcgagtcacgatgggccaaaacgggaacttgtacttcgcaaacgtgctcaccagcgacaaccatagtgattacatctgccacgcgcactttccggggaccagaaccatcatccagaaggagccaatcgacctccgggtcaaagccaccaactcaatgatcgatcggaaaccgaggctcctcttccccaccaattccagctctcatctagtcgccctccagggacaaccactcgtacttgagtgcatcgctgagggcttccccacgcccacaataaaatggctgcgcccatcgggcccgatgcctgcggaccgagtgacatatcagaaccacaacaagactctacagcttttgaaagtcggggaggaggacgacggcgagtacagatgcctagcggagaatagtctgggctctgctcggcacgcatattatgtgactgtcgaagcggccccctactggctgcacaagccacagtcccacctctacggaccgggcgaaactgccaggctggactgtcaggttcaaggccgaccgcagcccgaggtcacatggaggatcaatggtatcccagtcgaggagctagccaaagatcaaaaatacagaatccagagaggagcgttgatcctgtctaacgtgcaaccgtccgacactatggtgacccagtgcgaagcgcgtaacaggcacggactgctgctggctaatgcctacatttatgtggtacaattgcccgcaaaaatcctgactgccgataatcagacctacatggctgtacaggggtctacggcctacctcctatgtaaggcttttggtgcacccgtgcccagcgtccagtggttggacgaggacggaactacagtcctgcaggacgaaaggttcttcccatacgctaacggcacgctgggaataagagacctccaggctaacgacaccggccgttacttctgcctggctgcgaatgaccagaacaacgtgacgatcatggccaatctgaaggtgaaggatgcaactcaaatcacgcagggtcccaggtcaacgatcgagaaaaagggctcccgagtgacatttacatgccaagcgagctttgatccctcacttcaaccttctattacctggagaggggacgggagagaccttcaggagctgggagactccgataagtactttattgaggatggaagactagtaattcattccctggattatagcgatcagggaaattacagctgcgtcgcctccaccgagcttgacgtggttgagagccgcgcccaactcctggtagtgggttctcccggtcccgtacctcggctggtgcttagtgacctgcacctgttgacccagtcccaggtgcgtgtgagttggagtcccgccgaggaccataatgctccaatcgagaaatacgacatcgagttcgaggacaaggaaatggctcccgagaaatggtactctctcggtaaagttcctggtaatcagacttctaccactttgaaactcagcccctatgttcattacacatttagggtaacggctataaacaaatacgggccaggcgaacccagtcccgtgtctgagactgtcgtaacccctgaagcagctcccgagaagaatccggtcgatgtcaagggagaaggcaatgaaaccactaatatggtgatcacatggaaacccctaaggtggatggattggaatgcgcctcaggttcagtacagggtgcagtggcgcccccaagggacgagggggccgtggcaggagcagattgtgagtgacccattccttgtcgtaagtaatacctctacctttgtgccatacgaaataaaagtgcaggcagtcaacagtcagggtaaaggaccggagccacaggtaactattgggtattctggggaagactaccctcaggctataccagagttggaaggcattgagatcctgaatagtagtgctgtcctggtcaagtggcgtcctgtggacttagcacaagtaaaggggcatctccgagggtataacgttacatactggcgcgagggcagccagagaaaacattctaagcgccacattcacaaggaccatgtggtcgtacccgcaaatacgacctccgtgatactgtcaggactccggccctattcctcgtatcacctcgaggttcaagccttcaacgggaggggcagtggtccagcttccgagttcaccttctccactcccgagggagtgccgggccaccccgaggccttgcacctagaatgtcagtccaacacctctctcttactgaggtggcaaccgcccctttcgcataacggggtcctgactgggtatgtcctctcgtatcaccccctggacgaagggggtaaaggccagctcagcttcaatctgcgggatcccgagctgcgtacccacaacctgaccgatttgagtccccacctcagataccgcttccaactccaggcgactaccaaggaagggcccggagaggctattgtccgcgagggagggaccatggccctgtctgggatctcagattttgggaatattagcgctacagcgggagagaactactctgtcgtaagctgggtccccaaggaggggcaatgcaactttagattccatatcttgtttaaggctctcggtgaggaaaagggcggagcatccctatccccccagtatgtcagttacaaccagagttcatatacccaatgggacctacagcccgatactgactatgagattcacttattcaaagaacgcatgtttcgacaccagatggccgtgaagactaacgggacaggccgcgtgcggctcccaccagccgggtttgctactgaagggtggttcatcggcttcgtctcagcaatcattctgttattacttgtactgctaattctttgctttattaagcgtagcaaaggaggcaaatattcagtcaaagacaaagaagacactcaggtcgacagcgaggcaagacccatgaaagacgaaacatttggggagtacagtgataacgaggaaaaggcgttcggatcaagtcagccatccctgaacggagatatcaagccattgggcagcgatgattctctggccgattacggcggcagtgtcgatgtccagtttaacgaagacgggagttttatcggacagtattcaggtaagaaggaaaaagaagccgccggtggaaatgattcttccggagcgacaagccccatcaaccctgccgtggcgcttgagtag

SEQ ID NO: 121817 - DNA, 351 bp, Artificial Sequence
  Description of Artificial Sequence: Synthetic coding sequence
atggctgaaggtgctccgaaatggccgaaggaaactgttaagcccgtggaagtggaggaaggtgaaagcgtcgtacttccgtgcaaccccccccctagtgccgagccattgagaatctattggatgaatagcaagattctgcatataaagcaggacgagcgcgttacaatgggtcagaacggcaatttgtactttgccaacgtcctaaccagcgataaccactcggactacatctgtcacgcccatttccctgggacaagaaccatcatccagaaggaacctatcgacctgagagtgaaggcgactaatagcatgattgacagaaaaccacgattactgtttcctacttag

SEQ ID NO: 121818 - DNA, 3780 bp, Artificial Sequence
  Description of Artificial Sequence: Synthetic coding sequence
atggtggtggcgttgagatacgtgtggcccttgctgctgtgctctccctgcctcctcatccagattccagaggagagtttccccggacacagggttgtgatggaacccccagtgatcaccgagcagtcccccaggagactcgtagtcttcccaactgatgacatcagcctgaaatgcgaggcaagcggcaaacccgaagtccagttcagatggacccgcgacggtgtacacttcaaacctaaagaggagttgggcgtcactgtgtatcagtcaccccacagcggcagcttcaccatcaccggcaataactccaattttgcccagcgatttcaaggcatctaccgttgctttgcctctaacaagctcgggactgccatgagtcatgagattcgtttaatggccgaaggtgccccaaaatggcccaaggaaactgtcaagcctgttgaggtggaagagggtgaatctgtggtgctgccgtgcaaccctccacctagcgccgagccactgcgcatttattggatgaattcaaagatattacatatcaaacaggatgaacgggtgaccatgggacagaatggtaatctctactttgcaaatgtgctgacaagcgacaaccacagtgactacatatgtcacgcccattttccaggcaccaggaccatcattcagaaggagccaatcgacctccgggtaaaggcaactaactccatgattgaccgtaagccgcggctcctgtttcctactaactcctctagccacctggtcgcgctgcagggacaacccctagtactagagtgtattgccgaaggattcccgacgcctacaattaaatggctccgtccatccggcccgatgccagcggaccgagtgacttaccagaaccacaacaagaccctgcagctgctcaaagtaggtgaagaggacgatggagagtatcgttgcttagctgaaaattccctggggtcagctagacacgcctactacgtgactgtcgaagccgcaccatactggttacataagccgcaatctcacctctacggccccggtgaaaccgcccgactggactgccaggtgcaggggcggcctcagccagaagtgacatggcggataaatggcattccggtggaagagctggcgaaagaccagaagtaccgcatacagcggggggctctcattctgtccaacgtgcaaccttcagataccatggttacccagtgcgaagcccggaatagacatgggcttctccttgccaacgcgtacatctacgtagtgcagctgccagctaagattctgaccgcagacaaccaaacttacatggctgtgcagggaagcacagcctacctattatgcaaggctttcggggctcccgtccctagtgtacagtggctggacgaggacgggacgaccgtactccaggacgagcgattctttccgtatgctaacggtacattaggtattagggatttgcaggcaaacgacacaggaaggtatttttgtctggcagccaacgatcaaaacaacgtgaccatcatggctaatctgaaagtaaaggatgcgacccagattactcagggtcctcggtcaacaatcgaaaaaaagggcagcagggtgacattcacttgccaagcctcttttgacccatctctccaaccctctatcacttggagaggagatggcagggacttacaggaactcggcgactctgataaatacttcatagaggatggccgtttagtgatccacagcctggactactccgaccaagggaactattcctgtgtcgcttcgacggaactggacgtggtggagagcagagctcaattgcttgttgtgggatctcctggacctgttccaaggctggtactatctgacctccacttactgacacagtcccaggtccgggtgtcatggtcccctgctgaggaccataacgcccctattgaaaagtatgacatcgaatttgaggataaggaaatggccccagagaagtggtattcccttgggaaagtaccaggcaatcagacgtctacaactctgaaactatctccgtatgtccactacaccttcagggtgacggcaataaataagtatgggcctggggagccatctccagtgtccgagacggttgtaacccctgaggctgccccagagaaaaacccagtcgatgtcaagggggaaggtaacgagaccactaatatggtaatcacctggaaaccgctgagatggatggattggaacgccccccaggtgcaataccgcgtgcagtggaggccccagggaactcgggggccatggcaagagcagattgtgtccgatccatttctagtggtgtccaataccagcacttttgtgccgtacgaaattaaggtccaggctgtgaatagccagggtaagggtcctgagccacaggtaacaatagggtattctggagaggactatccgcaggcgattccggagctcgaaggaattgaaatcctgaacagcagcgctgtgcttgtcaaatggaggcctgtggatctcgctcaggtcaaaggtcacctgcgcggatacaacgtcacctactggcgcgaaggatcacagcggaagcactcaaagagacacatccacaaggatcacgtggtagttcccgccaacacgacaagcgttattctttctggtctgaggccttattccagctatcatttggaggttcaggcattcaacgggaggggttccggaccggctagcgagttcacatttagcacacccgaaggagtgccgggacatccggaggccttgcacctggagtgccagtccaatacatcactactgctgcgttggcagccacctctcagtcataatggtgtcctgactgggtatgtactgtcctatcatcctctggacgagggcggaaagggccaactgagcttcaacctccgagacccagaactgagaacacataatttaacggacctgagcccacacctcaggtatcgattccaattacaggccacaacaaaagagggtccgggggaggcgatcgtccgcgaaggtggcactatggctctttccggtatttcggatttcgggaacatttccgcaactgccggagagaactattccgttgtcagctgggttcctaaggaagggcaatgcaacttccggtttcatatattattcaaggctctgggagaagagaagggtggcgccagcctctctccacagtacgtttcgtataaccaaagttcgtacacacagtgggatctgcagccggacacggattacgagatacatctctttaaggaacggatgtttcgccatcagatggctgtgaagacaaacggcaccggccgcgtgaggctgccaccagccggatttgcaaccgagggctggtttatcggatttgtcagcgctattatcttgctgctgctcgttctactcattctctgcttcatcaagcgcagtaaaggcggaaaatacagtgtgaaagataaggaggacacccaggtggatagtgaagccagacctatgaaggatgaaaccttcggtgagtatcgctccctggaaagcgacaatgaggaaaaagccttcggatcgagccagccaagtttgaacggggacatcaaacccttggggtccgatgacagcttagccgattacggcgggagcgttgacgttcaattcaacgaggacggatctttcatcgggcaatacagtggaaagaaagaaaaagaagccgctggagggaacgattcatctggcgccaccagcccaatcaatccagctgtggccctggagtag

SEQ ID NO: 121819 - DNA, 1326 bp, Artificial Sequence
  Description of Artificial Sequence: Synthetic coding sequence
atggttccagcccttagatatcttgtgggggcatgtgggcgggccagaggcctgttcgctggcgggagccctggagcctgcggattcgccagcggtcggccccggcccctgtgcgggggatcccgaagcgcctctacaagcagctttgatattgtgattgtgggaggagggatcgtaggactggcttccgctcgcgccctaattctgagacaccccagcttatctatcggggttctggagaaggaaaaagacctggccgtacaccagacgggccataactcaggcgtgatccactccggcatatactataagcctgagagtctgaaagctaagctgtgcgtgcagggggctgcacttctgtacgaatattgccagcagaaggggatctcttacaagcagtgtggaaagctgattgtggccgtggaacaggaggagattcctagattgcaggccctgtatgagaaggggctccaaaacggagtgcccggcttacggctgatacaacaggaagatatcaagaagaaggagccatattgtaggggcctgatggccattgactgcccacacaccggcatcgtcgattatcgccaggttgcactctccttcgcccaagattttcaggaagcaggcgggagcgtgttaaccaactttgaggttaagggaattgagatggccaaagaaagcccatctcgctctatcgatggcatgcaatatcccatcgtgatcaaaaataccaaaggagaggagattaggtgccagtacgtcgtgacatgtgctggcctgtactctgatagaatcagcgagctgtccgggtgcactcctgatccccggatagtacctttccggggtgactatctgctactgaaacccgaaaaatgctacttagttaaggggaatatatatccagtgcccgattcccgatttccattcctcggcgtgcacttcactcctcggatggatgggtctatctggttgggaccaaacgcagtgctggcctttaagagggaaggttatagaccttttgactttagcgccacagacgtcatggacattattattaactcaggactgatcaagctggcatcgcagaacttttcatatggagtaaccgaaatgtacaaagcgtgtttcctcggcgccactgtaaaatacctgcagaagtttattcccgagataactatctctgacatcttgcgccaggtcgccgtgcgcggccctagctggctgtggcagcagccaatgaaagtgtcggacaataatatatactgtttcctgtggcgctgcttcgctttactgctcacaggaagcgcctgttccttcaaatag

SEQ ID NO: 121820 - DNA, 1392 bp, Artificial Sequence
  Description of Artificial Sequence: Synthetic coding sequence
atggtgccggcccttagatacttagtgggcgcctgtggccgggcaagaggcctgttcgccggcggcagtccaggagcctgtgggtttgcgtccggcaggccccgccccctgtgtgggggctctagatcagctagtacgagttcttttgacatagtgattgttggcggtggaatagtcgggttggcatcagcccgggctctcatcctgcgacacccgagtctaagcatcggggtactcgaaaaagaaaaggatctcgcagttcaccagaccggtcataactctggcgtaatccactcaggcatatattataagcctgaatccctcaaagccaaactgtgcgtgcagggcgccgcactcctctatgaatattgtcaacagaaggggatttcctacaagcagtgcggtaaattaatagtcgccgttgagcaagaagaaatcccacgcttgcaggctctctatgagaaggggcttcagaacggggtgccaggactcagactgattcagcaggaagatatcaagaagaaggaaccgtactgccggggccttatggccattgactgccctcatacaggcattgtggactacaggcaggttgccctatctttcgctcaggactttcaggaggctggtggatcggtgctgaccaatttcgaggtaaagggtattgaaatggccaaggaaagcccatctcggtccattgacgggatgcagtaccccatcgtgattaagaacactaaaggagaagagattagatgtcagtacgtcgtgacatgtgcagggctgtattctgatcggattagcgaattgtcaggctgcaccccagacccccggattgtccccttccggggagactacctgctgctgaaacctgagaaatgctatttggtgaagggtaacatttaccccgtgccagactcccggtttccattcctgggagttcactttactccaagaatggacggctccatctggctggggcctaacgccgtgctggcatttaagcgtgaaggttacaggccctttgactttagcgcaaccgatgtcatggacataatcatcaattccgggctgatcaagttagcttcccagaacttctcctatggtgttactgagatgtataaggcatgcttccttggggcgacagtaaagtacctgcagaagtttattcccgagattactattagcgatatcctgcggggacctgctggagtgcgagctcaggccctcgaccgagatggcaatctagtagaagatttcgtttttgatgccggagtgggcgacatcgggaatagaatccttcacgttagaaatgcaccgtctccagcagctaccagctctatcgctattagcggcatgattgcggatgaggtccagcaaagattcgaattatag

SEQ ID NO: 121821 - DNA, 1392 bp, Artificial Sequence
  Description of Artificial Sequence: Synthetic coding sequence
atggttcccgctctgcgttacctagtgggggcttgcggccgagcccgcggtcttttcgccgggggttctccgggagcttgcggttttgcctcaggccgcccccgcccactgtgcggcgggtctcgtagtgcatccactagcagtttcgacatagtgatcgtggggggagggatagtgggtctggcctccgccagagccctaattctgcggcacccgtccctcagtataggagtcttagaaaaggaaaaagacttagctgttcaccagactgggcacaactcaggagtgatccattcaggaatctactataaacccgagtcactgaaagccaaactttgcgtacagggagccgcccttctctatgagtattgccagcagaaaggcatttcttacaaacagtgtgggaaactaatcgtcgccgtcgagcaggaagaaatccctcgtctgcaagctctatacgaaaaaggcctgcagaatggggttccagggctccgactgatccagcaggaggacatcaagaagaaggagccatattgccgcggcctcatggcaattgactgcccacacaccggcatcgtggattaccgtcaggtggccctctccttcgcccaggatttccaggaggcgggggggtcggtccttacaaactttgaggtgaagggcatagagatggccaaggagagcccctctaggtcaatagatggaatgcagtaccccattgttattaaaaataccaagggcgaggagatcaggtgtcaatacgtcgtaacatgtgcaggcttatattccgaccgtattagtgaactgtctggctgtaccccagaccccagaattgtgccatttcgaggagactacttactgctcaagcctgagaaatgctatctcgttaagggaaacatatatcccgtgccagacagccgattcccatttcttggggtgcactttacgcctaggatggacggctcaatatggttgggaccgaacgctgtcctggcgttcaaacgcgagggctatcgcccatttgatttcagcgcgactgatgtgatggatataataatcaactccggcttaatcaagctggctagccaaaactttagctacggagtgaccgaaatgtacaaagcctgctttctcggcgccacagttaagtatctgcaaaagttcatcccagagatcacaatttctgacattctccgaggaccagcgggggtccgagctcaagcactggatagagacggaaatctcgtcgaagattttgtcttcgatgccggtgtcggggatattggtaaccgtatcctgcatgttaggaacgcaccgtcccctgctgcaactagctcgatcgcgatttccggcatgattgctgatgaggttcaacagaggttcgagttgtag

SEQ ID NO: 121822 - DNA, 3060 bp, Artificial Sequence
  Description of Artificial Sequence: Synthetic coding sequence
atgctgtggcgggtcttgcttagtaagcgccctcctttcccccaccctgaactggattttcaggaagcccccatcccgagctgtccaggacgcctaccaggacgaaaaaacagcgtggctctcgcggcggcgccacgcaaagagcctaccggtgaccgcgaaaaaccattgccgttcccagtactggcgccctttagtaatccagagcactccgcaccggcaaaagtggtccgcgccgccgtgcccaagcagaggaaaggatccaaggtcggggatttcggtgacgccatcaactggcctacacccggcgaaatcgctcataagagtgtccagccccaatcccacaagccccagccaacacgcaagctgccgcctaagaaggatatgaaggaacaggagaaaggcgaagggagcgattcaaaggagagccccaagacgaaaagcgatgagtctggtgaggaaaaaaacggcgatgaagattgtcagcgaggtggccaaaaaaaaaaaggcaacaagcacaagtgggtgcccctgcagatagatatgaagccagaagtcccccgcgagaaactagcatctcgcccaactagacctccagagccccgacacatcccagctaataggggcgagataaagggatcagagtcagcaacatatgtgccagttgctccacctacacccgcctggcagcctgaaattaagcctgagcctgcctggcatgatcaggatgagactagcagcgtgaaatccgacggtgctggtggcgcgcgggcctcttttagaggccggggtaggggtcggggcaggggcagaggcagaggccgaggtggaacacggacacactttgattaccagttcggatacagaaaatttgacggagtcgaaggtccgagaacaccgaagtacatgaataacatcacatattatttcgataatgtgtctagcactgagctgtactccgtggatcaggaacttctgaaggactacattaagcggcagattgagtattacttcagtgtcgacaaccttgaaagagatttcttccttcgaaggaagatggacgccgacggtttcttgccgattacactcatcgcaagttttcaccgggtccaggcccttacaacagacataagcctcatattcgccgcgctgaaggattccaaagtggtggaaatagtcgacgaaaaggtgagacgccgggaagaacctgagaagtggccactccctcctattgtggattatagccagacggacttttcacagctcctcaactgtccggagtttgttccgcgccagcattaccagaaagagaccgagagcgctcccggcagtcccagggccgtgacccccgtacccaccaaaactgaggaagtgagcaacttaaagacgctgccgaagggcctatcagcaagcctcccggatttggactccgagaattggatcgaggtgaaaaagcggcctcgcccttctcctgcccgacccaagaaatccgaggaatctcgcttcagtcatctcacctcactaccacaacaactgcccagtcaacaactgatgtctaaggatcaagacgaacaggaggaattggactttctatttgatgaggaaatggaacaaatggatggtaggaaaaacaccttcactgcgtggagtgacgaggagtcagactacgagatagacgatcgagacgtaaacaagatccttatcgtgactcaaaccccacattacatgaggcgacacccggggggagacagaaccgggaaccacacctcccgggctaagatgtctgctgaactggccaaggtgattaatgatgggcttttttactacgagcaagacctatgggccgagaagttcgagcctgagtacagccagatcaaacaggaagtggaaaacttcaagaaagtgaatatgatttcaagggagcagttcgatactttgactcccgagcctccggtggaccccaaccaggaggtgcctcccggccctccccgattccagcaggtgccaaccgatgctttagccaacaagctgttcggagccccagaaccctcaacaatcgctcgaagtttgccgacgaccgtgccagaatcgccgaactacagaaatacacgcacaccccgtacgccacggacgccccaactgaaagactcctcccaaacatcaagattctatccagttgttaaggaggggcgaactttggatgctaaaatgccaaggaaacgaaaaacccggcacagctcaaatcccccactcgaatcccatgtgggatgggtgatggattctagggagcacaggccaaggaccgcctcaatttcatcaagtccgagcgagggcacacctacagtgggatcatacggctgcacaccccagagcctgccgaagtttcagcaccccagtcatgagctcttgaaagagaatgggttcacccagcacgtgtatcataaatatcggcgccgctgcttgaacgaacggaaaaggttaggcatcggccagagtcaagagatgaatactctttttcgcttctggagcttttttttgcgcgaccattttaacaagaaaatgtatgaggaattcaagcagcttgccttggaagacgcaaaggagggctaccgttacggtctggaatgcctctttcgttattattcctacggcctcgaaaagaagtttagactcgatattttcaaggactttcaagaggagactgttaaggactacgaagctggtcagctgtacggccttgagaagttctgggcgtttctgaagtactccaaagctaagaatttagacattgatccgaaacttcaggagtatctgggaaaattcaggcggttggaggattttcgcgttgaccccccaatgggcgaggagggcaaccacaagaggcatagtgtagtggctggcggcggggggggggaagggcggaaaaggtgtccttcccagtcgagctcaagacccgcagcaatgatatctcaacctcccacaccgcccactggtcaacccgttcgggaagacgcgaagtggacctcacagcattctaacactcagaccctgggaaaatag

SEQ ID NO: 121823 - DNA, 2451 bp, Artificial Sequence
  Description of Artificial Sequence: Synthetic coding sequence
atggctacccaggtagaacccctcctccccggcggcgcaacactactccaggccgaggaacacggagggctggttcgaaagaaacccccgccagcccctgaggggaaaggagagcccgggccaaatgatgtgagagggggagagccggatggaagcgcgaggaggccgcgccctccctgtgctaagccccataaggaaggtaccggacaacaggagcgagaatctccccggcccctgcagttgcccggggctgaaggacccgccatctctgacggagaagagggcggtggggagccaggcgcaggggggggcgcggccggcgcagctggtgccgggaggcgcgacttcgtggaagccccaccccccaaagttaatccctggaccaaaaatgcactgccccctgtactaactaccgttaacggacagtccccccctgaacatagtgcccctgccaaagtggttcgggccgctgtccccaagcagcgaaaaggcagtaaggttggtgacttcggcgacgctattaactggcccactcccggcgaaattgcacacaagtccgtgcagccgcagtcacacaagcctcagcctacaaggaagcttccccctaagaaggacatgaaagaacaggaaaagggggaaggctcagatagtaaggagagccccaagaccaagagcgacgaatcaggcgaagagaaaaatggagatgaggactgccagcggggtggccaaaaaaaaaaagggaataaacacaaatgggtaccattgcaaatcgatatgaaacctgaagttccccgtgagaagctggcatcacggccaactagaccaccagagcccaggcacatcccagctaatcgcggcgaaataaaagggagtgagagcgccacctatgttccggtggcaccacccaccccagcttggcagccagagatcaaacccgagcccgcctggcatgatcaagatgaaacttcatctgtgaaatcggatggagctgggggcgctagggccagttttaggggccgggggaggggtcgagggaggggacggggtagaggaaggggaggtacacggacacactttgactaccagttcggctataggaagtttgatggcgtggaagggcccaggaccccaaaatacatgaacaatattacatattactttgataacgtgtcttctacagagctgtactcagtagaccaggaacttcttaaggactatattaaaagacagatcgagtattatttctctgtggacaacctcgagcgggatttttttctgcggagaaagatggacgcggatggttttctgcctatcaccctaatagctagctttcaccgggtccaggccctgacaacagacatcagccttatctttgcggccctcaaagatagcaaagtcgtggaaatcgtggacgagaaagtccggcgcagagaggagcccgagaaatggccattaccgcctattgtggactactcccaaaccgacttttcacaattgctcaattgtccagaattcgtccccaggcagcactaccagaaggagacggagtccgcccctgggagcccccgggcagtgacccctgttccaactaaaactgaggaagtcagtaacctgaaaaccctcccaaagggcctttccgctagcctcccagatctcgacagcgagaattggattgaagtgaaaaaacggccaaggccctctccagctcggccgaagaagagtgaagagagccgtttttcccacctcacttcactgccacagcagttgccctcacagcagctcatgagtaaagatcaagacgagcaggaagagctggacttcttgttcgacgaggagatggagcagatggatggcagaaagaatacttttacagcttggagtgatgaagagtctgactacgagattgatgacagagatgtcaacaaaatcctgatagttactcaaacgccgcattatatgcgtagacatccaggcggcgaccggactggcaatcatacctcgagggctaagatgagcgctgaattggccaaagttataaacgatggcctgttttactatgagcaagacttatgggccgagaaatttgagccagaatactcacaaatcaaacaggaagtggaaaacttcaaaaaggtgaatatgatctcgcgcgagcagttcgatacgctgactcccgaacctccagtagaccctaatcaggaagtgcctcctggccctcctaggtttcaacaggtgcctacagacgccctggcaaataaactgtttggggccccagagccatcaacaatcgcacgatccctgcctaccaccgtgccagagagcccaaactataggaatacccgaacacctcgtacgccacgcacaccacagcttaaagactctagtcaaaccagtagattttacccagtcgtgaaggaaggcaggacactggatgcaaaaatgccaaggtag

SEQ ID NO: 121824 - DNA, 282 bp, Artificial Sequence
  Description of Artificial Sequence: Synthetic coding sequence
atgaaagagcaggaaaaaggtgaaggaagtgacagcaaggaatcgcccaagactaagagcgacgaaagtggggaggaaaagaacggggacgaggactgtcagaggggtgggcagaaaaagaaggggaataaacataagtgggtgccactgcagatcgatatgaagcccgaggttcccagggagaagttagccagcagaccaacccgccctccggaaccacgccatatccccgccaaccgtggcgaaatcaaggggagcgagagcgcaacgtacgtgccatag

SEQ ID NO: 121825 - DNA, 1836 bp, Artificial Sequence
  Description of Artificial Sequence: Synthetic coding sequence
atgaaagaacaggagaagggtgagggcagtgattctaaggagtcaccaaaaaccaaaagcgatgagtcaggcgaagaaaaaaatggcgacgaggactgccagcgaggtggacagaaaaagaagggaaataaacacaagtgggtccctttacagattgacatgaagcctgaggtgcctagggaaaagttagcgtctcgacccacacgaccgccagagccgcgccatatccccgcgaatagaggagagattaaaggatccgaatctgcaacctatgtgcccgtggccccccctaccccggcctggcagcctgagataaaacctgaacctgcctggcatgaccaggatgagacatcctcggtaaaatcggacggcgcaggaggagctagggcctcttttagagggcgaggtcgcgggagaggtcgtggcaggggtcggggaagaggtggtacaagaacacactttgactaccagttcggctatcgcaaattcgatggggtggaaggtcctagaacccccaaatatatgaataacataacgtattacttcgacaatgttagttctaccgaattgtatagtgttgaccaggaactgttgaaggattacataaagcggcagatcgagtattacttttccgtggataatctcgagcgtgacttcttccttaggcgtaagatggacgctgacggcttccttccaatcaccctcattgccagcttccatcgggttcaggcattaacaaccgatatcagtcttatattcgctgctctgaaggactctaaggtggtagagattgtggacgagaaagtgcgcagacgagaagaaccggaaaaatggccactgcctcctattgtggactattctcaaaccgatttctctcaactactgaactgtcccgaattcgtgccccgccagcattaccagaaggagaccgagagtgcccccggcagccctcgcgctgtgacgcccgtcccgacgaagaccgaagaggtcagcaatctgaaaactctccctaagggactctccgccagtctgccggatctggattcagaaaactggattgaggtgaagaaaaggcctcgtccaagtcctgcccggcctaaaaagtcagaagaatctcggttcagccatctgacttcccttccacaacagctcccatcacagcagctcatgagcaaggaccaggacgaacaggaggagctcgattttttgtttgacgaggaaatggaacagatggacggtcgcaaaaacacatttaccgcatggtcagatgaggagtccgactatgaaatcgacgaccgagacgtaaacaaaattctgattgtgacacagacaccacattacatgcgccgtcatcccggaggggatcggacagggaatcacacctcaagagcgaaaatgagcgcagaactggcgaaggtcatcaacgacggactgttctattatgaacaagatctgtgggccgagaagttcgaaccagagtactcacagatcaaacaggaagtagaaaacttcaaaaaagtgaacatgatctcaagggaacaattcgatacacttacacccgagccccccgtggaccccaatcaagaggtgcccccgggacccccaagatttcagcaggtgcccacagatgcactggccaacaagctgtttggtgcacccgagccatctacaatcgccaggagtttgcccacgaccgttcctgagagccccaactatcggaataccaggacccctagaacccctcgtactcctcagctcaaggactcatctcagactagccgattctacccggttgttaaagaagggcgtacactggatgcgaaaatgcccagatag

SEQ ID NO: 121826 - DNA, 1749 bp, Artificial Sequence
  Description of Artificial Sequence: Synthetic coding sequence
atggagaccgaatcagggaaccaggaaaaagtgatggaggaggagtccacagaaaaaaagaaagaagtggagaaaaaaaagcgaagccgcgttaagcaagttcttgccgacattgcgaaacaggtggatttttggttcggcgacgccaacttgcataaagatcgattcctgagagaacagatcgaaaagtccagagatgggtatgtcgacataagtctgctggtgtcttttaacaagatgaagaagttaacaacggatggcaagctcatcgccagggccctcaggagctcagctgttgtcgagctcgatctggagggcactcgaatcagaaggaaaaagcctttgggggagagacccaaagacgaggacgaacgcacagtttacgtagagttgctgccgaaaaacgtcaaccattcatggattgagagggtcttcggcaaatgcggaaacgtggtctatattagcatcccacactacaagtccaccggcgaccccaagggattcgcttttgtggaattcgaaactaaagaacaggccgcaaaggcaattgaattcctcaataatccccctgaggaggcaccccgcaaacctggcatattccctaaaaccgttaagaataaacctatcccggccctacgcgttgtggaggaaaaaaagaaaaagaaaaagaagaagggccgcatgaagaaggaggataatatccaggcaaaagaagaaaatatggacacctctaacacttccatttcaaagatgaaaagaagcagacctacttcagagggctcagatatcgaaagcaccgaaccacagaaacagtgctcaaagaaaaaaaagaaaagggaccgcgtggaagcctcctcattgccagaagtccgaaccggcaagagaaagcgaagctcttcagaggatgccgaaagtttggcacctaggtctaaggttaaaaagatcatccaaaaggacattattaaggaggcttccgaggctagcaaggagaatcgggacatcgaaattagcactgaggaagaaaaggataccggtgatctgaaggacagcagtcttttgaagacaaaacgcaaacacaagaagaaacataaggagcgacataaaatgggcgaggaagtgataccgctaagagtgctgagtaagagtgagtggatggatttaaagaaagaataccttgcgttgcagaaagcttctatggctagtctgaagaagaccatttcacaaattaagtcagaatccgaaatggaaaccgattccggcgtgccacaaaatacgggcatgaaaaacgagaaaacagctaacagagaagagtgccggacacaggagaaggtgaatgcgactggtccccagttcgtatccggagtaatcgtcaaaattatcagcactgaacctctacccggccggaagcaagtgagagataccctagctgccatttccgaggtactctatgtagacctactggaaggagacaccgaatgccacgcccgattcaagacccctgaagacgcacaggccgtcataaatgcctatacagaaatcaacaagaagcactgctggaagctggaaatactctctggagaccacgaacagaggtactggcagaaaatattggtagatcgccaggcgaagctgaatcagcctcgggaaaaaaagcgaggcacagagaagttgattactaaggcagagaaaatcagactggctaagactcagcaggcaagcaagcacatccggttctctgagtacgactag

SEQ ID NO: 121827 - DNA, 1749 bp, Artificial Sequence
  Description of Artificial Sequence: Synthetic coding sequence
atggagacagaatctggcaaccaggagaaggttatggaggaggagtctaccgagaagaagaaggaagtggagaaaaaaaaacggtcacgggttaaacaagtgctggccgatattgctaaacaggtcgatttttggttcggtgacgcaaatctccacaaggataggttcctgcgagaacaaattgagaagagccgggacggatatgttgatatctccctgttagtgtccttcaacaagatgaaaaaactcacaacggacggaaagttgatcgcccgcgcgttacgctcctccgcagtcgtcgaactcgatctcgaaggtactcgcatccggagaaaaaaacccctcggcgaaaggccaaaagacgaggatgagagaactgtctacgttgaactgctacctaaaaatgtgaaccatagctggatcgaacgggtgtttggcaaatgcggcaacgttgtgtacatttctattccacactataagtcgaccggcgaccctaaagggtttgcttttgtggagttcgagacaaaggaacaggctgcaaaggctattgaatttctgaataaccctcctgaggaggcaccccggaaaccaggaatcttccccaaaaccgtgaaaaataagcctattcctgcattgagggttgtggaggaaaagaaaaagaaaaaaaaaaaaaagggccgcatgaaaaaggaagataacatccaggctaaagaagaaaacatggacacaagtaatactagtatctctaaaatgaaacgaagtcgccctacctccgagggatctgatatcgaatcgaccgaaccccagaagcaatgctcaaaaaaaaaaaaaaaaagagatagagtcgaggcctcatccctccctgaggtgcgaactggaaaaagaaagcggagctcaagcgaggacgctgaaagtctggctcccaggtcaaaagtgaagaagataattcaaaaggatatcatcaaggaggccagcgaggcctctaaggagaatcgagatatcgagatctctaccgaagaagaaaaagacactggggatctgaaagattcaagcttgctgaaaacaaagcggaagcataagaaaaagcataaagagaggcataagatgggtgaggaggtaattccactccgggtcctctcaaagagcgaatggatggatctcaaaaaggaatacttggccctccagaaagcctccatggcatcactgaaaaagaccatttcccagatcaaatctgagagcgagatggagactgatagcggggtgccacagaacaccgggatgaagaatgagaaaaccgccaacagagaggagtgccggacacaggagaaggtgaatgccactggaccccagttcgtttctggcgtgatcgtgaaaataatctcaactgaacctttacccggccggaagcaggttagagatacactggcggccatctccgaggtgttgtatgtagacctgctggagggcgacaccgagtgccacgcgagattcaagacccctgaggatgcgcaggcggttattaacgcgtacaccgagatcaataaaaagcattgctggaagcttgagatcctgtcaggagaccacgaacagcgatactggcagaaaatcttggtcgatcgacaggcaaaacttaaccaaccaagggagaaaaagagaggcacggagaagctgatcactaaagccgagaagatcaggctggccaagactcaacaagcttctaagcatatccgattctccgagtacgactag

SEQ ID NO: 121828 - DNA, 900 bp, Artificial Sequence
  Description of Artificial Sequence: Synthetic coding sequence
atggagaccgagtcaggtaatcaagaaaaagtcatggaagaggagtccactgagaagaaaaaagaagttgagaagaaaaaacgctctcgggttaaacaggtcctagccgacattgcgaaacaggtcgatttctggtttggggatgctaacctgcacaaggaccgttttctgcgagaacaaattgaaaagtcacgggatggctacgtcgacatcagtctgctggtatctttcaataagatgaaaaagctgactaccgacgggaagctgatcgcaagggcactaagatcttctgcggtggtggaattggatctggagggcacaagaataaggcgaaagaagcccctgggcgagagacccaaggacgaagacgagagaaccgtctacgtagagctgctgcctaaaaatgtgaatcacagctggattgagagggtcttcggcaaatgcgggaatgtggtttacatctccatacctcactacaagagcacgggggatcccaaaggcttcgcctttgtggagtttgagaccaaggaacaggcagcaaaagccatcgagttcctgaataacccgcccgaagaggcgcctagaaagccagggattttccccaaaaccgtcaagaacaagccaatccccgctctgcgagtcgtggaggagaagaagaaaaagaagaagaagaaggggaggatgaagaaagaagacaatatacaggctaaggaggaaaatatggatacctcaaacacgagtatcagcaagatgaaacgatcccggcccacttccgaaggatcagatatagaatcaaccgagccacagaagcagtgttctaagaagaagaaaaaaagggacagagttgaggcctctagcttgccagaggtacgtaccggaaaacggaaacgcagctcttag

SEQ ID NO: 121829 - DNA, 390 bp, Artificial Sequence
  Description of Artificial Sequence: Synthetic coding sequence
atggagactgagtcaggcaaccaggagaaagttatggaggaggagtctaccgagaaaaagaaagaagtggagaagaagaagaggtcccgagttaagcaggtgttagctgatattgccaagcaggtcgacttttggtttggagatgctaacttgcacaaggatcgctttttaagagaacagatagagaagagccgtgacggctacgtcgacatatccttgctcgtttcgtttaacaagatgaaaaagttgactaccgacggaaagctaatagctcgggctttgcgatcctcggcagtcgtagagttggatctggagggaacgcgcattaggaggaagaaaccactcggtgagcgcccaaaggacgaggatgagaggacagtctacgtgtag

SEQ ID NO: 121830 - DNA, 360 bp, Artificial Sequence
  Description of Artificial Sequence: Synthetic coding sequence
atggagactgaatcaggcaatcaggaaaaggtgatggaggaagaaagtaccgaaaagaaaaaagaagtggagaaaaagaagcggtcaagggtcaagcaggtgctcgcagatatcgcaaagcaagtagacttctggtttggcgatgctaatctgcacaaggataggttcttaagggagcagatcgagaagagtcgggacggttatgtggacatttctctgctcgtgagcttcaacaaaatgaagaaactgacaacggacggcaaactgatcgctagagcgctgagatcttccgcagttgtggagctggatttagaaggtactcggatccgtcgcaaaaagccgttaggtgagagaccttag

SEQ ID NO: 121831 - DNA, 1770 bp, Artificial Sequence
  Description of Artificial Sequence: Synthetic coding sequence
atgattcccaacatcgaaggcatggagaccgagtctggaaaccaggagaaagtcatggaggaggaatctactgaaaaaaagaaggaagtagagaaaaaaaagcgcagtagagtgaagcaagtgcttgctgacatcgcaaagcaggtggacttttggttcggggacgcgaatctgcataaggatcgcttcctgcgggagcagattgaaaaatctcgcgatggttatgttgatatctcattattagtttcttttaacaagatgaaaaagctcaccactgatggaaagctgattgcccgcgctctgagatctagtgcagtcgtggaacttgatctagagggcactaggattcgaaggaaaaaacccctgggagaacgtcccaaagacgaggacgagcgtacagtttacgtcgagctcctgcccaagaatgtgaaccacagctggatcgagcgcgtgtttgggaagtgcggcaatgttgtgtacataagtataccccactacaagtctactggcgatcccaaaggcttcgcatttgtcgaatttgagacgaaggagcaggcagcgaaggctatcgagtttctgaacaatccccccgaagaggcccccaggaaacctggcatatttcctaaaacagtcaagaacaagcctattcccgcactccgagtggtcgaagaaaagaaaaagaagaaaaagaagaaaggtcgcatgaagaaagaagataacattcaagccaaagaggagaatatggacacttctaatacttctatttccaaaatgaagagatctcgaccaacctccgagggtagtgatatcgagagtaccgagccgcagaaacagtgctctaagaagaagaagaaacgcgacagggtggaggcctcgtctctgccggaggtgcggaccggcaaacggaagcgaagcagctctgaggacgccgagtccctggccccacgcagtaaagtgaagaaaataatacagaaagatataattaaagaggcaagcgaagctagcaaggaaaaccgagatatcgaaattagcaccgaagaagaaaaggatactggagacctgaaggattcaagcctactgaagacaaaacggaaacacaaaaagaagcacaaggaaaggcacaagatgggtgaggaagtgataccgctccgcgtcttgagcaaatcggagtggatggacctcaagaaggagtatctggccttgcagaaggcgagcatggcctcactgaaaaagacaatctctcagattaaatctgaaagtgaaatggagaccgactccggagtcccccagaacactggtatgaaaaatgagaaaacagctaatcgcgaggagtgtcgcacccaggaaaaggttaatgcgactgggccccagtttgtgagcggcgtgatagttaagatcataagtaccgaaccactgcctggacgcaaacaagtccgcgacacacttgccgctatttctgaggtgctatatgttgatcttttggagggggacaccgagtgccacgctagattcaagacccctgaggacgcccaagcagtcataaacgcatatactgagatcaataagaagcattgctggaaactggaaattttatccggtgatcacgagcagagatattggcaaaagatcttagtcgacagacaggcaaagctgaatcaacctcgagagaagaaaagggggactgaaaagttgattaccaaagccgagaagattagattggcaaaaacccagcaagccagcaaacacatccgcttcagtgaatatgactag

SEQ ID NO: 121832 - DNA, 417 bp, Artificial Sequence
  Description of Artificial Sequence: Synthetic coding sequence
atgaagttcaccaccctgctcttcctggctgccgtagccggtgcactggtgtacgccgaagatgccagcagtgattcaactggcgctgaccctgctcaggaagctggtaccagtaaaccaaacgaggagatcagtgggccagcggagcccgccagtccccctgagacaacaaccacggctcaggagacttccgccgcagccgtgcagggcacggccaaagtgacgtcatctagacaggagctgaatcccctgaagtctatcgtggagaagagcatcctacttactgagcaggctctggctaaagccggaaagggtatgcacggaggcgtgcccggaggaaaacaattcatagagaacggcagcgaatttgcccagaaactcctgaagaaattttcactgctgaaaccctgggcctag

SEQ ID NO: 121833 - DNA, 429 bp, Artificial Sequence
  Description of Artificial Sequence: Synthetic coding sequence
atgcgcttctttgtgccccttttcttagtgggtattctgttcccagctatattggctaagcagttcacaaagtgcgaactctcccagctgctgaaggatattgacgggtatggaggaatcgctctgccagaactgatctgcactatgttccacacaagtggctatgacacgcaggctatcgttgagaataacgaatctacggagtacggactttttcagatctctaataaactttggtgtaaaagctcacaggttcctcaatcacgcaacatatgtgatatttcatgcgataaattcttagacgatgatatcacggacgatatcatgtgcgccaagaagattctggacataaaaggcatcgactactggctggcacataaagccctctgtacagagaaactggaacagtggctctgtgagaagttgtag

SEQ ID NO: 121834 - DNA, 1644 bp, Artificial Sequence
  Description of Artificial Sequence: Synthetic coding sequence
atgtatcgcctcatgtcagccgtcaccgcccgcgctgctgccccaggcggtctggctagctcctgcgggaggaggggagtacaccaaagagcaggccttccacccttgggccatgggtgggtcggtggacttgggttaggactgggtttagctctgggcgttaaattggcaggcgggctacggggggccgcacctgcccagtcccccgcagctcctgaccccgaagcgagcccactcgcagagcccccacaggagcaatccctagcaccatggtcccctcagacccctgccccaccctgttccagatgctttgcgagagctattgagagctcccgcgatctcctgcaccgaatcaaggacgaggtgggagccccagggatcgtggtgggagtctccgtagatggaaaggaagtttggtccgaaggcctgggatatgccgatgtagagaatagggtgccctgcaagccagagactgttatgagaatcgcgtccattagcaagagtctgaccatggtcgcgctggcaaagttatgggaagcgggcaaactcgacctggacatcccagtacaacactacgtcccagagtttcccgaaaaggagtacgagggagagaaagtgagtgtgaccactaggctgctgatttcccacttgagcgggatcaggcactacgagaaggacataaaaaaagttaaagaagagaaagcctacaaggccctgaagatgatgaaggagaatgtggcatttgaacaggagaaggagggaaaaagcaatgagaaaaacgacttcacaaaatttaagactgaacaggagaatgaggcgaagtgcaggaattccaaacctgggaagaaaaagaatgatttcgaacagggagagttgtacctgcgagaaaagtttgagaattctatagagagcttaaggctgttcaagaacgatcccttgttttttaaaccaggctcacaattcctttactctacattcgggtacacactgctggccgccatcgtcgaaagggccagcggctgtaagtatttggattacatgcagaagatttttcacgacttggacatgctaacgactgtgcaagaggaaaatgagccagttatctacaatcgtgccaggttctacgtttataataagaagaagagactagtcaatactccatatgtggataactcctataagtgggcaggaggcggtttccttagcacagtgggagacctgctcaaattcggaaacgctatgctttacgggtatcaggtgggcctcttcaaaaacagtaatgagaaccttctacccggctatctgaaaccggaaaccatggttatgatgtggacacccgttcctaataccgaaatgtcatgggataaagaaggcaaatatgctatggcttggggcgtcgtggaacggaaacagacctatggttcctgtcgcaaacagcgccattatgcttctcacactggcggtgctgtgggagcatcaagcgtccttctagtcctgcctgaagagctcgacactgaaactatcaacaacaaggtgcctccccgtggaataatcgtgtccatcatatgcaatatgcagagtgtgggattgaatagtacagccttaaagattgcgcttgagtttgataaagaccggtctgattag

SEQ ID NO: 121835 - DNA, 1122 bp, Artificial Sequence
  Description of Artificial Sequence: Synthetic coding sequence
atgtataggctcatgtctgccgttacagctagggccgccgcccctggtgggctggcctcatcctgtgggaggcgcggagttcaccagcgagccggtttgccacccttaggacacggttgggtaggcggactaggcctcggactgggtctggccctgggcgtgaagctggccggcggactgagaggggccgcaccagcccagtctcccgcggcaccagatcccgaagccagccccctggcggagcccccccaggagcagtccttagccccgtggtccccacaaactcccgcgccaccgtgtagtaggtgcttcgcaagagcaattgaaagcagtagggatttactccaccggattaaggatgaagtgggcgcacctggtattgtcgtaggcgtgtccgtggatggaaaggaagtgtggagcgaggggctagggtatgccgatgtggagaatcgcgttccatgtaaacctgagacagtgatgagaatcgcctcgatttccaaatctctcactatggtagccctcgctaagttatgggaggctggaaagctagacctggacatccccgtccaacactacgtccccgagttcccggagaaggagtacgaaggagagaaagtctcggtgacgaccagactcctcatcagccatctgagcgggataagacactatgagaaggacatcaaaaaggtcaaggaggaaaaagcgtataaagcattgaagatgatgaaagagaacgtggccttcgagcaggaaaaggaggggaagagcaacgaaaagaacgactttacaaagttcaaaaccgagcaagagaatgaggctaagtgtaggaatagtaagcccggtaagaagaagaatgatttcgagcagggggaactgtatttgagggagaagttcgaaaattctattgaaagtttgcggctgttcaaaaacgacccgctgttcttcaagcctggttcccaattcctgtatagcacctttggctatacactactagctgccatcgtggagcgggcctccggctgcaagtatctcgactacatgcagaagatttttcatgatcttgacatgctgacgaccgtccaagaagaaaacgagcctgtaatttacaatagggcccgctag

SEQ ID NO: 121836 - DNA, 5784 bp, Artificial Sequence
  Description of Artificial Sequence: Synthetic coding sequence
atggaactgtcttggcacgtggttttcatcgcattgctctcattttcctgctgggggtccgactgggaaagtgatagaaatttcataagcactgctgggccccttacgaacgatttgcttcacaacctcagcgggctgctaggagatcagtccagcaattttgtcgcaggagataaggacatgtatgtatgccaccagcccctgcctaccttcctgcctgagtatttttccagccttcatgcctcccaaatcacacactacaaagtattcctctcttgggcccaactgctacccgccggatcgactcagaacccagatgagaaaactgtacagtgttaccgtagactcctaaaggcgcttaagacagcacggctgcaaccaatggtgatcttacatcaccagacactgcccgccagcactctgcggagaaccgaggctttcgctgacctgttcgccgactatgctacatttgcattccacagtttcggagacttagtcgggatctggtttaccttcagcgatctcgaagaagtgatcaaggagctccctcatcaggaaagccgagcatcacaattgcagactctgtcggacgctcatcggaaggcctatgagatctaccatgagagctatgcgttccagggagggaaactctcagtcgtgctgagagctgaggatatcccagagttgctcctggaaccccctatctcggctctggcccaagacactgtcgatttcctcagcctggacctgtcgtacgagtgtcagaacgaagcttcactgaggcagaaactatcgaagctgcagacaatagagcctaaggttaaagtcttcatcttcaatcttaaattaccagattgccctagtactatgaaaaatccggcatccctgctcttcagcctgtttgaggctattaataaagatcaggttcttaccattggctttgacataaatgaatttctcagttgctcctctagctcaaagaaaagtatgtcatgctcactgacaggttcgctcgccttgcaacctgatcaacaacaggatcacgaaaccactgactctagccctgctagtgcctatcagcggatttgggaggctttcgccaatcagagccgggctgaaagggatgcctttctgcaggataccttccccgaaggctttctgtggggcgccagtacaggtgcattcaacgtggagggggggtgggccgaaggcggtcgcggcgtgtctatctgggatccccgacgccccctcaatacgacggaggggcaggcgactctcgaggtagcctcggacagttatcataaagtggcttccgatgttgcattgctgtgtggattgcgagcccaggtgtataagttttccataagttggtctcggatctttcctatgggacatggctctagtcccagtctgcccggagtagcctactataacaagctgatcgacagactgcaagatgcaggtattgagcctatggctacgctcttccactgggatctccctcaggcccttcaagaccacggaggctggcaaaacgagagtgtggtcgatgcgtttctggattacgccgctttttgcttctcaaccttcggagatagggttaagctgtgggtcaccttccacgaaccttgggtgatgtcttacgccgggtacggaaccggtcaacatccccccggaatcagcgacccaggggtggcgagttttaaagtggcccatctggtgcttaaggctcacgcccggacctggcatcactacaactcacatcatcgcccacagcaacagggacacgtcgggattgtcctgaatagcgattgggccgaacctctgtccccagagaggcctgaggatttgagagccagtgagcggttcctccatttcatgctggggtggtttgcgcaccccgtctttgtagacggggactatcctgcgaccttgcggacacagattcaacaaatgaatcgccaatgttctcaccctgtggcccagttacccgagttcactgaggctgagaagcagctgctgaaagggtcggctgatttcttaggcctcagccattatacatcgcgcttgattagcaacgcaccgcagaacacgtgtatccctagttatgacaccatcggcggcttttcccagcatgtaaatcatgtttggccgcagacctccagctcgtggatccgtgtcgtaccttggggcatcaggcgtctgctgcagttcgtgagtcttgagtatactcggggcaaggtgccaatctacttagccggaaatggcatgcctatcggcgaaagtgagaatcttttcgatgattccttacgcgtggactactttaatcagtatataaatgaagtgcttaaagctatcaaggaggacagtgtggatgttaggtcttatatcgcgcgctctctcatcgacggttttgaaggcccatccggatacagccagcgctttggactgcaccatgtcaatttttccgatagcagcaaaagccgtactccaagaaagagcgcctactttttcacctcaataatagagaaaaatggctttctgacaaaaggcgccaaaaggctgcttcctccaaataccgtcaatcttccatcaaaggtccgtgcctttacatttcccagtgaggtccccagtaaggccaaggttgtctgggagaaattctcctcacagccaaaattcgagcgagacttgttttatcacggtacattcagagacgactttctctggggcgtttcctcttccgcttatcagatcgagggggcctgggatgcagatggaaagggaccaagcatctgggataattttactcatacccctggtagtaatgtgaaagacaacgcgaccggcgacatcgcctgcgactcctaccaccaactggatgcagatcttaacatgcttagggcgctgaaagtcaaggcctatcggttctccatctcctggtctaggatttttccaactggtagaaatagttccataaactcccatggtgtggactactacaatcggctgatcaacggactggtagccagcaatatcttcccaatggtgaccctctttcactgggatctaccgcaggctttacaggatatcggtggctgggagaaccccgcattgatcgatctctttgactcatatgccgatttttgcttccagaccttcggtgatagagtcaagttctggatgacctttaacgaaccgatgtatctagcttggttaggctatgggtccggggagtttccccccggtgttaaggaccccggttgggctccctacagaattgctcacgctgttattaaggcccatgcccgggtgtatcacacatatgatgagaagtaccgacaggagcagaagggagtcattagcttgtcgctgtctacccattgggcagaacccaagtcccctggagtccccagggatgtcgaagccgccgacaggatgctgcagttctctctaggctggtttgcccacccgattttccggaatggggactacccagacacaatgaaatggaaagtcggcaatagatctgagctgcagcacttggccacctctcgactgcctagtttcacagaggaggaaaaacggttcattcgtgccactgctgatgttttttgcctgaacacatactattcacggatcgtgcagcacaagacgccaagactgaacccaccatcctacgaagatgaccaggagatggctgaagaagaagatccctcgtggcccagcacggccatgaatcgtgcagccccatgggggacacggcgattgctgaattggattaaggaagaatatggagatatccccatatacatcacagagaacggggtgggtcttaccaatccaaataccgaggacacagatcggatcttctaccacaagacctatataaatgaagcactgaaggcctatcgactagacggcatagaccttcggggatacgtggcatggtcactcatggataatttcgaatggctgaatggctacacagtgaagtttgggctgtaccacgtcgacttcaacaatactaatagacccaggacagcacgcgccagcgctaggtattacacggaggttatcaccaataacgggatgcctttggcccgcgaagatgagtttctttatggaagatttccggagggattcatttggtctgcagcaagtgccgcctatcagatcgaaggcgcctggcgtgccgatgggaagggactgtccatttgggatacattttcacataccccacttcgggtagagaacgacgctatcggtgatgtagcctgcgactcttaccacaagatcgcggaggacctagtgaccctacagaatctcggcgtgagccactaccgcttctctatttcttggtcccgtatcttgcccgatgggacaacaagatatatcaacgaggcgggactcaactactacgtccgattaatagatactctcctggcagcatccatccagccccaggtcacaatctaccactgggatctaccccagacactgcaggatgttgggggatgggagaacgaaactattgtgcagagattcaaggagtacgctgatgtcctgtttcagagactaggcgacaaggtgaagttctggattaccctcaatgagccatttgtgattgcataccagggatacgggtacgggaccgctgctcctggcgtgagcaatcgtcccggtacggcaccgtatatcgtgggtcataatttaatcaaggcacatgccgaggcatggcacctgtacaatgatgtgtatcgcgcgtctcagggaggtgtgatctcaataacaatctcaagtgactgggctgaaccccgagacccgagtaatcaggaggacgttgaggctgcacgccgatacgtacaatttatgggcggctggttcgcacacccgatctttaaaaacggtgactacaacgaggtcatgaagacgcgtatccgcgatagatccttagccgccggcctcaataaaagccgccttcctgaattcacggaaagcgaaaaacgcagaattaatggcacctacgatttctttggctttaaccactataccactgtgttggcttacaatctaaattatgccactgccattagttcatttgatgcggataggggtgtggcatcaatcgctgaccgaagttggccagactccgggagcttttggctgaagatgaccccctttggctttagaaggatccttaactggctgaaagaggagtataatgatccacctatttatgtaacagaaaatggggtgagccaacgtgaggagacggatcttaacgataccgcaagaatctattatttacgtacgtacatcaatgaggcccttaaagcggtccaggacaaggtggacttgaggggctataccgtttggtcagcaatggacaactttgagtgggctactggctttagcgagaggtttggcctacattttgtgaactattccgacccatcactgccccggatcccaaaagcatctgcaaaattctacgcaagcgtggtgcgttgcaatggtttccctgatcccgccaccggacctcacgcatgtttgcaccagcccgacgccgggcccacgatatcacctgtaagacaggaggaagttcagttcctgggcctgatgctggggacaactgaagcccagacagccctgtatgtgctgtttagcctcgtactgctcggtgtctgcggattagcttttctgtcttataagtactgtaagcggtctaagcagggcaaaacacagagaagccagcaagagttgtcaccagtgagcagcttttag

SEQ ID NO: 121837 - DNA, 3012 bp, Artificial Sequence
  Description of Artificial Sequence: Synthetic coding sequence
aaggtggctcacctcgtgttaaaagctcatgccagaacttggcaccattacaactctcatcaccgccctcagcagcaaggccacgtgggcattgtgcttaatagtgattgggcagagcccctatctccggagcgcccggaggatctgagggcatcagagcggttcttacactttatgctgggatggtttgctcacccggtgttcgttgatggcgactatccggcaactctgcgaacccagattcagcagatgaacagacagtgctcacatcctgttgctcaacttcctgagtttactgaagctgagaaacaactgctgaagggcagcgcagatttcctgggactcagtcactacacctctcggctcattagcaatgccccacagaacacttgcatcccatcctacgatactatcgggggcttcagccagcacgttaatcacgtgtggccacaaacctctagcagctggattagagtagtgccctggggcataaggcggctcttgcagttcgtgagcctagagtacactcggggcaaagtaccgatttacctggccgggaatggaatgcctattggagagtctgagaacctgttcgatgattctctcagggtggattattttaatcaatacataaacgaagttctgaaagcgattaaagaggacagcgtcgatgtgcgctcgtacatagcacgtagtctcattgacggattcgagggcccttcagggtacagtcagagattcggactccaccatgtgaatttttccgactcgtctaagtccaggacacccaggaaatcggcatactttttcacatccattatcgagaagaacggttttttgaccaagggcgctaagcgcttactgccacccaacacagtaaacttaccgagcaaggttcgagcttttacattcccttctgaggtcccttccaaggctaaggtcgtgtgggaaaaattttcaagtcagcccaaatttgaacgtgatcttttttaccacggtacgttccgggatgactttctttggggcgtatcttctagcgcctatcaaattgaaggcgcttgggatgccgatgggaagggacctagcatctgggacaatttcacacacactcccggcagtaacgtgaaagacaatgcaactggggatattgcatgcgactcataccaccaacttgatgctgacttgaatatgcttagagcgctgaaagtgaaggcctatcgattctcaattagttggagccgcatattccccaccggacgaaacagctctatcaatagtcacggggtcgactattataaccgattgatcaatggcctagtcgcctcaaatatttttccaatggtcactctgtttcattgggacctgccacaggctctgcaagacattggagggtgggagaacccagcactgatcgatctctttgattcttacgcagatttctgttttcagacattcggggatagggtcaaattctggatgactttcaatgaaccaatgtacttggcgtggctagggtacggatccggcgagtttccgcctggggtgaaagaccctggatgggccccctatagaatcgcccacgccgtaattaaagcccacgcccgcgtttatcatacatacgatgagaagtatagacaggaacagaagggggtaattagtctcagtctctccacacattgggccgagcccaagtcccccggggtgccccgagacgtggaagccgccgaccggatgctccagtttagcttggggtggttcgctcacccaatctttcgcaatggcgactatccagataccatgaaatggaaagtgggcaatcgaagtgagctgcagcatctcgccacttctcgtctgcccagctttactgaagaagaaaaaaggtttattagggctacggccgacgttttttgtcttaatacatactatagtcggattgtacaacacaagaccccacgcctgaaccccccctcatacgaggatgatcaggagatggctgaggaagaggacccttcttggcccagcaccgccatgaatcgggctgctccttggggcacccggcggttactgaattggatcaaggaggaatatggagatattcccatttacataacggaaaatggggtcggcctgaccaaccccaacaccgaggatacggaccggattttctatcataaaacctacatcaatgaagctctgaaagcatatagactggatggcatcgatttgcgcgggtacgtggcttggtccctgatggataattttgagtggctaaatgggtacacagtcaagttcggattataccatgtagatttcaataataccaatagacctcggactgccagagcctctgccaggtattacaccgaagttattactaacaatgggatgcccttggctcgcgaggacgaattcctgtacggtaggtttcctgaaggttttatctggtccgccgcgtctgcagcatatcagatcgagggcgcctggcgcgccgacgggaaaggtttgtcaatctgggatacattctcacatacacctctccgagtggagaatgacgctatcggcgatgtagcctgtgatagttaccacaagattgccgaagatctggtgacattgcaaaaccttggggtatcccactatcgcttttccatttcgtggtcacggattctgcccgacgggaccactaggtacatcaacgaggcagggctcaactactacgtgcgcttgatcgacacacttctcgccgctagcattcaaccacaggtcaccatctaccactgggatttaccacagacacttcaggacgtgggcggctgggagaacgagaccattgtccagcgatttaaggaatacgctgacgtgctgtttcagcggcttggtgacaaggtgaaattttggataactttgaacgaaccattcgtgatcgcgtaccaaggttatggctatggaacggccgcccccgtccatggccggctcgtatgcaccagctacttccaggaatggaggctgcaatag

SEQ ID NO: 121838 - DNA, 1005 bp, Artificial Sequence
  Description of Artificial Sequence: Synthetic coding sequence
atggcaactctgaaggagaaacttattgcgcctgtcgcagaggaggaagcaacagtgccgaacaacaaaataaccgtggtgggggttgggcaggtagggatggcctgcgccatctcaatactggggaagagcctggcagatgagcttgccctggtcgacgtgcttgaggacaaactcaagggggagatgatggacctacagcacggaagcctgtttcttcagacacctaaaattgtagctgacaaggattattctgtaaccgctaactccaagattgtggttgtgactgcgggcgtgagacagcaggagggggagtcaaggctgaatcttgtgcaacgcaacgtgaacgtttttaagtttattatcccacagatcgtaaagtattctcctgattgtataatcatagtcgtgagcaaccctgtggacatccttacctacgtcacatggaagctttctggacttcctaagcatagggtaattggtagtggttgtaacttagattccgcacggtttaggtacctcatggcagagaagctcgggattcatccttcgagctgccacgggtggatactcggggaacacggcgattcttctgttgcagtctggagcggggttaatgttgccggggtaagtcttcaggaactgaatcccgagatggggacagataacgatagtgaaaattggaaggaggtccacaagatggtggtggaaagcgcgtatgaagtgattaaactaaaggggtatactaattgggctattgggctgtccgtcgctgatctcatcgaatccatgcttaagaacctttccaggatccacccagtctcgactatggtgaaggggatgtacggtattgaaaacgaagtcttcttgagtctgccatgtattctaaacgcaaggggccttactagcgtgatcaaccaaaagttgaaggatgatgaggtagcccagctgaagaagtcagccgacacactgtgggacattcagaaagaccttaaggacctgtag

SEQ ID NO: 121839 - DNA, 699 bp, Artificial Sequence
  Description of Artificial Sequence: Synthetic coding sequence
atggcaactttgaaggaaaagctgatcgcccccgtggcagaggaagaggccacggtcccaaataacaagatcacagtggtgggagttggccaggtgggaatggcctgtgcaattagcatcctcggaaaatctttggcggatgaactcgcgctggtggatgtgctcgaagacaagctgaaaggagagatgatggacttgcaacatggatcattgtttctacaaactcccaagattgtggcagataaagattattcagtgaccgccaactcaaagatagtggtggtaacagccggggtgcgccaacaggaaggggagtccagactgaacctagtgcaacgtaatgttaacgtgtttaaatttatcatccctcagatagtgaagtacagcccagattgcattattatcgttgtgtccaaccccgtcgatattctgacctacgttacctggaagctgagcggactccccaagcatagagtgattggaagcggatgcaatttggattccgctcggttcaggtatctgatggctgagaaactgggcatccacccctcttcatgtcatggttggatcctgggtgaacacggggactcctccgtcgccgtgtggagcggggttaacgtcgcaggtgtgtccctacaggagcttaatccagagatgggcacagacaacgattccgaaaattggaaggaagtccattag

SEQ ID NO: 121840 - DNA, 1005 bp, Artificial Sequence
  Description of Artificial Sequence: Synthetic coding sequence
atggccaccctgaaggagaagctcatcgcccccgtcgcggaagaagaggcgaccgtacctaataacaaaatcacagttgttggggtgggtcaggtaggtatggcctgtgcaattagcatcctgggaaagagcttagcagacgaactagcacttgtcgacgtgctcgaagacaagttgaaaggggagatgatggacctacagcacggtagtctatttctgcagaccccgaagattgtcgccgacaaagactatagtgtcaccgccaattctaagattgtggtggtcactgctggggtgaggcagcaagaaggcgagtccagactcaacctggtccagaggaacgttaacgtttttaagttcattattcctcagatcgtgaagtactcccctgactgcattattatcgtcgtttctaatcctgtggatatactcacatatgttacatggaagctcagcggcctgccgaagcatagggtgatcgggagtggatgcaacctcgactcagcgagatttagatatcttatggcagagaaattaggaatacacccttcctcttgccatggctggatcctgggcgaacatggggactcctctgtcgccgtgtggagcggagtgaacgtcgcaggcgtgtccttacaggaactcaatccggagatgggcactgacaatgattccgagaattggaaggaagtgcacaagatggtggtcgaatcagcatatgaggtgataaagttgaaaggatatacaaattgggctattggcttgagcgttgcggatttaatagagagcatgctcaaaaacctctctagaatacatccggtttccacgatggtcaagggcatgtatggcattgaaaatgaggtgttcctatccctgccttgcatactgaatgcacgaggccttacaagtgtcatcaaccagaagctaaaagacgatgaggttgcccagctcaaaaaatctgctgatactctttgggatatacaaaaagatctaaaggacctctag

SEQ ID NO: 121841 - DNA, 414 bp, Artificial Sequence
  Description of Artificial Sequence: Synthetic coding sequence
atggccactctcaaagaaaaattgattgctcccgttgccgaagaggaagctaccgtgccaaacaacaagattacagtcgttggggtgggacaagtgggcatggcctgtgcaatatcaattctgggaaaatctctggcagacgagctcgccctcgttgatgtgctggaagacaagttgaagggagagatgatggacctccaacacggatctttattcctccagacaccaaagatcgtggcagataaggattacagtgtgaccgcaaattctaaaattgttgtggtgaccgccggagtacgtcagcaggaaggtgaaagtaggctcaacctggtgcagagaaatgtcaatgtctttaaattcataatccctcagatagtaaagtactcaccggattgtatcataatcgtggtctag

SEQ ID NO: 121842 - DNA, 309 bp, Artificial Sequence
  Description of Artificial Sequence: Synthetic coding sequence
atggcgactttgaaggaaaaactcatagccccggtcgcggaagaggaggccacagtgccaaacaataagatcaccgtcgttggtgtaggacaggtgggaatggcctgtgccatctccattctgggaaaatctctggccgacgagctcgccctggttgacgttctggaggacaagcttaagggggagatgatggatcttcagcacggctctttgtttctccagacacccaaaattgtagccgataaggactacagcgtgaccgccaacagcaagatagtggtggttacagctggggtcaggcaacagtag

SEQ ID NO: 121843 - DNA, 999 bp, Artificial Sequence
  Description of Artificial Sequence: Synthetic coding sequence
atgagcaccgtgaaggagcagctcattgagaagctaatagaggatgatgagaacagccagtgcaagatcacaattgtcggtactggggccgttggaatggcttgtgccatctccatcctgctcaaagatctagccgatgagctcgccctggtcgatgttgcgctggacaagcttaagggcgaaatgatggatctccagcacgggtccctgtttttttctacctcaaaaattacctctggtaaggactatagtgtctccgccaatagcaggattgtcatagtcacagcaggcgctcgtcagcaggagggcgaaacgcggctagctctcgtacagcgaaatgtagccatcatgaaatccattatcccagctatcgtgcactattccccagactgtaagattctcgtggtgagtaaccctgtggacatcctgacgtacatagtttggaaaatttctggtctcccagtgactcgagtgattgggagcgggtgtaacctcgacagcgccaggttccgataccttattggcgagaagcttggggtacatcctacatcctgccacggatggatcatcggagagcacggagacagctctgtgcctctttggtcaggggtaaacgtagctggggtggcattgaaaacactggatcccaagctgggcaccgattccgataaagagcactggaagaacatacacaagcaggtgatccagagcgcctacgagatcattaaactgaagggctacactagctgggcaatagggctttccgtgatggacctcgtgggctccatcctgaagaatcttaggcgcgtacacccagtgagtacaatggtgaaaggactctacggcattaaggaggagctctttctatctataccttgtgtccttgggcggaatggggtgagcgacgtcgttaaaattaatctgaactcggaggaggaggccttattcaagaagagcgcagaaactctgtggaatattcagaaggacctaattttttag

SEQ ID NO: 121844 - DNA, 999 bp, Artificial Sequence
  Description of Artificial Sequence: Synthetic coding sequence
atgtccactgttaaagagcagctcatagagaaactcattgaagacgacgagaacagccagtgcaagatcactatcgttgggaccggagccgtggggatggcatgtgcaatctcaattctgttaaaggacctggccgatgagttggcactggtggacgtggcactagacaagctcaagggggaaatgatggatctccagcatggatctctgttcttttcgacctctaagataacaagcggcaaggattactcagtctctgccaactcccgtatcgtaatagtgactgccggcgcaagacaacaagagggggaaacaaggctggccctggtgcaaagaaacgttgctattatgaaatccattattccagccatcgtccattattcaccagactgcaaaatcctcgtggtgagcaatcccgtcgatatcctcacctacattgtttggaagatctcaggactccccgtcacccgagttatagggagtggatgcaacttagacagcgcccgctttcgatacctcatcggagagaaactgggcgtgcaccctacctcttgtcacgggtggataattggcgagcatggagacagcagcgtcccactgtggagtggagttaacgtggctggcgtagcactgaaaaccctggatccaaagttaggcactgacagcgacaaggagcactggaaaaacatccataaacaggtcatccagagcgcttatgagatcatcaagttaaagggctacacatcttgggccatcggcctcagtgtgatggacctggtgggatccatcctcaagaatcttagacgggtgcaccccgtgtctacaatggtgaagggattgtatgggataaaggaggagctattcctctcaatcccatgtgtcttgggccgcaacggagtttctgacgtggtgaaaatcaatctcaattcggaggaagaagcgttgtttaagaagtctgccgagacattgtggaatatccagaaagacttgattttctag

SEQ ID NO: 121845 - DNA, 1524 bp, Artificial Sequence
  Description of Artificial Sequence: Synthetic coding sequence
atggcccggctcctgcggagtgctacctgggagctatttccctggagaggatactgctctcagaaagctaaaggggagctgtgcagagacttcgtggaagctcttaaggcagttgtcggaggttcccacgtgagcacagccgccgtagtgcgggagcagcacggacgagatgaatccgtccatcgctgcgagccaccagacgccgtggtgtggcctcagaacgtggagcaggtgagtaggctggcggccctttgttaccggcagggagttcccattattccttttggtaccggaacagggctggaaggtggggtttgtgccgtgcagggcggcgtgtgcgttaacctaacccatatggatagaattctcgagcttaaccaagaggattttagtgtggttgtcgaaccgggggttacgcgcaaagccttaaatgcgcatctcagagattcaggactgtggtttcctgtcgatcccggggcggacgcaagtctttgtggaatggccgccacaggcgcttccggaaccaatgcagtccgttatgggacaatgagagacaacgtcctaaatttagaggtggtgctgcctgatgggcgcctgttgcacacagccggtcggggcagacactttaggtttgggttctggcccgaaattccacaccacacagcctggtacagtccatgtgtaagtttaggcaggaggaaaagcgcagcgggatacaatctgaccggcctgttcgtcggctctgagggaacactcgggctgataaccgctacaacgcttaggcttcaccctgctccggaagccactgtcgccgctacatgcgccttcccttctgtgcaggcggctgtagattcgaccgtccatattctccaggccgccgtgcccgtggctcgcattgagtttctcgacgaggttatgatggatgcttgcaatcgatactctaagctaaactgtctggtggcccccacgcttttcctggaattccacggcagtcagcaggccctagaggagcagctgcagcgcactgaggaaattgtccagcagaacggtgcaagtgattttagttgggccaaggaagcagaggagagatccaggttatggacagcccggcacaacgcatggtatgcagcactggctacacgtccgggatgcaagggatactccacagatgtttgtgtgccaatttcaagactccccgaaatcgttgttcagacaaaggaagacctgaacgcatccgggctcaccggaagcatagtgggtcacgtgggtgacggtaatttccattgtatcctgctggtgaaccccgatgatgctgaagaactcggaagagtgaaggccttcgcggagcaactggggcgccgcgcattggctcttcacggaacctgcaccggggagcacggcattggaatgggcaaacgccaactgctgcaggaagaggtaggagcggtaggcgtcgaaaccatgagacagctgaaggctgttctcgacccgcagggtttgatgaatccaggaaaagtcctgtag

SEQ ID NO: 121846 - DNA, 1455 bp, Artificial Sequence
  Description of Artificial Sequence: Synthetic coding sequence
atggcccgtctactcaggtctgccacatgggaattattcccgtggaggggatactgctctcagaaggcaaagggcgagctgtgcagggactttgtggaggctctgaaggcggtcgtgggaggcagccacgttagcaccgccgcagtggtgcgtgagcagcatgggcgggatgaatctgtgcacaggtgcgagcccccagacgccgtagtgtggccccagaatgtggagcaagtctcaaggctggccgctctgtgctaccggcagggtgtgccaattattccattcggcacaggcaccggactggagggaggggtgtgcgccgtgcaagggggcgtctgcgtgaaccttactcacatggacagaattctggagttgaaccaggaggacttctcagtagttgtggagccaggtgtgaccagaaaagcactgaacgctcacttacgtgactccgggctctggtttcccgttgaccccggagcggacgcaagtctgtgcgggatggctgccacaggcgcttcaggaaccaatgccgtgcgatatggcaccatgcgcgacaacgttctgaacctggaagttgttctgcccgacggtcgcctactgcacaccgctgggcgggggcgccattttcgaaaaagtgcagcaggttataatctaacaggtttgtttgtaggctccgaggggacccttggcttgattactgccacaacactccggctccaccctgcccctgaagcgacagtggcagcaacttgcgccttccctagtgtgcaggcagctgtagacagcacggtgcacatcctccaagcagctgtccccgtggcgagaattgagttcttggatgaagtaatgatggatgcctgtaatcgctactctaagctgaactgcctcgtggcgccaaccctgttcctagaatttcacgggagtcagcaggccctagaggaacaattacaaaggacagaagaaattgtccagcagaacggtgccagtgacttctcttgggcaaaagaggcggaggaacggtctcgcctctggacagctaggcacaacgcctggtacgcggctctggctacacggcccggctgcaaaggttacagcactgacgtgtgcgtgccgatttctcgcctgcctgagatagtggtacaaacaaaggaagatctgaacgcatccggattaaccggctcaatcgtgggacatgtgggcgacgggaactttcactgtattctgttggtaaatcccgatgacgctgaagaactaggtcgggtaaaggcatttgccgagcagctgggtcgtagggctctggcactacatggcacatgcaccggcgagcacggaataggaatgggcaagagacaactcctgcaggaagaagtgggagctgtgggcgttgagactatgcgccaacttaaggcagtcttagacccacaggggttaatgaatcccggaaaggttttatag

SEQ ID NO: 121847 - DNA, 2139 bp, Artificial Sequence
  Description of Artificial Sequence: Synthetic coding sequence
atgcgggtgcttctgcacctacccgccttacttgcatctttaatcctgctgcaggctgccgcttccactaccagggcacagaccacacgaacctcagccatcagtgatactgtatcacaggctaaggtgcaggtgaataaagcgtttctggactctagaacaaggttgaagacagctatgtcatctgagactcctacgtccagacaactgagcgaatatctgaaacacgcaaagggccgcactcgcacagcaatcaggaatggacaagtctgggaggagtctctgaagcgactcaggcagaaggcatcgctgactaacgtaacagacccatctttggacctcacatccctgtcactcgaagtaggctgcggggccccagcccctgtggtgagatgcgatccttgttcgccatacaggactatcactggagattgtaacaatcgacgcaaaccagcacttggggctgcgaatcgggcactggcacggtggttaccagcggagtacgaggatggtctgagcctgccttttgggtggaccccagggaagacaaggaatgggtttcccttacccctggcacgggaggtgtccaacaagatagtagggtatctgaatgaggagggcgtgctcgaccagaatagatcactactcttcatgcagtggggccagatcgtcgaccacgacctcgattttgcacccgacacggaacttgggtccagcgagtatagtaaggctcagtgtgacgaatattgtattcagggcgataattgctttcccatcatgtttccgcccaacgaccctaaggctggcacacagggcaagtgcatgcctttcttcagggctgggtttgtatgccccacacccccttataagagtcttgcccgcgaacagatcaacgctctcacctcttttctcgatgccagtttcgtgtattccagcgagccatctttggcatcacgactgcgcaatctctcctcaccattgggactaatggccgtgaatcaagaggtaagcgatcacggcctgccttacctcccatacgattcaaagaagccgtccccctgcgagtttataaacactaccgctcgggtgccatgcttcctggccggggactctcgtgcttcagagcacattttgttggctacaagccacaccctctttttacgcgagcacaatagactagcacgcgagctcaaacgcctgaacccccagtgggatggtgaaaaattataccaggaggcgaggaagatcctaggggcatttgtccagatcatcacattcagagattatctgcctattttgctcggggaccatatgcagaagtggatccccccttatcagggttactcagagagcgtagacccccgaattagcaacgtgtttacgtttgcattcaggttcggacaccttgaggtgcctagttccatgtttagattagacgaaaactatcaaccttggggacctgagccagaactccccttgcataccctgttctttaacacttggagaatggtgaaagacgggggcatcgatccactagtgagaggcctcctggccaaaaaatcaaagctgatgaaacagaataagatgatgacaggtgagctacggaataagctgttccagcctactcaccgtatccacggttttgacctggctgctataaatacccagagatgcagagatcacggtcagccgggttacaatagttggcgcgccttttgtgatctgagccagccccagacgttagaagaattgaatacggtgttgaagtcaaaaatgctagccaagaagcttttgggtctgtacggtactcctgacaacatcgacatttggataggcgctatagctgagcccctcgtggagcgaggtcgtgtgggacctctgctagcatgcctgctgggaaagcaattccagcaaatcagagatggtgatcgcttttggtgggagaatcctggtgtcttcacaaacgagcagaaagattcactccagaagatgagctttagtcggctagtatgtgacaacacacggatcacaaaggtccccagagatcccttctgggcgaactcatatccctatgattttgtggactgttctgccatcgacaaactggacctgagtccatgggcctccgtgaagaactag

SEQ ID NO: 121848 - DNA, 1374 bp, Artificial Sequence
  Description of Artificial Sequence: Synthetic coding sequence
tgttttcctgttcagtttcctcctaatgaccctaaggccgggactcagggcaagtgcatgcccttctttcgggctggctttgtgtgtcctacccctccttacaagtcgttggcccgcgagcaaataaatgccctgacttcattcctcgatgcaagctttgtgtattcatctgagccatcattggccagtcggcttaggaacttatcctccccactggggctcatggccgtcaaccaggaggtcagtgatcacggattgccatatctcccatacgacagcaaaaaacctagtccctgtgaatttattaatactactgccagagtgccctgttttcttgccggcgacagtagagcttccgagcatattcttttagcaacctcccataccctttttcttagagagcacaataggctggctcgggagctgaagcggttgaatccccagtgggacggcgagaagctataccaagaggctcgaaagattctaggggcctttgtccagatcataacttttcgcgactacctacccatcctgctgggagaccacatgcaaaaatggatacctccgtaccaagggtattccgagtctgtcgatccccgcatctcgaacgtgttcactttcgcttttaggtttggtcacttagaggtacctagcagcatgttccggttggatgagaactaccagccatggggccccgaacctgagctgcccctgcatactctgtttttcaacacctggaggatggtaaaggatggtgggattgacccacttgtgagaggactgttggccaagaaatctaaacttatgaagcaaaataagatgatgaccggcgaactgagaaacaagcttttccaaccaactcataggatccacggattcgacctggcggccatcaatacccaaaggtgtcgggaccacggtcagcccggatacaactcctggagagcgttctgtgatctatctcaaccacagactttagaagagctgaacaccgtcctgaagagtaagatgctggcaaaaaaactcctaggcctctacggaacccccgacaacatagacatctggattggcgccatagccgagccactggttgagcgcggccgtgtaggcccacttttggcctgcctactggggaagcagttccagcagatcagggacggcgaccgtttttggtgggaaaacccaggggtcttcacaaacgagcagaaagacagcctacagaaaatgagcttctctcgcctagtgtgtgacaacacacgcattaccaaagtccccagagatcctttctgggctaacagctatccatacgatttcgtggattgctctgcaatcgataagctggatctctcaccatgggcctccgttaaaaattag

SEQ ID NO: 121849 - DNA, 1890 bp, Artificial Sequence
  Description of Artificial Sequence: Synthetic coding sequence
atgcgggttctcttgcatctgccggcgctgctcgccagcctcatactccttcaggccgcagcctccactaccagggatcctagcctggacctcacctcactctcgctggaagttggttgcggggccccggcccccgtggttagatgcgatccttgctcaccttatcggactataacgggcgactgcaataaccgtcgcaagcccgcactgggagctgcaaacagggctctggctagatggctccctgccgagtacgaagacggcttgagcctgccgttcgggtggactcctgggaagacacgtaatggattccccctgccattagctcgagaggtgtcgaataagatcgtgggatacctgaacgaggaaggggtattagaccagaatcgctcactgctgtttatgcaatgggggcagattgtggaccatgacctcgacttcgcgcctgatacggagcttggctccagtgagtactccaaggctcagtgcgacgaatactgcattcaaggggacaactgctttccaatcatgtttcctccgaacgacccaaaagccggaacccagggaaaatgtatgccgttctttagggccgggttcgtgtgtccaactccaccttacaaatccctcgcaagagaacaaatcaacgcgctgacatccttcctcgacgcgagctttgtctattcatctgaaccttctctcgcctccagattacggaaccttagcagtccactgggcctgatggctgtaaaccaagaggtgtctgaccatggactcccctatctgccctacgattccaagaagccaagcccatgtgaatttataaacaccacagctcgcgtcccttgctttctggcgggggactcccgtgcttcagaacacatcctgctggccacctcgcacaccttgtttcttagagaacataataggctcgcccgagaattgaaaaggcttaatccacagtgggatggagaaaaactgtaccaggaggcacgcaaaattctgggcgcatttgtgcaaattatcacatttagggattacctgccaattctcctcggcgatcatatgcaaaaatggatcccgccttatcagggttatagtgaatctgtggaccccaggatttccaatgtgtttacgtttgcgttccgtttcgggcacctggaggtgccttccagcatgttccggctcgacgaaaactatcaaccttggggcccagagcctgagcttccactgcacaccctgtttttcaacacttggaggatggttaaggacggcggcattgacccactggtgcgtggacttctggctaagaagtcaaaacttatgaagcagaacaagatgatgaccggtgaattgcgtaataaactctttcagccgacgcatcgcatccacgggtttgatcttgcggccattaacacacagcgttgccgcgatcatgggcagcctggatataattcttggagagctttctgtgatcttagccagcctcagacacttgaggagttgaacaccgtgctgaagagcaaaatgctggctaaaaagctgctggggctgtacgggactcctgacaatattgatatctggatcggggcgattgccgaaccattggtcgagagaggacgagttggaccgctcttggcttgcttgttgggtaagcagttccaacagattagggacggcgatcgcttctggtgggaaaacccaggcgtctttacaaatgagcagaaagactcactgcagaaaatgtccttttcaaggttggtctgcgacaacactaggatcaccaaggtccctcgggatccattttgggcgaattcttatccctacgactttgtagattgttccgccatcgacaagcttgatctgagtccatgggctagcgtgaagaattag

SEQ ID NO: 121850 - DNA, 1962 bp, Artificial Sequence
  Description of Artificial Sequence: Synthetic coding sequence
atgtccagcgaaacccccacctcacgacaactttccgagtacctaaaacacgctaagggaaggacccggacagcaatacgcaatgggcaggtgtgggaagaaagcctgaaaagactcagacagaaggctagcttgactaatgttacggaccccagtctggacctcaccagcttaagtcttgaagtggggtgcggagcacccgctcccgtggtgagatgcgatccatgctccccataccgcaccattactggagactgcaacaaccgacggaaacctgcactgggagccgctaatcgggcgctagcccgctggctgccggcggagtatgaagatgggctgtcacttccattcggctggactcccgggaagaccagaaatgggttccccctgcctcttgcccgcgaggtcagcaacaagatcgtgggataccttaacgaggagggagttctggatcagaatcgtagcttgttgttcatgcagtggggtcagatcgtcgaccacgatctggatttcgcccccgatactgaactaggcagcagcgaatatagcaaggcccagtgcgacgagtattgcattcagggtgataactgcttcccaataatgtttccacctaacgatcccaaagctggcacccaggggaaatgtatgccctttttccgagccggtttcgtgtgccccactcctccctacaaatccctcgctcgagaacagatcaacgccctcaccagttttttggacgctagttttgtttatagtagtgaaccctctctggcttccaggctgcggaatctgtcttctccccttggactgatggctgtgaaccaggaagtgtctgatcacggtcttccgtatttgccttacgattctaaaaaaccatctccgtgcgagttcatcaacactactgcaagagtgccctgctttctggcaggcgacagcagggcctccgagcatattttattggcaacaagccacactttgttccttagagaacataaccgactggcccgagaacttaaaaggttgaacccacagtgggatggggaaaagctataccaggaggcgcgaaaaatcctgggtgcctttgtccagattattactttcagagactacctccctatcctgctcggggaccatatgcaaaagtggatcccaccttatcagggctattccgagtccgttgacccccgaatatcaaacgtgttcaccttcgccttccgcttcggccacctggaggtaccatctagcatgtttcgactcgacgagaactatcagccctgggggccagagccagagctccctctccacacattgttcttcaacacctggcggatggtgaaagatggcggcatcgaccctctggtgcgcggcctgctcgccaagaagtcgaagttgatgaaacagaacaaaatgatgaccggtgaactcaggaacaaattgtttcagcctactcatcgtatccatgggtttgatctggccgccattaacacccagcgatgtagggatcatggccagcccggctataactcctggcgagccttttgtgatctgtcccagccacagaccctggaagagctgaacacagtgctaaaatcaaaaatgcttgcaaaaaagctcctggggttatacggcactcccgataacattgacatctggattggagctatcgccgaacccctagtcgagcgcggcagagttgggcctttgctcgcctgcctgttggggaagcagtttcagcagattagagacggagaccggttctggtgggagaacccaggcgtttttactaacgagcaaaaggactcacttcagaaaatgagcttcagcagactggtctgcgacaatactaggattaccaaagtgcctagggaccccttctgggctaatagctacccttatgatttcgtcgattgctcagcaatcgataagctcgatctctcaccatgggcatctgtcaaaaattag

SEQ ID NO: 121851 - DNA, 1323 bp, Artificial Sequence
  Description of Artificial Sequence: Synthetic coding sequence
atgggagatctagaactgctgctcccgggggaagccgaagtcctcgtccgcgggttgcgctccttccctctgcgggaaatgggcagtgaagggtggaatcagcagcatgaaaacctcgagaagcttaacatgcaggctatactagatgccaccgtctcccagggcgagccaattcaggaactgctcgtaacccacggaaaggtgcctaccctggtggaggagcttattgctgtagaaatgtggaagcaaaaggttttcccagtcttttgtcgtgtggaagattttaaaccacagaacacatttcccatatatatggtcgtgcatcatgaggcaagtattatcaatctcctggagacagtcttcttccataaagaggtgtgcgagtcggctgaagacaccgtactcgatctggtggactactgccacagaaagctgacactgctcgtggcccagtctggctgtggcggtccacccgagggtgagggctcacaggattctaaccccatgcaggagctgcaaaagcaggccgagctaatggaatttgagatcgcactcaaggcattgagcgttctacgctacataactgattgtgtggacagcttatctctctccaccttgtctaggatgttgagcacccataatctcccctgtttattggtagagttgctggagcatagcccgtggagtcgccgggaaggagggaaattgcagcagtttgaaggatctaggtggcatacggtggcgcctagtgagcaacaaaagttatcaaaactcgacggacaagtttggatcgctttgtataacctgctcctgtccccagaagcccaggcgagatattgtttaacttcctttgcaaagggtaggctgttaaagctgcgcgcgttcctcaccgataccctgttggaccagctccccaatctggctcacctacagtcttttctggcacacctaacattgaccgaaactcagcctccaaaaaaagatcttgtgcttgagcagatccctgagatctgggagaggctggagcgtgaaaatagaggaaaatggcaggccatagcgaagcatcagctacaacatgtcttttctccgtccgaacaggaccttaggctacaggccagaaggtgggccgaaacctaccgcctggacgtcttagaggccgtcgcacccgaacgccctcggtgtgcgtactgctcagctgaagcctcaaaacgttgtagccgttgtcaaaatgagtggtactgctgtagagagtgccaagtgaagcactgggagaagcacggaaagacgtgtgtgctagccgcccagggagaccgggcgaaatag

SEQ ID NO: 121852 - DNA, 2001 bp, Artificial Sequence
  Description of Artificial Sequence: Synthetic coding sequence
atgaggaaggtgagggggccacctgtctcttgtataaagcgggacagtccgattcagtgcatccaggccattgcagagaatcgggctgatgctgtgaccctggatggaggattcatttacgaggcggggctcgctccctacaagcttcggccggttgccgccgaagtgtacggaactgagagacagccgcgtacgcactattacgccgtcgccgtcgtgaaaaaaggtggcagctttcagctgaatgaactgcaggggttaaaaagttgccatacgggtctcagacggacggctggatggaacgtgccaattggcactctgaggccgttccttaattggactgggccccccgaacccattgaagcagccgtcgctcgctttttttcagcgtcttgcgtccctggagcagataaaggtcagtttcctaacctctgcaggctctgcgccggcaccggggagaacaaatgtgcattctcttcccaggagccctatttctcctactccggagcatttaaatgcctgcgcgacggcgccggggatgtcgccttcatcagggagtccaccgtcttcgaggacctttcagacgaggccgaaagggatgagtacgaactgctctgtcctgataatactcgcaaacctgttgacaagtttaaggactgtcatctggcaagagttccaagtcacgccgtagtcgcacgcagtgtgaacggcaaagaagacgccatttggaacctgctccgacaagcccaggagaagttcggtaaggataaatctccaaaattccaactgttcggctcgcctagcggacaaaaggacctgctgtttaaggacagtgcgataggcttctctagagtcccacctcgcattgattcagggctgtacctcggaagtgggtacttcactgctatccagaaccttcgtaagtccgaagaggaggtggcggcccgacgtgccagggtcgtctggtgcgctgtcggggagcaggagctgcgaaagtgcaatcagtggtccggcctttcagagggatctgtgacatgttcaagcgcttcgacaacagaggattgcatagccctagtgttgaaaggggaagcggacgccatgtcactggacggcggttatgtgtatactgctggcaaatgtgggctagtcccggtcctcgccgaaaactacaagtcacaacagtcaagtgaccccgatccaaactgcgtggatcggccagttgagggctatcttgctgttgcagtggtccgcaggagtgatacatcattgacgtggaatagcgtgaagggcaagaagtcatgccatacagcagtcgataggaccgccgggtggaatatcccaatggggctgttgttcaatcagaccggtagttgcaagttcgacgaatatttcagccagtcatgtgccccagggagcgacccacgcagtaatctgtgcgcgctgtgcatcggagatgagcagggtgaaaataaatgcgtgccgaatagcaacgagcgatactatggctatacaggcgcttttcgctgcttggccgagaacgcaggggacgtggccttcgtgaaggacgttacagttctgcagaacacagacgggaataacaatgaggcctgggccaaggacctaaagttagccgatttcgccctgttgtgcctagacggcaaacggaaacctgtaaccgaggccaggtcatgtcatctagcgatggctcctaaccacgccgtggtcagtcgtatggataaggtggagaggctgaagcaagtgctgctgcaccaacaagctaaattcgggcgaaatggatctgactgtccagataaattctgcctctttcaatcggagacaaagaacctgttgttcaatgataatacagagtgccttgcgcgcctgcatggaaagacaacatacgagaaatacctcggaccacagtacgtggctgggatcaccaacctgaagaaatgttcaactagtccccttctggaggcctgcgaattcttaaggaaatag

SEQ ID NO: 121853 - DNA, 453 bp, Artificial Sequence
  Description of Artificial Sequence: Synthetic coding sequence
atgaaacttgtgttcctcgtcttgttattcctgggtgccctgggactgtgcttagctggtcgtcggcgtagcgtgcaatggtgcgcagtttcacaaccggaggcgaccaagtgtttccaatggcaacgaaatatgagaaaggtcagagggcccccggtttcatgcatcaagcgggatagccccatccagtgtatccaggccattgccgaaaacagggcagacgcagttaccctggacggggggtttatctatgaggctggtctggccccctacaagctgcgccctgttgccgccgaagtctacggcacagagcgccagccagctgtgttccccgtgcagattaaggactctagccccacgtgcgtggcttgcgttcggggtcaggggaaaacaaacgtgccttctccccctcggaaccgtacatccgcgaccctggttccctcgagcgtctag

SEQ ID NO: 121854 - DNA, 846 bp, Artificial Sequence
  Description of Artificial Sequence: Synthetic coding sequence
atgactagcaaagaggatggcaaggccgctccaggtgaggagagacgccggagtcccttagatcacctgccccctcccgccaactcaaacaaaccgttgacacctttctctattgaagacattctgaataagccctccgtacgtagatcatacagcctttgcggtgcagctcatctgttggccgctgctgacaagcacgcccagggggggctgcccttggccggccgggctctcctgagccaaactagtccgctctgcgctcttgaggaactggcctcaaagacttttaaaggtctggaagtgtcagtattgcaggctgctgaaggcagagacgggatgactatcttcggccaaagacagacaccaaaaaagagacgcaaaagtcggactgcattcacaaatcatcagatttacgagcttgaaaagcgattcctgtatcagaagtatctgtctcctgccgaccgggaccagatcgctcagcagctgggcctgacgaacgctcaagtcatcacatggtttcaaaaccggagagcgaagcttaaacgagacctagaggagatgaaagcggacgtagaatccgcaaaaaagctgggtccatccgggcagatggacattgtggcactggctgaactcgagcagaattcagaggccactgctggtgggggtgggggctgcgggcgggctaagagccgcccggggtcccctgtgctgcccccaggcgcgcctaaggcccctggcgccggcgccctgcagctgagccccgccagccctcttaccgaccagcccgcaagttctcaggattgtagcgaggatgaagaggatgaggagattgatgttgatgattag

SEQ ID NO: 121855 - DNA, 597 bp, Artificial Sequence
  Description of Artificial Sequence: Synthetic coding sequence
atgaactccgggcgggaaccccgcactccgcggactttactgtcaatagctgatatcctggcccccagaatggtacctcgcgccccttcggccccccagttaccagagtctgggcctggacctacctctcccctctgtgcccttgaggagttgacctccaagacgtttaggggtcttgatgcccgggccttgcagccatctgagggcagggcgggccccgacgccttgggacccggaccctttggcaggaaacggcgtaagtccaggacggcttttacggcccagcaggtgctcgagcttgagagaaggttcgtgttccaaaagtacctggcgccttctgagcgggacggcctggccactcgcctcgggcttgccaacgcccaggtcgtgacctggttccaaaataggcgggccaagctcaagcgggacgtggaggagatgcgggcagacgtggcttcactgcgggctctgtctccagaggtgttgtgcagcctggcattgccagagggcgcccccgaccccgggctttgtctgggccccgcgggaccagacagcagacctcatttgtctgatgaggaaattcaagtggacgactag

SEQ ID NO: 121856 - DNA, 585 bp, Artificial Sequence
  Description of Artificial Sequence: Synthetic coding sequence
atgggtaagcgcacaagcctggaagtttcgctgggcgaactgggaggtgagaagtgccgtggtggacgccggtctttccccccacttgctgcatcccgccctgcccggccaggaggttggaggtgggctcgtcgcgatctctgcaagaccgcctccagagcagaaaataactctcaggcctgcaggccccaaaggcgagctggccccgacgctctggggcccggccccttcggccgcaagaggcgaaagtcacgcaccgcgtttacagctcaacaggtcctggagctggaaagaaggttcgttttccagaagtatctggcgccctcagagcgtgatggactagcaacccgcctgggtctggcaaatgcgcaggtggttacttggtttcagaataggcgggctaaattaaaacgggacgtcgaagaaatgcgcgccgacgtggcaagcttgagggctctcagccctgaggtcctttgtagtctggccctgcccgaaggcgccccagaccctgggctctgtctggggcccgctggcccagatagcagacctcacctttccgatgaggaaatccaggtggacgattag

SEQ ID NO: 121857 - DNA, 1398 bp, Artificial Sequence
  Description of Artificial Sequence: Synthetic coding sequence
atggaaacacctagccagaggcgggcaacacgctccggggctcaagcatccagtacacccctctcacctacaaggattacgcggttgcaggaaaaagaggatctgcaggagctcaatgaccgtctggcagtgtatattgacagggtgcgttccttggagactgagaacgccggcttacggttacgcatcacagagagcgaggaagtcgtgagccgggaagtgtcaggaattaaggccgcttatgaagctgagttaggtgatgccagaaagacactagactccgttgcaaaagaacgtgccaggctgcagctggagctgtccaaggtgagagaggagttcaaggagttaaaagctcgcaacactaaaaaggaaggagacttgattgcagctcaggctcgcctgaaggacctggaagccctgctgaatagtaaggaggctgccctttctaccgctctgtccgaaaaacgcaccctggagggtgagctgcatgatcttcgcggacaggttgccaagttggaagcggctttaggagaggccaagaagcagcttcaggacgaaatgcttcgacgggtggacgcagaaaaccggttgcaaactatgaaggaagagctagattttcaaaagaacatttattccgaagagttgcgcgagacaaagcgacggcacgagaccagattggtcgagattgacaatggtaagcagagggagtttgagtcccggcttgctgacgccttgcaagagctgagagcgcagcatgaagaccaggtggaacagtacaaaaaggagctggagaagacctactcagcgaaactcgacaatgcaaggcagtcggccgagcgaaattctaacctcgtcggggctgcccacgaggaactccagcagagccgcattaggattgactctctatccgctcagctctcccagctgcagaagcaactcgccgccaaggaggccaagctacgcgatctggaagacagcctggctagggagcgcgacacctcccgtaggcttctcgctgaaaaagaaagagagatggccgagatgcgggctaggatgcagcaacaacttgacgaatatcaagaacttctcgatatcaagttggcgctagacatggaaattcatgcttatagaaagttgcttgaaggagaggaggaaaggcttaggctgtcaccaagccccacctctcaacgctctagaggacgcgcgtccagccacagttcacagacacaggggggggggtctgtaactaagaagcggaagctagaatcgaccgagtcgagaagttcctttagccaacatgcccgtacgtctggtcgcgtggccgtggaagaagtggacgaggacgaagatggcgacgatctgctgcatcatcaccatgtcagtgggagccgcaggtag

SEQ ID NO: 121858 - DNA, 1905 bp, Artificial Sequence
  Description of Artificial Sequence: Synthetic coding sequence
atggaaactccgtcccagcgtcgcgctacccggagcggcgcacaggctagtagcacgccactatctcccacacgtataacccgtctgcaggagaaggaagacttgcaggaactaaacgaccggctagctgtgtatattgacagggtgcggagtcttgaaaccgaaaacgctggtctgcgcctgcgcataacggagtcggaggaggtggtgagcagggaagtctccggaataaaggccgcttatgaagctgagctcggggacgcgcgcaagaccctggactcagttgcaaaagaacgggcccgtttacagttagagctttccaaagtccgggaggaatttaaagaactgaaagctaggaatactaagaaggagggcgatttgatcgccgcacaggcgcggctcaaggatctagaagcccttctgaactccaaggaggccgcactgtctaccgctttgtcggagaaaagaacgctagagggcgagctccatgaccttcgaggccaggtcgctaagctggaggctgccctaggcgaggctaagaagcagctgcaggacgagatgctgcggcgcgtcgacgccgaaaataggctgcaaaccatgaaagaggagctcgatttccagaagaatatatactctgaggaattgcgggagacgaagcggaggcacgaaacccgtctcgtggaaatcgacaatggcaagcagcgtgagttcgaatcccggttggccgatgccctgcaggagctgagagcccagcacgaggatcaggtggagcagtacaagaaagaactggagaagacatactctgccaaactggataatgcgagacagtccgctgaaaggaatagtaacttggtgggagcagcacatgaggaactccaacagagccgaatccggatcgactcactgagcgcccagctgtctcagctgcagaagcagctggcagcgaaagaggcgaagctcagagatctagaggactccctcgctcgcgagcgggatacgagccgccgcctcctggcagaaaaggagcgcgagatggccgagatgagggcgaggatgcagcagcagttggacgaataccaggaattgcttgatatcaagctggcactcgatatggaaattcacgcataccgcaaactgcttgagggagaagaggaacgtctgcgactttctccttcccctacctctcaaaggagccgaggacgagcaagcagccactcatcccaaacacagggaggaggaagcgttaccaaaaagcggaagctcgaaagcaccgagtcccgcagctccttttcccaacatgcacggacgtcaggccgcgtagcagtcgaggaggtggatgaggagggaaagttcgtccgcctgagaaacaagagtaatgaagatcagagtatgggaaattggcagatcaagcggcaaaatggagatgacccactcctgacttatcgatttcctcctaagtttaccctgaaagccgggcaggtggtcaccatctgggcagccggggctggagcaactcacagcccacctaccgatctggtgtggaaggcgcagaacacttggggatgcggtaacagcctccgtacagcattgattaacagcacaggggagggatcacattgtagtagttccggggaccccgctgagtacaatcttcgatcacgcaccgttctctgcgggacatgcggccagcctgctgacaaggcgagtgccagtggatctggagcacaagtagggggcccaatttcatcaggatcatccgctagcagtgtaacggtaactcggtcttacagaagtgtggggggctctggggggggctcgttcggggacaatctggtgactcgctcatacctgttaggaaattcatcaccaaggacccagtctcctcagaactgttcaattatgtag

SEQ ID NO: 121859 - DNA, 1719 bp, Artificial Sequence
  Description of Artificial Sequence: Synthetic coding sequence
atggaaaccccctcgcagagacgagccacaagaagcggagctcaagcgtcaagtacacctctgagccccacccgaattactagacttcaggagaaagaggacctccaggagctgaatgatcgtttggccgtgtacatagatagggtgaggagccttgagaccgaaaacgccggcctaagactgaggatcacggagagcgaagaagtcgtctcccgggaagtctcaggaattaaggccgcttatgaggccgagctgggcgatgcaaggaagaccctggatagcgttgccaaggaaagggctcgactccagcttgaattatccaaggtacgggaggaattcaaggaactgaaggcaagaaatactaaaaaggagggtgacctgatcgcagctcaagcccggttgaaggatttagaggccctgttaaactctaaggaagcagctctgagtacggccctgtctgaaaaacgcacactggagggagagctccatgatctgagaggacaggtcgccaagcttgaggccgccctgggagaagcaaagaaacagctgcaagatgagatgctgagacgggtggacgcggagaacaggctgcagacaatgaaagaggagttggattttcagaaaaacatttactcagaagaactgcgcgaaacaaagcggcgacacgaaacccgactcgtggagatcgataatggcaagcaaagggaatttgagtcacgcctcgccgatgcattacaggaactcagagcccaacacgaagatcaagtggagcagtataaaaaagaactggaaaagacttatagtgctaagttagataacgcacgacagagtgccgaacgcaacagtaatcttgttggtgctgcccatgaggagttacagcaatcccggattaggattgattctttgagcgctcagctatcccagctgcagaaacagctggccgcgaaggaggcaaagctgagggacctggaagacagcctcgctcgcgagcgagataccagccgtaggttgctggctgaaaaagaacgcgagatggccgaaatgagggctagaatgcaacagcaactggacgagtaccaagagctcttggatattaagctcgcccttgatatggaaattcatgcataccggaaactcctagaaggggaggaggagaggctgcggctgagcccttcaccaacctctcagcgctcaagaggcagagctagtagtcactccagccagactcaaggcggtggctccgtgactaagaaaaggaagctggaatctactgaatctcgcagctctttctctcagcacgctcggacatccggtcgggtggccgtggaagaggtagacgaggagggaaagtttgtaaggttgaggaacaagagtaacgaagaccagagcatgggcaactggcagatcaaaaggcagaacggcgatgatccccttctcacttaccgcttccccccgaagttcaccctgaaggctgggcaagtggtaacaatatgggcagctggagccggcgccacacacagtccgcctaccgaccttgtgtggaaggcccagaatacctggggttgcgggaactccttgagaactgcactcataaattccaccggcgaggaggtggcaatgcgaaaactggtacggtcagtcaccgtcgtggaagatgacgaagatgaggacggcgacgacctgctccatcaccatcacgtgagtgggagccgaaggtag

SEQ ID NO: 121860 - DNA, 1476 bp, Artificial Sequence
  Description of Artificial Sequence: Synthetic coding sequence
atgcagccattactctgtctgggcaatctggaggacgcaagggaacgaactgggactctgctcgctcaacatcctgcatggggcaggactcgggcaaaacccgggagcccactgaacactaagaaggagggcgacctgattgccgcccaggcccggttaaaagacctggaggctctgttgaacagtaaagaggctgcactgtccaccgcattgtcagagaaacggacattggagggcgagctgcatgacctccgcggacaagttgcaaagctggaggccgcactgggggaggcgaaaaaacagttgcaggatgaaatgctgaggcgcgtggatgcggaaaatcgtctgcaaaccatgaaagaagagctggacttccagaagaacatttactcagaagagcttcgggagacaaagcgccgacacgagacgcgcctcgtggaaattgacaatggtaaacagcgggagttcgagtcgcgccttgctgatgctttgcaggagttgcgagctcagcacgaagaccaggtggaacaatataaaaaggagttagagaagacctattctgccaagctggacaacgccagacagtctgcagaaagaaacagtaatctggttggggcggcacacgaagagctccagcagagtcgcatccgcattgattcactgagcgctcaattgtctcaactccagaagcagctggcagcgaaggaggctaagctgcgcgatttggaagacagtctggctcgggaaagagacacaagtcggcgcctgctggctgagaaagagagagaaatggccgagatgcgtgcccgcatgcagcagcagctagatgagtatcaggagcttcttgacattaagttagctctcgacatggagattcacgcttatcgcaagcttctcgagggggaggaagaacgacttcggttgagcccctctcccacctcccaaagatccaggggaagggcttcctcacactcttcacaaacccagggcggtggcagcgtgactaagaaacgaaagctggaaagtacagagtctagaagctccttttcacagcacgctcgcacatccggccgtgtggccgtagaagaggtcgatgaagagggcaaatttgtgcgccttcgaaataaaagcaacgaagatcaatccatgggcaattggcagattaaacgccagaacggagacgatcctttgttaacctatcgcttccctcctaagtttaccctcaaggctggtcaggtcgtgactatttgggccgctggtgccggcgctactcatagtccccccacagatttggtttggaaggcccagaatacctggggctgtggcaactctctgcgaacagctctaattaatagcacaggagaggaagtcgctatgcggaaactggtgagatccgtgactgtggtggaggatgatgaagatgaggatggcgatgacctgctgcaccaccaccatgtgagtgggtcccgccggtag

SEQ ID NO: 121861 - DNA, 1845 bp, Artificial Sequence
  Description of Artificial Sequence: Synthetic coding sequence
atggagaccccctcgcagaggagagcaacccggagtggcgcgcaggccagcagcacccctttatcccccacaaggatcacccggttgcaggagaaggaggatctccaggaactaaatgataggctggcagtgtacattgacagggtccgtagtctcgagaccgagaatgccggcctcagactacgaattactgaaagcgaagaggttgtgagtcgcgaggtgtctggcattaaggctgcgtatgaggcagagttgggcgacgcgagaaaaacactggacagtgtggcgaaggagagagccagactccaactcgagctgtctaaggtgagagaagagttcaaggaactgaaggcaagaaatactaagaaagagggggatctgattgcagcgcaggctcgactgaaagacctggaggccctactgaacagtaaggaggccgcactttcgacagcactgtcagaaaaacggactctggaaggagagcttcacgacttacgcggccaggtagcaaaactcgaagccgctctcggggaggcgaaaaagcagttgcaggatgagatgttgaggcgtgtcgacgctgagaaccggctccagaccatgaaggaggaactggatttccagaaaaacatctattcagaggagttgcgagagacgaagcggcgtcatgagactcgcctggtcgaaatagacaacggaaaacagcgcgaattcgaatcaagactagccgacgctctgcaggagctccgggctcagcacgaggatcaagtggagcaatataaaaaggaactggagaaaacctactcagccaagcttgacaacgcaaggcagtctgccgaaaggaacagcaacttggtgggggccgcgcatgaagagttgcaacagtcacggatcaggattgattccctgtcggcacagctcagccagttgcagaagcaattggcggcaaaggaagctaaactgcgggatttggaagattccctagcaagagagcgcgataccagcagacggcttctggctgagaaagagagggaaatggccgagatgagagctcgcatgcagcagcaactcgatgagtatcaggagctgctcgatatcaagttggcactggatatggagatccacgcttaccgaaaactcctcgaaggcgaagaggagcggctccgactgtcccccagccccacctcccaacggtctcgaggtcgggcctcctctcactctagtcagacacagggtggcgggagtgtcacgaagaaaaggaaactagagagcaccgagtctcgctcaagttttagccagcacgctcggacatcggggagggtagccgtcgaagaggtggatgaggaggggaagttcgttcgcctgagaaacaagagtaacgaagatcagtctatggggaattggcaaattaagagacagaacggagacgatcccctcctaacctaccgctttccgcccaaatttacacttaaggcaggacaggtcgtaactatctgggcggcaggagcaggcgccacccatagccccccaaccgacttggtttggaaggctcaaaacacctggggctgtggaaactcccttcgcacggctttgatcaactcaacaggtgaagaagtcgcaatgagaaagctggtgaggtccgttacagtggtggaagacgacgaggacgaagatggcgatgacctgctccatcatcatcacggctcccattgttccagctccggcgatcccgcagagtacaatctgaggtctcggactgtgttgtgtggcacttgtgggcaacccgccgataaggcctccgcctcaggttccggtgcgcagagccctcagaattgctcaatcatgtag

SEQ ID NO: 121862 - DNA, 1995 bp, Artificial Sequence
  Description of Artificial Sequence: Synthetic coding sequence
atggagaccccaagccagcggagggctacaagatccggtgctcaagcctcctctactccactctcgcccacgagaatcacccggctccaagagaaagaagatctgcaggaactgaacgataggctagctgtctatattgaccgggtccggtcattggagacggagaatgccgggttgaggctaaggatcacagagagcgaagaagtagtcagtagagaagtttccggcatcaaagctgcttacgaagccgagcttggcgacgcacgcaagacccttgattcggtagcaaaagaacgggccaggctgcagcttgaactgagcaaagtgcgggaagagtttaaagaactcaaagcaagaaataccaagaaggagggggaccttatcgccgcccaggcccgactcaaggacctcgaagcgctacttaatagtaaagaagcagccctttctactgcactgagcgaaaagaggacactggagggggagctccatgacctcagaggccaggttgccaaactggaggccgcccttggggaagccaagaaacaactgcaagatgagatgttacggagggtggatgccgagaatcggctgcagaccatgaaggaagagttggactttcagaaaaatatatactctgaagaactgcgtgaaacaaagaggcgacatgaaaccagactggtggagatcgataacggaaagcaacgcgagtttgagtccaggctagccgatgcactccaggagttacgggcccagcatgaggatcaggttgaacagtacaagaaggaactggaaaagacgtacagtgcgaagctggataacgctcgccaatcagccgaacgtaactcaaacttggtcggggccgctcacgaggaactgcagcaaagtaggataaggatcgactcactcagcgctcagctctctcagttgcagaagcagcttgcagctaaagaggctaagctgagagacctcgaggactcgctggcacgagaaagagatacaagtagaagattgctagctgagaaagaacgggaaatggcggagatgcgagcccgcatgcagcaacagctggatgagtaccaagaactgttagacatcaaactcgcgcttgacatggaaattcacgcctacaggaagctcctggagggagaggaggaaagactgcgcctgagcccatcccccaccagccagcgctcgagagggagggcctcatcccatagttctcaaacccagggaggcggcagtgtcaccaaaaaaaggaaactagagtcaacagaatcacgctcaagtttttcccagcatgcgcggacttctgggcgggtcgctgtcgaggaggtcgatgaagagggaaagttcgtaaggctgagaaacaagtctaatgaggaccagagcatgggaaactggcagatcaagcggcaaaacggcgacgatccactactgacgtaccgattccctccaaaattcactctgaaggctggccaggtggtcacgatttgggctgccggcgccggtgcaacccactcaccgcccacagatctcgtttggaaggcccagaacacttggggttgcggcaattccctgcgaacagcactcataaactccacaggggaagaggtggccatgcgaaagctggttagaagtgtgaccgttgtcgaggacgatgaagacgaagatggagatgatctgttacaccaccatcacggtagtcactgttcatcttccggagacccagccgaatacaatctaagaagtaggacagttttatgtggaacctgcggccagccagctgacaaggcctcggctagtggatcaggtgcgcaggttggagggcctattagttcaggctcaagtgccagttcagtcaccgtgacacgatcatatagatctgtaggcggcagtggcggggggtcattcggcgataacctggttacgcgcagctacttgctcgggaactcatcccccagaacacaatccccccagaattgctcaatcatgtag

SEQ ID NO: 121863 - DNA, 1719 bp, Artificial Sequence
  Description of Artificial Sequence: Synthetic coding sequence
atggaaactccttcacagaggcgagccacaaggagtggggcccaggctagtagcacccccctcagcccaactcgaatcacaagactgcaggagaaagaagatcttcaggagttgaacgacagactggcggtttatattgacagagtccggtctctcgaaaccgaaaacgcgggtctgagactcagaattacggaatcggaggaggtggtgtcacgggaagtgtcagggattaaagccgcatacgaggccgagttgggcgacgctaggaagacgctggattcggtggcgaaagaaagagcccgtctgcaactggagttgagcaaagtgagagaggagttcaaggaactcaaagctcgcaatacgaaaaaagaaggcgatcttattgctgctcaggcacgactcaaagacctcgaggccctgttgaacagcaaagaagctgctttgtctacagccctgtctgagaaacgaactctagaaggcgaattgcatgacctgaggggccaagtcgccaaactggaagcagcactcggtgaggccaaaaaacagttgcaggacgagatgctcaggcgcgtggatgcagagaaccgcttgcagaccatgaaggaagaacttgactttcagaaaaacatctactctgaggaacttcgcgaaacaaaacgcagacacgagacaagactcgtggaaatcgacaacggaaagcagagagaattcgagtcaaggctggctgacgctttgcaagaactccgggctcaacatgaggatcaagtggaacaatataaaaaagaattggagaaaacgtattcagcgaaactggataatgccagacaatccgccgagcggaatagcaacctggtaggggccgcccacgaggaactacaacagagcaggattcgtattgatagcctgagcgcccagttgagtcagttgcagaagcagctcgccgcaaaggaagcaaaactgagggacttggaggactcccttgctcgagagcgtgacacaagtcggagactattggcggagaaagaaagagagatggccgaaatgagggccagaatgcaacagcagcttgatgagtaccaggagctgctggacattaagttggcgctggacatggagatccacgcctaccggaaactgcttgaaggcgaggaagagagactgagactttccccctcacctacctctcagaggagtcgaggtcgcgcatcaagtcatagcagtcagacacagggtggaggctccgtgaccaaaaaacgaaaacttgagagcacagaaagtcggtcatccttcagccaacacgcacgcacttcgggtagagtggcggtggaggaagtcgatgaggagggaaagttcgtgcggttgcggaataagtctaacgaagatcaatctatggggaactggcagatcaaaaggcagaatggtgacgatcctttactcacatatcgatttccccctaaattcactctcaaggcaggccaggtggtaacaatatgggctgctggtgctggagctacacacagcccacctactgatctggtgtggaaggctcagaatacttgggggtgcgggaactccctcaggaccgcacttatcaattcaaccggcgaagaggtcgccatgcggaagctcgtgaggtcagtgactgtggtggaggatgacgaagatgaggacggggacgacctgcttcatcaccatcacgtgagtggctcacgtagatag

SEQ ID NO: 121864 - DNA, 1476 bp, Artificial Sequence
  Description of Artificial Sequence: Synthetic coding sequence
atgcaaccactgttgtgcctgggtaacttagaagatgccagggaacgcaccggcactttgctggctcaacacccggcttggggccgcaccagagctaaacctggaagccctttgaataccaaaaaggagggcgacctgatcgccgcgcaagcacggctgaaagatctggaagctctcttgaatagcaaggaggcggccctgagtactgcgttgtcggaaaaaagaacacttgagggcgagctccatgacctgcgaggccaagtggccaaactggaagccgccttgggcgaggctaagaaacaactgcaggatgaaatgttgcggcgggtcgacgctgaaaaccgactacagacaatgaaggaggagctcgactttcagaagaatatttactctgaagagctcagggagacaaagcgccgccacgagactcggctagtcgaaatcgacaacggcaagcagagagagttcgaaagtagacttgcagatgcactccaggagctgcgcgcccaacacgaggaccaagttgaacaatacaagaaagaactggagaaaacttattcagccaagctcgacaatgccagacaaagtgctgagcgcaactccaatctcgttggagccgcgcacgaagagttgcagcagtcaaggattagaatcgatagcctgtcggcccagctgtctcagctccagaaacagctcgctgcaaaagaagctaaactgcgcgatttggaagatagcctagcaagagaacgagatacttcacggaggctgctggccgagaaggagcgggagatggcagagatgagggcccgcatgcagcagcaactggatgagtaccaagaattgctggacattaagttggcgctagatatggagattcacgcctaccgcaaactattggaaggggaagaagagagactcaggctgtctccctcacctacgtcacagcgaagccgcggacgggcctcatctcacagctcccagacccagggaggtgggagcgtgacaaagaagaggaagctggagagtacagagagccgatctagcttcagccaacacgctcgcacatccggccgagtggccgtggaagaggtggacgaagagggcaagttcgtgcggctgcgtaacaagtccaacgaagatcagagcatgggtaactggcagatcaagcgacagaacggagacgatccactgctgacttacaggtttccccctaagttcacattaaaagctggacaggtagtgacaatctgggcagccggcgcaggggccacacacagtcctccgactgatcttgtttggaaggcacaaaacacctggggttgcggaaattctttaagaacagctctgatcaattccactggagaagaggtggccatgcgtaaactggtgagatccgtaacggtcgtggaggatgacgaagacgaagatggcgacgatctcctgcatcaccaccacgttagtggctccaggaggtag

SEQ ID NO: 121865 - DNA, 1464 bp, Artificial Sequence
  Description of Artificial Sequence: Synthetic coding sequence
atggaaactccgagccagagacgcgcaactcgatccggggcccaggctagctctacacctctgtcacctaccagaattacacggcttcaggagaaagaggacctacaggaactcaatgaccggctggccgtgtacattgatcgggtcaggtctctcgagaccgagaacgccggtttgcgacttagaatcaccgagtccgaggaagtggtttctagagaagtaagtggaattaaagctgcgtacgaggccgagcttggagatgctaggaaaacactggactccgtcgctaaagaacgcgctaggctgcagctggagttatccaaggtcagagaggagtttaaggagctcaaggcccgaaacaccaagaaagagggtgaccttatcgctgcccaggctcggctgaaagacctcgaggcgctgctgaattctaaggaggccgccctgtcaactgctctgtccgagaagcggaccctggagggcgaattacatgacctcagagggcaagtcgccaaactggaggccgcactcggcgaggctaagaagcagctgcaggacgaaatgctgaggagagtggacgctgagaatcggctccaaaccatgaaagaggagcttgatttccaaaaaaacatttacagtgaggagctgcgggagacgaagagacgacatgagaccagacttgtggagatagacaatggcaagcagagagagttcgaaagccggctcgctgatgcactacaggaactgcgtgctcagcatgaagaccaggttgagcagtacaaaaaagagctggagaagacttatagcgcgaagctggacaacgccagacagtcagccgaaagaaatagtaatctggttggcgccgcccacgaggaactgcaacaaagccggatacggatcgattccctgagtgctcagctgagccagctgcagaaacaactggctgcgaaagaggctaaactgagggacctggaggacagcctggctcgggagagggacacctctcgtcgattgctggctgagaaggagagggagatggccgagatgagggcgcggatgcagcagcagctggacgagtaccaggagttgctggatatcaaacttgcgctagacatggaaattcacgcttatagaaaactgctggagggagaggaagagcgcctgagactaagtccttccccgaccagccagcggtcccgaggaagggcatccagccattcttctcagacacagggcggcggatcagtaactaaaaaaagaaaactggagagcactgagtccaggtccagcttttcacaacacgcaagaacatccggcaattctctgaggaccgcactgattaactctacgggagaagaagtagccatgcgcaagctagtccgttctgtgaccgtggtagaggacgatgaggacgaagacggcgatgatctgctgcatcatcatcacgtgagtggatcacgccgctag

SEQ ID NO: 121866 - DNA, 1725 bp, Artificial Sequence
  Description of Artificial Sequence: Synthetic coding sequence
atgggcaattctgaagggtgcaatacaaagaaggagggagacctgattgccgctcaagcccggcttaaagacctcgaggccctgcttaacagcaaggaggccgccttaagtacagccctgtcagagaaacggactctcgaaggtgagttgcatgatctgcgcggacaggtggccaagttagaggcagcccttggggaagccaagaagcagctccaagatgaaatgctacgtagagtggacgccgagaaccggctgcagactatgaaggaagaactggattttcagaagaacatctactctgaggaactaagggagaccaagagacggcacgagacacgcctggtggagattgacaatggcaagcagagagaattcgaaagtaggctcgctgatgccctgcaggaactcagagcgcagcacgaagatcaggttgagcagtacaaaaaagagctggaaaagacgtattccgcaaagctggataacgcccgccagagtgcggagagaaactccaatctggtcggggctgctcatgaggagctacaacagagcagaataagaatcgacagcctctcagcacaactgtcccaactgcagaagcagctggccgctaaagaggccaaactccgcgacctagaggacagcctggccagagaacgcgacaccagcagaagactactggccgagaaagaacgcgagatggctgaaatgcgtgctaggatgcagcaacagttggacgagtatcaggaattactggacatcaagctggcactggatatggagatccacgcgtataggaagttgctggagggagaggaggaaagactccgactgtcacctagtccgactagccagaggtcaaggggccgcgcatccagccattcttcccagacacagggaggggggagcgtgacaaaaaaacggaaactagagtcgacagaatcacgaagttctttcagtcagcacgcccgtacttccggccgggtggcggtggaagaagtggacgaggaggggaagtttgtccgtctcaggaacaaatccaacgaggaccagtcaatgggaaattggcagataaaaaggcagaatggggacgaccccctgctgacctatagatttccacctaagttcacactgaaagcaggacaagtagtgacaatttgggcagctggggctggagctactcactctcccccgaccgatctcgtctggaaagcccagaacacctggggatgcgggaatagtctgcgcaccgcactaataaattcaacaggcgaagaggtcgccatgcgcaagttggtcagatctgttacagtggtcgaggatgatgaagatgaggacggagatgatctccttcaccaccatcatgggtcacattgctcctcatctggggatccagcggaatataatttaaggtccagaaccgtgctgtgtgggacctgtggccaacccgccgacaaggcatccgcgtccggttccggcgcacaagtgggcgggcccatatccagcggtagttccgccagttccgttaccgtgacacggtcctatcgttcagtcggggggtccggggggggttcttttggagacaacctggtgaccagatcctacctgctgggtaattcgagcccgagaactcaaagcccgcagaattgctcaatcattcaggagatgggaatgaggtgggaagtcgaagagggccggagaaaagtgagcctgtcgtgcctcccctag

SEQ ID NO: 121867 - DNA, 1848 bp, Artificial Sequence
  Description of Artificial Sequence: Synthetic coding sequence
atgccaagccggaaattcgccgacggtgaggtagttcgcggcaggtggcccgggtcctccctatactatgaagtagagattttgtcacacgattccacatcgcagctatacaccgttaagtacaaggatgggactgagttggaactgaaagagaacgacatcaaacccctgacatccttcaggcagaggaaaggcggaagcacctctagctctccatcaaggagaagaggaagccgttcgcgaagccggtcccggtccccaggacgaccaccgaaatctgcccggaggtccgccagtgccagccatcaagcagatatcaaggaagcccggcgcgaggtggaggtgaaactgactccactcatcctgaagcctttcggaaattcaatctctagatacaatggagagccagagcatattgaacggaatgatgctcctcacaagaatactcaggagaaattttctctctctcaggaaagtagttacattgcaacccagtactctttgcgacctagacgagaggaagtcaagcttaaggaaattgattctaaagaggagaaatatgttgctaaggagctggcagtgagaactttcgaggtgactccgatccgagccaaggaccttgaattcgggggcgtgcctggcgtgttcctcatcatgttcggcttgccagtatttctgttcctgctgctgctgatgtgcaaacaaaaggatcctagtctactcaatttcccccctccacttcccgcattatacgaactatgggaaacaagagtgtttggagtctatctgctgtggtttcttattcaggtgttgttctatctgttgccgatcggaaaggtcgtcgagggcaccccacttatcgacgggaggaggctgaagtatcgcctcaatggcttttatgcgttcatccttacatccgccgtaattggtacctcactgtttcagggcgtggaatttcactatgtctactcccattttctgcagttcgcgctggcagcgacagtcttttgcgtggtcctttcagtttatctgtatatgagatcgttgaaagcgccgcgcaatgacttgagtccagcttctagtggtaacgctgtctacgactttttcatcggacgagagctgaatccaagaatcggcacatttgaccttaagtatttctgtgagctcaggccagggctgataggctgggtggtgatcaacctggtgatgcttctggctgagatgaagatccaggaccgagcagtgccttccctagcaatgattctagttaactctttccagctgctgtacgtagtcgatgccctgtggaacgaagaagcacttctaacgaccatggacattatccatgatggtttcggattcatgctggccttcggtgatctggtgtgggtgccgttcatttattcttttcaggcattttatctcgtctcccatccaaatgaagtgtcttggccaatggcaagcctcatcatcgtcctcaaactctgtggatatgttatcttcagaggcgccaacagccaaaagaacgcttttagaaaaaatccgtccgaccctaagctggcacacctgaaaaccatccacacttctaccggcaaaaacttactggtgtccggctggtggggcttcgttaggcatcctaactatctgggagatctgattatggcgcttgcatggtccctcccctgtgggtttaaccatattctcccatacttctacatcatttacttcacaatgctgttagtacatcgcgaagcacgagacgagtaccactgcaaaaaaaaatatggcgtcgcatgggagaagtattgtcagcgggtaccctatcgcatcttcccatatatatactag

SEQ ID NO: 121868 - DNA, 1848 bp, Artificial Sequence
  Description of Artificial Sequence: Synthetic coding sequence
atgccctctcggaaatttgcagacggagaagtagtgcgaggaaggtggccggggtcatccctgtactatgaggtggagatcctctctcatgactcaacttcccagctttataccgtaaagtataaagacggaaccgaactagagctgaaagagaacgatataaagcctctgactagctttcggcagcgtaagggcggcagcacctccagttccccctcaaggaggcgcggctccaggtcacgatcaaggtcccgctcccccggaaggcctcctaagagtgcacgtcgtagcgcaagcgcatcacaccaggccgatattaaggaagctagacgagaagttgaggtaaagctgactccactaattctaaaaccttttggcaattccatctcgaggtacaacggtgagcccgagcatattgaaaggaacgacgcaccacataaaaacactcaggagaagttttcactcagtcaagagtcgagctatatcgctacacaatacagcctcaggccccgccgggaggaagtaaagctgaaggaaattgattctaaggaagaaaagtacgtggctaaagaactggcagtccgcactttcgaggtgaccccaatccgagccaaagacctcgagtttggaggcgttcccggcgtgttcctcattatgttcggactgcccgtcttcctctttttattacttctaatgtgtaaacaaaaagaccccagtctgttgaatttcccgccgcctcttcccgcgctatatgagctctgggagactcgagtgtttggcgtttatctcctttggttcctgatccaggtgctgttttacctgctacctattggaaaagtggttgaaggaacacccctgatcgatggtagacggcttaagtatcgattgaatggattctacgctttcattttaacctcggccgtcattggaacgagcctgttccagggtgtcgaattccactatgtttattcccacttccttcagttcgccctggcagccactgtattctgcgtggtgttatccgtgtatctttacatgcgcagccttaaagctcctaggaacgatctgagccctgctagcagcggcaatgccgtgtacgatttcttcattggacgcgaactcaatcctcggataggcacatttgatctgaaatacttctgcgaactccgcccaggcctgatcggctgggtagtgatcaatctagtcatgttgctggctgagatgaaaatccaagaccgtgccgtgccctcactcgctatgatcctggtgaacagctttcagcttctatacgtcgttgatgcattatggaatgaagaagccctcctaaccactatggacattattcacgacggatttggcttcatgctcgcttttggagatctcgtctgggtgccatttatctatagttttcaggccttctacctcgtgtcacacccaaacgaggtgagctggcctatggcatcgctgatcattgttctaaaactctgcggctatgtcatctttcgtggtgcaaactcacagaaaaatgcttttcgaaagaacccttccgatcctaagctggcccatttaaagaccatacatacttcaaccggtaaaaatctgttggtgagcggatggtggggctttgtgcgccacccaaattacctcggggacctgatcatggcattagcctggtcattgccatgtggttttaaccatattctcccatatttttacattatctacttcaccatgcttcttgttcaccgggaggcacgtgacgaatatcactgtaagaaaaagtatggcgtcgcttgggagaaatactgccagcgcgtgccctatcgaattttcccttacatctactag

SEQ ID NO: 121869 - DNA, 156 bp, Artificial Sequence
  Description of Artificial Sequence: Synthetic coding sequence
atgccttcgagaaaatttgcagatggcgaagtagtcagaggaaggtggcctggaagtagtctatactacgaggtggaaattctctcccacgattccacttcacaactgtatactgtgaagtacaaggacggcacagaattagaactgaaggagtag

SEQ ID NO: 121870 - DNA, 387 bp, Artificial Sequence
  Description of Artificial Sequence: Synthetic coding sequence
atcggcagggagctcaatccccgaatcggcacattcgacctcaagtatttttgcgagctgcgccctggactaattggctgggtggtcattaatctagtgatgctacttgcagaaatgaagatacaggaccgggcggtgccctctctggccatgatccttgtgaattcttttcagctgctctatgtggtcgacgcgctgtggaatgaggaagctttgctgactaccatggatattattcatgacggcttcggattcatgcttgccttcggcgatctggtgtgggtacccttcatctacagctttcaggccttctatttggtttctcacccaaacgaggtatcttggcccatggcttctctgatcatcgtgctgaagcgagagtactag

SEQ ID NO: 121871 - DNA, 642 bp, Artificial Sequence
  Description of Artificial Sequence: Synthetic coding sequence
atgccgtccagaaaattcgccgacggagaagtggtccggggccgctggcctggctctagtctatattatgaagttgaaatcctttcccacgattctacatcccagctttacacagtcaagtacaaagacgggacggagcttgagttgaaggaaaacgacatcaagcctttgacttcattcaggcagcggaagggaggcagcaccagctcctcaccaagtagacgccgaggaagcagaagccgctccagatcccggagtcctggacgacccccaaaaagcgcgcggaggtcagctagtgctagtcatcaggccgacatcaaggaggcgaggcgggaggtcgaagtgaaactcacccccctgatcctgaaacctttcgggaactccatcagcagatataacggggagccggaacatatagagcgaaacgatgctccccataaaaacacacaggagaaattcagcctatctcaggagtcttcttacattgccactcagtacagcctcagaccacgccgcgaagaggtgaagctgaaggagatcgattctaaggaggagaaatacgtagcaaaagagctagccgtgagaacatttgaggtgactccgatcagagcaaaagatctcgaattcgggggcgtgccgtag

SEQ ID NO: 121872 - DNA, 324 bp, Artificial Sequence
  Description of Artificial Sequence: Synthetic coding sequence
taatctacctctctgaaaatgtacttctacttctacatagatctgaagacaattcatacttcaacaggcaagaatctgctagtgtctgggtggtgggggtttgtcagacacccaaactatctcggggacctcataatggcactggcatggtcattgccatgcggatttaatcacatcttgccttacttttacattatctattttactatgctactggttcacagagaagcccgagacgagtaccactgcaagaaaaagtatggggtggcatgggagaaatactgtcagagggtgccttatcggattttcccgtatatatattag

SEQ ID NO: 121873 - DNA, 1761 bp, Artificial Sequence
  Description of Artificial Sequence: Synthetic coding sequence
atggccactgcgacacctgtgcctcccaggatggggtcaagggccggggggcccactacccccctgtcacccacacggctttcaaggttgcaggaaaaggaggagttgcgagagctgaatgaccggctggctgtgtacattgataaggtccggtctttggaaacagaaaactccgctctgcagttgcaggtgaccgagagagaggaagtccgaggcagagagcttacaggacttaaggccctgtatgagacagagttggcagatgcccggagggctcttgacgataccgctcgcgaaagggctaaactacagatcgagcttggtaagtgtaaagcagagcacgaccagctactgctgaattatgcaaagaaggagtcagatctaaacggggcgcagattaagttgcgtgaatacgaggcagcacttaacagtaaggacgcagccttggctaccgcgctaggcgataagaaaagcctggagggagacctggaggacctgaaagaccagatcgctcaactggaggctagcctcgctgccgctaagaagcagttagccgatgagacactcctcaaggtcgatctcgagaataggtgtcagtctttgacagaagatctagaatttcggaaatctatgtacgaagaggagatcaatgagaccaggaggaagcatgaaacccgactggtcgaagttgattctggtcggcaaatcgaatacgaatataagctggcccaggcgctgcacgagatgagggagcagcacgacgctcaggtgcggttatataaggaagagctcgagcaaacttaccacgccaaacttgagaacgccaggttgagctccgaaatgaatacctcaacggtcaattccgcccgggaggaactgatggagtcacggatgcggatcgaaagcttgtcgtctcagttaagcaacttacagaaagagtcacgcgcatgtcttgaaagaattcaagagttagaggatttattagccaaggaaaaggacaattccagacgaatgctaaccgacaaggaacgggagatggctgagattagagaccagatgcagcagcaactgaacgactatgagcagctcttagatgtgaaacttgctctcgacatggaaatttccgcctatcgtaaactgctagagggcgaagaggaacggctgaagctgtctcccagtccttcaagcagagtgactgtatcacgagcgtcatcttcaaggtcagtgaggaccactcgcggtaaaaggaagagggtggatgtggaagagagcgaggcctcgtccagtgtaagcatcagccacagtgccagcgccacaggcaacgtgtgtatcgaggaaattgacgtggatggcaaatttatccgcctcaagaatacttctgagcaagatcagcccatgggcggctgggagatgataagaaaaattggggacacctccgtgtcatataagtacaccagccgctacgtgcttaaagcagggcagacagtgactatctgggcagccaacgccggggtgaccgctagcccccctaccgatcttatttggaagaaccagaactcctggggcacgggggaagatgtgaaggtcatcctcaagaatagtcagggagaggaagtcgcccaaagatctacagtgtttaagacaacaattcccgaggaagaggaggaagaagaggaggcagctggggtagtggttgaagaggagctttttcatcaacagggcacgccacgcgcctccaatcgttcatgcgccatcatgtag

SEQ ID NO: 121874 - DNA, 1803 bp, Artificial Sequence
  Description of Artificial Sequence: Synthetic coding sequence
atggccacccctttgccgggtcgtgccggagggccggctactcctctatctcccacaagactgtctaggctccaggagaaggaggagctacgcgagcttaatgacagactggctcactatatcgatagggtgcgagctcttgagcttgagaacgaccgtctattgctgaaaatcagcgaaaaggaagaggtgacaacccgggaggtatccggaatcaaggctctgtacgaaagtgaattagccgacgcacgccgggtcctggatgagaccgcccgagagagggcaagattacagatcgagatcggaaaattacgcgccgagctagatgaggtaaataagtcagctaagaagcgggagggcgagctgaccgtggctcagggtcgagttaaggacctggaatctctttttcatcgcagcgaagtggaactagccgcggccctgagcgataagcgtggtttagagagcgatgttgccgagctgagggcccagctggccaaagcggaggacgggcacgccgtagccaagaagcaattggaaaaagaaactctcatgcgggtggatttagagaatcgctgccaatctctccaagaggaactggacttccggaaaagtgtgtttgaggaggaggtcagagagacaagaaggcggcacgagaggcgcctggttgaggtggacagcagccgtcaacaggagtatgatttcaaaatggcccaggccttggaggagttgcgatctcaacatgatgagcaagttaggctctacaaactcgaactggagcagacctatcaggctaagctcgactcagcaaagctgtctagtgatcagaacgataaggcagccagcgctgcccgggaggaattgaaagaggctcgaatgaggctcgagtcactgagctaccagcttagcggccttcagaagcaggccagcgcagctgaggatcggattagggaacttgaagaagcaatggctggggaacgtgacaaattccggaagatgctggatgccaaggaacaagagatgaccgagatgagagatgtgatgcaacaacagctggccgaataccaggagctcctagacgttaaacttgccttggatatggaaataaatgcttatcgcaagttgctggaaggtgaagaagaacgactaaaacttagcccctccccctccagtagagttacagtttccagggcgaccagtagtagctccgggagtcttagcgccactgggcggctgggccgctctaaacgcaagcgactcgaagttgaggaacctctaggctccgggccctctgtgctgggaactggaacaggcggctccggcggcttccatttagcacagcaggcctcggccagcggctccgtgtccattgaggagattgacctggaaggaaaatttgtgcaactcaagaataactcagataaggaccagtcgttgggtaactggcgcatcaagcgccaggtgcttgaaggcgaggagatcgcctataagtttactcctaaatacatactgagagctggccagatggtcaccgtatgggccgctggcgccggcgtagcacatagtcccccctctaccctcgtctggaagggacagtctagctgggggacaggcgagtcctttcgtacagtcttagtgaatgccgatggagaagaggtggccatgcgcactgtgaaaaagtcttcggttatgagggagaacgagaatggggaagaggaggaagaggaggccgagttcggggaagaagacctttttcatcagcagggtgaccctagaacgacctcgaggggatgttacgtgatgtag

SEQ ID NO: 121875 - DNA, 1803 bp, Artificial Sequence
  Description of Artificial Sequence: Synthetic coding sequence
atggctacccccctcccagggagagccggcggccctgccacgcctttatctccaactaggctgtcacgattgcaggagaaggaggagcttcgtgagctgaacgaccgcctggctcactacatcgaccgagtgcgagcgctggagctcgagaacgacagactgctgcttaagattagtgaaaaagaagaagtgacaacacgcgaagttagcgggattaaggctctgtatgaaagcgagctggccgacgctcgacgtgttctcgatgaaaccgcgagagagagggccagactccagattgagattggaaaacttcgcgcggagcttgacgaggtgaataaatccgcgaaaaaacgcgagggagaactcacggtcgcccagggcagggtgaaggatctagaatccttgtttcacagatctgaagtcgaactggctgcggctctgtcagataaacggggtctcgagtccgacgttgccgagctgcgcgcccagctggcaaaggccgaagacggccatgcagttgcaaagaaacaactcgaaaaagagacccttatgcgagttgaccttgaaaatagatgtcaaagcctccaggaggagctggacttcaggaagagtgtgtttgaagaggaggtgcgagagactaggaggcgtcatgagaggaggttagtggaggtggacagttctagacagcaggagtatgattttaaaatggctcaagctctggaggaactcaggtcacagcacgacgagcaggtgcgcctttacaagttggagttggaacagacgtatcaggccaagttagattctgccaaattatcttctgaccaaaacgataaagccgcatcagccgcccgcgaggagcttaaggaagccaggatgaggctggagtctctgagctaccagctctcaggactgcaaaaacaggctagtgcggcagaggacagaatccgagaacttgaagaggccatggccggagaaagagataagtttcgaaaaatgctcgacgccaaagagcaggagatgacggagatgcgagatgtcatgcagcaacaactggcagagtaccaggagctcctagatgtgaagctcgccctcgatatggaaatcaatgcatatagaaaattgctagaaggagaggaagaacgcctgaagctctcaccctcacctagcagtcgcgttactgtgtctagggccaccagctcaagcagcggctccttatctgcaacgggccgcttgggaaggtctaaacgcaaacgactggaggtcgaggagcccctgggcagcggaccttccgtgttgggaactggtaccggaggttctggcggctttcacctggctcagcaggcctcagccagtggttctgtgtctatcgaggagatcgatctggaaggtaagttcgtgcagcttaaaaacaatagcgataaagatcagtctctaggaaactggcggataaaacgacaggtactggagggcgaagaaatcgcctacaagtttacaccaaagtatatcctgcgcgctggacagatggtgactgtgtgggctgccggtgccggggttgcgcatagccctccctcgactttggtgtggaagggacagtcctcttggggaacaggcgagtcatttagaaccgttctcgttaatgcagatggcgaggaggtcgctatgaggaccgtaaaaaaatccagcgtgatgagagaaaacgagaatggggaggaggaagaagaggaggccgagttcggagaggaggacttatttcaccagcagggtgatcctaggactacctctaggggctgctatgtaatgtag

SEQ ID NO: 121876 - DNA, 651 bp, Artificial Sequence
  Description of Artificial Sequence: Synthetic coding sequence
atgctaattggaggcaacattgaggtgcacgtgaaccctggtgacggcacgggcttacggaaggcgctgctacacgcacctacgggcacctgctcagatggccaggcacactcaatttcattagtgagaaaccgaaggatcattaccgtgcagctggatgagaacaaccctgtggaaatgaagctgggtacactggttgagtcccggaccataaatgtctctaacctttatgttggcggcatccccgaaggggagggcactagtctcctcactatgcggcggtctttccacgggtgtatcaagaatcttattttcaaccttgagcttctcgactttaactctgccgtcatgagcaagtccacatggactcccgcaggttgtcagaagggtctgagttggctgcctatgcagcggaccaagctgctcccagagccaagagccttccccgtgggagctgcctcattcacaatctcccaggttcaaagcgcaaaggaaggactggggcagagagagctgaaatgggggctcgcagttaaagtccccgccaaggcaggcgctggggccggagcgggcgccgtacttaagatccgcgccggtaccggaagggaacgtgtgcctcaggctacacaaatgactcggcccaacccctag

SEQ ID NO: 121877 - DNA, 9228 bp, Artificial Sequence
  Description of Artificial Sequence: Synthetic coding sequence
atgaggggcggggtgctgctcgtgctccttctgtgcgttgcggcacagtgcaggcaacggggactatttcccgcaatcctcaatctcgcgagcaatgctcatatttcaaccaacgccacttgtggagagaaaggccctgaaatgttttgcaaacttgttgagcatgttcctggccgcccggtacggaaccctcagtgccgtatttgcgacgggaattccgcgaaccctcgggagcgacaccctatctcccatgctattgatggcactaataattggtggcagagcccttctatccagaacggccgggaatatcattgggtgaccatcactctggatctccgccaggtgttccaagttgcatacgttatcattaaggcggccaacgcgccgcgtccaggcaattggattttggaaaggtctctagatggtacaacattttctccctggcagtactatgcggtgagcgacagcgaatgtctgtcccggtataacatcactccgaggcgcgggcccccgacttacagagccgacgatgaggtgatctgtacatcatactacagtcgactggtgccactagagcatggtgaaattcacacatccctgattaatgggcgaccctctgcagacgacctgtccccaaagctcctggagtttacttccgcacgctatatcaggctgcgattacagcggatcaggaccttgaacgccgacctgatgactctgtctcaccgagaacctaaggagttggatccgatcgtgaccaggcgttactactacagcataaaggacataagtgtgggggggatgtgcatctgttatgggcacgcgtccagttgcccatgggacgagactaccaaaaaattacagtgtcaatgtgagcacaatacttgtggagagagctgtaaccgctgctgccccggataccatcagcagccttggcgacctggcaccgtgagcagcggtaacacctgcgaggcctgcaattgtcataacaaggcaaaggattgttattacgacgagtcagttgctaaacaaaagaagtcacttaacactgctggccaattcaggggcggaggtgtctgcatcaattgcctccagaacacaatgggcattaactgcgaaacctgtatcgacggctactacaggcctcataaggtttctccttatgaggacgagccctgtcgcccctgcaattgcgatccagtcgggtctctgtccagtgtttgtatcaaggacgacctgcactccgacttgcataacggcaagcagccaggtcaatgtccatgcaaggaggggtataccggcgaaaaatgcgataggtgtcaactgggatataaggattacccaacctgcgtatcttgcggctgcaatccagtggggtcagcttccgacgaaccctgcaccggcccatgtgtctgcaaggagaatgtggagggaaaagcttgcgatagatgtaaacccggattttataacctgaaagagaaaaatccccgcgggtgctctgaatgtttctgctttggcgtgagcgacgtgtgctcatctctgtcctggcctgtgggccaggttaattcaatgtccggctggctcgtcacagatctgattagtccaagaaagataccatcacagcaggacgccctggggggtagacatcaagtctctattaacaacaccgcagtgatgcagcggcttgccccaaaatattattgggctgcccctgaggcctacttgggaaacaagctaacagcttttggaggttttctgaagtacacagtctcgtatgacatccccgtggagaccgtggacagcaacctgatgtcacacgcggacgtcattatcaagggaaacggactgaccttgtctactcaggccgaggggctcagcctgcagccgtatgaggaatatctgaatgtcgtgaggttagtgccagagaattttcaggattttcacagcaagaggcaaatcgatagagatcaactcatgaccgtcctggctaatgtgactcatctgcttatccgagctaattacaactcggcaaaaatggctctttataggctggaaagcgtgtcactcgatatcgcaagcagcaatgctattgacttggtggttgccgctgacgtggagcattgcgagtgccctcagggatacacagggacgtcttgtgagagttgtctgtcaggctactatcgagtggatgggatcttattcggtggtatttgccaaccttgcgagtgccacggccatgctgctgagtgcaatgtgcacggggtgtgtatagcttgcgctcacaacactacgggtgttcactgtgagcagtgcctgcccggtttttatggtgagccttctcgtggtacccctggggattgccagccctgtgcttgccctttaacaatcgcctctaacaacttctctcccacatgtcatctgaatgatggcgatgaagtcgtgtgcgattggtgtgcacctggttactcaggggcttggtgcgagagatgcgccgatggatactatgggaatcccaccgtacctggggaaagttgtgtgccctgtgactgtagcggaaatgttgatccaagcgaggctggtcactgcgacagcgtgaccggggaatgtctaaagtgcttgggaaataccgatggtgcccactgcgagcgatgtgccgacggcttttacggcgatgccgtcaccgctaaaaattgccgggcctgtgaatgtcacgtaaaaggcagtcatagtgcagtctgccatctggaaacagggctgtgcgattgcaagcctaacgtgacaggccagcaatgcgatcagtgtctgcacggctactacggcttggattctggccacggctgtagaccctgtaactgcagtgtggccggaagcgtcagcgacggctgcactgacgaaggacagtgccattgcgttccaggagttgctggaaagagatgcgatagatgtgctcacgggttctatgcctatcaggacggatcatgcaccccctgtgattgcccccacactcagaacacctgtgacccggagaccggagaatgtgtatgccctccccacacgcagggagtcaaatgcgaggagtgcgaggacggccactgggggtatgatgccgaggtcggatgccaagcctgcaactgttccctggtggggtcaacacatcaccggtgcgacgtggtgacgggacattgccaatgcaaatctaaattcggtggaagggcttgtgatcagtgctcactgggataccgagatttccctgactgtgttccctgcgactgtgacctccgtggaacctcaggagatgcctgcaaccttgaacagggactgtgcgggtgcgtggaggaaacaggggcatgcccctgtaaagaaaacgtcttcggaccccagtgtaatgaatgccgtgagggcacatttgccctccgggcagacaatcctctggggtgctccccttgcttctgctcagggctttcacacctctgtagcgaactggaggactacgtgcggacacctgtgacactggggtctgaccagccccttctccgggttgtgtctcagagcaatctaaggggaaccaccgagggcgtctattatcaggctccggatttcttgctggacgctgctaccgtccgccagcacatccgcgctgagcctttttattggcggctgccacagcagtttcagggcgaccagctcatggcttatggtggcaaacttaagtactccgtcgctttctacagcttagatggagtgggaacgagcaacttcgagcctcaggttctcataaagggcgggaggataaggaagcaggtgatttacatggatgcgcccgccccagagaacggcgtacggcaggaacaggaggtggctatgcgtgaaaatttctggaaatacttcaatagtgtatcagagaagcccgtgacaagggaggacttcatgtccgtgctttcggatatcgaatacatcctgatcaaggccagttacggccagggcctccagcaaagcaggatcagcgatataagtatggaggtcggaagaaaggcagaaaaattacacccggaggaagaggtggcctcgctgcttgaaaactgtgtgtgcccaccagggacagtgggtttctcctgccaagactgtgctcctggttaccatagagggaaacttccggcggggtccgaccgcggtccaaggccgctggtggccccgtgtgtgccatgtagctgtaataaccactcagacacctgcgacccaaacactggcaaatgcctcaattgcggagataacacagcaggagaccactgcgatgtgtgtaccagtggttactacgggaaagtcaccggcagcgcatccgactgcgctctctgcgcatgtccccactccccgccagctagcttttcccctacatgcgtgctagaaggggaccacgattttcggtgcgacgcatgcctattgggatacgagggcaagcattgtgagagatgctcctcctcatactatggaaatcctcagacgcctggaggttcctgtcagaagtgtgactgtaatccccatggcagcgtgcacggagactgcgataggacgagcggacagtgcgtgtgtagattgggggcttcaggcctgcggtgtgacgaatgcgagccccggcacatccttatggaaactgattgcgtgagctgcgacgacgagtgcgtgggcgtgctattgaacgacctggacgaaattggagacgcagtactgagcttgaacttgaccgggattatcccagtcccttacggaatactctcaaacctcgagaacacaacgaagtacctgcaggagtcactcctcaaggagaatatgcagaaagacttgggcaagattaaactggagggggtggcggaagagacggacaatttacagaagaagctgactaggatgttggcctccacgcagaaagttaatcgggctaccgagaggatcttcaaggaatcccaggatctagccatcgccatcgagcgtcttcagatgtctattaccgaaatcatggagaaaaccacgttaaaccagaccctcgatgaagactttctgttgccaaattctactctgcagaacatgcaacagaacggtacaagtcttctcgagatcatgcagatacgtgatttcacgcagctgcaccaaaacgccaccttagaattgaaggctgccgaagacctgctgtctcagatccaggaaaactaccagaaacccctggaggaactggaagtgcttaaagaagcagcatcacatgtgttgtccaaacataacaacgagctcaaggctgctgaggccctggtgcgcgaggcagaggctaaaatgcaggaaagcaaccatcttctgctgatggttaatgcgaacttgcgggagttcagcgacaaaaaactgcacgtgcaggaagaacagaatcttacctccgagctcattgtgcagggtagaggactcatcgacgccgccgcagctcagacagacgccgtgcaggatgccctggaacaccttgaggatcaccaggataagcttctgctctggtcagccaagattcgccaccacattgacgacctagttatgcacatgtctcagagaaacgctgtggacctggtgtacagggcagaagaccacgccgcggagttccagagattggccgatgtgctgtatagtggattggaaaacatccgaaacgtgtcacttaacgccactagcgccgcatatgtgcattataacatacagagtctcatcgaagaaagcgaggaactcgctcgtgacgcacaccggaccgtgacagaaacatccctcttgtccgaatccctggtgtctaatggcaaagcggccgttcagcgatccagtagattcctgaaagagggtaacaatctgtctcgcaagctgcctggcattgctttggagctctctgagcttagaaacaagacaaacaggtttcaagagaacgctgtcgaaattactagacagacgaatgaatcactgctgatcctgcgggcgattcctaaaggtatccgggataaaggagctaaaactaaggagttggcgacaagcgctagtcagtccgccgtgtcaaccctgcgcgacgtagccgggttgtctcaagaactgctcaatacctcagcatcgctgagccgtgtcaacactactctgcgcgaaacccaccagctgctgcaggactccactatggccactctgctggcgggtagaaaagttaaagacgtcgaaatccaggctaaccttctctttgataggctgaaacccctgaagatgttagaggaaaacttgtcgcggaatttgtcagagatcaagcttctgattagccaagctaggaaacaggccgcctcaattaaggtggcggtcagcgctgaccgcgattgtatccgggcataccagcctcagatcagttcaaccaattacaacactctgactttaaatgttaagacccaggagcccgacaatctcttgttttacctcggatcaagtaccgcttccgactttcttgctgtggagatgaggaggggccgtgtggcatttctctgggacctgggatccggcagcactcggttggagttccctgactttcctattgacgacaatcggtggcactccatacatgtcgcaagattcggcaacattgggtcgctatccgtgaaggagatgtcaagtaatcagaagagcccaacaaaaactagcaagtcaccaggcacggctaacgtcttggatgtgaataatagtacccttatgttcgttggcggactcggagggcagattaagaagtccccagccgttaaagttacccacttcaagggatgccttggcgaagcattcctgaatgggaagagtattggcctctggaattacattgagcgagaaggcaagtgtcggggctgtttcggcagctctcaaaacgaggacccatcctttcactttgacggatcaggatattcagtggtagaaaagagcctgcctgcaacggtgactcagataatcatgctctttaatactttctcccccaacggcttgctgctctatcttggaagttacggtacaaaggattttctgtcaatcgagctatttagagggcgcgtgaaagttatgaccgatctgggaagcggccccatcaccctcttaacagaccggcgctacaataacgggacttggtacaagatagctttccagcgcaatcgaaagcaaggggtcctagctgtcatagacgcctataacacttcaaataaggaaacaaaacaaggggaaacccccggtgcctcctctgatctaaatcggcttgataaggaccctatttacgtgggcgggttgcctcggtctcgggtagtgcgccggggcgtgactaccaaaagcttcgtcggctgtataaagaatcttgagatttccaggtcaacatttgatctgctacgaaattcctatggggtgcgcaaggggtgtctgctggagcccatcagaagcgtgtcttttcttaagggaggctatattgagttacctcctaaatcgctgagtccagagtcagagtggctcgttacgtttgcaaccacaaactcatccgggattatcctggcagccctggggggcgatgtcgaaaagaggggggaccgcgaagaagctcatgtgcccttcttttcagtcatgttaatcggggggaacatagaggtccacgtcaacccaggggacggaaccggacttagaaaggccctactgcatgcgccgaccggaacctgctcggatgggcaggcccactcgatctccctcgttcgcaatcgcaggatcatcactgtccagttggacgaaaataatcccgtggagatgaagctcgggactctggtggagtctcggaccatcaacgtaagcaacctgtacgtggggggtattcctgagggcgaaggcaccagccttctcactatgaggcgttctttccatggctgtatcaagaacttgatttttaacctcgagctcctagattttaactccgctgttgggcacgagcaggtggacctggatacttgctggctttctgagaggccaaagctggctcctgatgctgaggattccaaacttctgccagaacccagagctttccccgaacaatgtgtggttgatgcagccctggagtatgtgccaggggcccatcagttcgggctaacccagaattcgcattttatcctcccattcaatcagtcggcagttcgcaagaagctaagcgtggaattgagcattcggacatttgcttcttcagggctgatttattacatggcccatcagaatcaggcagactacgctgtactgcagttgcacggcggtaggctccacttcatgtttgacttaggaaagggaaggacaaaggtctcgcacccagcattgctgagtgatgggaagtggcatactgtgaaaacagattatgttaaaagaaagggctttatcaccgtggatggcagagaatcgcccatggtgactgtggttggtgacggcaccatgctcgatgttgaaggtctgttctatctcggtggcttgccaagtcagtaccaggcccggaagatcggaaatataacacacagcatccccgcctgtatcggcgatgtcaccgtgaattccaagcagcttgacaaagacagccctgtcagcgcctttaccgtgaataggtgctacgctgttgctcaagaaggcacctatttcgatggatctggatacgctgctttggttaaagaaggctacaaggtccagtctgatgtgaacattaccctggaatttaggacatcaagccaaaacggggtgctgcttgggataagcactgcgaaagtggatgcaatcggattagagctggtagacggcaaagtgctttttcacgtcaataatggagcagggcgtattaccgctgcgtacgaacctaagacagccacagtactttgcgatggtaaatggcacactctgcaagccaacaagtctaaacatagaattactctgatcgtggatggcaatgctgtgggtgccgaatcaccccatacacagtcgacctccgtggatactaataatccgatttatgtggggggctatccggccggggtgaagcagaaatgtctgcgtagccagacttcctttcgcggctgcctgcggaagctcgccctcattaagtcgcctcaggtccagtcttttgacttctcgagggctttcgaactgcacggcgttttcctgcactcttgccccgggactgagtcatag

SEQ ID NO: 121878 - DNA, 9366 bp, Artificial Sequence
  Description of Artificial Sequence: Synthetic coding sequence
atgcccggtgcagcgggcgtgctgctgctgctgttattatctggcgggcttggcggggttcaagctcagcgcccccagcagcaacgtcaaagccaagcacaccagcagcgtgggctgttccctgcggtgctgaacctcgcctcaaatgccctaattacgaccaacgccacctgcggggagaaaggccccgagatgtactgcaagctggtggagcacgtgccaggccaacccgttaggaatcctcagtgcaggatttgtaaccagaactcctccaaccccaatcagcggcaccccatcaccaatgcaatcgatggaaagaacacatggtggcagtccccatctatcaagaatggcatcgaataccactacgtgaccatcacgctggacctacaacaggtttttcagattgcatatgtgattgttaaggccgctaactcaccaagaccggggaattggatcctggagcggagcctcgacgatgtggagtataagccatggcagtatcacgcagtgaccgacaccgaatgtcttaccttgtacaacatttacccacgcaccggcccccctagctacgctaaggacgatgaagttatatgcacctctttttatagtaaaatccacccactcgaaaacggcgagatccacatatccctgatcaatggaaggcccagtgctgatgaccccagcccagagcttctggagttcacatcggcccgctacatcagactgaggtttcagcgcattaggactctaaatgccgatttgatgatgtttgcccacaaggaccccagagagatcgacccgatcgtgaccagacgctattattattcagttaaggatatctccgttggggggatgtgcatttgctatggccacgcccgagcctgtcccctggaccccgctacgaataagtcaagatgtgaatgcgagcataacacatgcggagatagctgcgaccagtgctgccctggtttccatcagaagccttggagagcaggcacattcctaacgaaaactgaatgtgaagcatgcaactgtcatggcaaggccgaagagtgctattacgatgagaatgtagcaaggagaaacctgtctctcaacatccgcgggaaatacataggggggggggtctgtataaattgcacacagaacacagctggaattaattgtgaaacgtgtacagatggcttcttcagaccaaagggcgtatcccctaactaccctagaccatgtcagccttgccactgcgatccgatcggaagccttaatgaagtgtgtgttaaggacgaaaaacacgctcgccgcggacttgcccccggctcttgtcattgcaaaactggatttgggggggtgtcctgtgataggtgtgccagaggttatactgggtacccagactgtaaagcatgcaattgctctggtctggggagtaaaaatgaagacccctgtttcggcccctgcatttgtaaagaaaacgttgaaggcggcgactgctctaggtgtaagtcaggtttcttcaatctgcaggaagacaattggaagggatgtgatgagtgtttctgctctggagtttccaacaggtgccagtctagctattggacatacgggaagatccaggacatgagtggttggtatcttactgacctccccgggcggatcagggtggctcctcaacaggatgacctggattcccctcaacagatctcaattagtaatgctgaggcaaggcaggcactgccccattcttattactggtccgcccccgcgccctacctcgggaataaactcccagccgtcggtggccaactgaccttcacaatttcctatgacttggaggaggaggaggaagacacggaacgcgtgctacagctgatgatcatcctggagggaaacgatctgagcatttccactgcgcaagacgaggtctatctccatccttcagaagagcacacaaacgtgctccttctgaaggaggaatcgtttacaatccacggaactcatttccccgtcaggcggaaggaatttatgaccgttctggccaacctaaaacgtgtactgttgcagataacttatagcttcggaatggacgctatattccggctgtcatctgtgaatctcgaaagcgcagtgtcttatcccactgatggttctatcgcggccgcagtagaagtatgtcaatgtcctcctggctacacaggctcttcatgtgagtcttgttggcctcgtcatcgccgggttaacggcaccatcttcggagggatttgtgaaccatgtcagtgttttgggcacgcggaaagttgtgacgacgtcactggcgaatgtctgaattgtaaggaccacacaggcggcccatactgcgataagtgtttacctggtttctacggtgagcccacgaagggcacatcagaggactgccagccctgcgcatgtcccctcaacataccctccaacaatttctccccaacatgtcacctcgatcggtcactgggactgatatgcgatggctgtccagtgggttataccggcccccggtgcgagcgctgtgcagagggttattttggacagccatcagtccccgggggctcgtgccaaccttgtcagtgcaacgataatctagatttttctatcccaggttcgtgcgacagcttaagtggaagttgcttaatttgtaaacctgggaccactggccgatactgcgagctctgcgcagacggatattttggagatgcagtggacgcaaagaattgccagccttgtcgctgtaatgctggcggctccttctccgaggtgtgccacagtcagactggccagtgcgaatgccgagccaatgtgcaggggcagaggtgcgacaaatgcaaagccgggaccttcggtctccagagcgcaagggggtgcgtgccatgtaattgcaactccttcggatctaagtcctttgattgtgaagagagtgggcagtgttggtgccaacctggggtcaccggcaagaagtgtgaccggtgcgctcacgggtactttaatttccaggaagggggttgtactgcctgtgagtgtagtcatttgggaaacaactgcgatccaaaaaccgggcgctgtatctgtcctcctaatactattggggagaagtgctctaagtgcgcccctaacacttggggtcacagcataaccactggatgcaaggcatgcaactgtagcacagtcggtagcctggatttccagtgtaatgtgaatactggacaatgcaactgtcaccccaagttttccggcgcgaaatgtaccgaatgctctagagggcactggaattacccgcgatgtaatctctgcgattgctttctgccaggcaccgatgcaaccacatgcgacagtgaaactaagaagtgcagctgctccgaccaaacagggcagtgcacatgcaaagtgaatgtcgagggcattcattgtgataggtgtcgcccgggcaagtttggtttagatgcgaaaaatcccctgggttgtagctcatgctattgcttcgggacgacgacccagtgctccgaagccaagggactcatccgaacgtgggtaactctgaaggctgaacagactatccttcctctggtggatgaggcgctgcagcacaccactaccaagggaatcgtgttccagcatcctgagattgttgcccatatggatcttatgagagaggatctccatctcgaaccattttattggaaattaccagagcagttcgagggcaaaaaactgatggcgtacggcgggaagctgaagtacgcaatctacttcgaggcccgggaagagaccggcttcagcacctacaacccccaagtgattattcgcggaggcaccccgacccacgcgaggattatcgtacgtcatatggccgcccccctgatcggacagctgacgcggcacgagatcgagatgaccgaaaaagagtggaaatattacggcgatgaccctagagtgcataggacagtgacccgcgaggacttcctcgatatcttgtacgacatccactatatcctgatcaaggcgacttacgggaattttatgaggcagagccggatctcagagatctcaatggaagttgccgagcaggggagaggtactaccatgactccccctgccgaccttatcgagaaatgcgactgccccctggggtattccggactgtcttgtgaggcttgccttccgggcttttaccggctccgttcccaacccgggggaaggacacccgggcccaccttgggcacgtgcgtgccttgtcaatgtaatggccacagctccctttgcgaccccgagacttctatttgccagaactgccagcaccacaccgctggggacttctgtgagcggtgtgcactgggctattacgggattgtaaaaggtctgcccaacgattgccagcaatgtgcttgccctctgatctcctcatcaaataatttctctcctagctgcgtggctgaggggctggatgactaccgctgtaccgcatgtccccgagggtacgagggtcagtattgcgagaggtgtgcaccaggatatacaggatcaccgggaaatcccggaggaagctgccaggagtgcgagtgtgatccctatggctctctgccggtgccatgtgatcccgtgactgggttctgcacatgtagaccaggcgcaactgggaggaagtgcgacggctgcaagcactggcacgcacgcgaaggttgggaatgtgtcttctgtggggatgaatgcacaggactcctgctcggcgacctggcgcgactggaacaaatggttatgagcattaatctcacaggccctctgcccgccccctataagatgctttatggactagagaatatgacacaagaactgaagcatctactttctcctcagagggctccggagagactgatccagcttgccgagggaaaccttaataccttggttaccgagatgaacgagctgttgacccgcgcgaccaaggtgacagcagacggcgaacaaacaggacaagatgcggagcggacaaatacacgcgcaaaatcactgggggaatttatcaaggaattggcacgggatgccgaggctgtgaatgagaaggcaatcaagctgaacgagaccttgggcactagagacgaggctttcgagcggaacctcgaagggctccagaaggaaatcgaccagatgatcaaagagttacgcaggaagaatttggaaacgcagaaagagattgccgaggacgagctcgtggctgccgaggccttgctgaagaaggtcaagaagctgttcggagagagccgcggcgaaaatgaagagatggaaaaggacctaagagagaagttggcggactacaagaacaaggtggacgacgcctgggatctcctgcgggaggcgacagataaaattcgggaggccaatcggctgtttgctgtgaaccagaagaacatgaccgcattggaaaaaaaaaaagaggccgtagagagtggcaagcgccagatagaaaatactcttaaggagggcaatgacatcttggatgaagcaaacagacttgcggacgagatcaatagtatcatagactacgtggaggatatccagacaaagctcccacccatgtcagaggaacttaacgacaaaatcgatgacctttctcaggaaattaaagaccgcaaactcgccgaaaaagtgagccaagccgaatcccatgccgcgcagctcaatgacagttcagccgttctggacgggatactggatgaggcaaaaaatatctcctttaatgccactgccgcgtttaaagcctacagtaatatcaaagattatattgatgaagctgaaaaggttgcaaaggaggcgaaggaccttgcacatgaggccactaagctcgccactggcccacgcggtctgctgaaagaggacgctaaaggctgcttgcaaaaatctttcaggattttgaacgaagccaaaaaactggccaatgacgtcaaggagaacgaggaccacctgaatggcctgaaaacacgtattgagaatgctgatgccagaaatggcgatcttttgaggacactgaacgatacactgggaaaattgagcgctattcccaatgacactgcagctaagctccaagccgttaaagataaggcacgccaggcaaatgacacagccaaggacgtcctggctcagatcacagaattacaccagaatttggacggactaaagaagaactacaataaactagctgacagcgtcgctaagaccaatgccgtggtgaaggacccaagcaaaaacaccgtagccgatgcagatgctaccgtaaaaaacctggagcaggaggcggatcgactgatcgataaattaaaaccaattaaggaactggaggataatttaaaaaagaacatttcagaaatcaaagagctcatcaaccaggcccgcaagcaggccaacagtattaaagtctctgtctcatcaggtggcgactgcattcgcacctacaaacctgaaataaagaaagggagttataataacattgtagtgaatgtcaagacggccgtcgcagataatcttctgttttacctcggaagtgctaaatttatcgacttcctggcaattgaaatgagaaagggtaaggtatcctttctatgggatgtcgggtctggagtcgggagggtggagtaccccgacctcactatcgatgactcttactggtaccgcatcgtggcctctcggacaggcagaaatggaaccatttcggttagggcactggacggaccgaaggcatcgattgtgccctccacccaccacagcacttctccacccggttatactattctggatgttgacgccaacgccatgctctttgtgggtggtctgacgggaaagctgaaaaaggccgatgccgttagggttattactttcaccggctgtatgggagagacgtactttgataataagcccatcggattgtggaatttccgggagaaggagggcgactgcaaagggtgcacagtgagcccgcaggttgaggattctgaggggactatccagttcgacggagaaggatacgctttagtctcccgacccatccgatggtatcctaacatttcaaccgttatgttcaagttccggaccttctcttcatctgccctgcttatgtacctggctacaagagatcttagagattttatgagtgttgaattgaccgacggacatattaaagtatcgtacgacctcggcagtggaatggctagtgtcgttagcaaccagaaccataacgacggaaagtggaaaagctttactctgagtcgcatccagaagcaggcaaatatctcaatagtagacatagatactaatcaggaggagaacatagccacttcttcaagcggaaacaatttcgggctggacttgaaggccgatgataagatttacttcggtggtctgcccaccctccgcaatctgagtatgaaggctaggcctgaggtcaacctcaagaagtacagcggttgcctgaaagacatcgagatcagtagaactccttacaacattttaagttctcccgactatgtgggggtcaccaaagggtgtagcctggagaatgtttacacagtctccttccctaaaccgggattcgtggagctgagccctgtgcccatcgatgttgggaccgagatcaatctgagttttagtacaaagaatgaatccggtattatcctactagggtctggcggaacacctgctcctccgagacggaaacggcgacagactgggcaggcttattacgctattctgttaaataggggacggttggaggtacatttaagcactggagcccgcactatgaggaaaatcgttatccgccctgagcctaacctattccatgatgggagggaacactccgtgcacgtcgaacgcacccgcgggatcttcacggtccaggtcgatgagaaccgtagatacatgcagaatctaaccgttgaacagccaatcgaggtgaagaaactcttcgtgggcggcgcacctccagaatttcagccctcacctctacggaacatcccaccctttgaagggtgcatatggaatctggtgattaattcggtgccaatggatttcgcaagacctgtgagtttcaaaaatgcggatattggccgctgcgcacaccagaaactcagggaagatgaggatggagctgcgccagcagaaatagtgatccaacctgagccggtccccactccggcattccctactcccacgccagtgctgactcacgggccatgcgcggcagaaagtgaaccagccctcctgatcggtagtaagcaattcgggctctcacggaactcgcacatagcaatagcatttgacgataccaaagtgaaaaatcgtctcaccattgaattagaggtgcggaccgaggcagaatccggactgttattttacatggctcgcatcaatcacgctgatttcgcaactgtgcagctgaggaacgggctaccctacttcagctatgacctgggaagcggagatactcacacaatgatcccaactaaaatcaacgacgggcaatggcataaaataaagattatgcgttccaaacaagagggcattctgtacgtcgatggggcgtctaatcgtacaatcagtccgaagaaagccgatatcctcgacgtggtgggcatgctgtacgtcggtggactgcccataaactataccacacgcaggattggccccgtgacctactcaatagacggctgtgtgcgtaacttgcacatggccgaggcccctgcagatttggagcaacccacttctagttttcacgtgggtacatgttttgccaatgctcagcgcggtacctatttcgatggaacaggtttcgcgaaagctgtagggggtttcaaggttggattagaccttctagtggagtttgagtttagaacaactaccacgacaggagtgctcctggggatcagctcccagaaaatggatggaatgggcatagagatgatcgatgagaagctgatgttccacgtggacaacggagccggtcggttcacagcggtgtatgatgcaggcgttccagggcatttgtgcgatggccagtggcacaaggtcacagcaaataaaattaagcacaggattgagctcacggtcgacggcaatcaggtggaggctcaatcacccaacccagcgtctacctctgccgacactaacgaccccgtgttcgtggggggcttccccgacgatcttaagcagttcggcttaacaacttccataccattccgcgggtgtattaggagcctgaagctgaccaaaggaactgggaaacctcttgaggtaaatttcgcgaaagctctcgagctaaggggagtgcagccggtctcgtgccccgccaactag

SEQ ID NO: 121879 - DNA, 9369 bp, Artificial Sequence
  Description of Artificial Sequence: Synthetic coding sequence
atgcccggcgctgcaggggtgttactcctgctcctgctgagcggagggctggggggcgtacaggctcagcgcccgcagcagcagaggcagagtcaagcgcatcaacagcgcgggttgtttccagcagttttgaatctggcatcaaatgctttaattaccacaaacgctacatgcggcgagaagggtcccgaaatgtattgcaaattggtggagcacgtgccaggccaaccggtgagaaatccccagtgtcggatctgcaaccagaactcttccaacccaaatcagcgacaccccatcactaatgcgatcgacgggaagaatacttggtggcagtctccatccattaaaaatggcatcgagtaccactacgtgaccattacattagacttgcaacaagtctttcagatagcttatgtgatcgtgaaggccgccaatagtcctcgccccgggaattggatacttgaacgttcgttggacgacgttgaatataagccttggcaatatcatgcagtcaccgacaccgagtgcttgaccttatataatatctatcctcgtacgggccctccatcatacgccaaggatgatgaagtcatctgtacctccttttactctaaaatccatcccctggaaaatggggagattcatatcagtctgattaacggacgccctagcgcggacgatccctctccggagctgctggaatttacgtcggcacgctatattcggctgagatttcagcggattcggaccttgaacgccgatctcatgatgttcgcccacaaagatcccagggagatcgatcccatcgtgacgagacggtactattactcagtcaaggacatctctgtgggcgggatgtgcatctgctatggccacgcccgtgcatgtcccttagatcccgctactaacaagagccgctgcgagtgtgaacacaatacctgtggagactcctgtgatcaatgctgccccgggtttcatcagaagccttggagagcgggaacctttctgactaagactgagtgcgaggcctgtaattgccacggcaaagccgaggagtgctattatgacgagaatgtggccagaaggaacctctctcttaatattagagggaaatacatcggtggcggggtgtgcataaactgcacgcagaacacggccgggatcaattgcgagacctgtaccgatgggttttttcgccccaagggcgtctcaccaaattatcctcgaccatgtcaaccatgtcactgcgaccctattgggagcctgaacgaggtatgcgtgaaagacgagaagcatgcgcggagaggactggcccccggatcgtgccattgcaaaacaggttttggcggagtcagctgcgaccgatgtgcgagaggttacacagggtatcccgactgcaaggcgtgtaattgcagcggcctcgggagcaagaatgaggacccttgcttcgggccttgtatctgtaaagagaatgttgaagggggcgactgtagtcggtgcaaaagcgggttcttcaatctgcaagaggataactggaagggttgtgacgaatgtttctgctccggtgtctcaaatcgctgtcagagcagctactggacctatgggaaaatccaggacatgagcgggtggtaccttaccgacctacctgggagaatccgagtggcacctcagcaggatgatcttgactcgccccagcaaatctctatttccaatgccgaggcccgccaggccctcccgcactcctactattggagtgcacccgcgccatatcttggaaacaaactcccagcagtgggcggacagcttactttcaccatcagttatgatcttgaagaagaagaggaagataccgaacgcgtccttcagttgatgatcattcttgaggggaatgacctctccatttccacggcacaggatgaagtgtacctgcacccttcagaggagcacactaacgtcctgctgcttaaagaggaatccttcacaatccacggaacacactttcccgttagacgcaaggaattcatgaccgtactggcgaacctcaaacgcgtgctgctccagataacatactcattcggcatggacgcaatcttccgcctctcatcagtaaacctcgagagcgccgtgagttacccgaccgatggctctatcgcggcggccgttgaggtttgccagtgcccccccggatacactggttcttcctgcgaatcttgctggcctcgacacagacgagtgaatggcaccatattcggcggcatctgtgagccatgccagtgcttcggacatgcggagagctgcgatgacgtgaccggagaatgcttgaattgcaaggaccataccggagggccctattgcgacaagtgccttcctggtttctacggtgaaccgacaaagggcacctcagaggactgtcagccctgcgcctgtcctcttaatattccctccaacaacttcagccccacctgtcaccttgacaggtccctggggcttatatgcgacgggtgtccagtcggatatactggacctcgctgcgagcgatgtgctgagggctacttcggacagccgagcgtccccggcgggagctgtcagccatgccagtgtaatgacaatcttgactttagtatcccaggcagctgcgactcgctgtccggtagttgtctgatttgcaaacctggaacgacaggacggtattgtgaactgtgtgcagacggttatttcggagatgcggtggacgctaaaaactgtcagccatgcaggtgtaacgcgggaggcagcttttccgaggtgtgtcacagccagacaggccaatgcgagtgcagagccaacgtacaggggcaacgctgcgataaatgcaaggctggcactttcggcctacagtctgccagaggatgtgtgccctgtaactgcaactcctttggatctaagagctttgactgtgaggaatcaggacagtgttggtgtcagcccggggtcactggcaaaaaatgcgatcgttgcgcccatggatacttcaatttccaggagggtgggtgcacagcctgtgaatgctcacacttgggtaacaactgtgacccgaaaacagggcgatgcatctgtcccccgaataccatcggcgagaagtgcagtaagtgcgcccctaatacatggggccacagtattaccacaggctgcaaggcatgtaactgttcgaccgttgggagtctggacttccagtgtaacgttaacaccggtcagtgtaactgccaccccaagttcagcggtgccaagtgcaccgagtgcagccgggggcactggaattatccacggtgcaatctgtgtgattgctttttacccggtacagatgcaacaacttgcgacagtgagacgaaaaaatgctcttgttccgaccagacaggtcagtgtacctgcaaagtgaatgtggaaggaattcattgcgaccgctgccgcccggggaagtttggcctcgatgccaagaacccactcgggtgctcttcgtgttactgctttggaaccacaacccaatgcagcgaagccaaaggtttgataagaacatgggtgacactgaaagccgagcagacaatcttgccactcgtggacgaggccctgcagcacaccacaaccaagggcatagtcttccagcacccggaaatcgtggcacatatggacctgatgagggaagacctccacttagaacctttttattggaagctccccgagcagttcgaagggaagaagctgatggcttatggtggaaagctgaagtacgctatctactttgaggcgagagaagaaaccggattttctacatataaccctcaggtgatcattagagggggaacccctactcacgctagaatcattgtgcgacatatggcagcacccttgatcggccagcttacaagacatgaaattgagatgaccgaaaaggaatggaagtactacggagacgacccacgcgtccaccggaccgttacccgggaagatttcctcgatatactatatgatattcactacatccttatcaaggcaacttacgggaacttcatgaggcagagtcggatcagcgagattagtatggaggtggcggaacaggggcgcggcaccacaatgactcctccggcggatctcattgagaaatgtgattgcccactgggatactcggggctatcttgcgaagcatgcctaccaggcttctaccgcctccgctcccagccaggcggacgcacccccggaccaaccctgggaacatgtgtcccttgtcaatgcaacggacactcctccctgtgcgatcctgagacatcaatttgccaaaattgccagcaccacaccgccggcgacttttgcgaacggtgtgccctgggttattatggcatcgtaaaaggcctgcctaacgattgtcagcagtgtgcatgccccctcatttctagctctaacaactttagcccgagctgcgtggccgagggcctggatgactaccgatgtaccgcatgccctcggggctatgaaggacagtattgtgagaggtgtgccccaggatataccggctctcccggaaaccctgggggcagctgtcaggaatgcgaatgcgatccgtatggtagcctcccggttccgtgcgacccagtcacaggtttctgcacatgccggcccggtgcaaccggcaggaaatgtgatgggtgtaagcattggcatgcccgggagggttgggaatgcgtcttctgcggtgacgagtgcaccggcctcctcctgggggacctggctagactggagcagatggtcatgtccatcaacctgaccggccctctccctgcgccctacaagatgctgtacggactggagaacatgactcaggagcttaagcacctgctttcaccccagcgtgctccagagagactaatacagttggccgagggcaacctgaataccttggtgactgagatgaatgagctgctcacaagggcgacaaaggtaacagccgatggcgaacagaccggtcaagacgcagaacggaccaatacccgcgctaagtccctcggggaatttatcaaagaattagcacgggatgctgaagcagttaatgaaaaagctatcaaattaaacgaaacacttggaactcgggatgaagccttcgagcgcaatcttgaaggattgcagaaggagatagaccaaatgattaaagagttgcggagaaaaaacttagaaacccagaaggagatcgcagaggacgagcttgtggccgccgaggctttgttgaagaaggtgaagaaactatttggagagagtcgtggggagaacgaagaaatggagaaggacctgcgggaaaagttggctgactacaagaacaaagttgatgatgcctgggatctgctaagggaagcaacggataagattagggaagcaaacagacttttcgctgttaaccagaagaacatgactgccctggagaaaaaaaaggaggcggttgagagtggaaagcgccagatagagaacaccctgaaggagggcaatgatattctcgacgaggctaatcgactggccgatgagatcaattcaatcatcgattatgtggaggacatccagacaaagctcccccccatgtcagaggagttgaatgataagattgacgacctgtcacaagagattaaggaccgcaagctcgccgagaaggtctctcaagccgaatcccacgccgcacagctgaacgattcttctgctgtactggacggtatactggacgaggctaagaacatcagttttaatgcgactgctgccttcaaagcatatagcaatattaaggactacatagatgaagctgaaaaagttgctaaagaagcgaaggatctggcgcacgaagcgactaagctcgctactggccctcgcgggctactcaaggaggatgcaaaaggatgtctgcagaaatccttccggatcttgaacgaggccaagaaacttgcaaacgacgtcaaagagaatgaggaccaccttaatggcttgaaaaccagaatagagaatgctgacgctcggaacggcgatcttctgagaaccctcaatgacaccttgggcaaattgagtgcgattcctaatgatactgccgctaagttgcaagccgtcaaggataaggcccggcaagccaacgacactgctaaggatgtgttggcacagattaccgagctgcaccagaatctggacggcctcaaaaaaaattacaataagcttgccgattcggtggcaaaaaccaacgcggtcgtgaaggaccccagtaaaaacaaaattgttgccgacgctgacgccaccgtcaagaacctggaacaggaggcggatcgcctgatcgacaaactgaagccgataaaggaacttgaggacaatctgaagaagaacatctccgagataaaggaattgatcaaccaggcccgaaagcaagctaattctattaaggtgtcagtgagttctggaggagactgcatcagaacctataaacctgagattaagaaaggttcttacaacaatatcgtggtaaacgtcaaaacagctgtggccgataacctcctgttttacctaggttcagcgaagttcatagattttttggccatcgagatgcgcaaggggaaggtcagctttctgtgggatgtagggtcaggcgttggaagagttgaatacccagaccttacaattgatgatagttactggtaccgcatcgtggcatcaaggaccggacgaaacggaaccatctctgttcgtgcactggacggaccgaaagcttcaatcgttcctagtacccaccactctacatcaccacctggttatacgattcttgacgtcgacgcaaatgcaatgctgtttgtcgggggcctcacaggcaagctgaagaaagcagacgccgtccgcgtaataacatttacaggctgcatgggtgaaacttactttgacaacaagcctatcggcctctggaactttcgagagaaagagggggactgtaaaggttgtaccgtttccccccaggtggaagactcagagggtacaatacaatttgatggggaggggtatgctctagtcagtagacctatccgatggtacccgaatatctctacagtgatgtttaagtttcggacattctcaagcagtgccctactgatgtatctggcaacaagagacctgcgtgactttatgtccgtggaactcacagatgggcacatcaaagtaagttacgatctgggaagcgggatggcatctgtggtctcaaaccaaaaccataatgacggcaaatggaagtcattcacactgagtagaattcaaaaacaggcaaatatctccatcgtggatatcgacacaaaccaggaagaaaacattgccacttcgagctccggcaacaactttggcctcgacttaaaagcagatgataagatctatttcggggggttaccaacactacgcaatctgcgcttgttcaaccggcctgaggtaaacttaaagaagtattcaggatgcctgaaggacattgaaatctctcgcactccatataatatactgagtagcccagattatgtgggagtcacaaaagggtgcagcctcgaaaatgtgtacacggtctccttcccgaaacccggttttgtggaactgtcacccgtcccgatcgacgtgggtaccgaaatcaacctatccttctccactaaaaatgagtccggaatcatcttattaggaagcggcggaacgcccgccccgccacgtcggaaacgtagacagaccggccaagcctactacgctattctgctgaacagaggacgtctagaggttcacttatcaaccggagccaggaccatgcggaagattgtgattagaccagaacctaatctgttccatgacggaagagagcattcagtgcatgtggagcggacgaggggcattttcacagtccaggtggacgaaaataggcgctatatgcagaacctgacggtcgagcagcccatcgaagtgaaaaaactgtttgtgggcggtgctcccccggagttccagcccagtccactgcgcaatataccccccttcgaaggctgtatatggaacctggtcattaactcggtgccgatggatttcgcacggcccgtgagcttcaaaaacgccgacatcggcagatgtgcccaccaaaaacttagagaggatgaggacggagccgccccagctgaaatcgtcatccagcctgagccagtccccactcctgcgtttccgacccccacacccgtgctcacacacgggccgtgtgcagcggaatcagaacctgctttgttgatcgggtccaagcagtttgggttgtcccggaacagccacatagcgatcgcgtttgacgacaccaaggtcaaaaaccgattaacgattgagcttgaggtgcgcacggaggccgaaagcgggctgcttttttatatggcccggattaatcacgccgactttgcaacagtgcagctgcgaaatggtttgccatactttagctacgatttgggatctggagatactcacaccatgatacccactaagatcaacgatggccaatggcacaagattaaaattatgaggtcaaagcaggagggcatcctctatgtcgatggggcatctaaccgcaccatttcccctaagaaggctgatattctggatgttgtcggcatgctgtacgttggagggttgccaattaactacacgacgaggcgtataggccccgtcacttattcaattgatggatgtgtgagaaacctacacatggctgaggctcccgccgacctggagcagcccacctcttctttccacgtgggcacatgctttgccaatgcccagcggggtacgtacttcgacggcacaggttttgcgaaggcggtcgggggcttcaaagtggggctggacctgctggtggaatttgagttcaggaccaccaccacgacaggtgtgttgctggggatcagttcgcagaagatggatggtatgggcatagaaatgatcgacgagaagctgatgttccacgtcgacaacggagcgggacgcttcacagccgtgtacgatgccggtgttccaggccatctgtgtgacgggcagtggcataaagttaccgcaaataaaatcaaacacaggatagaattgaccgtagacgggaaccaggtcgaggcccagagccccaacccggcatcaacatcagctgacactaacgacccagtgtttgtcggaggcttcccggatgatctgaagcagtttgggcttacaacatccattccatttcggggctgtattagatccctgaagcttacaaaaggcactggcaaacccctagaagttaacttcgctaaagcgttagagctccgtggcgttcagccagtgagctgtcctgctaactag

SEQ ID NO: 121880 - DNA, 9369 bp, Artificial Sequence
  Description of Artificial Sequence: Synthetic coding sequence
atgcccggagcagctggcgttctgcttctgctgctgctctctggcgggctaggtggcgtgcaagctcagaggccccaacagcagcgccaatctcaagcccatcagcaaagaggtctgtttccggccgtgctgaacttagcttcgaacgccttaattacgaccaacgctacttgtggagagaagggcccggagatgtattgtaaactggtagagcatgtaccaggacagcctgtgagaaatccccagtgccggatttgtaatcagaacagtagtaatcctaatcaacggcaccccattactaatgccattgatggtaagaacacctggtggcagagcccatcgataaagaacgggatcgaataccactacgtgaccataactctagatcttcagcaggtctttcagatcgcctacgtgattgtaaaggcagctaactcccctcggccaggaaattggatactggaacgatccctcgacgatgtggaatataagccttggcagtaccatgcagtgacagacaccgagtgcctgacactttataatatttatccacggacggggccgccctcatacgcgaaagatgatgaggtgatctgcacctcattttattccaagattcatcccctggagaacggtgaaatccacatctctttgattaatgggcgtcccagcgctgatgatccttcccccgaacttctcgagttcacatcggctcgatatataagacttaggttccagcgtatcagaacccttaatgctgatctgatgatgttcgctcacaaggatccgagagaaattgatcctatcgttacccgacggtactattacagcgtgaaggacatctcagttggcgggatgtgcatctgttatggacatgccagagcttgtccactagaccctgcgactaacaagtcaagatgtgaatgtgagcataacacttgtggtgacagctgcgatcaatgctgccccggctttcaccagaagccgtggcgggctggcacctttttgacaaaaaccgaatgtgaagcttgcaactgccatggcaaggccgaagagtgctactacgacgaaaatgtcgctcgccgcaatctgtctctgaatatcagggggaaatacatcgggggaggagtatgcatcaactgcactcaaaataccgctggcataaactgcgagacttgtactgatggcttctttaggcctaagggggtgagcccaaattacccaaggccttgccagccctgtcactgtgacccaatcggttcactcaatgaggtttgtgttaaggacgagaagcatgctagacgcggtttggcccctggctcttgccactgtaagacaggcttcgggggcgtctcttgcgacaggtgcgctcggggatacaccggataccctgactgtaaagcatgcaactgtagtggtctgggatccaagaacgaagatccatgcttcgggccctgcatctgcaaggaaaacgtagagggaggggattgtagccgatgtaaaagtgggttttttaatctgcaggaggataattggaaagggtgcgatgagtgcttctgttctggggtaagtaaccggtgccagagctcgtattggacgtatgggaagattcaggacatgtctggatggtatttgacagacttgcccggcagaataagagtggctcctcagcaggacgacttggactcccctcagcaaatttccatcagtaacgctgaagctaggcaggcgctgcctcattcctactactggagtgctcctgcaccttacctcggaaataaactgccagccgtcgggggtcagcttactttcacaatcagctacgatctggaggaagaggaagaggacactgagagagttctacagctgatgatcatcctggaagggaatgacctctcaatcagcaccgcccaggacgaagtatacttacatccctccgaggagcatacgaacgttcttttgctcaaggaggagagcttcaccattcacggcacacactttcccgtgcgacggaaagaatttatgacagtgctggccaatctgaaacgtgttctccttcagattacatacagttttggtatggatgcaatctttagattgtcttctgtgaacctggagagtgccgtaagctacccaaccgacggcagcatcgcagctgccgtggaagtttgtcagtgcccaccaggatacactggttcaagttgcgaatcctgttggcctcggcacagacgagtcaacgggacaatcttcggggggatctgtgagccctgtcaatgcttcgggcacgctgaaagttgtgatgatgtgaccggggaatgtttgaactgcaaagaccataccggaggaccctattgcgataagtgtcttccagggttttacggagagcctaccaagggaaccagtgaggattgtcaaccatgtgcttgtcccctgaacattccatcaaacaacttctccccaacatgtcatctcgatcgatctttaggactgatctgcgatggatgcccggtggggtataccggccctcggtgcgaacgatgcgccgaggggtattttggacaaccatcagtgccaggagggtcttgtcagccctgccagtgcaatgacaatttagacttctctattcccggaagctgcgactctctgagtggaagctgcctgatatgcaaaccgggtacaaccggaagatactgcgagctgtgcgccgatggctacttcggtgacgcagtggacgctaaaaattgtcagccctgccgctgcaacgcaggcggatctttcagcgaggtatgtcactctcagacgggccagtgcgagtgtcgcgccaatgtgcagggccagcgatgcgataagtgcaaggcagggactttcgggctgcagtctgccagagggtgtgttccgtgtaattgcaatagtttcggctctaagtcattcgactgcgaagagtctgggcagtgttggtgccaacctggggtgacgggtaaaaagtgtgaccgttgcgcccacggctatttcaatttccaagagggcggctgcacagcctgcgagtgctcccacttgggcaacaactgtgatcccaagactgggcggtgtatctgcccacccaataccatcggggaaaaatgcagcaaatgtgcgcctaatacatgggggcactccattaccactgggtgtaaggcctgtaattgctcaaccgtcgggagccttgacttccagtgcaatgtcaatactggccagtgtaactgtcatcccaagttcagcggtgcaaagtgcaccgagtgttcccgtggacactggaactatccaagatgtaacctgtgcgactgctttcttcctggcaccgatgccacaacatgcgactctgaaaccaagaagtgcagttgttctgatcaaaccggacagtgcacttgtaaggtgaacgttgaagggatccactgtgatagatgccggccgggcaagttcggattagatgctaagaaccctttggggtgcagcagttgctattgctttggcaccactactcagtgctctgaagcgaagggactaatccgcacatgggtaaccctgaaagcagaacagacgatacttccgctagtcgacgaggctctgcagcatacaactacaaaaggaatcgtctttcaacatcccgagattgtcgcacacatggatcttatgcgcgaggatctccatcttgagcccttctattggaagcttccggagcaattcgagggaaagaaactcatggcctatggggggaagctcaagtacgccatctacttcgaggctcgggaagaaacggggttctccacctacaatccacaggtgataattaggggaggcacccctacacacgcacggattatcgtgcggcacatggcagcacccctcatcgggcagctaacccgccacgagattgagatgaccgagaaagagtggaagtattatggtgacgatccacgcgtgcacagaaccgtgacgagagaggacttcctggacatcctctacgacattcattacatcctgattaaagccacatacggcaacttcatgcgccaatcccgcatttcagagattagcatggaggttgccgagcagggccgcggcacgacgatgacaccacctgcagatttaattgaaaagtgcgattgtccgcttggttactccgggctgtcctgcgaggcatgtttgcccggattttaccggttgcgtagccagccgggagggcgcacccccggccctacccttggaacctgcgtcccgtgccagtgtaatggacacagctctctgtgcgacccagaaacatctatctgtcagaattgccagcatcataccgccggtgacttctgcgagcgctgtgctctgggctactacggcatcgtgaagggtctccctaatgattgccagcagtgcgcttgcccactgatttcctccagcaataattttagtccatcttgcgttgcagaagggctggatgattacaggtgtaccgcctgccctcgcggatatgaagggcaatactgtgaacggtgtgcacctgggtacacagggtcacctgggaacccaggagggtcctgtcaggaatgtgagtgcgacccctatggttctctcccagttccctgcgaccccgtgaccggattttgtacctgcagacctggagccaccggccgaaagtgtgatggatgcaaacactggcatgctcgcgagggatgggaatgtgtgttctgtggagatgaatgtaccgggctgctgctgggcgacctggccaggcttgagcagatggtgatgtctatcaatttgacgggaccgctccctgctccttacaagatgctgtacggcttggaaaatatgacacaggagttgaagcatttgctgagtcctcagcgggcaccagagagactgattcagctcgctgagggtaatcttaataccctggtgactgaaatgaacgagctgttgacccgcgccaccaaagtgacagcagatggagagcagacaggtcaggatgccgagcgcacaaataccagagcaaaatccctgggcgagttcatcaaggagctcgcccgggatgctgaggccgttaacgaaaaagccattaaactgaacgagactctaggaactcgcgacgaagcgtttgaacggaacttggaagggctgcagaaagagatcgaccagatgattaaggagctgcggcgtaagaatcttgagacgcagaaggagattgccgaggatgaactggtagctgccgaggctctgctgaaaaaagtgaagaagctgttcggtgagtcccgcggtgaaaatgaggagatggaaaaggatttgagagaaaagctggctgattataagaataaagtggacgatgcctgggacctgttaagggaggctactgacaagatccgggaggctaatcgtctgttcgccgtgaaccagaaaaacatgactgccctggaaaaaaaaaaggaggcagtagaaagtggaaaaaggcagattgagaatacactcaaagagggcaatgatattctggacgaggccaaccgtttagctgatgaaattaacagcatcatagattatgtcgaagatatacagaccaaactgccacccatgagcgaggagctgaacgataaaatagacgacctgtctcaggagattaaggaccgtaagctcgccgagaaggtgtcccaagcagagtcccacgctgctcagctgaatgactcctctgctgttttagatggcattctagatgaagctaagaatattagttttaatgctaccgcagcgtttaaagcctatagcaatatcaaggattacatcgacgaagctgagaaggtggcgaaagaggccaaggatttggcacatgaggccacgaagctggctactggcccacgcgggctgctgaaagaagatgcaaagggatgtcttcagaaatcatttagaatcctcaatgaagccaagaaattagcaaacgacgtaaaagaaaatgaagaccatttaaacggtttaaagaccagaattgaaaacgcggatgcgcgtaatggtgacctcctgaggacccttaatgatacgttggggaagctgtccgctattccgaacgatactgcagcaaagttgcaagctgtgaaagacaaggcccggcaggcaaatgacacagctaaggatgtcttggcacaaatcacagaacttcatcagaacctggatggacttaagaagaactacaacaagctagcagatagcgtagctaaaactaacgccgtcgtgaaggacccatctaagaataagattatcgcggatgcagatgcaaccgtgaagaatttagaacaagaggctgacagactgatcgacaagctgaagcccatcaaagaattagaagataatcttaaaaagaacatatcagagattaaggagctgatcaatcaggccaggaagcaagcaaactcgatcaaagttagcgtatcttctgggggcgattgtattcggacctataaaccggagattaaaaagggcagctacaataatatagtggtgaatgtgaaaaccgcggtggcggacaatctcctgttttacctggggagtgcaaaatttattgactttctggccattgagatgcggaaagggaaggtgagctttctgtgggacgtgggaagtggagtcggtcgggtggaatatccagacctcaccatagatgattcatattggtatcgcattgtggccagccgcacaggacgcaacgggacaatatctgtgagagcccttgacgggccgaaggcctctattgtaccttcgacacatcactccacgagtccccccggatacacgattttggatgtggatgcaaatgcaatgctatttgtcggggggctaaccggaaaactgaaaaaggctgacgccgtgcgagtgatcactttcaccgggtgcatgggtgaaacgtattttgacaataaacctattggcctctggaattttcgagagaaagagggcgattgtaaaggctgtactgtctctccccaggtagaagattcggaaggcaccattcaattcgacggcgaaggatatgctctggtcagtaggccgataagatggtatcctaatatcagcacagtcatgttcaaatttcgtacattttccagctctgctttactgatgtacctggccactcgcgacctgagggacttcatgtctgtggaactgacagatggccacattaaggtttcctacgatctaggtagcggaatggctagtgtggtaagtaaccagaatcacaacgatggaaagtggaagtcctttactctctcacgcattcagaaacaggcgaacatcagcatcgtggatatcgacacgaatcaggaggagaacatcgcaacatcctcgtccggaaataatttcgggctcgatttgaaagccgatgataaaatctacttcggtggactgccaacacttagaaacctgtctatgaaggctagaccagaggttaatttaaaaaaatatagcggttgtcttaaggatattgaaatttccaggaccccatacaacattcttagctcgcccgactatgtcggcgttaccaaaggatgtagcttggaaaatgtctataccgtgagttttcctaaaccaggattcgtggaactgtccccagtgcctattgatgtgggcaccgagattaacctgagcttctccactaaaaatgagtctgggattatcctgttgggatctgggggcaccccagcaccgccaagaaggaaacggagacaaacagggcaggcttattacgcaatcctgctgaatagaggacgcctggaagtccacctaagtaccggagccagaactatgcgcaaaatagtaattcggccagaacccaacttgtttcacgatggcagagagcattccgtgcacgtcgagcggactcggggaatcttcactgtccaggttgacgagaatcgacggtatatgcaaaatcttactgtggaacaacccatcgaagttaagaaactgttcgttggtggtgccccccctgaattccaaccttctcctctgcggaatataccaccctttgagggctgcatctggaatctggtgataaattccgtgccaatggacttcgctagacctgtcagttttaaaaatgccgacattggaaggtgtgctcatcagaaattgcgcgaggatgaagatggagcagctcctgccgaaatcgttatccaacctgaaccagtcccaacgcctgccttccctacacctaccccagtcctgactcacgggccctgcgccgccgagtcggaacccgccctgcttatcggaagtaagcagtttggtttatcaaggaactcccatatcgcgatcgccttcgacgatactaaggtaaagaaccgcttaactattgaattggaagtacggacagaggctgaatcgggcttgcttttctatatggcaagaattaaccatgccgatttcgccaccgtgcagctaagaaacgggctaccatactttagttacgacctcggatcgggagatacacacactatgatacccaccaaaatcaacgatggtcagtggcacaagatcaagatcatgagatctaaacaggaaggcattctttatgtggacggcgcaagtaataggactattagcccaaagaaggccgacattcttgacgtagtgggaatgctttacgtgggggggctgcccatcaactacactacccggagaatcggtccggtgacgtatagtatcgatgggtgtgtgcggaacctacatatggctgaggcccctgcggatctggagcagccaacatccagcttccacgttggaacttgttttgcaaatgcccagcgcgggacatattttgacggcaccgggtttgccaaggccgtgggcggcttcaaagtggggttggatctccttgtcgagtttgagtttagaaccaccactaccaccggagtcctcctgggcatctcttctcagaagatggatggaatgggaattgaaatgatcgatgaaaagttgatgttccacgttgataacggggctgggcggtttaccgccgtttatgacgccggcgtacccggacatctgtgcgatggacagtggcataaggtgaccgcaaacaaaattaagcatagaatagagctaaccgtcgacggaaatcaggtggaagcccagtctcccaacccggcttccacgtccgccgacacaaatgaccctgtgttcgttggcggcttcccggatgacctgaagcagttcggcctcactactagcatcccgttcaggggctgtatccgcagcctcaagctgaccaagggcacgggtaaacctctagaggttaactttgcaaaagccctggaactccgaggagtgcagcccgtctcctgccccgccaactag

SEQ ID NO: 121881 - DNA, 3387 bp, Artificial Sequence
  Description of Artificial Sequence: Synthetic coding sequence
aagaagctcgcgaatgacgtgaaggaaaatgaggatcatcttaatggcctgaaaactagaatcgagaatgcagacgcacggaatggggatctcctgcgtaccctaaacgatacgttgggtaagctctcagccatacccaatgacactgccgccaaacttcaggcagtgaaagacaaggcccggcaggcgaacgacactgccaaggatgtgctcgctcagatcacggaactacaccagaacctcgatgggttaaaaaagaattataataaactggccgactctgttgctaagacgaatgcagtggtcaaggatccttcaaagaatacagtcgcagatgccgacgcaaccgtgaagaacctggaacaggaggccgatcgtctaattgacaaactgaaaccaattaaggagttggaggacaatctcaaaaaaaatatctctgagattaaagagcttatcaatcaggcaagaaaacaagccaatagcataaaagtttccgtatcctccggcggcgattgcatccggacctataagccagaaataaaaaagggtagttataataatatcgtggtcaacgtgaagacagcagtcgcagacaatctcctgttttacctgggcagtgccaagtttatcgatttcttggctatcgagatgaggaaggggaaagtatcgtttctgtgggacgtggggtctggagtcggccgggtggagtacccggacctcacaattgacgattcgtactggtacaggatcgtcgcatctcgcaccgggagaaatggtacgattagcgttcgagccctcgacggacccaaagcttctattgttcccagcacccatcactcaacctctcctcctggttacaccatcctcgacgttgacgcaaacgccatgttgttcgttggtggtctgacaggaaaattaaagaaggctgatgctgtgagggtaatcacattcacaggctgcatgggcgaaacctatttcgacaataaacctattggcctgtggaatttccgggaaaaggaaggtgactgcaaaggttgtaccgtcagcccccaggtggaagactccgaggggactatacagtttgatggtgaagggtacgcactggtgagtcgaccaattcggtggtaccccaatattagcacagtcatgtttaaattcaggacattttcttcctccgccctgcttatgtatctagccacacgggaccttagggacttcatgtccgtggaactcactgatggacacattaaggtttcctatgatctgggcagcgggatggctagcgttgtctcaaatcagaaccacaacgacggtaaatggaagtcgtttacgttgagccggatacaaaaacaagccaatatatccatagtcgacatcgacaccaaccaggaggaaaatatcgccacgtccagctccggaaacaacttcggactggacttaaaggctgacgataagatctacttcggcgggttaccaacgctccggaacctgagcatgaaggcgagacccgaggtcaatctcaagaaatactccgggtgcctgaaagacattgagatttctagaactccctacaacatcttaagcagcccagattatgttggagtgaccaaaggctgcagtttagagaacgtatatacagtgtccttccctaagcccggttttgttgagttgtctccggtccccatagacgtcgggacggaaattaacctgtcgttttcaaccaagaacgagtcaggcatcattctgctgggaagcggtggtactcctgcccccccgagaagaaaacggcgacagacggggcaggcatactacgccattctcctgaatcgcggccggctagaagtccatcttagcaccggggccaggacaatgcgcaagattgtcatcaggcctgaaccaaatctgtttcacgacggaagggagcactctgtgcatgtggaacgaacaagggggatatttacggtccaggtggatgagaaccggcgctacatgcagaatctgaccgtggaacagccaatcgaggtgaagaaacttttcgtgggaggggcccccccagaatttcagccatcccctctgaggaatatcccccctttcgagggatgcatctggaacctggtgatcaatagtgttcctatggacttcgcacgtcccgtgtctttcaaaaacgcagatatcggcagatgtgcccaccagaaactgcgcgaggacgaagatggtgctgcccctgccgaaattgtgattcagcctgagcctgtgcccacgccagctttccctaccccgacgccggtgctcacacacggcccctgtgccgcagaatcagagccggctctgcttatcggaagcaaacagtttggtctgtcccgcaattcccacattgccattgcctttgacgataccaaggtgaagaatcggctcactatcgagctggaggtgagaacagaggccgaatctggtctactcttctatatggcgcgtatcaatcacgccgattttgctactgtgcagctgcgcaacggactcccctatttctcatacgacctgggctccggagacacacatactatgattcccacaaaaatcaatgacgggcagtggcataagatcaagattatgcggtctaaacaggaggggatcctgtacgtagatggtgccagcaatcgaactatttcaccgaaaaaagcagacatcctggacgtcgtcggaatgttgtatgtgggtggtctcccaatcaactatacgacgagaaggatcggccccgtcacttatagcatcgacggctgcgtgcggaacctccatatggccgaggccccagcagatcttgaacaacccacgagtagctttcatgtcggtacctgctttgcgaatgctcagaggggcacatatttcgatgggacagggttcgccaaggccgtgggtggcttcaaggtcggactggatctgctcgtggagttcgaattccggactaccaccaccaccggggttcttctgggaattagcagtcagaagatggacggaatgggaatagaaatgattgacgagaaattaatgtttcatgtcgataacggggcaggccggttcactgcagtgtacgacgcaggcgtcccagggcatctttgcgatggtcagtggcacaaagtgaccgccaacaagataaagcatcgcatcgagctgaccgtggatggtaaccaggtggaggcacagagcccgaatccagcgagtacatcagctgacactaacgatccagtgtttgtgggtggtttccccgatgacctgaagcagtttgggcttacaacaagcatcccatttagggggtgcattcgcagcctaaagctgactaagggtacagcttctcactggagactgattttgcctaggccctggaattag

SEQ ID NO: 121882 - DNA, 5175 bp, Artificial Sequence
  Description of Artificial Sequence: Synthetic coding sequence
atgccacccgctgtcagaagaagcgcttgtagtatggggtggttgtggattttcggcgccgcactgggtcagtgcctgggatacagcagccagcagcagagagtgccattcttgcagcctcccgggcagagtcagctccaagcatcttacgtcgagttcagaccgtctcaggggtgcagccccggctactatcgggaccacaagggcctgtacaccggccggtgcgtaccttgtaattgtaatggccactcaaaccagtgtcaggatggttctgggatttgtgttaactgtcagcacaacactgctggcgaacattgtgaaaggtgtcaggaaggttactatggaaatgccgtgcatggttcgtgtagagcgtgcccctgcccgcacaccaactcatttgcgaccgggtgtgtggttaatggcggagatgtccgatgctcttgcaaggcgggctatacgggcacacagtgcgaaaggtgcgcaccaggttatttcggtaacccccagaagttcggaggttcgtgccagccatgctcctgtaactctaacggtcagctgggctcatgtcatcctcttactggggactgtatcaaccaggagcccaaggatagtagtcctgccgaggaatgcgatgactgtgacagttgtgttatgactcttctgaacgacttagcaacaatgggcgaacagctgcgcctggtgaaaagtcagctgcaggggctgtccgcctccgccggccttctggaacagatgagacacatggaaacccaagcaaaagacctaaggaaccaactgctgaattaccggagcgctattagtaatcatggctcaaagattgagggattagaacgagagctgactgatctgaatcaggaattcgagactcttcaagagaaggctcaggtgaactctcgcaaagcacagactcttaataataatgtcaatcgtgcaacccagagtgctaaggaacttgatgttaagatcaagaatgtgatccgaaatgtccacatactcctgaagcagatctccgggaccgatggggagggcaataacgttccatccggtgacttttcaagggagtgggctgaggcgcagcgaatgatgcgagagctgcgtaatcgtaacttcgggaagcaccttcgggaagccgaggcagacaagcgggaaagtcagctactgctgaaccggatacgcacttggcagaagacccaccagggagaaaacaatgggctggccaattcaatcagggactcgttgaatgagtacgaggctaagctctccgacctgcgagcaaggctacaggaggccgcagcccaggcgaaacaagccaacggcctaaatcaggagaatgagcgggccctcggcgcaatccagagacaggtcaaggagatcaatagcctccaaagcgacttcacaaagtatctgaccacggcagatagttctttactgcagacaaatattgctctacagcttatggagaagtcgcagaaggaatatgagaagctggcagcaagcctcaatgaagctcgtcaggaactgtccgacaaggttcgggagctgagccggtccgctggtaaaaccagcctggtggaggaggctgagaaacacgcgaggagtctgcaggaactggctaaacaacttgaagagatcaagaggaatgcttccggcgacgagctggtcaggtgcgcagttgatgctgctacagcttacgagaacatcctgaatgcaatcaaagccgctgaggatgcagccaatcgcgccgcctctgccagtgaatctgcacttcagacagtaatcaaggaggatctgccccgaaaagctaagactctgagttctaattccgacaagcttcttaacgaggccaaaatgactcagaagaagcttaagcaagaggtttcaccagccctcaacaacctgcagcaaactctcaatatcgttacagttcagaaagaggttatagatactaacttaactacactgcgggatggactccatggcatccaaaggggcgacatagacgccatgatcagcagcgccaagagcatggtgagaaaagcaaacgatatcacggacgaggtattagacgggctgaatcccattcagacagacgttgagcgcatcaaggacacatatgggcggacacaaaacgaggatttcaagaaggccttgaccgatgcggacaattccgtcaataaactcactaacaaactgccagatctgtggagaaagatcgagtcaattaatcagcagttgttgccgctcggcaacatttctgacaatatggatcgcatccgcgaactgatccagcaggccagagatgcagctagcaaggttgcagtgcccatgaggttcaatggcaagtctggcgtagaagtgagactgccaaacgacctggaggatctcaaagggtatacaagcctgagcctgtttctgcagcggccaaatagtagggagaatggtgggaccgagaacatgttcgttatgtaccttggcaacaaggacgctagcagagattacattggaatggcggtggtagacggccagctgacctgcgtgtataacctgggagatagggaggccgagctccaggtggatcagattctgaccaagtcagagacaaaagaagctgttatggatcgcgtgaagttccagcgtatataccagtttgccaggcttaattataccaagggggccacatcatctaaacccgagactcctggcgtgtatgatatggacggccggaactcaaatacgttgctcaacttggatcccgaaaatgtggtcttttacgtcgggggatacccccccgacttcaagctacccagcaggctttcctttcccccctataagggatgtatagaactggatgacttgaacgagaatgttctgtccctgtacaattttaagaagacattcaacctgaacacaaccgaggtggaaccctgccgccggaggaaagaagaatccgacaaaaattatttcgaagggaccggatatgctagggttccaactcagccacacgcccctattcccactttcggacaaaccattcagactacagtcgaccgcggcctgctgttctttgctgagaatggggacaggttcatcagcttgaacattgaagatggcaagctaatggtgcgctataaactcaacagtgaactcccaaaggagcggggagtgggtgacgctatcaataacggccgagatcatagcatccaaattaaaatcgggaagctccagaaaagaatgtggataaatgtagatgtgcagaatacaatcatcgacggagaagtcttcgactttagtacatattacctgggcggcatccccatcgccatcagagagcgctttaacatctccactcctgctttccgcggttgcatgaagaatttgaaaaagacttccggcgttgtgaggctgaatgatactgtgggagttacgaagaagtgttccgaggactggaaactggtgaggtcggctagctttagcaggggaggccagctctcttttaccgacctcggcctgcctccgaccgatcatcttcaggcaagcttcggttttcagacattccagccttctggcatattgctggatcatcaaacatggacccgaaacctccaggtgacgttggaagatggatatatcgagttatccacttctgattcaggctccccgattttcaagagcccccagacttatatggacggactcctccactatgtaagcgtcatatcagacaattctgggttacgcctgctgatcgacgaccaattactccgcaattccaagcgccttaaacacattagtagttccaggcagagcttgcggcttggaggcagtaattttgagggatgtatctcaaacgtgtttgtccagcgcttgagcctatctccagaagtgctggacctcaccagcaacagtctcaaacgggatgtgagcctcggtggatgttcactgaacaagcccccgttccttatgctcctgaagggcagtactcgcttcaataaaacaaagactttccgaatcaaccagctcctccaggataccccggtggcaagcccacggtccgtaaaagtgtggcaggacgcctgttccccgttaccaaagacccaggctaatcatggcgcacttcagtttggcgatattcccacatcacacctcttattcaaattgccacaggagctccttaagcctcgcagtcagttcgcagtggacatgcagactactagtagtcggggccttgttttccataccggcaccaagaatagttttatggccttgtatctgtccaaggggaggttggttttcgcactgggaacagacgggaagaaactgagaatcaagtctaaggagaagtgtaatgacgggaagtggcatacagtggttttcggtcatgacggtgagaagggacggctagtcgttgacggtctgcgagcccgggaaggctccctcccaggtaactcaactatcagcatacgggcacctgtgtacttaggttcacctccttctggcaagcccaaatccttgcctacaaattcgttcgtgggatgcttaaaaaacttccaactcgactctaaacctctgtatacgccctccagtagcttcggagtaagcagttgtctcgggggcccattggaaaagggtatctacttctccgaagagggggggcacgttgtcttggcccactccgttctcctcggaccagaatttaagctcgtgttttcaatccgccccaggtcactgacagggatcctgattcacattggctcccagccggggaaacacctctgcgtgtatttggaggctggaaaggttactgcaagtatggacagcggcgcaggagggacatcgacttccgtcaccccaaaacagagtctctgcgatggacagtggcactcggttgccgtaactatcaagcagcacatcctccaccttgaattggatactgattcctcatatacagcgggacagattccatttcctcccgcttcaactcaggaacctctacacctcggtggcgcccctgcaaatttgaccacactgaggataccagtctggaagagtttcttcggatgtctcaggaatattcatgtcaaccacatcccagtgcctgtaactgaagccctcgaagttcagggtcctgtctctctgaacggctgcccggatcagtag

SEQ ID NO: 121883 - DNA, 10002 bp, Artificial Sequence
  Description of Artificial Sequence: Synthetic coding sequence
atggcggctgccgccagaccaagaggcagagcattgggaccagtactaccacccacacctctcttgttgctagtgttgcgggtcctgcccgcctgtggggcaaccgcacgggaccccggtgccgccgctggcctgtcactccaccctacatatttcaacctagccgaggccgctcgcatttgggccaccgccacttgcggcgaacgcgggcctggggagggccgtccccagcccgaactgtactgcaagctggtgggaggccccactgcaccaggcagcggccataccatccaaggtcagttctgcgattactgcaacagtgaggaccccagaaaagctcaccccgtcactaatgcaatagatggcagtgagagatggtggcagtctccgccattgtctagtggtacccagtataaccgggtgaacctgacactcgatcttggccagctttttcacgtggcgtatatcctgattaaatttgctaattcccccagaccagacctgtgggtactggaaagaagcgtggattttggcagcacatacagtccgtggcagtatttcgcgcacagcaaagtggactgtctgaaggagttcggcagggaggccaacatggcggttacaagagacgatgatgtcttatgcgtcactgaatattcacggatcgtacccctggaaaatggcgaggtggtagtatccctcatcaatggtcgaccaggagcgaaaaatttcactttcagccatactttgagagagttcacaaaagcaaccaatatccgcctacggtttctgagaacaaatacactgctcggccatctcatttcgaaggcccaacgggatcctacagttacgcgacggtactactacagcattaaagatatcagcataggaggacaatgcgtctgcaatggccatgctgaggtctgcaacatcaataatcccgaaaaactcttccgatgcgagtgccagcaccacacttgtggagagacgtgcgaccgctgttgcactggctataaccagagacggtggcgaccagctgcctgggagcagagtcatgaatgcgaggcttgcaattgccacgggcacgccagtaattgttactacgacccagacgtcgaaagacagcaagcttctcttaatacgcagggaatctacgccggtggcggggtgtgcattaactgccaacacaacacagcgggcgttaactgcgagcagtgcgctaaaggatactataggccatatggcgttcccgtggacgctcctgatggctgcattccatgttcttgcgacccagagcatgccgatggttgtgagcagggatcaggccgttgccactgtaagcccaactttcacggggataactgtgaaaagtgtgccatcggctattataattttccattttgcctgcgcatccccatatttccggtcagtactcccagttctgaagatccagttgctggcgatattaagggctgcgattgcaacctggaaggggtgctgccagagatttgtgacgctcacggtaggtgtctgtgtagacccggcgtggaggggccacgatgtgacacatgccgatctggtttttattcctttcccatttgccaggcatgttggtgtagcgctttgggatcatatcagatgccctgcagtagcgttacaggtcagtgtgagtgtagacctggagtgactggccagcggtgcgaccggtgcctgtcgggagcctatgattttccacactgccagggtagctcttccgcatgcgatcccgcaggcacgatcaatagcaacttgggatactgtcagtgcaaactccacgtggaaggccccacatgctccagatgcaagttgttgtactggaatctggataaagagaacccatcagggtgcagtgaatgcaaatgtcacaaggctgggactgtttcaggaaccggcgagtgcagacaaggtgacggagactgtcattgtaagtcgcacgtcggcggagattcttgcgacacctgtgaagacggctactttgcgttggaaaagagtaactatttcggctgtcagggatgccagtgcgacattggcggggccttatcaagcatgtgcagcggaccatccggggtgtgtcaatgcagagagcacgtggtcgggaaagtgtgtcagcggcccgaaaacaactactactttcccgacctccatcatatgaagtacgagattgaggacggatctactcctaacggacgtgacctgcgctttggctttgatccattggcgtttccagaattttcatggagaggatatgcacagatgacttccgtgcagaacgacgtgcgcattacactgaatgttggtaagtcttctggttccctcttccgcgtgattcttaggtatgtgaatcctgggaccgaagccgtgagcggtcacatcaccatttaccctagttggggggccgcacagtctaaagagattatcttccttcctagcaaagaaccggccttcgtaactgtgccaggcaacggttttgctgaccctttcagcatcactccaggcatttgggttgcttgcattaaggccgaaggagtgctgttggactacttggttctccttcctagagactattacgaggcatccgtgctgcagctgcctgtgaccgaaccttgtgcatacgccggaccaccacaggaaaactgcctgctgtatcagcacctgcccgtaaccagatttccttgtaccttagcgtgcgaggcgcggcacttccttcttgacggcgaaccacgccccgtcgcagtaagacagcccacccctgcccaccctgttatggtggacctgtcaggtcgagaggttgagctccacctgcgccttcgcatccctcaggtcggacactatgtggttgtcgtggaatactcaacagaagccgctcagctgtttgtcgtcgacgtgaacgtcaagagctctggctcagtgcttgccggacaggtgaacatctacagctgtaactattccgtgctctgtcgaagcgctgtgattgaccacatgagccggatagctatgtacgaacttctcgcggacgccgacattcagctgaaagggcacatggctcgttttctgctccatcaggtatgcattataccgatcgaagaattctccgctgagtacgttcggccccaggttcactgtatcgcgtcatacggacgttttgttaatcagtccgccacatgcgtgtccttggcccatgaaaccccacctactgccctgatcttggatgtgttatccggtaggcccttccctcatctacctcagcagagttctccatcagtggatgtgctgccgggagtgaccctaaaggctccacagaatcaagtaacccttagaggaagggtgccacatttgggacggtacgtgttcgttatacatttttatcaagcggctcaccccacttttcccgctcaggtctctgtggacggcggttggcccagggccggaagcttccatgcctccttctgtccacatgtgctgggctgtcgggatcaagttattgccgaaggacagatcgaatttgacatatccgagcctgaagtcgccgctaccgtcaaggttcctgaaggaaaaagtctggtgctagtccgtgtcctggttgtgcccgctgaaaattacgactatcaaatcctgcataaaaaatcaatggacaagtccctggaattcatcacaaattgtgggaaaaattctttttatctcgatccgcagaccgcgagcaggttttgcaagaatagtgccaggtctctggtggccttctaccataaaggcgctcttccttgtgagtgtcaccctactggagcaaccgggccgcactgtagcccagaaggcggccagtgcccatgtcagcccaatgtgattggtagacaatgcacacgatgcgctacagggcattatggcttcccccgctgtaagccctgctcttgcgggcggagattgtgtgaggaaatgactggccaatgtcgctgccccccccgcacggtacgaccccagtgtgaggtctgcgagactcattccttcagctttcacccaatggcgggatgcgagggatgtaattgtagtaggcgggggacaattgaggccgcgatgcctgaatgcgaccgggactccgggcagtgtcgatgcaaacctaggataaccggtagacagtgcgaccgctgtgcctctggattctaccgcttcccggaatgtgtaccttgcaattgcaaccgtgatgggactgagcccggggtttgtgatcccggcaccggcgcatgtctctgcaaagagaatgttgaaggaactgaatgcaacgtgtgcagggaaggctcattccacctagatcctgccaatcttaagggctgcactagttgcttttgtttcggggtcaacaatcagtgtcatagcagtcataagcgtcgaacaaaatttgttgacatgcttggctggcacctggagacagcagatagagttgacatacccgtatcattcaatcccggaagcaatagcatggttgccgatctgcaggagctgcccgccaccattcactccgcttcttgggttgcaccaaccagttatttgggagacaaggtgagctcttacggcggttacctgacgtaccaagcaaagtcttttggcctccctggagatatggtgttactggaaaagaagcctgacgtgcagttgacaggacagcacatgagcattatttatgaggaaaccaatactcctagaccggatcgcctgcaccacggccgcgtccatgtggtcgaggggaatttccgccatgcttcatcaagagcgccagttagccgcgaggagctcatgacggtcctttctaggcttgcagacgtaagaatccaaggcttatacttcacagagacccaaagacttactcttagcgaggtagggctcgaggaagcttcagacaccgggtcaggcaggatcgcactcgccgtggagatttgcgcctgtccccctgcctacgccggcgatagctgccagggatgctcccctgggtattaccgggaccataaagggctttatacaggccgatgtgtgccttgcaactgcaatgggcactctaatcagtgccaagatggatccgggatttgcgtaaactgtcagcacaataccgccggtgaacattgtgaaaggtgccaggagggatactacggcaacgcggtccatggatcatgccgagcatgtccctgtccccatactaacagttttgcaaccggctgcgtggtaaatgggggagacgtaaggtgctcctgtaaggccggctatacgggcacacagtgcgagcgctgcgccccagggtactttggcaatccccaaaagttcggagggtcttgtcaaccttgctcttgtaactcaaatgggcagctcgggtcatgccatcctttgactggcgattgtattaatcaagagccgaaagactcaagtcctgctgaggaatgtgacgattgcgacagctgtgtgatgactctcctgaatgacctggcgactatgggcgaacagctcagactagtgaagtcccagctccagggactcagtgcgtctgcaggtctgttagagcagatgagacatatggaaacccaggccaaggacttgcgcaatcaacttctcaactacaggagcgccatatctaatcatggatcaaagatcgaaggtctggagagggaactgaccgacctgaatcaagagtttgaaaccctgcaggaaaaggcgcaggtcaatagtcggaaggcccagacgttgaataataacgttaatcgggcaacgcagtcggctaaggagctcgacgtgaaaattaaaaacgttattaggaatgtgcacatcctgcttaagcagatctccgggacagatggagaagggaacaatgtgccatctggtgatttctccagagagtgggcagaggcccagcgaatgatgcgcgaactgcggaacaggaacttcggcaagcatttgagagaagcggaggcagacaagcgggagtctcagctgctattaaacaggattaggacttggcagaagacacaccagggggaaaataatgggcttgcgaatagtataagagacagcttgaatgaatacgaggccaagctgtccgatcttagggcacgcctgcaggaggctgccgctcaagcaaaacaagccaacggcctgaatcaggagaatgagagggctctgggcgcaatccagcggcaggtaaaggagataaacagtctccagtccgactttacaaaatacctgaccacagccgatagcagtctgttacaaacaaacatcgctctgcaactgatggagaagtctcagaaagagtacgaaaaactggccgcttccctcaacgaggctcggcaggaactgtcagacaaggtccgggagctgtctagatctgcaggaaaaacttcattagtggaggaggctgaaaaacacgcccgatctctgcaagaactcgccaagcaactcgaagagattaagagaaacgcatcaggggacgaattggtacgctgcgccgtggatgcagccaccgcctatgagaatattttgaatgccattaaagccgctgaggacgcagctaatagagcagcttctgcctctgaaagcgctttgcagactgttatcaaggaggatctgccacgtaaagctaagaccctctcaagcaacagcgataagctcctcaatgaagctaagatgacgcaaaaaaaattaaagcaagaggtcagcccggccctcaataaccttcagcaaacgcttaatatagtgactgtccagaaggaggttattgacaccaaccttacaacccttcgggatggcctgcacggcattcaacggggagacatagacgcaatgattagtagcgcaaaatccatggtgaggaaggctaacgacattaccgacgaggtgctggacggcctcaatcccatacagaccgacgtcgaacgaatcaaggacacttacggacgcacccagaatgaggactttaaaaaagcgctcactgacgccgataattctgtgaacaaattgaccaataagttgcctgacttgtggcggaaaatagaatcaattaatcagcagcttctccctctgggaaatatttccgataatatggaccgcatccgagagttaatacagcaagcaagagacgccgcttccaaggtggccgtaccaatgcggtttaacgggaaatccggggttgaggtacgcctgcctaacgaccttgaggatcttaaggggtacacttctctctcattgttcttgcagcgaccaaactcccgagagaatggaggcaccgagaacatgtttgtcatgtatcttggcaacaaagatgcaagcagagactacatcgggatggccgtggtggacggacaacttacttgcgtgtacaatttgggagatcgtgaggcggagctgcaagtggatcaaatcctcaccaagtctgagaccaaggaggctgtaatggacagagtgaaattccagcggatatatcagttcgctcgtctcaattatacaaaaggagctacttcttctaagcctgaaacccctggggtatatgatatggacggcaggaactccaatacactacttaatctagatccagaaaatgtggtgttctacgtagggggctatccccccgattttaaactcccctcacgcctcagcttcccaccgtacaaaggatgcattgaactagacgatttgaatgaaaacgtcctgtctttgtataatttcaaaaaaacatttaaccttaacaccacagaggtggagccatgcaggagaagaaaagaggaatccgacaagaactacttcgagggcacaggctacgcccgcgtgccaactcagccccatgctccaattcctactttcggacagacaatccaaactacagttgaccgggggctcttgttctttgccgagaatggtgaccgcttcatttcgttgaacatcgaggacggcaagctgatggtgaggtacaaactgaattccgagctacccaaggagagaggggtgggggacgcaattaataacgggcgtgaccactctattcagatcaaaatcgggaagctgcagaagcggatgtggattaacgttgacgttcagaatacaataattgatggcgaggtctttgactttagcacttattacctcggagggattccaatcgccattagagagcggttcaatatatctacacctgccttcagaggatgcatgaagaatctgaagaaaacatcaggtgtggtgagactcaacgatacggtcggagtaactaagaagtgtagcgaggactggaaactggtaagatcggcctctttctccaggggcgggcaactctccttcaccgacttgggcttaccgcccacggaccaccttcaggcttctttcggctttcagacctttcagcccagcggtatcctgctggatcatcagacttggacacgcaacctgcaggtgactctggaagacgggtatatcgagctctcgacaagcgattcaggcagccccatatttaagagtcctcaaacttacatggacgggctgcttcactatgtgtcggtcatctccgataactcaggactaaggctgttaatcgacgatcagctattaaggaacagtaaaagactgaagcacatctccagctccagacaatccctacggctgggcggctccaactttgagggctgcatcagtaatgtattcgtacaaagactttctctgtcacctgaagtgctcgacctaactagcaactcattgaagcgcgatgtttccctggggggctgtagtctcaacaagcctccttttctgatgctgttgaagggcagtacccggtttaataagaccaagacgttcaggatcaaccaactgcttcaggatacacctgtggcctcgcctcggtctgtgaaggtgtggcaagacgcgtgcagcccactgccaaagactcaggccaatcacggggctctccagttcggggatatacctacttcccacctcctctttaaacttccacaagagctgttaaagcctcggtcccagtttgccgtggacatgcaaacaacatcctcccgcggactagtcttccacacaggcactaagaacagcttcatggcactatacctcagcaaaggacggttagtatttgccttgggcacagatggtaaaaagctgagaattaaatccaaagaaaagtgcaacgacggaaagtggcatacagtagtgtttgggcatgatggcgaaaaagggaggcttgttgttgatggcctgcgtgcacgcgagggcagcttaccaggaaacagtacaatatctatccgggccccagtgtatctggggtccccaccgagtgggaaaccaaagtcccttcccactaactcctttgtcggctgtctgaaaaactttcaactggattctaagcccttgtataccccttcctcctcctttggtgtcagttcgtgtttgggtgggcccctggagaagggaatatatttctcagaagaggggggccatgtggttctagcccacagcgtgttgctggggcccgagttcaagttggtgttcagtatacgcccacgttcacttacaggaattttaatacacattggctcccaacctggtaagcacctgtgtgtgtacctggaagctggcaaagtgaccgcctccatggatagcggcgccggaggaacttcgacaagtgtgacaccaaagcagagtctctgcgacgggcagtggcatagtgtggcggtgacaataaaacagcatattttgcatctcgaactggacactgattcaagctacaccgctgggcagatcccatttcctccggcaagtactcaggagcctttgcatttgggaggtgccccagctaatctgacgacgctgcgcatccctgtctggaaatcatttttcggatgtctgcggaacatccatgtgaaccacattcccgtcccagtgacggaagccctggaagtgcaggggcccgtaagtttaaatggttgcccagaccaatag

SEQ ID NO: 121884 - DNA, 9834 bp, Artificial Sequence
  Description of Artificial Sequence: Synthetic coding sequence
atggccgctgccgccagaccccgcggtagagctctcggtccagtgctcccccctacacccctgcttctgttggtgctcagagttctcccagcttgtggtgctactgcccgggacccaggcgcagcagcaggattaagcctccatcccacttatttcaatctcgccgaagctgcacggatctgggccaccgccacatgtggcgagcggggtccaggcgaaggccggccgcagcccgaattgtattgtaagctcgtcggaggcccaaccgcaccaggatctgggcacaccattcaaggccagttctgcgactactgcaatagcgaagacccccgaaaggctcatcctgttaccaatgccattgatgggtccgagcggtggtggcagagtcctccattgagctcaggtactcaatacaatcgtgtcaatctgacgcttgaccttgggcagctcttccatgtggcctacatcctgattaaattcgccaattctcctagacccgacttgtgggttctcgaacgctcagtggacttcggctcgacatactccccctggcagtactttgcacattccaaagtggattgcctaaaagagttcggacgcgaggccaatatggctgttactagagatgacgatgtcctctgtgttactgagtatagcaggatcgttcccctggagaatggcgaggtggtcgtttcactgatcaacgggagacccggtgccaagaactttactttttctcacaccctgcgtgagtttacgaaagccacgaacatccggctccgcttcctgcgcacaaatacactccttggacatctcattagtaaggcgcaacgggaccccacagtaaccagacgctattattactcaattaaagatatcagcattggcggtcaatgtgtttgcaacgggcatgccgaggtatgtaacataaacaaccccgagaaactgtttcggtgcgaatgccaacaccacacatgtggcgagacgtgcgaccgctgctgcacaggctataatcagaggcggtggaggcctgccgcgtgggagcaatctcacgaatgcgaagcctgtaattgccatggtcacgcctcaaactgctactacgatcccgatgtagaacggcagcaggcaagcttaaacactcagggaatatacgctggcggaggcgtttgcatcaactgccagcataacaccgccggagtgaactgcgagcagtgtgctaagggttattaccggccttacggtgttccagttgatgcaccagacggctgcattccctgcagctgcgaccctgaacacgctgatggatgcgagcaggggagtggacgctgtcactgtaaacccaatttccacggagataactgtgaaaagtgcgcgatcggatattacaatttcccattttgcctgaggattcccatctttcccgtaagcacaccatctagcgaggaccccgtggctggcgatataaagggttgtgactgcaacctggagggagtgttgcctgagatctgtgatgcacacggccgatgtctgtgccgaccaggcgtggagggaccacggtgtgatacatgtcggagcggattttattcattccctatctgccaggcctgttggtgttctgctttgggatcttatcaaatgccctgctcctctgtgaccgggcagtgcgagtgtaggcccggggtgaccggccagcgctgtgatcgctgcctgtccggagcctacgatttcccacactgtcagggtagtagctctgcatgtgatccggccggcacgatcaacagtaatctgggatactgccagtgtaagttgcacgtcgagggccctacatgtagccgctgcaaacttctttactggaacctggataaggaaaatccgagcggatgctccgagtgcaagtgtcacaaagctgggactgttagcgggaccggagaatgcaggcaaggtgacggcgattgtcactgcaagagtcatgtcggtggcgacagctgcgacacgtgcgaagacgggtatttcgccctggaaaaatccaactactttggctgccagggctgtcagtgtgacattggaggcgccctctctagcatgtgctcagggccttccggggtctgccaatgccgcgagcacgttgtggggaaggtttgtcaaaggcctgagaacaactactattttccggaccttcatcatatgaagtacgagatcgaggatggctcgacccctaatgggagggacttaaggtttggattcgatcccttggccttccccgaattctcgtggcgcgggtacgcacaaatgacttctgtgcagaatgatgtgcgtatcacacttaatgtgggcaagtcctcaggctctctctttcgtgtcatcctgcgatacgtaaacccaggcacagaagctgtatctggacacataacaatctacccttcctggggcgcagctcagtcaaaagagattatcttccttccgtcaaaggagcccgccttcgtcactgtccctggcaatgggtttgccgatcctttttctatcaccccaggaatctgggtcgcatgtattaaggccgagggcgtgctgctggattatctggtgcttctgcccagagactactacgaggcaagcgtgctgcagttgcccgtgacggagccctgcgcctacgcgggtcctccgcaggagaactgcttgctgtatcagcatcttcctgtaaccagatttccttgcactctagcttgtgaagcgagacatttccttctggacggggagccgaggcccgtggcagtcagacaacctactcccgcccacccagtgatggtggacttgtctggccgcgaggtggaactgcacttgaggctcagaataccgcaggtgggccactatgtggtagtggtggagtattcgacagaagctgctcagctgtttgtagtggacgtaaacgtaaaaagctctggctccgttcttgcaggacaggtgaatatatattcgtgcaattacagcgtactgtgccgctccgcagtgatcgatcacatgtcgaggatagctatgtacgagctacttgcagatgctgacattcagcttaaagggcatatggcccgtttcctgcttcatcaggtgtgtattatccccattgaggaattcagtgccgaatatgtacggcctcaggtgcattgcattgcaagctacggacggttcgttaaccaatccgccacatgtgtgagccttgctcatgagactccccctactgcactcattctcgatgtgttgtcagggcgcccctttccacacctgccccagcagtcaagtccctccgttgacgtgttgcctggtgtgactctgaaagccccacagaaccaggtcaccctgcgtggccgcgtgccccatttaggtaggtacgttttcgtcatacatttttatcaggctgcccatccaacattcccggctcaagtgtctgtagacggtggatggccgcgcgccggaagctttcacgcatctttttgtccacacgtcctcgggtgtagggatcaggtaattgcggagggccaaatagagttcgatatctctgagcccgaggttgccgccactgtcaaggtcccagagggtaagtcgctcgtgttagtgagggttctggtggtgccagctgaaaactacgactaccagattctacataagaagagtatggataagagtctggaatttattacaaattgtggcaagaacagcttctacctagatccacagaccgcctctcgtttttgtaaaaactccgcaagaagccttgtagctttctatcataagggagccttgccttgcgagtgtcatcctacgggagcaaccggccctcactgttcaccagagggtggccagtgtccatgccagcctaatgtgatcggccggcagtgtacccgctgtgccactggacactacggctttccccggtgtaagccctgcagctgcggccgcagactgtgcgaggaaatgacagggcagtgccgctgccctcctcgaactgttcggccccagtgcgaggtgtgtgaaacccattctttctcttttcacccgatggcaggttgcgagggctgtaattgctcccggcggggcactatcgaggctgcgatgcccgaatgcgacagggacagtgggcagtgtcggtgcaagccacggataaccgggcggcaatgcgaccggtgcgcaagcggcttctaccggtttcctgagtgcgtgccttgcaactgcaaccgtgatggcaccgagccaggagtgtgcgatcctggcacgggcgcttgtctgtgcaaggagaatgtcgaaggcactgagtgcaacgtttgtagggaaggaagcttccacctcgaccccgctaatctgaagggatgcaccagctgtttttgcttcggcgtgaacaaccaatgtcactccagccacaagcgtaggacaaagtttgtggatatgctcggctggcatctcgagaccgccgatagggtcgacatcccggtcagcttcaacccaggcagcaacagtatggttgccgacctgcaggaactgcctgctacgattcacagcgcctcatgggtagccccgacatcctacctgggcgataaagtcagtagctacggcggctacctcacatatcaggcgaaatctttcggactgccaggggatatggttctgctcgagaagaaaccagatgtgcagctaacaggacagcatatgtcgatcatctacgaagagacaaacactccaagaccagatcgattgcaccatggacgcgtgcatgtggtggaaggcaactttcgacatgcttctagccgagccccagtatctcgcgaggagttgatgaccgttctatctcggctagccgacgtccgcatccagggattgtacttcactgaaactcagcgactgaccttgagcgaagtgggcctggaagaggcatcggacacaggaagtggcaggatcgccctcgccgtggagatttgcgcttgccctcccgcctacgccggcgactcttgccagggctgttcacctggctattatcgcgaccacaaaggattatataccggccggtgtgtaccttgcaattgcaatggtcattctaatcaatgccaagacggatctggaatctgcgtgaactgccaacacaacacagctggcgaacactgcgagcgctgtcaagaaggatactacggtaacgccgtacacggaagctgccgggcctgcccctgtcctcacaccaatagtttcgcaaccggatgtgtggtgaatgggggggacgtccggtgctcttgcaaggctggctacacgggcactcagtgcgagagatgtgcccccggatacttcgggaatcctcagaagttcggtggatcctgtcagccttgcagctgcaattcaaatggccaactgggaagctgtcatcccctaactggggattgcataaaccaggagccgaaggattcttctccggctgaagagtgcgacgattgcgactcttgcgttatgactcttctcaacgatctcgcaaccatgggagaacagctcaggctggtcaagtctcaactacagggcctgtcagcatccgcagggttgctggagcagatgagacacatggagactcaggccaaggacctccgcaaccaattacttaattaccgtagcgcaatcagcaaccacggctccaaaatcgagggactggaaagggagctgaccgatctgaatcaggagtttgagacgctgcaagaaaaagctcaggtaaatagccggaaagctcagacactgaataacaatgtgaaccgggcaactcaatccgccaaagaactcgacgtgaaaatcaaaaatgttatacggaatgttcatatgctgaaccggataagaacatggcagaagacacaccaaggagaaaataatggtctggcaaactccattagagatagtctgaacgaatacgaggcaaaactcagtgacctgcgtgccagactgcaggaggccgccgcccaggccaagcaagccaacggactgaatcaagaaaatgagagggcactgggagctattcagcggcaggtgaaagagattaattcactgcagtctgactttactaaatacctgactaccgccgactccagtctcctgcaaaccaacattgctctacagttgatggaaaagagtcagaaagagtacgagaaactggccgctagtttgaatgaggcgaggcaggaattaagcgataaagttcgagagctcagcaggagcgcggggaaaactagtcttgttgaagaggctgaaaaacacgcgaggtctctgcaggagctagctaaacagctggaggagatcaaacggaacgcctctggagacgaactggtcagatgtgcggttgatgctgctaccgcctatgagaatatccttaacgccatcaaggccgcagaagacgcagcgaacagagcggccagcgcatctgaatcagccctccagactgtgattaaggaggatttaccaaggaaagcgaaaaccctgagctcaaactccgacaaactgttaaacgaggcaaaaatgacccaaaaaaagctgaagcaggaagtgagcccggcattgaataatctgcagcagaccctcaacatcgtcacggtccagaaggaagtgatagatacgaacctcactacactgcgggacggtctacatggaatacaacgtggtgatatagatgctatgatctcctctgctaagagcatggtccgcaaggcaaacgacatcaccgatgaggtactggacggcctgaatccaatccaaactgacgtggagaggattaaagacacatatgggcgcacgcagaacgaggattttaagaaggcgctcactgacgccgacaacagtgtcaacaaacttaccaacaagcttcccgacctttggaggaaaattgagtccatcaaccagcaactgctccccctggggaacatttctgataatatggatcgcattcgggagttgatacagcaggctcgcgacgccgcaagcaaggtggccgtgcccatgagatttaacgggaaatctggggtggaggtcaggctccccaatgacctggaggatctgaaaggttacaccagtttgtctcttttcctccaaaggcctaattctcgtgagaatggggggacggagaacatgttcgttatgtaccttggaaacaaggacgcaagccgggattacataggcatggcagtggtggacgggcagttgacttgcgtatacaaccttggggaccgagaggctgaactgcaggtcgatcagatcctgactaagagcgagacaaaagaagctgttatggatagggtgaagttccagcggatatatcagttcgctagactcaactataccaaaggggccacgtcttctaagccagaaacacccggagtgtatgatatggatggacggaacagtaataccctgctcaacctggaccccgagaacgtggttttttatgtgggcggataccccccggattttaaactcccaagtcggctctcgttccccccctacaagggctgcattgaactggacgacttaaatgagaatgtgctctctctgtataattttaaaaagactttcaatttgaatactacagaggtagaaccctgccgccgaaggaaggaagagagcgataagaactactttgaagggacgggttatgcgagggttccaacccagccgcacgcccctatcccgactttcggacagactattcagaccacggttgaccgcggtttgctcttcttcgcggaaaatggtgatagatttattagcttaaacatagaagacggaaagctgatggttcgctataagctcaactccgaactccccaaggagagaggcgtgggcgacgccataaacaacggcagggatcacagcatccagattaaaattggaaaactgcagaagcgcatgtggatcaatgtggacgtgcagaacactatcattgatggagaagtctttgacttttccacatattacctgggcggcatacccatcgcgataagggagcgctttaatatctccacaccggcgtttcgggggtgcatgaaaaacctaaaaaaaaccagcggcgttgtgcgcttgaacgacaccgtcggggtgacaaagaaatgctccgaggactggaaactggtcagatccgcctccttttcgagggggggacaactgtctttcactgatctcggcctgcctccgaccgatcacttgcaggccagtttcggattccagacattccagccatctgggattttattggatcaccagacctggactcgaaatctgcaggtgacgctggaagatggctacatcgaactgtctacctctgacagtggaagccccatatttaagtctccccaaacgtacatggacggattactccattatgtttcagttatttctgataactctgggttgaggctcctgatcgacgaccaacttctacggaattccaagagattgaaacatatctcctccagcagacagtccctgcggttgggaggcagtaacttcgaggggtgtatatctaatgtttttgtgcagcgcttaagcctgtccccagaggtcctcgatctgacctccaattcactgaagcgtgatgtgagtctgggcggttgttcactcaataagccgccttttttgatgttactgaaaggatccacaagatttaacaagacaaaaacctttagaatcaatcaattgcttcaggatactcctgtcgccagcccccgctctgtcaaagtatggcaggatgcctgttcccccctccctaaaacgcaggccaaccacggagccctgcaatttggagacattccaacatcacatctgcttttcaagctccctcaggaactgctcaagcctaggagtcagttcgcagtggatatgcaaacgacatctagccgaggcctcgtgttccataccgggactaaaaactcatttatggcgctgtatctgtcaaagggtcgtctcgtgttcgccctcggcacagatggcaagaaacttagaataaagagcaaggagaagtgcaatgacgggaagtggcacacagtggtgttcggacacgatggggagaaggggcggctggtggtggatggtttgagagctagagagggaagcctaccgggcaattctactatttcaattcgagctcccgtttacctcggttctccccctagcggcaaacctaagagcctacccacaaatagcttcgtggggtgtctgaagaactttcagttagactcaaagcccctctacactccctcttccagcttcggagtgtcttcttgtctgggcggtcctttggaaaagggcatttacttttccgaggagggtgggcatgtcgtgctagcccattcagtgcttctcggccccgagttcaaacttgtattttctataaggccaagaagtttaacagggattctgatccatattggatcccaacctggtaaacacctgtgtgtctatctagaggcgggcaaggtgaccgcaagtatggactctggtgcgggtgggacctccaccagcgtgacgcccaaacaaagtttgtgcgatgggcaatggcatagtgttgcagtgaccattaagcagcacatattgcatcttgagctggatactgatagttcatatacagctggacaaataccgttccctcccgcaagtacccaggagcctctccacctagggggggcccccgctaacctgacgacgttaaggattccagtttggaaatctttctttggctgcctcaggaatatacacgtgaaccatattcctgttcctgtgacagaagccctagaagtccagggcccagtaagtctcaacggatgtccagatcagtag

SEQ ID NO: 121885 - DNA, 4560 bp, Artificial Sequence
  Description of Artificial Sequence: Synthetic coding sequence
atggccgcggccgcgcgtccacgtggtagggctttaggccctgtcctccctcctacccctctgttactactcgtattacgtgttttacctgcgtgtggcgccaccgcccgggatcccggtgcagctgcaggcctgagtctgcacccaacatattttaacctcgctgaagcggccagaatttgggccactgcgacatgtggtgagagagggccgggggaaggccgaccccagcccgaactatactgcaagctggtggggggtcccacagcccccgggtccggtcacaccatacagggccagttttgtgactattgtaatagtgaagaccccagaaaagcccaccctgtcacaaatgccatagatgggagcgaacgatggtggcagtctccccctctgagtagcggcactcagtacaaccgggtcaatttaactctggacctggggcaactgttccatgtcgcctacattctgattaaattcgctaacagccccagacccgacttatgggtgctagaaagatccgttgatttcggctcaacatactctccctggcagtatttcgcccatagcaaagtagactgcctgaaggagtttggacgggaggccaacatggcggtaactagagatgatgatgtgttgtgtgtgacggaatacagccgcatcgtgccattggagaatggtgaggtggtggtgtctctgatcaacggccgaccaggagcaaagaattttactttctcacatacgctgagggtctaccagggcaacaaacacccactgtttttgaggactaatacactccttggacatcttatttctaaggcacagcgcgaccccactgtaactcgtaggtactattacagcatcaaagacatttctataggcgggcagtgtgtgtgcaatgggcatgcagaggtctgtaacatcaacaatccagagaagctgttccggtgcgagtgccaacaccatacttgtggggagacctgcgacaggtgttgtacagggtacaaccaacgcaggtggaggccagccgcctgggagcagtcacatgaatgtgaggcatgcaactgtcatggccatgcaagtaactgttactatgatcccgatgtggagcggcagcaggcttctctgaatacccaaggtatttatgctggcgggggggtttgcatcaactgccaacataacaccgccggcgtcaactgtgagcagtgcgcaaagggctattaccggccgtacggggtgcctgtggacgctccggacggttgcataccatgctcctgcgaccctgagcatgccgatggctgcgaacagggcagcggccgctgtcactgcaagcctaactttcatggtgacaactgcgagaagtgcgcgattgggtactacaacttcccattttgcctgagaatccccattttccctgtatcaacgccgtcatccgaggatcccgttgccggggatattaaaggttgcgattgtaaccttgaaggagtgctgccagaaatctgcgatgctcacggtagatgcttgtgccgccccggggtggagggtccccggtgcgacacttgccgctcaggtttttattcattcccaatttgtcaggcttgctggtgttctgctctcgggtcataccagatgccctgtagcagtgttactggccagtgcgagtgtagaccaggagtgactggccaacgatgcgaccgctgtctgagtggagcgtacgacttccctcactgtcagggaagttcttcagcgtgcgatccagctgggaccatcaactccaacctcggctactgccagtgcaaacttcacgtggaggggccaacttgttcccggtgtaaattgttgtattggaatctggataaagaaaaccccagtggctgttccgaatgtaaatgtcacaaagccggcacagtgtccggaacaggtgagtgtcggcaaggggacggggattgtcattgtaagagtcacgtggggggcgattcctgcgacacctgtgaggacggttatttcgcgctcgagaagtctaactacttcgggtgtcaagggtgtcagtgtgacatcggaggagcactctcatccatgtgttccggcccctctggcgtctgccaatgtcgggaacacgttgtcgggaaggtctgccagcggccagagaataattactattttcctgatctgcatcatatgaaatatgaaatagaggacggtagcacaccaaatggtcgcgatctcagatttggcttcgacccgctagccttccctgagttctcttggagaggctacgcccagatgaccagcgtgcagaacgatgtgcgcattaccttgaatgtggggaagtcttcagggagcctgttccgcgtaatactgagatacgtgaacccaggcaccgaggctgtgtctggacatatcactatttatcccagctggggagcggctcaatctaaagaaatcatcttccttccttctaaggagcctgccttcgtgaccgtaccaggcaacggattcgccgatccctttagcataacaccaggcatctgggtggcatgtattaaagcggagggcgttttactggattatctagtattgctgcccagggactactacgaagcgtctgtcttgcagcttcctgtcaccgagccttgcgcctatgctggaccaccccaggaaaattgtctgctttaccaacacctgccagttacaaggtttccatgtacgctcgcctgcgaggcaagacatttcctactagatggagagccgagacccgtggccgtgcgacagcccaccccagcccatcctgtcatggtcgacttatcaggacgcgaggtcgagctgcacttacggctcagaataccccaggtggggcattatgtggtcgtggttgagtacagcaccgaggctgcccagttgttcgtggttgatgttaacgtgaagagctctggaagcgttctcgccggccaggtgaacatttatagctgcaattacagtgtgctctgccgatctgctgtcattgatcatatgtctaggattgcgatgtatgagctgcttgcggacgctgacattcagctgaaaggccacatggcccgattcctgctgcaccaggtgtgcatcattcccatcgaagaatttagtgccgaatacgtgcgcccacaggtgcactgcatcgccagttacggaagatttgtcaaccagtcggccacctgtgtctctctggcacacgagacaccccccactgcacttatcctggatgtgttatctggaagacctttccctcatctcccccagcagagctccccatcagtggatgttttgccgggggtcactctcaaagcccctcagaatcaggtgacactacgcggacgcgtcccccatcttggaagatacgtgttcgtcattcacttttaccaagccgcccaccctactttccccgctcaggtttctgttgatggtggctggccacgggctgggagtttccacgcatccttctgcccccatgttctggggtgccgagatcaggtcattgcagaaggccagatagaattcgacatttccgaaccagaggtggccgccacggtgaaggtgccagagggaaagtcgcttgttctggtgcgcgtgttggtggtacctgcggaaaattatgattatcagatcctgcacaagaagtccatggacaagagtctggagttcatcaccaattgcggtaaaaatagcttttaccttgaccctcagaccgcatctaggttttgcaaaaattctgccagatccctggtggccttttaccataaaggtgcactgccctgcgagtgtcaccccactggagcgacaggaccgcattgcagcccagaaggcggagcacacgcaagccccacttcgtctggaggatccgcaccggcggtgcagcaagcgtacggcttcccccggtgcaagcgcaaatcttgcagctgcggccggcggttatgcgaggaaatgactggacagtgccgctgcccgcccagaaccgtcaggccgcagtgcgaggtctgcgagacacatagcttttctttccatccgatggccggatgtgaaggctgcaactgctctcggcgcgggaccatcgaagcggctatgcctgaatgtgatagggactcgggccagtgccgctgcaagccacggatcacaggaaggcaatgtgaccgttgcgcgtccggcttctaccgtttcccagaatgcgtgccctgtaactgtaatagggatggtacagagcccggagtctgtgacccagggaccggggcgtgcctctgtaaggaaaacgtcgagggtacagaatgtaacgtgtgtagggagggctcctttcatcttgatcctgcaaatctcaaagggtgtacgtcatgcttctgtttcggagtaaacaaccagtgccatagctcccataaaaggcgtacaaaattcgtggatatgttagggtggcacctcgaaaccgccgaccgcgtcgacattcccgtgtctttcaaccctggctccaattcaatggtggcagacctgcaggagctaccggccaccatccattccgcatcttgggtcgccccatag

SEQ ID NO: 121886 - DNA, 1743 bp, Artificial Sequence
  Description of Artificial Sequence: Synthetic coding sequence
atggccgctgcagcgcggccccgaggcagagcactaggtccggtcctaccaccaacaccactgctgctgctcgtgttacgggtattacccgcctgtggagccacggccagagacccaggtgctgccgccgggttgagtttacacccaacttatttcaatttggccgaggccgcccggatttgggccactgccacatgcggcgaacgcggccccggcgaaggaaggccccagccggagctgtactgtaagctagtgggaggtcccaccgcgcctggcagtggccacaccattcagggacagttctgcgactactgtaatagcgaggacccccggaaggcacacccagttaccaatgcaattgacggcagtgagcggtggtggcagagcccccctttgtcctctggcacccaatacaacagggtcaaccttaccctcgaccttgggcaactcttccacgttgcttatatactaattaaattcgctaacagtcctcgtcctgatctctgggtgttagaaagaagtgtagactttggcagcacctattccccttggcagtattttgcacactccaaggtggactgtttgaaagaatttggcagagaagccaatatggccgtaaccagggacgatgacgtgctgtgcgtgaccgagtatagccgcatcgttcctttggaaaatggagaggtggtggtgtcgttgattaatggtcggccaggtgccaaaaacttcacattttcccatacactgagagagtttactaaggccactaatattagactgcggtttctgcgcactaacaccctgcttgggcatctgatctcaaaagcccagcgcgacccaactgtcacaaggcgctattattactcaatcaaagacatatctataggcgggcagtgcgtgtgtaatggacacgccgaggtctgtaatattaacaatccggagaagctgttccggtgtgagtgccagcaccacacatgtggcgaaacttgcgatcggtgctgcacaggatataatcagcggcgttggcgacccgctgcgtgggagcagtctcatgagtgcgaagcttgtaattgtcatggtcatgcctcaaactgttactacgatcccgatgtggagcgtcagcaggcaagcctgaacacacaaggcatatacgccggcggaggtgtttgcattaattgccaacacaacacagccggcgtgaactgtgagcagtgcgcgaaaggctactaccgaccttatggcgttcctgttgatgcgcccgacggctgcattccttgttcctgtgacccagaacatgcggatggctgcgagcagggcagtgggagatgtcattgcaagcccaacttccacggcgacaattgcgaaaaatgcgctatcgggtattataattttcccttctgtttgaggataccgattttcccagtgtcaactcctagctctgaggatcctgtggctggggacatcaaaggaaattggtgtgactgcaacctcgagggggtgcttccggaaatttgcgatgcccacggccggtgtctgtgtagaccaggtgtagaggggccacggtgtgacacttgtaggagtggcttttattccttccctatttgccagggtccgtctgagaaggtggcaatttacaaaccagagtccaggcccagtgctgagactgagccagccagcacctggatcctggatttcccagcatcaaggacaggtgaaatcaatttctactgcctgtctccatag

SEQ ID NO: 121887 - DNA, 5007 bp, Artificial Sequence
  Description of Artificial Sequence: Synthetic coding sequence
atgcctcctgccgtaagacgctccgcatgcagcatgggttggttatggatctttggggccgctctggggcagtgcctgggatactcatctcagcagcaacgagttccattcctacagcctccgggccagagtcagctacaggcctcttatgtggagttccggccgagtcagggatgcagcccaggttattatagggaccataagggattatacacaggtaggtgtgtcccttgcaattgcaatgggcatagcaatcagtgccaggacggctccggaatatgcgtgaattgtcaacataataccgcgggtgagcactgtgaacggtgtcaagaaggctattacggcaacgccgtccacggatcatgccgcgcctgcccatgtccacacaccaacagcttcgccactggatgcgtcgtaaacggcggcgacgtgcgatgtagctgtaaagcgggatatactggtactcagtgtgagaggtgcgcccctgggtattttggcaacccgcagaaatttggcggttcatgtcaaccttgttcctgtaactctaacggccagctgggttcatgccatccactcacaggagactgcattaatcaagaacccaaggactcctcgcctgctgaggaatgtgacgactgtgattcttgcgtgatgacccttctgaacgacttggccaccatgggggaacagcttcgattagtgaagtcccaactacaagggctgtcagcctccgcgggccttctcgagcaaatgcggcacatggagacacaggcaaaagatctgcgtaaccaactacttaattatcggtccgcaatttccaaccacgggtccaagattgaaggattagaaagagagctgaccgacctcaaccaggaatttgaaaccctgcaggaaaaagcacaggtcaactctagaaaagcccagactctgaacaataacgtcaacagagcgacccaaagtgccaaggaactggacgttaagatcaaaaatgtaatacgcaatgtgcacatgcttaatcggatccgtacatggcagaagacccaccaaggggaaaacaatggcttagcaaatagcattcgcgactctctgaatgagtacgaggcaaaactttccgacttgcgggccaggctccaggaggctgccgctcaggccaagcaagcaaacggcctgaaccaggaaaacgaaagggcgctcggagcgatccaaagacaggttaaggaaattaattcattgcagtctgatttcacaaaataccttacgacagcagatagctctttgcttcagaccaacattgccctgcaactcatggagaaaagccagaaggagtatgagaagctggcagcatccttgaatgaagctcgtcaggagctgtccgacaaagtgagagagctgtcacggagcgctggtaagacctccctcgtcgaggaggccgagaaacacgcccgctcactccaagagctagcgaagcagctcgaggaaattaaacgtaacgcttctggcgacgagttggtgcgatgtgcagtggatgctgcgaccgcgtacgagaatatcctgaacgccataaaggctgcagaagatgccgctaatcgggcggcatccgcctcagagtccgctcttcagacagtcatcaaagaagacttaccccgcaaggcaaagaccctgtcctccaacagcgacaagctcctgaatgaagccaagatgacccaaaaaaagcttaaacaggaggtgagccctgctctgaataatcttcaacagacgttgaacatcgttaccgtgcaaaaggaagtgattgacaccaatctgacaaccttgagggacgggctccacgggattcagcggggtgacatcgatgccatgattagttctgccaagagcatggtgagaaaagctaacgatattactgacgaggtcttggacggcctgaacccgatacagactgatgtggagagaatcaaggacacatacggccggacacaaaatgaggattttaagaaggctctcacagacgcagacaattccgtcaacaagctgacaaacaaactgcctgatctgtggagaaagatcgagtctatcaaccaacaactcctgcctctgggtaatataagcgacaacatggatagaatacgggagctgatccagcaggctcgagacgccgccagtaaagtcgccgtgcccatgagattcaatgggaaatcgggtgtggaagtacgattgcctaacgatctggaggatcttaaggggtacaccagcttgagcctttttctgcagcggcctaactcccgagaaaacggagggacagaaaacatgtttgtaatgtacctaggtaacaaggacgcaagtagggactacattggcatggcagtggtcgacggtcagctcacatgtgtctataatttaggcgacagggaagctgaactgcaggttgatcagattctgaccaagtcagaaacaaaggaagctgtaatggaccgggtgaagtttcagcgcatataccagttcgcccgcttgaattacacaaaaggagccacttcttcaaaacccgagaccccaggtgtgtatgacatggatgggcgcaactctaatactctgcttaacctggacccggagaacgttgttttttacgtcggcgggtacccgccagatttcaaactaccatcacgcctgtctttccccccttacaaaggttgtattgagttggatgacctgaacgagaacgtcctgagtttgtataactttaaaaagacttttaatctcaatactacggaggttgaaccctgtaggcgccggaaggaggagtctgacaagaattacttcgaaggcactggttatgctagagtacccacccagccacatgcaccaatccccaccttcggccagactatccagacgacagtggatcgtgggcttttgttttttgccgaaaatggtgaccggtttatttctctgaacattgaggacgggaagctgatggtccgctacaaactgaactctgaactcccaaaagagagaggtgtgggggatgccatcaataacggcagggatcattccattcagataaaaattgggaaactccaaaagagaatgtggatcaatgttgacgtccagaacacaattatcgacggcgaagtctttgatttcagcacttattatctcggggggattcctatagcaatccgcgaaagattcaatattagcactcctgcttttagaggttgcatgaaaaacctcaaaaagacctccggggtggttagattgaacgatacagtgggcgttaccaagaaatgcagtgaggactggaagctggtgcgctccgcatcattctccagaggtggtcagctgtcttttaccgatttagggctgccccctaccgaccacttacaagcatccttcgggttccagacattccagccatccggcatccttttggatcaccagacctggaccaggaacctgcaggtgacgctggaggatggctatatcgagctgtccacctccgacagcgggtcccccatatttaagagccctcagacatacatggacggcctgctccattatgtgagcgtgattagtgacaactcaggattgcgtctgctcatcgacgaccagttgctgcgcaactccaagcgtttgaaacacattagcagtagcaggcagagcctccgcctgggcggatccaattttgaaggatgcatctccaacgtgttcgtgcagaggctctcattgagcccagaggtgttagatctgacctccaatagcttgaaacgagacgtctccctcgggggatgcagcctcaataagcctccatttctgatgctgctcaaaggaagcactcgctttaataagactaagaccttccgaatcaatcagctgctgcaggatacacccgtggcctccccacgaagtgtgaaagtgtggcaagatgcctgctcccctctgcccaagacacaggccaaccacggtgctttgcagtttggcgacataccaacctcccatctcttattcaaacttcctcaagagctcctcaagcctcgttctcagtttgcagtcgatatgcagactacctcctcacgggggttagtgttccacacaggcacaaaaaacagtttcatggccctatacctctccaaaggcagactcgtattcgctctcggcacggacggcaaaaaattgcgaatcaagtctaaggagaaatgcaacgacggtaaatggcataccgttgtgttcggccatgatggcgagaaaggacgcttggttgtcgatgggctgcgagcccgcgaagggtccctgcctggtaacagcactatctcaatccgcgccccagtgtacctgggttctcctccttctgggaagccgaaatctctacccaccaactcttttgttggttgtctgaaaaattttcagctggacagcaagcccctgtatacacccagctcctcatttggcgtgtccagctgtctcggaggaccgttggaaaaaggaatttatttcagcgaagagggaggacacgtggtcttggctcacagtgtactgctcggtccagagttcaaactcgtcttctccatccgccccaggtccctcaccgggatcttaatccacatcggcagtcagccaggaaaacacctgtgtgtatatttggaggctgggaaagtcaccgcatctatggactcgggcgcgggcgggacttccaccagtgtcaccccaaagcagtcactatgcgacggccagtggcactccgttgctgttacaattaaacagcatatcctgcaccttgaactggacacggactcatcttatacagcaggacaaatccccttcccacccgctagcacccaggaacctctgcatctgggaggagcccccgctaacctaacaactttacgaatcccagtgtggaaatccttttttggttgtcttagaaatatccacgtgaatcacattcccgtgcctgttacggaagccttagaagttcagggtcctgtgagcctcaatggctgcccagatcagtag

SEQ ID NO: 121888 - DNA, 1065 bp, Artificial Sequence
  Description of Artificial Sequence: Synthetic coding sequence
atgcagggactccttttcagtactctgcttctagccggtctggcacagttttgctgcagagtgcaaggcactggacccctcgatacaaccccagaagggaggccaggggaagtgagcgatgcacctcagagaaaacaattttgccattggccttgtaagtgcccccaacaaaaacctcgatgtccacccggggtgtcactggtgcgagatggctgtggttgctgcaagatttgtgccaagcagcctggcgaaatctgcaatgaagcagacctttgtgatccccacaaggggctttactgtgactacagtgtagaccgtcctcgttacgagacgggtgtctgtgcctatctagttgcagtggggtgtgagttcaaccaagttcattaccacaacggtcaagtgttccagccaaacccgctgttttcctgcctctgcgttagcggagctattggatgcacaccattattcatcccgaagctggctggaagccattgctccggtgccaaggggggaaagaagtcagaccagtctaattgtagtctcgagcccctgctgcagcagctgtccacctcctacaagaccatgccggcctaccgaaatctccccttgatttggaaaaagaagtgcttggtgcaagccaccaagtggacgccatgttccagaacttgcggcatgggcatctccaacagagtgactaacgaaaacagtaattgcgaaatgagaaaagagaaaaggttgtgttacatccaaccatgcgacagcaatattctgaagaccattaaaatcccaaaaggaaagacctgccagccgaccttccagctgtctaaggcagagaagtttgttttctcaggttgctccagcacccaatcctacaagccaaccttctgcggaatatgcctggacaagcgttgttgcatccccaataaaagtaaaatgatcacgatccagtttgactgtcccaatgagggtagctttaaatggaagatgctttggatcaccagctgcgtgtgccaaaggaactgccgcgaacctggagacattttttctgaattaaaaattctttag

SEQ ID NO: 121889 - DNA, 267 bp, Artificial Sequence
  Description of Artificial Sequence: Synthetic coding sequence
atggctctctcctctgcttggcgcagcgtcctccctctctggttactttggagtgccgcctgcagtcgggccgctagtggggacgataacgccttccctttcgatatcgaggggagcagcgctgtgggtaggcaggatccgccagagaccagcgaacctcgggtagccttaggacggcttcctccagccgcagaaaaatgcaatgccggctttttccataccctgtcaggagagtgcgtgccatgcgactgcaacggcaactcatag

SEQ ID NO: 121890 - DNA, 363 bp, Artificial Sequence
  Description of Artificial Sequence: Synthetic coding sequence
atggctttgtctagcgcctggagatccgtcctccctctctggctgctctggtccgcggcctgctcaagggctgcgtctggtgatgataatgcgtttcctttcgatatagagggaagctccgccgttgggagacaggatccacccgaaacgagtgaacctcgcgtggccctggggaggctgccccctgcggccgaagtgcagtgtccatgccattgtcatccagcgggcgctccagcccccccacgggccgtacctcactcctccttttctctctctccacccttgtctagtccccagtgcctggaatctttcacctgggcacggtccgtgagaaaactcgaaattaagagcttccctctgtag

SEQ ID NO: 121891 - DNA, 549 bp, Artificial Sequence
  Description of Artificial Sequence: Synthetic coding sequence
atggccctgtcctcagcctggaggtccgtgctacccctgtggttgttatggagcgccgcgtgctcgcgggcggcaagcggcgacgacaatgccttccccttcgatattgaaggatcgtctgcagtaggacgccaggaccccccggagacctccgagcctagagttgccctcggcagattaccacccgccgcggagaagtgcaatgctggattcttccacacactgtcaggtgaatgtgtgccgtgtgattgtaacgggaactccaacgagtgcctagatgggtcagggtattgcgtgcattgtcagcgcaacacaaccggagagcactgcgagaaatgtttagacgggtacattggtgacagcattaggggagccccccagttttgtcaaccctgtccatgtccattgccccacctagcaaactttgccgagtcctgctaccgcaaaaacggtgcagtgcgctgcatttgcaatgaaaattacgctgggccgaattgcgagaggccttctccacagagcaccagggggttccctctgaacgactcctag

SEQ ID NO: 121892 - DNA, 537 bp, Artificial Sequence
  Description of Artificial Sequence: Synthetic coding sequence
taaatttttgaggattgcgacgaggtcaccggacagtgtcggaactgcttgaggaacactacgggattcaaatgtgagagatgtgccccaggttactatggtgacgcacgcattgccaagaattgtgccgtttgcaactgtggtggaggcccatgcgactctgtgacaggcgagtgccttgaagaggggtttgaacctcctacaggtatggactgtcccaccatttcttgtgacaagtgtgtttgggatctgactgatgccctgcgtctggctgctttgagtattgaagaaggaaaaagtggcgtgctcagcgtgtcaagcggcgcagccgctcaccggcatgtgaatgagatcaatgcaaccatctacctgctaaagaccaagctttccgaacgtgagaatcagtacgctctcaggaagatacaaatcaataacgccgaaaacaccatgaagtccctcctgagcgatgtagaagagttagtggagaagcactggaacaagccaaggaggcggctggagctgcaggaaggggtgtag

SEQ ID NO: 121893 - DNA, 5451 bp, Artificial Sequence
  Description of Artificial Sequence: Synthetic coding sequence
atggccttgagcagtgcttggcgctcagttctgcccttgtggctcttgtggtccgccgcctgttcgcgggctgctagtggtgacgacaacgctttcccattcgatatcgaggggtctagcgccgtagggcgacaggatccacccgaaaccagtgagccgcgggtagctctgggtaggctgcccccagcggccgaaaaatgcaatgccggcttttttcacaccctgtccggggaatgcgttccatgcgattgcaatgggaacagtaatgagtgccttgatggttcaggctactgcgtgcattgccagagaaacactacaggtgaacactgcgagaaatgtcttgatggatatattggcgacagtattagaggggccccacagttttgccagccgtgtccctgtcctctcccacaccttgctaatttcgcagagagctgttatcgaaagaacggcgctgtacggtgtatttgcaatgaaaactacgctggccccaattgcgagaggtgcgcacctggctattatggtaaccctttattgattggaagcacctgcaagaagtgtgactgctcagggaactctgaccctaatctgatcttcgaagattgtgatgaggtcaccgggcagtgtcggaattgcttgaggaacacgaccggctttaagtgtgaaagatgcgcaccaggctactacggggacgcacggatagcgaagaattgcgccgtgtgcaactgtggaggcggcccctgtgacagcgtcaccggagagtgtcttgaggaggggtttgagcctcctacagggtgtgacaagtgcgtgtgggatctcactgacgcactgcgcctggctgctctgagtattgaggagggtaagagtggcgtgctctccgtgtcctctggtgcagctgcacatcgtcacgtcaacgagatcaatgccactatctacctgctaaagaccaagctctcagaacgggagaaccagtacgcgctaaggaagattcaaatcaacaacgctgaaaacaccatgaaatctctgctgagcgatgtggaggaattggttgagaaagaaaaccaggccagccgcaaaggccagctggtacagaaggagagcatggataccatcaatcacgccagtcagctcgtcgagcaggctcatgacatgagggataaaattcaagagatcaacaataaaatgctctactacggtgaagaacacgagctgagccccaaagaaatatctgaaaagctcgtgttggcgcaaaaaatgctcgaggaaattaggagccggcagcctttcttcactcaacgggagctggttgatgaagaagccgatgaagcctatgagctgctctcccaagccgagtcttggcagcgattgcataacgagacccggacactattcccggttgttttggagcagctagatgattacaacgccaagctgtcagaccttcaggaagcccttgatcaggcactgaactatgtgcgggatgccgaagacatgaatagggccacggctgcacgccagcgggaccacgagaagcagcaggaaagggtaagggagcagatggaggtggtcaatatgagcctgagcacatccgctgattccctgacaacccccagactgaccctgtccgagctcgatgacataattaagaacgcatccggcatttatgctgaaatcgatggcgcaaagtccgaactacaagtgaagttgtcaaatttgagcaacctttcccatgacctggtgcaggaggctatcgaccacgcacaggacttacaacaggaggctaacgaattatcaaggaagctccactcctccgacatgaatggccttgtgcagaaagccctggatgcttcaaacgtgtacgaaaacatagtaaactacgtcagcgaagccaatgagaccgctgagtttgccctaaacacaacagacaggatttatgacgcagtgtcgggcatcgacacccaaatcatctaccataaagacgagagcgagaatctattaaaccaggcccgggaactacaggccaaagccgaaagttcgagcgacgaggccgtggctgacacctccagaagggtggggggagctctggcgcgcaaatccgctcttaagactcgcctgtccgacgcagttaaacaactgcaagctgcagagcggggcgacgcccagcaaagacttggccagagccgccttatcacagaggaggccaaccgtactacgatggaggtccaacaggccaccgctcctatggcgaataatcttacaaattggtcacaaaatctgcagcacttcgattcttctgcctataatactgctgtgaattccgcacgagatgccgtgaggaacttgacagaggtggtgccccaactcctggaccaactacgaaccgtggaacagaagaggcctgccagcaacgtgagcgccagtatacagcgcatcagggagctgattgcccagacacgatctgtggctagtaagatccaggtctcaatgatgttcgacggacagtcagcagtagaagtgcactcgcgcacgtctatggatgacttgaaggcattcacaagccttagtctctacatgaagcccccagtgaaaaggcccgagttgacagagacagccgaccagttcatcctgtacctggggagcaagaacgccaagaaggagtacatggggctagccattaaaaacgacaaccttgtctatgtttataatctgggcaccaaagacgtggaaatacctcttgactcaaaacctgtatcaagttggcccgcatatttttctattgtcaagatcgagagagttggtaagcacggaaaagtctttcttactgtgccctctctctccagtaccgcggaggagaagtttattaaaaagggcgagttcagcggcgatgactctctcctggacttggaccctgaagacacggtgttttacgtcggcggcgtgccaagtaatttcaaactcccaactagcctgaatctgcccggcttcgtaggttgcctggaactcgcaactttaaacaacgacgtgatcagtctctataacttcaaacacatttacaatatggacccctccacttctgtcccttgcgcacgcgacaagcttgccttcacccagagcagagccgcttcatatttttttgacgggagtggttatgctgtcgtacgtgacatcaccaggagaggcaaatttgggcaagtcaccaggtttgatattgaggttaggacacctgctgacaacggtctgattctgttaatggtgaacggctccatgttttttaggttggagatgaggaacggctacctccatgtgttctacgacttcggtttcagcggtggccctgttcatctggaagacacattaaagaaagcacaaattaacgacgccaaatatcatgaaatcagcatcatttaccacaatgacaagaaaatgattctggtagtggaccggaggcatgtcaagtcaatggacaacgagaaaatgaagattcccttcacagacatttatatcggaggcgcgccaccagagattttgcagagtcgagccttgcgcgcccatctcccccttgacataaacttccgagggtgcatgaaaggtttccaatttcagaagaaggatttcaacctgcttgagcagactgagactttgggtgttggttacgggtgcccagaagatagtctgatctcgagacgtgcctactttaacggtcaatcttttattgcgtcaatacaaaagatctcttttttcgatggatttgaggggggcttcaacttccgcacattgcagccaaacggcctgttattctactacgcaagtggcagtgacgtcttttctatctctctggacaacggtaccgtcatcatggatgttaaggggatcaaagtgcagtcagtggataagcagtacaatgacggcctatcacatttcgtgatctcttccgtgtctcctacccggtacgagcttatcgtagataaatcccgggtaggttccaaaaaccctaccaagggaaaaattgagcagactcaggcatccgagaaaaaattttattttggagggtcccctatcagcgcacagtacgcaaatttcacgggttgtatctctaatgcgtacttcacaagggttgatagggatgttgaggtcgaggactttcagcggtacactgaaaaggtccatacctctttgtacgaatgtcctatcgaatcgagccccctcttcctgctccacaagaaggggaaaaatctctcgaaaccaaaagcgagtcagaacaagaaaggcgggaaaagtaaggatgctccctcgtgggacccagttgccctgaaacttcccgagcggaacacacctcgcaatagccactgccacctcagcaatagtcctcgtgccattgagcatgcctaccagtatggcgggactgccaattcaagacaagagtttgagcacctgaagggagatttcggcgctaaatcgcagttttccattagattacgaacgcgaagctcccatggcatgatattctacgtgtcagaccaggaggaaaacgactttatgactctgttcctggctcatggaagactggtatacatgttcaatgtcgggcataagaaacttaagattcggagccaggagaagtataatgacggcctctggcacgatgtaatcttcatcagggaacgctcaagcggcagactcgtcatcgacgggctgcgagttctcgaggagagcttgccaccgacagaggccacttggaaaattaagggccccatctatttgggcggagtggcacccggcaaagctgtgaaaaacgttcagatcaacagcatatacagtttctctggctgtcttagcaacttgcagttaaacggtgcttccatcaccagcgcttcacaaactttcagtgttacaccctgctttgaaggccccatggagacaggcacttacttcagcacagaaggaggatatgtagtgctcgacgaaagcttcaatatcggcctgaagtttgagatagcctttgaggtgcggcctcggagcagcagcggtacactggtgcatggccactctgtgaatggtgaatacctgaacgtccacatgaaaaatggccaggtgatcgtcaaggtcaataatgggattcgtgatttcagcacctccgttactcccaaacagtccctgtgcgatggacgatggcaccggataactgtgatacgcgattctaacgtcgtccagttggatgtggactccgaggttaaccatgtcgtcggtccactgaacccaaaacccatagatcacagagaacccgtcttcgtcggtggagtgcccgaaagcttgctgacacctaggctggcaccctctaagccttttacggggtgcattagacacttcgtgattgacgggcatcctgtctcctttagcaaggccgcgctggtgtctggtgcggtgagtataaatagttgcccagctgcctag

SEQ ID NO: 121894 - DNA, 5451 bp, Artificial Sequence
  Description of Artificial Sequence: Synthetic coding sequence
atggccctgtccagcgcctggagaagtgtccttcccctctggttactgtggtccgccgcctgctctagagcggcctcaggggatgacaatgctttcccctttgatatcgaaggctcatctgcagtgggacgccaggacccccccgagactagcgagccccgagttgcgttgggccgcctgccgccggccgctgaaaaatgtaacgccggttttttccacaccctgtctggcgagtgcgttccttgtgattgtaatggtaactcgaatgaatgcctcgacggttcaggctattgcgtccactgccagaggaacaccactggcgagcattgtgagaaatgtctggacggctatattggagatagtattagaggggcgccacagttctgccagccttgcccatgtcctctcccacaccttgcaaatttcgctgagtcctgttatcggaagaacggggccgttagatgcatctgcaacgagaactatgccggcccaaactgcgagaggtgcgcacctggttactacgggaatccacttctgattggctctacatgtaagaagtgtgactgcagcggaaactccgacccaaacctgatctttgaagattgcgacgaagttaccggccagtgtagaaactgtctgaggaatacaaccgggttcaaatgcgaaaggtgcgctcccggatactacggagacgcccggattgccaagaattgtgcggtatgcaattgcgggggagggccatgcgattccgtgactggtgaatgcctcgaagaaggttttgagcctcctacagggtgcgataagtgtgtttgggatctgactgatgccctgcgcctagctgccctatccattgaggaggggaaatctggtgtgctaagtgtgtctagtggcgccgcagcacatcgccatgtcaatgagattaacgctaccatctatctgctcaagactaaactcagcgagcgcgagaatcagtatgctttgagaaagatacaaatcaataacgcagaaaacacgatgaagagcctcctctcagacgtggaagaattggtggaaaaggaaaatcaggccagccgaaaggggcagctcgtgcaaaaagaatcaatggacaccataaatcatgcctcacaactcgttgagcaggcccacgacatgcgagacaagatccaggagatcaacaacaagatgttatattatggggaggaacatgagctgtcccccaaggagatctccgagaagctggtactggctcagaagatgctggaagaaatccggtcccgtcagcccttttttacccagcgtgagttggtggatgaagaggcagatgaggcctatgagctcttgagtcaggctgaaagttggcagcggcttcataatgaaacccgaacccttttcccagtggttctagagcagctcgacgattacaatgctaagttatccgatctgcaagaggcactggaccaggcccttaactacgtaagagacgctgaggacatgaacagggcgactgctgctcggcagcgcgatcacgagaagcagcaggaaagggtgcgcgaacagatggaggtagtgaacatgtctctgtccacctccgcagactccctgaccaccccgcgcctaacactcagtgagctggatgatatcatcaagaacgcatcaggaatttatgccgaaatcgacggcgccaagagcgaacttcaggtgaagctgtccaatctgagtaacctgtctcatgacctggtgcaggaggctatcgaccacgcccaagacctgcagcaagaggcaaatgagttgtccagaaagttgcactcctcagacatgaatggtctggttcagaaagccctggacgctagcaatgtgtacgaaaatattgtcaattatgtatccgaggcgaatgagaccgctgagtttgccctaaatacgacagatcgaatatacgacgccgtctctggaattgatacacagatcatctaccacaaagatgagtctgagaatctcctgaaccaggctagggaactgcaggccaaggccgaatcaagttctgacgaggccgtagctgatacctcgcgaagagtcgggggggccctggcaagaaagagtgctctgaagacaagactgagtgatgccgtgaagcagctgcaggcggccgagaggggcgatgcccagcagcgactgggacagtcccgactgatcactgaggaagcaaacagaacgaccatggaagtacaacaggctactgcccccatggccaacaacctcaccaactggagtcagaaccttcaacatttcgactcttctgcttataacaccgccgtgaatagtgcccgtgatgcagtccggaatctgacggaagtggtcccccagcttctggaccagctgcgcaccgtagagcagaaacgtcccgcctctaatgttagtgcatctatccaacggattagagaactgattgctcagactcggagtgtggcctcaaagatccaagtctctatgatgttcgatggtcagtctgccgtcgaagttcattctcgcacctcgatggacgacttgaaggcctttacttcactgtccctctacatgaagccacccgtcaagaggcctgaacttacagagaccgcggaccagtttatcctgtatttgggttccaagaatgccaaaaaagaatatatgggcctcgctatcaaaaacgataatctcgtgtatgtgtacaacttgggaactaaggatgtcgaaatccctctggattctaaacccgtgagctcatggcccgcatatttctcgatcgtgaagatagagcgcgtaggcaaacacggaaaagttttcctgacggtcccttctctttcttctactgccgaagagaagttcataaagaagggagaatttagcggagacgacagtctactggacttggacccagaggatacagtgttctacgtggggggggtcccaagcaatttcaaattgcccacctccctgaacttaccgggattcgtcggctgcctcgagctcgccaccctgaataatgacgtgattagtctctataacttcaaacatatctacaacatggatccatccacatcagttccttgcgccagagataaattggcattcacacagagcagagcagcatcatacttttttgacggctccggatacgctgtcgtgagagatattacacggcgcgggaaatttgggcaggtgacgcgctttgacatcgaagtccgaaccccggcagataatgggctcatcttactgatggtgaacgggtctatgttctttcgcttagaaatgaggaatggatatctccacgtattttatgattttggcttctccggaggtcccgtccacctggaggacacactcaagaaagctcaaatcaatgacgccaaatatcacgaaatctcgatcatttaccacaacgacaagaagatgattctagtcgttgatcgacgacacgttaaaagcatggataatgagaagatgaagatcccgttcaccgatatatacatcgggggagccccgcccgagattttgcaaagcagagctttgagggctcacctgcctctagatatcaatttccgaggatgcatgaagggcttccagttccagaagaaggacttcaatctcctggaacaaacagaaactctcggggttggatatggctgtcccgaggatagcttgataagtcgacgggcttactttaatggccaatcgtttatcgcctctatccaaaagatctctttttttgacggctttgaggggggatttaatttcagaaccttgcagcccaacgggttactcttctactatgctagcggcagcgatgtcttttcgattagcctcgataatggaacggtgattatggacgtgaaagggattaaagtccagtccgtggataaacagtacaatgacggcctctcacacttcgtgattagctccgtttcacctactcgctacgaactcattgtcgataaatccagagtggggagcaaaaatcccactaaaggcaagattgaacagactcaggcatcggagaagaagttctactttggtggctccccgatttcagcccagtatgccaattttaccggatgcatctcgaacgcttattttaccagagtagatagggatgtcgaggtggaggacttccaacgatatactgaaaaagtgcacacctccctgtacgaatgccctatcgagagcagccctctgtttctgctccataagaaaggtaagaatctgtccaaaccaaaagcttcccagaacaaaaagggcggcaagagcaaagatgcccctagctgggacccagtggctcttaagctgccagagcggaataccccgcggaactctcattgtcacctcagtaactccccccgtgcaatcgaacacgcttaccagtacggtgggaccgcaaactctaggcaggagtttgagcaccttaagggagatttcggagctaaaagccagttctcaatcaggcttaggactcgctcttcccatgggatgattttctacgtcagcgatcaggaagaaaacgatttcatgacactgttccttgcgcatggccggttggtgtatatgttcaatgtaggccacaagaaactcaagattcggtcacaggagaagtacaatgacgggctttggcatgatgtgatcttcattagggagcggagctcgggaaggttggtgatcgacggcctgcgcgtgttggaagagtctctgcctcccactgaagcaacatggaaaatcaagggacccatctacctcggaggtgtggccccaggaaaagccgtgaagaatgtgcaaattaacagtatatattctttcagcgggtgtttgtccaacctccagctgaatggagccagcattactagtgcaagccaaacctttagcgtcactccatgctttgaaggacctatggagactggcacgtactttagtactgaaggagggtatgttgtcttagatgagagttttaacatcggcctgaagttcgagatagcgttcgaagttaggccaagatcctcttccggcacactggtgcatgggcactccgttaatggggagtaccttaatgtgcatatgaaaaatggtcaggtcattgtgaaagtgaacaacggcatacgggacttctctactagtgtgacgccgaagcagagtctatgtgacggccgctggcatcggatcacggtgattcgggattcaaacgtggttcagctcgatgttgactctgaagtaaatcatgttgtaggtcctctaaaccccaagcctatcgaccatagggaaccagtgtttgtggggggcgttcctgaaagtctcctcactcccagattggccccaagtaagccctttactggatgtattcggcactttgttatcgacggccatcccgtcagcttcagcaaggctgccctggtgagtggcgccgtgagtataaacagctgtccggccgcgtag

SEQ ID NO: 121895 - DNA, 390 bp, Artificial Sequence
  Description of Artificial Sequence: Synthetic coding sequence
atggcgttgtcctcagcatggcgcagcgtgctgccactttggctgttgtggagcgccgcctgttcccgggccgcatctggcgatgataatgcctttccatttgatattgagggctcaagtgccgtgggtaggcaggaccccccagagacatccgagcccagggtggcccttgggaggctaccacccgctgctgaaaaatgcaacgcaggcttttttcacacactcagtggcgaatgcgtgccctgcgattgcaatggaaatagcaacgagtgtctggacggctcaggttattgcgtgaccacagacggcgaagaccccgggttcagcgcctccgcactgagttttatactgagctcacagggggcgcgcgaggcaagggccccaacatag

SEQ ID NO: 121896 - DNA, 363 bp, Artificial Sequence
  Description of Artificial Sequence: Synthetic coding sequence
atggctctgagctctgcttggcgctccgtcttaccactgtggctgctgtggagtgctgcctgttcacgggctgcaagtggagatgacaatgcattcccattcgatatagagggcagttctgccgttgggcgccaggaccccccagagaccagcgagccaagagtcgccctcggtcggttaccgcctgccgctgaggtgcagtgtccatgtcactgtcatcccgcaggagcacctgccccaccacgagccgtcccccactcctccttttctttaagtccccccttgtcttccccgcaatgtcttgaaagttttacttgggccaggtccgtgagaaaactggagattaagagcttccctttgtag

SEQ ID NO: 121897 - DNA, 1125 bp, Artificial Sequence
  Description of Artificial Sequence: Synthetic coding sequence
atggctcttagcagtgcatggcgatccgtcctgccactatggttgctttggtcagccgcctgctcacgggcagccagcggggatgacaacgcgttccctttcgatattgaggggtcctccgctgtggggaggcaggatccaccagaaacatccgaaccaagagtggctctcggccggctacccccggccgcagagaagtgcaatgccgggttcttccatactctctctggcgagtgcgttccttgcgattgtaacggcaattctaatgagtgcctggacggctccgggtattgtgtgcattgtcagcgtaataccacaggagagcactgtgaaaaatgtcttgatgggtacattggtgattcaatacgcggcgcgccacaattttgtcagccttgtccatgccccctccctcatttggctaattttgccgaaagctgctaccgcaaaaatggggcggtgcggtgcatatgcaacgagaattacgcgggccccaattgcgaaaggtgcgcccccggctactacgggaatcctctccttatcggaagtacctgtaagaaatgtgattgtagcggcaatagcgaccctaatctcatcttcgaggactgcgatgaggtaaccggtcaatgcaggaactgtctgcgcaacaccactggctttaaatgcgagcgctgtgctccaggttactacggcgatgcccgcatcgctaaaaactgtgcagtttgtaattgtggaggaggaccctgtgactccgtgacaggcgagtgcctagaagaagggttcgagcccccaacaggaatggattgcccaaccatttcatgtgataaatgcgtgtgggatctgactgatgctttgaggctcgccgccttgtccatcgaggaggggaagagtggcgtgctaagtgtgagctcaggcgcagcagctcatagacacgtgaacgagatcaacgccaccatttatctgctgaaaaccaaactgtccgaaagggagaatcaatacgccctgcgaaagatccagatcaataatgccgagaacactatgaagtcgctgctttcagacgtcgaggaactggttgagaaacactggaataagccaagacgccggctcgaactgcaagaaggtgtatag

SEQ ID NO: 121898 - DNA, 363 bp, Artificial Sequence
  Description of Artificial Sequence: Synthetic coding sequence
atggcactgagcagcgcctggaggagcgttttgcctctgtggcttttatggtctgctgcctgttctagggcagcaagcggcgacgataatgctttcccattcgatattgagggtagttccgctgtcgggcggcaagatcctcccgaaacatccgagccccgcgtggccttaggtcgcctgcctcctgccgcggaagtgcaatgcccctgccattgccaccctgctggcgcaccagcacctcccagggctgtccctcattccagtttttcactgagcccgcccctgtcgagcccacagtgtttagagagttttacctgggctcgaagcgtcaggaagttagagataaagtcgttcccactgtag

SEQ ID NO: 121899 - DNA, 324 bp, Artificial Sequence
  Description of Artificial Sequence: Synthetic coding sequence
atggccctttcctcggcgtggcgttctgttttaccactttggttgctatggtccgctgcgtgttcccgggccgcctctggcgacgacaatgcgttcccttttgacatagagggtagctctgcagtcgggcgccaggaccctcccgagaccagtgaacctcgggtggccctcggcaggctaccccccgcagccgaaaagtgcaatgcaggctttttccataccctgagcggggagtgtgtgccctgcgactgtaacggaaattccaatgaatgcctggacggtagcggctactgcgttcattgccagcgcaacaccacaggatag

SEQ ID NO: 121900 - DNA, 996 bp, Artificial Sequence
  Description of Artificial Sequence: Synthetic coding sequence
atggccttatcaagcgcttggagatcggtgctccccctgtggctcctgtggagcgcagcttgttcgcgggccgcttcaggagatgataacgccttccccttcgacattgaaggctcctcggccgtgggacggcaggatccccctgaaacaagtgaaccaagggtggctttgggccggctgcctcctgccgccgaaaagtgcaatgccggattttttcacactctgagcggggagtgtgtgccttgcgattgtaacggcaacagcaacgagtgccttgatggatctggctattgcgtgcattgtcagcggaacaccacgggtgaacactgcgaaaagtgtctggatggatacattggggactccatcaggggggcgccacagttctgtcagccatgcccttgccccctgccccatctggccaactttgccgaaagctgctatagaaaaaacggagctgttaggtgcatttgcaatgagaactatgccggcccgaactgcgaaaggtgcgcgcctggctactacggcaaccctctcttgatcggatctacatgcaagaaatgcgactgctcaggcaacagcgatccaaacctcatcttcgaggattgcgatgaagtcactggccaatgcagaaactgtctgcggaatacgacaggcttcaagtgcgagagatgcgcacccggctactacggggacgcccgcattgcgaaaaactgcgcagtctgtaattgtggcggaggaccctgcgactcagtgaccggggagtgcctggaagagggcttcgaacctcccaccggcatggattgcccgacaatctcttgtgacaagtgtgtgtgggacctgacagacgcacttaggctagctgctctgtccatcgaggagggaaaaagcggggtcctgtcagtgagttctggggcagccgctcatcgacatgtgaacgagattaacgccaccatatacctgctgaaaaccaaactaagcgaacgtgaaaatcagtag

SEQ ID NO: 121901 - DNA, 246 bp, Artificial Sequence
  Description of Artificial Sequence: Synthetic coding sequence
atggccctttcatcagcttggcgaagtgttctcccactgtggctgctttggtccgcagcctgcagcagagccgcctccggagacgataatgccttcccatttgacattgagggctctagtgctgtaggaagacaagatccccccgaaacttccgagcccagggtcgccctcggcaggctgcccccagccgcggaaaaatgcaacgctggcttctttcacaccttgtctggtgagtgcgtaccctag

SEQ ID NO: 121902 - DNA, 5451 bp, Artificial Sequence
  Description of Artificial Sequence: Synthetic coding sequence
atggcgctgtcatctgcttggcgctctgtcttgcccttgtggctactctggtcagcagcctgtagcagggccgcctctggagatgataatgccttcccctttgacatcgagggatctagtgcagttggcagacaggacccccccgaaacatctgaaccgcgcgttgctctgggtaggctgccccctgccgctgagaaatgcaatgctggattcttccacactctatccggagagtgcgtgccatgcgactgcaacggcaattctaatgagtgtctcgatgggtccggatactgcgtgcactgccagcggaacaccaccggtgagcactgcgaaaagtgtctagatggatacataggggatagcataaggggggccccacaattctgtcaaccatgtccttgccccctgccccatctggccaatttcgccgaaagctgctatcgcaagaatggggccgtgcgttgcatctgcaatgagaattatgccggtcccaactgcgagagatgcgccccgggctattatggtaatccattgctaattggaagtacttgtaagaaatgtgattgttcaggcaatagcgacccaaacctgattttcgaagactgtgacgaagtgacgggccaatgtcgaaactgcctgcggaacactaccggatttaagtgtgaacgttgcgccccgggctattatggcgacgccagaatcgctaagaattgcgctgtctgcaactgtggaggaggcccgtgcgattccgttacgggggaatgcctagaggaaggcttcgagcccccaaccggctgtgataaatgcgtgtgggacctgacagacgctttgcgacttgctgccctgagtattgaggagggcaaatcgggggtcctttccgtgtcaagcggtgcagcagcccataggcatgtaaacgaaatcaacgccaccatttatttactgaaaaccaaactgagcgagagggagaatcagtatgcccttcggaagatccagataaataacgctgagaatacaatgaaatccctgctcagtgacgtggaggaacttgtagagaaggaaaatcaggcctccagaaagggacagctagtgcaaaaagaaagcatggacacaataaatcatgcatcgcagctggtcgagcaagcacatgatatgcgggataagattcaggaaattaataacaaaatgttgtattacggcgaggaacacgagttgtcccccaaggagatttccgaaaaattggtgctcgcacagaaaatgctggaggagatcagaagtcgccagcccttctttacccagcgtgagctcgtggatgaggaggccgatgaggcctacgaacttctgagtcaggctgaatcctggcaaagactacacaacgaaactagaaccctgtttcctgtggttctggagcagctcgacgattacaacgcgaaactcagcgatctgcaggaagcactcgatcaagctttaaattacgtccgagatgcagaagatatgaatagggcaacagctgcaaggcaacgggatcatgaaaaacagcaggagcgggtgcgggaacaaatggaggtcgtgaacatgtccttgtcaactagtgctgactctctgactacaccccgcctgacgctgtcagaactcgacgacataatcaaaaacgccagtggcatctacgccgagatagacggtgccaagagtgaactgcaggtcaaactgtcaaatctgtcaaatctgtctcacgatctggttcaagaggctatcgatcatgctcaggacctacagcaggaagcgaatgagttatccagaaaactccactcctccgatatgaatggcctggtgcaaaaagcactggatgcctcgaatgtgtacgagaatatcgtgaattatgtcagcgaggcaaatgaaacagccgagtttgccctgaatacaaccgatcgcatttatgacgccgtcagtgggatcgatacacagataatttatcacaaagatgagtctgagaacttgctcaatcaggctagagaattacaggcgaaagccgagagtagcagcgacgaggcggtcgccgacacctctaggcgcgttgggggtgctctcgccaggaagtctgccctgaaaaccagactgtccgatgctgtaaagcagttgcaggcggccgagcggggcgatgcgcaacagaggctggggcagtctcgactgatcaccgaagaggcgaaccggaccacaatggaggttcagcaagccactgcccccatggccaataatctgacaaattggtcacagaacctgcagcactttgactctagcgcatataacaccgcggttaattcagcccgcgacgctgtacgaaatctgacggaagtggtgcctcagctgctggaccagctgagaactgttgagcagaagcgtcccgcatcaaacgtgagtgcttctattcagcgcatcagagaactcatcgctcagacccgctccgtggcctctaaaatccaggtaagcatgatgttcgatgggcagtccgctgtagaggtgcatagcagaacaagtatggatgacctgaaagcttttacatcgttgtccctgtatatgaagccccctgtgaagagaccagagcttaccgaaacagccgatcagtttatcctgtacctgggttctaagaacgccaaaaaggagtacatggggctggcaatcaaaaatgacaacttggtgtacgtctataacttggggacaaaggacgtcgaaatccccctggattccaaacccgtgtcttcatggcctgcatacttctcaattgtcaaaattgagcgtgttggcaagcacggtaaggtgtttttgaccgtgcctagcttatcttccacagctgaagagaaatttatcaaaaagggagagttctccggagacgattctctgttggatctggatcctgaagatacggttttttatgttggtggggtgccctcaaatttcaagctgcctacttccttgaacttacctggctttgtaggctgtttagaactcgccacactgaacaacgacgtgataagcctttataacttcaaacatatttataatatggacccttccacaagcgtgccatgcgcgagagacaaattggccttcacccaatctagggcagctagttatttctttgacggatccgggtacgccgtcgtcagagacataacacgtcgaggcaaatttgggcaggtgacccgtttcgatatcgaggtgcgcaccccagccgataacggtctgattctcctgatggtgaacggatccatgttcttccgcctcgaaatgaggaatggttatctgcatgtgttttatgacttcggcttcagcggtggccctgtgcacctggaggacacattaaaaaaggctcagattaacgacgctaaataccacgagatatccattatttaccacaacgataaaaaaatgatcctggtggtggacagacgccatgtcaaatcaatggacaacgagaaaatgaagatccccttcacagacatctacatcggcggcgcacctcctgagatcctccagagccgcgcactgcgggcccacctgccactcgatattaacttccgaggctgtatgaagggctttcagttccagaagaaggattttaatctccttgaacaaaccgagactctgggggtggggtacgggtgcccagaagattcattgattagtcgaagggcctattttaacgggcagagtttcatcgcatccatccagaaaatcagtttctttgacggctttgagggcggctttaatttccggacactgcagccgaatggcctactgttctattacgccagcggctcagacgtgttttccatttctttggataatggcacggtgatcatggacgttaagggaatcaaagtccaaagtgtggataaacagtacaatgacggactctcccacttcgtaatttcttccgttagcccgacacggtacgagctcattgtagataaatcgcgggtgggatccaaaaacccaactaagggtaagattgaacagactcaggccagtgaaaagaaattttattttggaggatcaccaatctcagctcagtatgcaaacttcacaggatgcatatcaaatgcctatttcacaagggtggaccgggatgttgaagttgaggattttcaaaggtacaccgagaaggtgcatacttctctgtacgagtgcccgattgagagttcccccctgtttttgctgcataaaaaaggcaaaaacttatccaaaccaaaggcctcccagaataaaaaaggtggaaaatcgaaggacgctccaagttgggaccctgtggctctgaaacttccagagcgaaacacaccccggaactcacattgccatctgtccaattcccctagggcgattgaacatgcctatcagtacggggggactgccaattcacggcaggagttcgagcacctgaaaggagattttggcgccaaaagtcagttttctatcagacttcggacccgatcttctcacggcatgattttttatgtgagtgaccaggaggaaaacgactttatgaccctgttcttggcccatggtcgacttgtgtacatgtttaacgtggggcacaaaaaattaaagattcgctctcaggagaagtacaatgacggactgtggcacgacgtgatctttatccgcgagaggtcctccggacggcttgtcatcgacggcctgagagtgctggaagagtctttgcctccgacagaagcgacatggaagataaaaggccctatctatcttggcggagtggcccctggtaaggccgtgaaaaacgtgcagataaacagcatctactccttcagcggctgtctgtcaaaccttcagcttaatggtgccagtatcactagtgcgagccagacatttagcgtgactccgtgtttcgaaggaccaatggaaaccggaacctacttctctaccgagggaggctacgtggtgctagacgagtcgttcaatattggattgaagtttgaaatagcttttgaagtgcggcctcgctctagtagcgggacgctggtacatggccactcagtcaacggggaatacctgaacgtgcacatgaagaacgggcaggttattgtgaaggtcaacaacggcataagagatttttcaacgtcggtgacccccaaacagtctctctgcgacggtcggtggcataggattactgtgatccgggattctaatgtcgttcagctggatgtcgacagtgaggtgaaccacgtcgttggtcctctcaacccaaagcccatcgatcacagggagccagtctttgtgggtggcgttccagaaagcctgctgacccccagattggcaccaagtaagccctttaccgggtgcatacgccactttgttatcgacgggcaccccgtgtctttcagcaaagccgcattggtttcaggagccgtttcgataaattcttgccccgctgcttag

SEQ ID NO: 121903 - DNA, 975 bp, Artificial Sequence
  Description of Artificial Sequence: Synthetic coding sequence
atggctctaagcagcgcctggaggagtgtcttgcccctttggctgttgtggagtgcagcttgctcacgcgccgcatcgggcgatgataatgcattcccttttgatatcgagggctcgtccgcagtagggcggcaggacccgcccgagacatcggagcctagagtggccctcggaagactgccacctgcggcagagaagtgtaacgccggtttttttcacacactgagcggagaatgcgtgccgtgtgattgcaatggaaacagcaatgaatgtttagatggctcaggatattgcgttcattgccagcgaaacactactggagagcactgtgagaaatgtctggatggctatatcggtgatagcatcaggggcgctccccaattctgccagccctgtccatgtccactcccccatctcgccaattttgctgagtcttgctaccggaagaacggcgctgtaaggtgtatatgtaatgaaaattacgctgggccaaactgcgagcgatgtgcaccaggatattatgggaaccccctgctgattggcagcacttgcaagaagtgtgactgctccggcaactctgacccgaatctgatcttcgaggactgtgatgaggtcactggccaatgtcggaattgtttgcggaataccaccgggttcaagtgcgaaaggtgcgccccaggctactatggcgatgctaggatcgctaaaaattgtgctgtttgcaattgtggtggcgggccgtgtgactcagtaaccggtgagtgccttgaagaagggttcgagccccctacgggctgcgacaaatgcgtttgggacctgacagacgccctgcgcctggcggcgttgagtatcgaagaaggcaaatcgggggtcctttccgtctcatctggcgctgcagcacacagacacgtcaacgaaatcaacgcaactatctatctgctcaagaagactaagcagaaaaataataagaaatag

SEQ ID NO: 121904 - DNA, 11088 bp, Artificial Sequence
  Description of Artificial Sequence: Synthetic coding sequence
atggctaagcggctctgtgccggatcagccctctgtgtgcgcggcccgcgcgggcctgcccccttgctactggtgggactggctctgctgggggccgcccgggcccgggaggaggcaggaggtggtttctccttacaccccccctactttaatctggccgagggagcccgcattgcagccagtgctacgtgcggcgaggaggcacccgcccgcgggtcgcccagacctacagaagatctgtattgtaagctggtgggaggtcctgtggctggaggggaccctaaccaaacaattaggggacagtactgtgatatttgtactgcagccaattcaaacaaagctcaccctgcatcaaacgccattgacgggacggaaagatggtggcaatccccacccctgtcccgcggactggaatataatgaggtgaacgttacgctggacttaggccaggtattccatgtggcctacgttctgatcaagttcgcaaactctccgcggcccgatctatgggtgttggaaagaagtatggattttggtagaacgtatcaaccatggcaattctttgcgtcatccaaacgggactgtcttgaaagatttggtccccagactctggagcgaataacaagggacgatgctgccatttgcactaccgagtattcacgcatcgtgcctctggaaaacggggaaattgtggtctcactggttaacgggcggcccggagctatgaacttttcatacagtcctttgctgcgggagttcacaaaagccacaaacgtcagactaaggttcttacggactaacaccttgttggggcatctgatgggcaaggcactaagggaccccaccgtgacaaggcggtactactattcaatcaaggatatttcaataggaggcaggtgtgtgtgccatgggcacgcagacgcatgcgacgctaaggaccccactgatccattcaggctgcaatgtacatgtcagcataacacctgtggggggacatgtgatcggtgctgcccagggttcaaccagcagccctggaagcccgcgacagccaattccgccaacgagtgtcagtcgtgtaactgttacggacatgctaccgactgctactatgaccccgaagtcgacagacgccgtgcatctcagtctctggacgggacttaccaaggcggaggcgtgtgcatcgactgtcagcaccatactactggggtcaattgtgaacggtgtttacccgggttctatcggtccccaaaccatcccctggattcaccacacgtgtgtcgccggtgtaactgtgaatccgactttaccgatgggacttgcgaagatctgaccgggcggtgctattgtaggcctaacttttccggagagcgttgtgatgtatgtgccgaaggcttcacgggatttccgagctgctacccgaccccatcatctagcaacgacacccgtgaacaagtgctaccagcagggcagattgtaaactgtgactgcagcgctgccggcacgcaaggcaatgcttgtaggaaagatcccagggtcggacgatgtctctgtaagcccaacttccagggcactcactgcgaactctgcgcgcctgggttctacgggccaggctgccagccatgtcagtgctcctcacccggggtggcagacgatcgctgcgaccccgacacgggccagtgtcggtgtagggtgggatttgaaggggctacatgcgatcgctgcgcacctggttatttccactttccactttgtcaactctgcggatgtagccctgccgggactctccccgaggggtgtgacgaagccggccgttgcctgtgtcagcccgagttcgctggtccacactgcgatcgctgtcggcctggctatcacgggtttcccaactgtcaggcttgcacatgcgatccacggggggctctggaccagttatgcggtgcaggcggcctttgcaggtgtcgccccgggtacactgggacagcatgccaagagtgttctccagggtttcacgggttccccagttgcgtgccctgccattgcagcgcggaaggttcactccacgcagcctgtgatcctagatccggccagtgctcttgtaggccccgggtgaccggactaagatgtgatacatgtgtgcctggcgcatacaatttcccttactgcgaagctggctcttgtcaccctgcaggactcgctcccgttgacccagctctccctgaggcccaagtgccctgcatgtgtagggcccacgtcgaggggccctcctgtgatcgctgcaaacctggcttctgggggctgagtccttctaacccggaaggatgcaccagatgttcctgtgacctgcgaggcaccctcggaggggtggcagagtgccaacccggtacaggccagtgcttctgcaaaccacatgtatgtggccaggcctgtgcctcctgcaaagacggtttttttgggctggaccaggcagattattttggatgccggtcgtgtcggtgcgatattggcggagcactcgggcaaagttgcgaacctcggacaggggtgtgtcggtgtaggcccaatacccagggaccaacctgttccgaacctgctcgagaccactacttgccagaccttcaccacctaagactggagcttgaggaagcagcaaccccagaaggacacgcagtgcggttcggctttaaccctttggagtttgagaacttctcatggagaggctatgctcagatggctcctgtccaacccaggatcgttgccagattaaacctgacaagtccagaccttttttggctcgtgtttcggtatgtgaatcgcggggcgatgtccgtgtcaggacgcgtttccgtccgagaggaaggacgaagcgcaacttgtgctaactgcacagcacaatcgcagcctgttgcctttcctcctagcaccgagccagcttttatcaccgtccctcaacgtggatttggagagccattcgtgttaaatcccgggacctgggccctacgcgttgaagctgagggcgtgttgttggactatgtcgtgctgctgccgtctgcttactacgaagccgctctgcttcaactgcgtgtcacagaagcttgcacttacaggccgagtgcccagcagtctggagacaattgtttgctctacacccatctgccccttgatgggttccccagcgcggccggactggaagcactctgcagacaggacaactcactgccacgcccctgccctaccgagcagctgtcaccctcccaccccccccttattacctgcactggttcagacgtcgacgtccagcttcaagtggcggtcccgcagcctggccgctatgcactggtggtggagtatgccaacgaggacgctagacaggaggtgggggtggcagttcacacaccccagcgggcgcctcagcaagggttactgtcgctccacccatgtctctattctaccctgtgtcgcggaacggccagggacactcaggatcacctggctgtcttccatctcgacagcgaagccagcgtgagacttaccgcagagcaggcgcggttcttcctgcatggggttactctggtgccgatcgaggaattcagccccgagttcgtggaacccagggtgtcttgcatatcctctcatggcgcttttggccctaatagcgccgcctgtctgccatcacgctttccaaagcccccgcagccaatcatcttgcgggattgtcaggtgattcccctccctcccggcttgcctttaacacacgcgcaggacctcacacctgcaatgagtccagcaggtcctcgcccccggccgccaactgctgttgaccctgatgccgagcctacactgctacgtgagccccaggccactgttgtttttactacccatgttcctacattggggcggtacgccttcctgctgcacggctaccagcccgctcatccgacatttcccgtcgaggtgctcatcaatgccggccgggtctggcaaggccatgcgaacgccagcttctgcccacacgggtacggttgccgcaccttggtcgtgtgcgaaggccaggcattgcttgacgtgactcattcagagctcactgtcacggtacgggtcccaaagggacgctggctatggctggattatgtgctggtcgttccagagaacgtatattcctttggatacctgagagaagagccactggacaaatcatacgactttatttcccactgcgctgctcaggggtaccacatctcacctagtagttctagtcttttttgcagaaatgctgcagcaagtctgtcactgttttataacaacggagctcgcccttgcgggtgtcacgaagtgggagctacgggaccgacatgtgagccatttggggggcagtgtccctgccatgcccacgtgatcggacgggactgtagtcgatgcgccaccggatattggggttttccaaactgcagaccttgcgactgcggggccagactgtgcgatgagttaacaggtcagtgcatctgtccccctaggacaattccacccgattgcctcctctgccaaccgcagacattcggatgccatccactggtgggctgtgaggaatgcaattgcagtggtcctggcatacaggaactgaccgaccctacatgcgatactgactcagggcagtgtaaatgtcggcccaatgtgaccggacgtcgctgcgatacgtgtagccccggattccacggatatccaagatgccggccctgcgattgccacgaggcaggcaccgccccgggcgtgtgtgatcctctcacaggacagtgttattgcaaggaaaacgtccaggggcctaaatgcgaccagtgctctctaggaactttctcgctcgatgcagcaaaccccaaaggctgcacccgctgtttttgttttggcgccaccgagcgctgtcggtcgtcatcatatacccgtcaggaattcgttgacatggaggggtgggtgctgctgagtaccgacagacaggtcgtgcctcacgaacgtcagcctggaactgagatgcttagggccgatttaagacacgttccggaagcagtgcctgaagcatttcccgagctatattggcaagcccccccttcctacctaggagaccgtgtttcttcctatgggggcactttgaggtacgagctccactctgaaactcagaggggtgacgttttcgtgcctatggagtcaagacctgacgtagtactccaaggaaatcagatgagcatcaccttcttggaaccagcttacccaacccctggacacgtgcatcggggacagctacagctcgtggagggcaacttccgccacaccgagacgaggaacaccgtcagccgcgaggagttgatgatggtattggcgtctctggaacagctgcagattagagccctgttttctcagatctcctccgcagtgtttctgcgtcgggtagctctcgaggtggcaagtcctgctggccaaggggctctggcgtccaacgttgagctgtgcctgtgcccagcatcatataggggagacagctgccaagaatgtgcccctgggttctatagagacgtgaaggggcttttccttggcagatgtgtgccgtgtcaatgtcacggccattcagacagatgtctgccaggctctggggtttgcgtggactgccagcacaacaccgagggcgcacactgcgaaaggtgtcaggccggcttcgtgtcctccagggacgaccccagcgccccttgcgtgagctgcccctgcccactgtcagtacctagcaataatttcgcagaggggtgcgtccttaggggaggcaggacacagtgcctctgcaaaccaggatacgccggtgcttcctgtgaacggtgcgcccccggtttctttggaaacccactcgtcctgggcagcagctgccagccttgtgactgttcaggaaacggcgatccgaatctactattctcagattgtgatccgctgaccggcgcttgccgtggttgtctccggcacacaactggaccccgctgtgaaatctgtgcgccaggtttttatggaaatgctctgctgccaggcaattgtaccagatgcgactgtacaccttgcggcaccgaagcctgtgacccccattctggacactgcctgtgcaaggcaggcgttaccggacgacgttgcgacaggtgccaagagggccactttggcttcgatggatgtggcgggtgccgaccgtgcgcctgcggacctgccgccgaaggaagtgaatgtcaccctcagagcggccaatgccactgcagaccggggaccatgggtccccaatgccgggagtgcgctccagggtactggggcctgccagagcagggatgtaggcgctgccagtgccccggcggcaggtgtgacccgcacactggtcggtgcaattgcccccccggtctgtccggcgaaaggtgtgatacctgcagccagcagcaccaggttcccgtcccagggggccccgtcggccattcaatccactgcgaggtgtgtgatcactgcgtcgtcttgttattggatgacctagaaagagctggcgccttgctgcccgccattcacgagcaactacggggaatcaacgcaagcagcatggcctgggcacgactgcatcgcctaaacgcgtccatcgccgatctacaaagccagctgcgctcaccactcggacccagacacgagaccgcccagcagctggaagtcctagaacaacagtcgacttcccttggtcaggacgcaagacgtctgggagggcaagctgttggcacaagggatcaggctagccagctgctagctggcaccgaagcaacacttggacacgccaagaccctgctcgcagcaattcgcgcggtagataggacattgtccgaactcatgagtcaaacagggcacctaggtctggctaacgcctccgccccctctggggagcagttactgaggacgctggcagaggtggaacgcttgctctgggagatgcgcgctcgtgaccttggggcgccccaggcagccgcagaggcagagctagccgccgctcagcgtctcctagcgcgtgtacaggagcaactcagcagcctttgggaggaaaatcaggctctggccacgcaaactagagaccgattggcccagcacgaggctggactgatggatctgcgggaagcccttaaccgcgcagtggatgccacccgggaagcccaagaactcaattcaaggaaccaggagcgcctggaggaggccctccagcgaaaacaggagctgtctagagacaacgccaccttgcaggcaacgctccacgccgcccgagatacgctggctagtgtgtttcgcttgttgcattctctcgaccaggccaaggaagaattggagcgtctggctgcaagcttggacggggccagaactcccctgctgcagagaatgcagacattctccccagcaggttcaaaattgcgcctcgtggaagcagcagaggcacatgcacagcaattgggccagttagccctgaatctgtcatctattatcctcgatgtgaatcaggatcggctgacgcaaagggcaattgaagcttccaacgcatattcgagaatcctgcaagcggtgcaagccgccgaagatgcagcaggccaggctctccaacaggccgaccatacttgggccacggtggtgcggcagggtctcgtagacagagctcaacagctgctggctaactcgactgcattagaagaggcaatgctacaggagcaacagcgcctgggccttgtgtgggctgctctccaaggagctcggacacaacttagggatgtgcgcgctaagaaggatcagctggaggcccacattcaggctgcacaggccatgctagcaatggacacagatgagactagcaaaaagattgctcatgccaaagctgtagcagcggaagcccaggacaccgccacgcgggttcagagccaacttcaagccatgcaggagaacgtcgaacggtggcagggccagtacgaaggccttaggggccaggaccttggccaggccgtgctggacgctggacattctgttagtacacttgaaaagacgctcccacagctgctggcaaagctgtctattctagaaaacaggggggtgcacaacgccagtctggcgttgtccgcatccattgggagagtgcgggaactcatcgcacaggcacgcggggcagccagcaaggtgaaggttcccatgaagtttaacggacggagcggcgtgcagctgcgcactcctcgagatcttgctgatctggctgcatacaccgccctcaagttctaccttcaggggcccgagcctgaaccaggccaaggcactgaggaccggttcgttatgtatatggggtcgaggcaggcaactggagactatatgggcgtctcgcttcgggacaagaaggttcactgggtataccaattgggtgaggctgggcctgccgtgcttagtatcgacgaggacattggggaacagtttgcagcagttagtctggatcgcacactgcaattcggccatatgagcgttacggtagaacggcagatgattcaggaaaccaaaggtgacactgttgccccaggagctgaaggactgttaaatctgcgccccgatgacttcgtcttctacgtgggtggataccctagtactttcacacctccacccttgctacggtttccgggatacaggggttgtattgaaatggacacacttaacgaggaggtagtgagcctctataatttcgagaggactttccagctggacaccgcggtggaccggccgtgcgcccgaagcaaatccacgggtgacccatggctgactgatggctcatacctggacgggactggatttgccagaatctcttttgatagccagatcagtacgacgaaaagattcgagcaggagctgcgacttgtgtcatattctggggtgctgttcttcctcaaacagcagtctcaatttttatgtctggcggtgcaggaaggatctcttgtcctcctgtacgactttggagcaggacttaagaaagccgtacccctgcagccacctccaccactcacatccgcttctaaggctatccaagtgttcctactgggcggcagcagaaagcgagtacttgtgcgagtggaaagagcaactgtgtactcagtggaacaagacaatgacctggagttggctgacgcctactaccttggcggagtcccaccagatcagctgcctccttcactccggcgtctattcccgaccgggggctccgtgagaggttgcgtgaaaggtatcaaggcactcggaaagtacgtggacttaaagcggctgaacaccactggcgtatcagccggctgtactgctgaccttctggtcgggagggcaatgactttccacggtcacggatttctcaggctggcactgtcaaatgttgccccccttaccggaaatgtatattcaggatttggctttcattctgctcaagacagcgctcttctctattaccgcgctagcccagatggactgtgtcaggtgtctctccaacagggaagggtatcactacaactcctgcggacagaggtaaaaacgcaggctggctttgctgacggcgccccccactatgtggcattttattctaacgctactggagtgtggctttatgtggatgatcagctgcaacaaatgaaacctcaccgtggccctccacccgagctgcagcctcagccagagggtcccccgcggctcctcctcggcgggttacccgaatctggcaccatttataatttttctggctgcatcagtaatgtatttgtccagaggctcctggggccacaaagagttttcgatctgcagcaaaacctcgggagcgtgaatgtgtccacgggctgcgctcccgccttgcaggcacagacccctggcctcggccctaggggcctccaggctaccgcaagaaaggcaagcagaagatcacgacagcccgcccggcatccagcttgtatgctgcctcctcacttgcggaccactagggactcttaccagtttggagggtcactctcctcccatcttgagtttgtggggatcctggcccggcaccgcaactggccttcacttagcatgcacgtgttaccacggtcatcgcgggggctgctcctgtttactgctaggctgagacctggcagcccgagtcttgctctattcttgtccaacgggcattttgtcgcacagatggaagggctcggaacaaggctccgggctcaaagccggcagcgtagtagacccgggaggtggcataaggtgagtgtgcgctgggagaagaatcgcatcctactcgtgaccgatggggcccgtgcatggtctcaggagggtccccatagacagcaccaaggcgcggagcaccctcaaccgcacaccttattcgtgggcggcttgcctgccagctcccacagctccaagttgccagtaaccgtcggttttagcggctgtgtgaagcgcctgagacttcatggaaggccccttggcgcaccgaccagaatggctggggtgaccccttgcattctcggtccccttgaagccggacttttcttccctggaagtgggggcgtgataaccctggacttgcccggggctaccctgccagacgtggggctcgagttggaggtccgtcctctggctgtcacaggtttgatctttcacctcggccaagcccggacgccgccttacttacagcttcaggtaacagaaaaacaggtcctccttagggccgatgatggggccggagagttcagcacttctgtgacccgcccttcagtgctgtgcgacggccaatggcatcgtcttgctgtcatgaaaagcggaaatgtgctgcgactcgaagtggatgcgcagagcaatcataccgtagggcctcttctcgcggctgccgctggagctcccgctcccctatacttaggaggtctgcctgagccgatggctgttcaaccatggcccccagcctactgtgggtgcatgcgccgcttggccgttaacagatcacccgtggccatgactcgaagcgtcgaggttcacggcgctgtgggagccagtggctgtcctgcggcttag

SEQ ID NO: 121905 - DNA, 1503 bp, Artificial Sequence
  Description of Artificial Sequence: Synthetic coding sequence
atggccaaacggttgtgcgcaggctctgctctttgcgtgagaggcccgaggggccccgcccctctgctgttagtgggactggcccttttgggagcagcgcgtgctcgcgaggaggcaggggggggctttagcctacatccgccatactttaatctggcagagggagccaggatcgctgcttcggcgacttgcggcgaggaggcccccgcccgcggctccccaagacctacagaggacttatattgtaaactggtcggcgggcctgtggccgggggtgatcccaatcaaacaatccgcggccagtactgcgacatatgcaccgcagcaaactcaaacaaggcccatcccgcctctaacgcaattgatggcactgaaaggtggtggcagagcccccccctcagcagaggactcgaatacaatgaagtgaatgtgacactcgatctgggccaggtcttccacgtcgcctatgtcctgatcaagtttgccaactccccgaggcctgatctgtgggttcttgagcggtcaatggatttcggacggacataccagccgtggcaatttttcgcgagcagtaagcgcgattgcctggagagatttggccctcagacattagaacggataacaagggacgacgccgcgatatgtaccaccgagtattcacgcatagtccctcttgagaatggcgaaatagtcgtgagcttggtgaatggtaggcccggagccatgaactttagctattcaccgttactacgggaattcactaaggcaactaatgttcgcctgaggttcctgcgtactaatactctcctgggccacttgatgggcaaagccttgcgggatccaactgtgacaaggcgctattactactcaattaaggatatttcgatcggcggccggtgcgtgtgccatggccacgccgacgcgtgcgacgcaaaggaccccactgatccatttcggttgcagtgtacctgtcagcataacacatgtggcgggacctgcgatcgctgttgtcctgggtttaaccagcagccatggaaacctgccacagcaaactctgccaatgaatgccaatcctgtaactgttacggacacgcaacagattgctattatgacccggaggtggatcggcggagagcctcccagagtcttgacggtacctatcaaggcggtggagtgtgtatcgactgtcaacaccacacaactggtgtgaactgtgagcgctgtctgcccggattttaccggagcccaaaccaccctctggattctccacacgtgtgtcggagatgcaattgtgaaagcgactttaccgacggaacatgcgaagatcttaccggacgctgctattgcaggcccaattttagtggagaaagatgcgacgtttgtgccgagggtttcacaggatttcccagttgctatccgactcccagctcttctaacgatactagagaacaggtcctgcccgcgggccaaatagtcactaacaccaagatttcctgggtctag

SEQ ID NO: 121906 - DNA, 1587 bp, Artificial Sequence
  Description of Artificial Sequence: Synthetic coding sequence
atggctaaaaggctgtgtgcaggaagcgccctgtgtgtgcgcggaccccggggaccggctcctctgctcctggttggacttgcccttctcggagccgcaagagcccgtgaggaggcaggcggcggattctccttgcaccccccatacttcaacctcgctgaaggtgcacgtatcgctgcctctgctacatgcggcgaggaagccccggccagaggctccccccgaccaacggaggatttgtactgcaagctggtgggtgggcctgtagccggaggggacccgaaccagactatccgggggcagtactgtgatatttgcaccgctgcaaattcaaataaggcccatcccgcttccaatgccatcgatggcacagagcggtggtggcagtcccctcctctgagcaggggtctggagtacaatgaggtgaacgtaacgttagatctgggccaagtgtttcatgtcgcctatgtgctcattaagtttgccaattcgcctcgacctgatctgtgggtattggagaggtcaatggactttggaaggacctaccagccttggcagttctttgcctcaagcaaacgggattgccttgagcgcttcgggccacagacactcgaaagaatcacacgggacgacgccgcaatttgtaccaccgaatactctcggattgtgcccttggagaatggggagatagtggtctccctcgtcaacggtcggccaggggctatgaatttctcctacagccccctgctgcgcgaattcaccaaagccacaaacgtgcgcttgagattcttgaggacgaatacgctgctcggacatctcatgggcaaagccttaagagatcctacggtgacccgcaggtactactattcgattaaagatattagcattggcggtagatgcgtgtgccatggacacgcagacgcttgtgatgctaaggatcccacagacccattccgactgcagtgtacctgccagcataatacttgtggcggtacgtgcgatagatgttgtcctgggtttaaccagcagccatggaaacccgcaacagctaacagcgcaaatgagtgccagtcctgcaattgctatggtcacgccaccgactgttactacgacccagaagtggataggagaagggcctctcagagcttggatgggacttatcagggaggcggtgtctgtattgactgccagcatcacacaacgggcgtgaactgtgaaagatgccttcctggtttctaccggtctccgaaccaccccctcgactccccacacgtttgtaggaggtgcaattgcgagagcgattttacagatggtacatgcgaggacctaaccggtcgctgttattgccgtcccaacttctccggggagcggtgcgatgtgtgtgcggagggcttcaccggattccctagctgctaccctacaccgtccagctctaatgatacacgagaacaagtcttgccagccggacagatcgtcaacggggtgagcctttgccgccctggctggtcagcggtcgcgcgatcacgcctgacgagcacgagtgctagttgggtgcaagcgatcctgctgccccagagtcccgagtag

SEQ ID NO: 121907 - DNA, 2187 bp, Artificial Sequence
  Description of Artificial Sequence: Synthetic coding sequence
atgtgggtgactaaattactgcctgcgctactgctgcagcatgtcctgcttcacttactgctgctgccaatagcgattccgtacgcggaaggccagaggaagagaaggaataccattcacgagttcaaaaagagcgccaaaacgaccctcatcaagatcgatcctgcattaaagatcaagactaaaaaggtgaacactgcagaccagtgtgcaaatcgttgtacaaggaacaagggccttcccttcacttgtaaggcattcgtgttcgataaagcccgcaagcagtgcttgtggtttccctttaactcaatgtcgtcgggcgttaagaaggagttcgggcacgaatttgatctttacgaaaacaaagattatattcgtaattgcattatcgggaaggggaggtcctacaaaggcacagtgtccataaccaaatccgggattaaatgtcagccctggagttctatgatcccacatgaacattccttcttgccgtcgtcctaccgtggaaaggacctccaggaaaattattgtaggaacccccggggtgaggaaggaggcccgtggtgcttcacctcaaacccagaggtgagatacgaggtatgcgacattccccagtgctccgaagtggagtgtatgacatgtaacggggaaagctacaggggactgatggaccacaccgagtccggcaaaatttgtcagcgatgggatcatcagacccctcacagacataagtttctgcccgagaggtacccagacaaaggattcgatgataactactgcaggaaccctgacgggcaacccagaccgtggtgctatacactcgatccccatacaagatgggagtactgcgccatcaagacctgcgctgataataccatgaatgacacagatgtgcctttggagacaactgaatgcattcaaggccaaggtgaaggttatcgaggaaccgtcaacaccatatggaatggcattccttgccagcggtgggacagtcagtacccacacgaacacgacatgacacccgagaacttcaaatgcaaggatctgcgcgaaaactactgccggaatcccgacggatctgagtctccatggtgtttcaccaccgacccgaacatccgggttggttactgctcccagatcccaaattgcgacatgtcccatggccaggactgttacaggggcaatggcaagaattacatgggaaatctcagccaaactcgttctgggctgacctgttctatgtgggacaagaacatggaggatcttcatcgccacattttctgggaacccgatgcatcaaagctcaatgaaaactactgccggaatccagatgacgacgcgcacggaccctggtgttataccggtaaccccctgatcccctgggactattgccccatatcaaggtgcgaaggcgacactacaccaacaatagtgaatttggaccacccggtgatctcctgtgcgaaaacaaagcaactgagagtggtcaatggtattcccacaaggacaaacattggttggatggtctccctccggtacagaaataagcatatctgcggaggctccttaatcaaggaaagttgggtactgaccgctagacagtgcttcccttcaagggatctgaaagattatgaagcttggctcggcattcacgacgtgcacgggcgcggggatgagaagtgtaagcaggtcctgaacgtgtcccaactcgtatatgggcccgagggcagcgatctggtgctgatgaagctggcgcggcctgcagtgcttgacgactttgtttcaacaatcgatttgcctaattacggttgcactataccggagaagacgagttgctccgtatacggttggggttacacagggctgatcaactatgatggcctgctccgcgtggctcatctctatattatgggcaacgaaaaatgctcacagcaccacaggggtaaggtcactctcaacgagtccgaaatttgcgccggcgccgagaagattgggtcagggccttgtgaaggagattacgggggacccctcgtctgcgagcagcataagatgagaatggtgctgggcgttattgtgcccggtaggggttgtgccattcctaataggccagggatctttgtgcgagtcgcatattacgccaagtggatccacaagatcattttaacttacaaggtccctcaaagctag

SEQ ID NO: 121908 - DNA, 276 bp, Artificial Sequence
  Description of Artificial Sequence: Synthetic coding sequence
atgggattactgcaattgctagcattctccttcctggcattgtgccgcgctagggtgcgggctcaagagcccgaattctcttatggctgcgccgaaggctcttgctatcctgcgactggggatctgcttattggaagggctcaaaagttgagcgtgaccagtacttgtggtctgcacaaacctgagccgtattgcatcgtatcgcacctgcaggaagacaagaagtgtttcatctgcaattcccaagatccatatcacgaaactctgaatccctag

SEQ ID NO: 121909 - DNA, 2553 bp, Artificial Sequence
  Description of Artificial Sequence: Synthetic coding sequence
atgggtctgttacaactcctcgctttttcatttctggccctctgccgggcccgggtgcgcgcgcaggagcctgaatttagttacgggtgtgccgaaggttcatgttaccccgcaacgggcgatttgttgatagggagagctcagaagctgtctgtaacctctacatgcggtcttcacaagcctgagccctactgtatcgtgtcccatttacaggaggataagaagtgttttatttgcaattcacaggacccatatcatgagaccctcaacccagactcccacctgattgaaaatgtggtcactactttcgccccaaacagactgaagatctggtggcagtctgagaatggcgttgaaaatgtgacaatccaactcgatttggaggcagaatttcacttcacgcatttgatcatgacgttcaagacattcaggcctgcagctatgctgatagaacgcagctctgactttggcaagacctggggcgtgtatagatactttgcctatgattgtgaagcgtcttttccaggaatttctaccggaccaatgaagaaagttgatgatattatttgcgatagcaggtactctgatattgagcctagcaccgagggcgaggtgatcttccgggcgctcgaccctgccttcaaaatcgaggacccatattcacctaggatccagaatctcctgaagataacaaatttacggattaaattcgtgaagcttcacacactgggagacaatcttctagacagcagaatggagataagagagaagtattattacgctgtgtatgatatggtagtgcggggcaactgcttttgctacggccacgcctccgaatgcgcaccggttgatggtttcaacgaggaggtggaagggatggtccatggtcactgtatgtgtaggcacaacacgaagggtctgaattgtgaactgtgtatggatttttaccatgacttgccatggaggcccgctgaagggaggaacagcaatgcttgcaagaaatgtaactgcaatgaacattctatatcatgccacttcgatatggcagtgtatctggccaccgggaacgtgagcggtggtgtctgtgacgattgccaacataatacaatgggccgcaattgcgagcaatgtaaacctttctactaccagcacccagagcgggacatacgtgatcccaatttttgcgaaaggtgcacttgtgatcccgctggaagccagaacgagggtatctgcgactcctatacagatttctccaccggactgattgccggccaatgccggtgcaagctgaacgtagagggagagcattgcgatgtgtgcaaagaaggtttttatgacctgagtagcgaggacccttttggatgcaagtcatgtgcctgtaaccctcttgggaccattccagggggcaatccctgcgattcggaaaccggtcactgttattgcaagaggttagtgactggacagcactgcgaccagtgtctgcccgagcactggggtctgtccaacgacctcgacggctgcagaccgtgtgactgcgatctcggaggcgccctgaataacagctgtttcgccgagagtggacagtgtagctgtaggccgcatatgatcggacgtcagtgtaatgaggtggaaccaggatactatttcgctacactcgaccattacttgtacgaggccgaggaggccaatttaggccccggtgttagcatcgtagaaaggcagtacattcaagataggatcccttcttggaccggtgcagggtttgtaagagtcccagagggggcctatttagagttctttatcgataatatcccgtattcaatggaatatgacattttaattagatatgaaccacagttgccggaccactgggaaaaagccgttattaccgtccaacgcccggggcgcatccctacgagcagcaggtgcggcaacactataccagatgacgacaatcaagtcgtgagcttgtctcctggcagccgctacgtcgtgctgccccggcctgtgtgcttcgagaaaggtacgaactacactgtgcgcctcgagctccctcaatataccagctctgactcggatgtggagtctccttacacgctaatagattccttggtgcttatgccctattgcaagagtctggacatctttactgtcgggggatccggggatggggtggtgaccaattctgcatgggagacattccagcggtatcgatgcctggagaatagcagatcagtggtcaagacacctatgacagatgtctgtcgcaacatcatcttctcaatttctgctctgctccaccagaccggcctagcatgcgagtgtgatcctcagggatcacttagctcagtgtgtgatcccaatggcgggcagtgtcaatgtaggccaaacgttgttggacgtacctgcaacaggtgcgctcctggtactttcggattcggcccatccggctgtaagcggcgcttccttaagtcaatcgtgatgcattctttcaggctcacgcagcctctgtggcagggatccatagcagcagaaccaatgcttccctcatag

SEQ ID NO: 121910 - DNA, 5397 bp, Artificial Sequence
  Description of Artificial Sequence: Synthetic coding sequence
atggagctgacctctagggagagaggtaggggtcaacccctgccctgggaactgaggcttggtctcctcctgagcgtgcttgcagctactttagcccaggcccctgcccctgacgtgcccggctgctcccgaggatcgtgctacccggccaccggggacctgttggtcggtagagccgaccggctgaccgcatctagtacttgcggactgaatggtccccagccttactgcattgtgagccatctacaggatgaaaaaaaatgttttctgtgcgactctcgcaggccattctcagctagagataatccccactcccataggattcagaatgtggtcacttccttcgctcctcagaggagggccgcctggtggcagtcagaaaacggtattcctgccgtaaccatacagctcgatctcgaggccgagttccattttactcacctcatcatgacctttaagacctttcggccggccgcaatgctggtggagcgcagcgccgatttcggacggacttggcacgtgtatagatacttctcctacgattgcggagccgacttcccaggcgtgcctctcgcaccccctcggcattgggatgacgtggtgtgcgagtcgagatactcagaaatcgaaccgtctaccgaaggcgaggtgatttaccgtgtgctcgatcctgctatcccaattccagatccctactcctcaagaattcagaaccttttgaagatcacaaatctccgagtgaatttaactagattgcataccctgggtgacaatctcctcgacccacggcgggagattagggagaagtattactatgccctctacgaattagtcgtcaggggcaactgcttctgttacgggcacgcatcagaatgcgcccccgctccaggagcaccggcgcacgcagagggtatggtccacggtgcttgtatctgtaaacacaacacaaggggtctcaactgcgagcaatgccaggatttttatcgggacttaccttggaggccggcagaggacggacattcccacgcctgtaggaagtgcgaatgtcacggccacactcattcctgccattttgacatggccgtttaccttgcctctggcaatgtgtccgggggggtgtgcgacggctgccagcacaacaccgccgggcgccactgcgaactgtgtagaccttttttctacagggatccaactaaggacctacgggatcctgcggtgtgccgatcttgcgactgtgaccccatgggctctcaggacggaggccgctgcgacagccacgacgatcctgcactggggctggtcagcggacagtgtagatgtaaagagcacgtggtgggaacccggtgccagcagtgtcgagatggatttttcgggctgagcatcagtgatcggctaggctgccggcgctgccagtgcaacgccaggggcaccgtgcctggcagcactccatgcgaccctaatagcgggtcctgctattgcaagaggctggtaacaggaagagggtgcgatcgctgcttacctgggcattggggactctcacatgatctgctcgggtgtcgaccctgcgattgcgatgtcggtggggccctagacccccagtgtgacgaaggtacagggcagtgccactgcagacaacatatggtcggccgccgttgtgagcaggtacagcctggttacttccggccctttttggaccacctgatatgggaggcagaagacactagaggacaggtacttgacgttgtggaacgcctcgtgacacctggcgagacgccatcatggacaggatcgggattcgtgcggctgcaggagggacagacattggagtttctagtggcctcagtgcccaaagccatggactacgaccttttactccgcctggagccacaggtgccagagcaatgggccgagttggagctcatcgtgcagagacccgggcccgtgcctgctcactctttgtgtgggcacttagttccaaaagatgatcggatccagggcacattacaaccccacgcccgctacctgattttcccaaacccagtttgtttggaaccgggtatttcctataaactgcacctgaagctggtccgcacaggtgggtccgcccagcctgagactccttattccggacctgggttgcttatcgattccttagtgctgttgccccgggtccttgtgttagaaatgttcagcggcggcgacgcagccgctttggagaggcaggcaacattcgagcgttaccaatgccacgaagaagggcttgtgccttcaaagacttcaccatcagaggcctgcgctcctctgttgatctccctttcaacgctgatttataacggcgcacttccttgccagtgcaaccctcaaggctctctttcttcggaatgtaatccacatggaggccagtgtctatgcaaacctggagttgtgggacgacgttgcgatctctgtgcccctggctactatggattcgggcctacaggttgccaagcctgtcagtgctcccacgaaggcgcattgtcttcactttgcgagaagacctccggccagtgtctatgtcgcaccggtgcctttggactacgctgcgatcggtgccagagaggccaatggggcttccctagctgtcggccatgtgtgtgcaacgggcacgcggatgaatgtaacacccataccggcgcatgtttgggttgccgtgaccataccgggggggagcactgcgagaggtgtattgccggtttccacggggatcctaggttgccctatggaggccagtgtaggccttgcccctgtcctgaaggtccaggatcacagcggcactttgcgacatcttgccaccaagacgagtattcacagcaaatcgtctgccactgccgtgcggggtacacagggctgcgttgcgaagcgtgcgccccaggccacttcggagatccctctaggccgggggggcgctgtcagctttgcgagtgcagtggcaacatcgaccctatggaccccgacgcgtgtgatccccatacaggccagtgtctccgctgcttgcaccacacagagggcccccactgtgcccactgcaaacccggattccatgggcaggccgcccgacagtcttgtcaccgctgcacctgcaatctcctcggaacgaacccacagcagtgtcccagcccagatcaatgccactgcgatcccagttctggacagtgcccttgcctgcccaacgtccagggcccatcctgtgatcggtgcgccccaaatttttggaatttaacatctgggcacggctgccagccatgcgcatgtcatccctcccgggctcgaggtccaacctgtaacgagttcactgggcagtgtcattgcagggctggctttgggggtcgaacctgtagtgaatgtcaagagctgcactggggggacccagggctacagtgccacgcctgcgactgtgattcccgaggaattgacactcctcagtgtcatcggttcacaggccattgctcatgtagacctggcgtgtccggcgtccgttgcgaccagtgcgcgcggggcttctctggcattttccctgcctgtcatccctgtcatgcctgtttcggagactgggatagggtcgtgcaggacctcgccgcgagaactcaaagacttgagcagcgggcccaggaactacagcaaactggggtcctcggcgcctttgaaagctctttttggcatatgcaggagaagctcggcattgtgcaagggattgtgggcgctcgcaacacttcggccgcctctactgctcagctggtcgaggccactgaggagttgcgaagagagatcggcgaagcaactgagcacctcacacagctagaagccgatttgacggacgtgcaggatgagaacttcaatgccaatcatgctctatcaggcctggagagggataggcttgccctgaacctcaccttgcgtcagttggaccaacacttggacctgctgaaacactccaactttttgggcgcctacgattcaatccgccacgcgcatagccagagtgccgaggcggagcgccgcgctaacacttccgccctggctgtgccatcacctgtgtccaatagtgcgtccgcacgccatcggaccgaggccttgatggatgctcagaaggaggatttcaactccaaacacatggctaatcagcgcgccctggggaagttgtccgcccacacacacaccctctccttaacagacataaatgagcttgtgtgcggcgcaccgggcgatgcaccctgcgctacctctccctgtgggggagcgggatgcagagatgaggacggccagccccggtgcggcggcctgtcgtgtaatggagctgccgccacggccgacctggctctagggcgggcacggcatacgcaggccgagctccagagagcccttgccgagggaggttcaatcctgagccgcgtggctgagacgcgaagacaggctagtgaagctcagcagcgggcgcaagctgcccttgataaggctaatgcctctcggggccaggttgaacaagcaaatcaggaactgcaagagcttatccagtctgttaaggatttcttaaaccaggagggggctgaccccgatagtatcgaaatggtggctactcgcgtactggagttatctatacccgcctccgccgaacagatccaacatctagctggcgccattgctgaaagggtcagatccctggccgatgtggacgccatactggccaggacagtcggcgatgtgaggagagccgaacagttactccaggacgccaggcgggccagatcctgggcagaagacgagaagcaaaaagccgaaactgtacaggcagccctcgaagaagcccagcgagctcagggcatcgcccagggagccatccgcggggccgttgctgacaccagggacacagaacagacactataccaagtgcaagagcggatggccggagctgagagagcactaagctccgccggggagcgcgcacgccaactggacgcactgctggaggctcttaagcttaagcgggccggaaattccctcgcagcctcaactgccgaagagacggccggaagcgcacagggtagggcccaagaagctgaacagctcctgcgcggccctttaggagatcagtaccaaaccgtcaaggcactggccgagcggaaagctcagggggtcctcgctgctcaggcccgggctgagcaactaagggacgaagctcgggatcttctgcaggccgcccaagacaagctgcagcgattgcaggagctggagggtacatacgaggagaacgaaagagccctggaatctaaagctgcccagcttgatggcttggaagcccggatgagatccgtgctgcaggcaataaacttgcaggtgcagatttacaacacctgccagtag

SEQ ID NO: 121911 - DNA, 1143 bp, Artificial Sequence
  Description of Artificial Sequence: Synthetic coding sequence
atgcaagaaaagctgggcatcgttcagggcatcgttggcgcacgcaatacgagcgccgccagcactgcccagctcgttgaggctactgaggagttgcgcagagaaattggcgaggccactgagcacttaacccaattggaggccgatctgaccgatgtgcaggacgaaaattttaacgcaaatcatgccctgagcgggctagagcgtgatagacttgcgctgaacctaacactgcggcagctggatcagcacctggatttactaaaacactccaactttttgggagcctacgacagcatccgacatgcacactcccagtcagcggaagccgagagacgggctaacacatctgcactcgccgttccatcacccgtatccaattcggcctcggctaggcatcggaccgaagctcttatggatgcccagaaagaagatttcaacagcaagcacatggcaaaccagcgggcacttggtaaactctccgctcatacccacaccctgtctctgaccgacatcaacgaactagtgtgcggagcccccggtgatgctccctgcgctacgtcgccttgtgggggcgcgggttgccgcgacgaagacggccaaccaaggtgcgggggcctctcctgcaacggcgccgccgccactgcggacttggccctcgggagagccaggcatacccaggcagagttgcagcgcgccctggccgagggcggttccattctctccagggtcgccgagaccaggcgacaggcctccgaggcccagcaaagggcccaggcagccctcgacaaagccaatgcctcaaggggacaagtcgaacaggccaaccaggaattgcaagagctgattcagagcgtcaaggacttcctcaatcaggaaggtgcagaccccgacagcatcgagatggtggcaactcgcgtcttggagctttccattccagcttctgctgaacaaattcagcacctcgccggggcgatagcagaaagggtgaggtctctcgctgacgtcgacgccatactcgcccagggcattgcgcagggagccatccggggggctgtagccgacacacgagataccgaacagccggtcccggggaccggcgaggacggccgatgccgggctggtaccgagttgtgtcgctag

SEQ ID NO: 121912 - DNA, 5397 bp, Artificial Sequence
  Description of Artificial Sequence: Synthetic coding sequence
atggagcttacctctagggaaaggggtagaggacaacctctgccctgggagctccgtttgggccttctgctcagtgtactggccgccacactggcccaggcaccagccccagatgtccccggctgtagcagaggcagctgctaccccgccactggggacctgctggtcggccgcgccgacaggttgactgcttcaagcacttgtggtttgaatggaccacaaccgtattgcattgtaagtcatctacaagatgagaaaaagtgttttttgtgcgattcgcgccggcctttcagcgctagggataaccctcattcccacagaatacagaacgtggtcacatcattcgccccccagagacgcgccgcatggtggcagtccgagaatggaatcccggccgttaccattcagctggacctggaggccgaattccatttcacacacttaatcatgacgtttaagaccttcagacccgctgccatgttggtggaacggtcagcagacttcgggaggacctggcacgtttatcgctatttttcctacgactgtggggcggattttcccggcgtcccgctggcccctcctcggcattgggacgacgtggtgtgcgagtcaagatactcagaaatcgagccaagcacagagggagaggtcatctatcgggtgctcgatccggcgatccccatccctgatccatacagctcacgaatccaaaacctgctgaaaatcactaatctgagagtaaatctgacccgcttacacacactgggggacaatctgttggacccaagaagggagatcagggagaaatattattacgccctttatgagctcgtggtgcggggtaactgcttttgctacggacatgcctctgagtgcgccccggcccccggagctcctgcccatgcggaagggatggtgcatggtgcttgcatatgcaagcacaacaccagggggttaaactgcgagcagtgtcaggatttttaccgggacttaccatggaggcctgccgaagacggccactcacacgcctgccggaagtgcgaatgtcatgggcacacacactcatgccatttcgatatggcagtgtatctggcctccggcaacgtgtccggcggagtgtgtgacggctgtcagcataatactgcgggtcggcattgtgagctgtgccgtccatttttttaccgtgacccaactaaggacctgagggatccagcagtgtgcagaagttgcgactgtgatcccatgggatctcaggatggcggaaggtgcgacagccacgacgacccagctttaggactcgtgtcaggtcagtgccgttgtaaggaacatgttgtcggaaccagatgccagcagtgcagggacggcttttttggactctcaatttctgataggctaggctgtaggcggtgccagtgtaatgcacgtggtactgtccccggcagcacaccttgcgaccccaactctgggagctgttattgtaaaagactggttaccggccgcggatgtgacaggtgtcttccaggacactgggggctgtcacatgaccttttaggatgcaggccttgcgattgcgatgtgggcggggccctcgatccccaatgcgacgagggaacggggcagtgtcactgtcggcagcatatggtaggcaggcgctgtgaacaagtccagcccggttactttcgccccttcctagaccacttaatctgggaggccgaggataccagaggccaggtgctggacgtggttgaacgcctggttacccccggcgagacaccttcttggacagggtctggctttgtccggctgcaggaggggcaaaccctggagtttcttgtagcctctgtgcccaaggccatggattatgatctcctcctgaggctggaaccacaggtgcccgaacagtgggcagagcttgaactaatcgtgcagaggccaggaccggtacccgcccacagtttatgtggtcatctggtgccaaaagacgacaggattcaggggactttgcagccccatgctcggtatctcatattcccgaatcccgtgtgtctggaacccggtatctcatataaactccacctgaagctggttcgcacaggaggatcagcacagccagagacaccatacagtgggccgggcctactcattgactccctcgttctcttgccccgggtactggtcctggaaatgttttcaggaggggacgcggcagccttggaaagacaagctacctttgaacggtatcagtgccacgaggagggtctcgtgccttccaaaacatcgccttcagaagcctgtgcccctctgctgattagcctaagtactctgatctataatggagcattgccatgccagtgcaatccgcagggaagcctttcaagtgagtgcaacccccacgggggccagtgtctgtgcaaacctggagtggttggacggaggtgcgacctgtgcgcacctggctactacggttttggaccaacagggtgtcaggcctgccagtgctcacatgaaggagctcttagctccctgtgcgaaaaaacttccgggcaatgtctgtgccggacaggggcttttggtctgaggtgtgatcggtgtcagaggggacagtgggggttcccgtcatgtagaccctgcgtctgtaacggtcacgccgacgagtgcaacactcatacaggcgcttgtctcggctgcagggaccataccggaggagagcactgtgagcggtgtatagccggattccatggtgaccctcggctcccctacgggggccagtgcaggccctgtccatgtcccgaagggcctggctcacaacgacattttgctacctcctgtcatcaagacgagtactcccagcagatcgtttgccactgtcgtgccggctataccgggctccgatgcgaagcgtgcgcacccggacattttggtgatccatccaggccaggtgggaggtgtcagttgtgcgagtgttcggggaacatagatccaatggaccctgacgcatgtgatccacacaccggacagtgtctgcgttgtttgcaccacaccgaaggaccgcactgtgcgcactgtaagcctggttttcacggacaagcggctcgccagagctgtcatcgttgcacatgcaatctgctcggtacaaatccccagcagtgtccctcacccgatcagtgccactgtgacccttcctcaggccagtgcccatgtctgccaaatgtgcaaggcccctcttgcgaccgctgtgctcctaatttctggaaccttacctcaggacatggctgtcagccctgtgcgtgtcaccctagccgggcaaggggacctacgtgcaatgaatttactggtcagtgccattgcagggctggctttggggggcgtacatgctctgagtgccaggaattgcactggggagaccctggtctccagtgccacgcctgcgactgtgatagccgtgggatcgacaccccgcagtgtcaccgcttcaccggccattgtagctgccgccccggcgtctccggcgtcaggtgtgatcagtgtgccagggggttctcgggcattttccccgcctgccatccctgtcatgcttgttttggggattgggatcgggtcgtccaggaccttgccgcgcggacacagcgcctagagcaaagggcccaggaactccagcaaaccggggtcctaggagcctttgaaagtagcttttggcatatgcaggagaagctggggatagtgcagggcattgtcggtgctagaaacacaagcgcagcgagcaccgctcagctggtagaggctaccgaggagctgcgtcgtgagatcggagaggcaaccgagcacctgactcaactggaggcagacctgaccgacgtgcaagacgagaacttcaacgcgaaccatgccctgagcggactcgaaagagatcgcctcgcccttaatttgaccctgaggcaactggaccagcacctggatcttcttaaacattctaacttccttggggcctatgacagcattcgccatgcccacagccagtccgccgaggcggagcgcagagcgaacacatcggctctggccgtgccctcaccagtcagtaactcagcttccgcgcgccatcgcaccgaggcattaatggacgctcaaaaagaagatttcaattctaagcatatggccaaccagagagccctggggaagttgagcgcccatacacataccctgtctctgactgacataaacgagttagtctgtggagccccgggggacgcaccatgtgccacatccccttgtgggggcgcaggctgccgagacgaggatgggcagcctagatgcgggggactcagttgtaacggggcggctgcaactgctgacctcgcactgggcagggcgcgtcatactcaagccgaactgcagagagccctggcggaaggaggatctattctgtccagagtcgccgagaccaggaggcaggcctctgaggcacaacaacgcgcgcaggcagccctagacaaagcaaatgcatctagagggcaggtcgagcaggccaaccaagagctgcaagagcttatacagtctgttaaggactttctcaatcaggaaggcgctgacccagactccattgagatggtggccacacgggtcctggagctcagtattcccgcgtctgccgaacagatccagcacctggcaggcgctatcgccgaacgtgtgcggagtctggccgacgttgatgcgatcctcgcgcgtactgttggcgacgtgcgccgcgctgaacagcttctgcaagatgccaggcgggctagaagttgggcagaagacgaaaaacagaaagccgagacagttcaggctgcccttgaggaggcacagagggctcagggaatcgcccagggtgcaatccggggagctgtggccgacacacgtgataccgaacagacactgtatcaggtgcaggagagaatggccggggcagagcgggcactgagctctgccggcgagcgcgcacgacagctcgacgccctgctcgaggcgcttaaactgaagagggcgggcaatagtctggctgccagtaccgctgaggaaaccgcaggaagtgcacagggacgtgcgcaggaagcggagcagctgctgagagggcctctgggtgaccagtaccaaaccgtgaaagcccttgctgaacgcaaagcacaaggagtcctggcagctcaggctcgcgctgagcagctccgggacgaagccagagacctcctgcaggccgctcaagacaaactgcagagattacaggagctggaagggacctacgaggaaaatgagcgcgccctggaatccaaggcagctcagcttgatgggttagaagctcgaatgcgatctgtcctgcaagcaattaatctccaggttcagatatacaacacctgccagtag

SEQ ID NO: 121913 - DNA, 3519 bp, Artificial Sequence
  Description of Artificial Sequence: Synthetic coding sequence
atgcgacctttcttcctcctctgtttcgccctcccagggctgctccatgcacagcaagcttgttcgagaggtgcctgttatccccccgtcggcgacttgctggtcggcagaacccgttttctgcgggctagcagcacttgcggcctgaccaagccggaaacctattgtacccaatacggagagtggcagatgaaatgttgtaagtgtgactcacggcaaccacacaactactacagccatcgtgttgaaaatgtcgcgagtagcagcggcccgatgcgatggtggcagtcccagaacgatgtgaaccccgtctcactgcagctcgacctggaccggagatttcagctgcaggaggtcatgatggagtttcagggaccgatgccagccgggatgctgattgagcgctcaagtgactttgggaagacctggcgcgtgtaccagtacctggcagctgattgtaccagtacttttcctcgcgttagacaggggcggcctcagtcttggcaggatgtgcgctgccagtccttgccgcagcgaccaaacgctcggctgaacggaggaaaagtgcaacttaatctgatggaccttgtgtcaggaatacccgcaacccagtcacagaagattcaggaggtgggagaaatcaccaacctgcgcgtgaactttacacggctcgcaccggtcccccaacgggggtatcacccaccatcagcgtactatgcggtgagccagctgaggctgcagggatcttgcttctgccacggccacgccgatagatgcgctccgaagccaggagcctccgcaggcccgtctaccgcagtacaggtgcacgatgtttgcgtctgccaacacaatacagccggccctaactgcgagcgatgcgcccccttctacaacaaccgcccttggcgcccagccgaggggcaggacgcccacgaatgccagcgctgtgattgtaatgggcattccgaaacatgccatttcgatccagcggtgttcgccgcctctcagggggcttacggcggagtctgtgataactgtagagatcataccgaagggaagaactgtgaacgatgccagctgcattattttagaaatcggaggccaggcgctagtatccaggaaacctgtataagttgcgaatgtgacccggacggagccgtgcccggcgccccatgtgaccccgtcaccgggcagtgcgtctgcaaagagcatgtgcagggagaacgatgtgacctctgcaagccgggttttaccggcctgacatacgctaacccccagggctgccataggtgtgattgtaatatcttggggagccgccgggatatgccctgtgacgaggagtctggtcgctgtttatgtctgccaaatgtagttgggcctaaatgtgaccaatgcgccccgtatcactggaagctcgccagcgggcaagggtgtgagccatgcgcttgtgatccacataactctctttcccctcaatgtaaccagtttaccggccaatgtccctgtcgggaagggttcgggggtctgatgtgcagtgcggccgccattagacaatgccctgatcgcacatacggcgacgttgccaccggctgtagagcctgcgattgtgatttcagaggtaccgagggccccgggtgtgacaaggcatcaggcagatgcctttgcagaccgggcctgacagggccacgatgtgaccagtgtcagcgtggatactgtaatcggtatcccgtgtgtgtagcatgtcacccgtgtttccagacctatgatgccgaccttagggaacaggcactccggttcggccggctaagaaatgccacagcatctctttggtccggcccgggtctggaggataggggcctggcctctcgtatccttgatgccaagagcaagattgagcaaatcagggcggtgctgtccagtcctgctgtaaccgagcaggaagtcgcccaggtggcctctgccattctgtccctgcgacgtaccctacagggtctacaattggacctgcctctcgaagaggagacgttgtccctcccaagggacctggagtctctcgatcggtcattcaacggtctgttaacaatgtatcagcgcaaaagagaacagttcgagaaaatctcatcggccgacccgagcggggcatttcggatgctgagtaccgcatatgagcagagcgctcaggccgcacaacaggtgtcagattccagtcgcctgctcgaccagctacgggattccagaagagaagctgaaaggctcgtgaggcaagctggaggggggggtgggaccgggtcacccaaactggtggcactacgcctggagatgtctagtctgcccgatctgacgcccacatttaataagctttgcggcaactctagacagatggcctgcactccaatcagttgccccggggagctgtgtccacaggataacggtacagcttgcggatctaggtgcagaggagtattgccccgagccgggggggcttttctgatggctggacaggtggctgagcagttacgaggcttcaatgcccagcttcagagaactcgacagatgatccgagccgctgaggagtctgcatctcaaatccaatcctccgctcaacggttggagacccaagtcagcgcctctaggtcacaaatggaagaagacgtcaggcgcactcgtcttctgattcagcaggttagggacttcctcactgatcctgacaccgacgcggcgaccatccaggaagtgagcgaagccgtcttagctttatggctgcccactgactccgccactgtgttgcagaaaatgaacgaaatacaggccattgccgcccgcctcccaaatgtcgatcttgtgttgagccagactaaacaggatattgctcgagctcggagactgcaggcagaggccgaagaggctcgcagtcgggctcacgcagtagaggggcaagtcgaggacgtcgttgggaacttgcggcaggggaccgtagctttacaggaggcacaagacactatgcaaggcactagccgcagcttgcgtctgatccaggatagagtggccgaagtacagcaggtcctgcgtccagcagagaagctggtgacttcgatgactaagcagctcggtgacttttggaccaggatggaagagctgaggcaccaggctcgacagcagggagcagaagccgtgcaggctcaacagcttgccgaaggcgctagcgagcaagcactgtctgcacaagagggctttgaaagaattaaacagaagtacgcagagcttaaagatcgattgggccagtcaagcatgctaggcgaacagggcgcacgtattcagtcagtgaaaacagaggccgaggaactgttcggggagactatggaaatgatggacaggatgaaagacatggagttggagttactcagagggagccaggcaataatgctgaggtcagctgacctcacaggactggagaaaagagtggagcagatcagggaccacatcaatggccgggtgctgtattacgcaacttgcaagtag

SEQ ID NO: 121914 - DNA, 3519 bp, Artificial Sequence
  Description of Artificial Sequence: Synthetic coding sequence
atgaggcccttcttcctcttgtgctttgccctgccgggactactgcatgcacagcaggcctgttctagaggtgcatgctacccccccgtgggggacctcttggtaggacggacacgctttctgcgggcatcaagcacctgtggactaaccaagcctgaaacatactgcactcagtatggtgagtggcagatgaaatgttgcaaatgcgattcgcgacagcctcacaattactacagtcatagggtggagaacgtagcttcgtctagtggtcccatgcgatggtggcagtcacagaacgacgtcaatccagtttcactgcagttggatttggacaggcggtttcagctgcaagaggtgatgatggagtttcagggccccatgcccgcagggatgcttatagagagatccagtgatttcgggaagacatggcgagtgtaccagtatctagcagccgattgtacaagcaccttccctagagtgcggcaaggtcgcccacagagctggcaagatgtgagatgccagagcctcccccagcgccctaacgcgcgcttaaacgggggaaaggttcagctcaatctaatggatttggtcagtggcattcccgctacccagtcccagaaaatccaggaagtgggcgagataacaaacctgagagtgaacttcaccaggctggcccctgtgcctcaaagggggtatcatccacctagtgcgtactatgctgtgagccagctgcggctgcagggcagctgcttttgccatggtcatgcagataggtgcgcccccaagccaggcgcctcggctggacccagtacagccgtgcaagttcacgatgtatgcgtttgccagcataatacagccggccccaactgcgaaagatgtgcccctttttataacaatcggccatggagaccagcggagggccaggacgcccacgagtgccagcggtgtgactgcaacggccactccgagacctgccattttgacccagctgtgtttgcagcaagtcagggggcctatgggggcgtgtgcgataactgtcgcgatcataccgagggcaaaaactgtgaaaggtgccagcttcactatttccgcaaccgcaggccgggcgcttcaatacaagagacttgtatttcttgcgaatgtgacccggacggcgcagtgcccggggcaccttgtgaccccgtgactggtcagtgcgtttgtaaggagcatgtgcaaggggagcgatgtgatctgtgtaagccaggcttcaccggactgacatacgccaaccctcaagggtgtcaccgttgtgattgtaacattctgggtagcaggcgcgatatgccatgcgacgaggaatcaggccgctgcctgtgcctgccaaatgtggtgggacccaaatgcgatcagtgtgctccttatcactggaaactggcctctggtcaaggctgtgagccgtgtgcctgcgatccccataattcactttctccccagtgcaaccaattcactggtcaatgcccttgtcgcgagggcttcggaggtctgatgtgttcggcagctgcaatacggcagtgcccagatcgcacgtatggagatgtggcaaccggatgccgtgcttgtgattgcgacttccggggcactgagggaccaggctgtgacaaggctagtggacgctgtctatgcaggcctggactgaccgggcccaggtgtgaccagtgccaaagagggtattgtaaccgttaccccgtatgcgtcgcctgccatccttgtttccagacatacgacgctgacttgcgggaacaagcactgcgctttgggaggctgcgcaatgccactgccagcttatggagcggaccgggtctcgaggatcgcggactggcttccagaatcctcgatgcaaaaagcaagatagaacagatccgcgcagtgctgtcctctcctgcagtgactgagcaagaggtggcccaggttgcgagcgccatcctgtccctgcggcgaactcttcagggactgcaacttgatctacctctggaagaggaaacactttcgctcccacgtgatctggaaagccttgaccgctcttttaatggtctcctgacaatgtaccaacggaagagggagcagttcgagaagatttcgtccgccgatccatccggcgccttccggatgctgagcaccgcatacgagcagtcagcccaggccgcccaacaagtgtccgactcgtctaggctcctggaccaactgcgagattccaggagggaggccgagcgcctggtgagacaagctggaggtggtggaggcaccggctcccctaaattggtggccctgcggcttgaaatgtctagtctgcccgatttaacacctacgttcaacaaactgtgtggcaattcgcgacagatggcctgtacacccatatcctgtccaggcgagctctgcccacaggataacggcactgcatgcggctcccgatgcagaggcgttctgccgagggctgggggcgcattcctgatggccgggcaggtggccgagcagctcagggggttcaacgcacaattgcaaagaacgcggcagatgatcagggccgcggaagaatcagcctctcagatccagagctcagctcagaggctggagacccaagtgtctgcatcccgcagccaaatggaggaagatgtacgccgcacccggctccttatccaacaggtgagagacttccttaccgaccccgatactgacgctgccaccatacaggaggttagcgaggccgttcttgcgttgtggctgccaacagattcagctacagtgctgcagaagatgaatgagattcaagcaattgccgcccgattgccgaacgtggaccttgtgttgtcccaaacaaaacaggacatcgctagggcacgtagactccaggccgaggcggaggaagcccgctcccgggcccacgccgttgagggccaagtcgaggacgttgtcggaaaccttcgacagggaacagttgctctgcaggaggctcaggacacgatgcaaggtacctctcgctcactgcgtctaattcaagatagggtcgcagaagtccagcaggtgttgcgaccggctgaaaagctcgtcacgtcaatgaccaaacagcttggggacttctggactcgcatggaggaactgcggcaccaagcacgacagcaaggtgccgaggcggttcaagcacaacagctcgcggagggagcatccgaacaggccctctcagcacaagaaggattcgaacgcataaagcaaaagtatgctgaactgaaggacagattaggccagtcatcaatgctgggagagcaaggagcccgcattcagagtgtgaaaacagaggccgaggagctcttcggagagacaatggaaatgatggaccgtatgaaggatatggagcttgagctgctccggggctcacaggccatcatgttgcggtctgcagacctgaccgggctggagaagagagtcgaacagataagggatcacattaacggcagagtcttgtattatgctacatgtaagtag

SEQ ID NO: 121915 - DNA, 3519 bp, Artificial Sequence
  Description of Artificial Sequence: Synthetic coding sequence
atgcgcccattcttccttctgtgcttcgccctgccggggctcctgcatgcccagcaggcgtgctcacggggggcatgctatccacctgtcggagacctcctagttgggaggacgcgcttcctgcgggccagtagtacctgcggcttgaccaagccagagacctattgtactcagtatggagaatggcagatgaagtgctgtaaatgtgattcgcggcagcctcacaattactattcacatagggtggagaatgtggccagcagctctggcccaatgcgatggtggcagtcccagaatgacgtcaaccctgtgagtctccagcttgatctggacagaaggtttcagctccaggaggtgatgatggagtttcagggacccatgcccgctggcatgctcattgagcggagtagcgactttggaaaaacgtggagagtctaccagtatctcgccgccgattgtacgtccacattcccccgagttcgccaaggtaggccccagtcatggcaggatgtacgatgtcagagcttgccccagcgtccgaacgctcgcttaaatggcggcaaggtgcagctcaatttgatggatctggtcagcggaattcccgcaactcagagccagaaaatccaggaggtgggtgagataactaatctaagggtaaacttcactaggctggctccagttccacagaggggatatcaccccccaagtgcgtattacgctgtgtcccagctgagacttcagggttcttgcttttgtcatggtcacgccgacagatgtgcccccaagcctggcgcttccgccggccccagtaccgccgtgcaggtgcacgatgtttgtgtgtgtcaacataatactgctggcccaaactgcgagcgatgtgctccattctacaacaatagaccctggagaccagctgaagggcaagatgcccacgaatgccaacggtgcgattgtaatggccattcagagacctgtcattttgatcccgctgtgttcgcagcgtcccagggtgcctatggcggcgtctgcgataactgtcgtgatcacactgaaggtaagaactgtgagcgatgccaactgcactatttcaggaacagacgcccgggcgcctctatacaggagacctgtatcagttgtgaatgcgacccggatggcgccgtgcccggggccccttgcgacccagttaccgggcaatgcgtatgcaaagaacacgtgcagggagaacgttgcgacctttgtaaaccaggatttaccgggctgacgtatgccaatcctcaaggatgtcaccgttgcgattgcaacatcctcggctctcggcgggatatgccgtgtgacgaggagagcggccggtgcctctgtctgcctaacgtcgtgggacctaagtgcgaccagtgcgctccctaccactggaagttagcatccggacagggatgcgagccttgcgcctgcgatccccacaattcgctgagtccccagtgtaaccagtttaccggacaatgcccctgcagggaggggtttgggggtttaatgtgctccgccgctgcaattcgccaatgcccagatcgaacgtacggcgatgttgccaccgggtgcagagcctgcgactgcgatttcaggggaacagagggaccaggatgcgacaaagctagcgggcgttgcttgtgccgacctggactaaccggcccaagatgtgatcagtgccagcggggctattgcaatcggtatccggtctgtgttgcctgccatccttgcttccagacgtatgatgccgatctcagagaacaggccttaaggttcggaagactcagaaacgccaccgcgagtttgtggtctggtcctggcttggaggataggggactagcctcacggatcctagacgccaaatccaaaattgagcaaattcgggcggtcttgagttctcctgcggtgaccgagcaggaggtagcacaagtggcttctgccattttatccctgagacgcactctccaggggctccagctagatctgcccttggaggaggagaccctcagtttaccccgggacctagagtcgctcgatcgaagcttcaatggtctgctaacaatgtaccagcggaagagagaacagttcgaaaaaattagcagtgctgatccctccggggcattcagaatgctgagcactgcgtacgagcagtccgctcaagcggctcagcaggtttctgactcctctcggctgttggatcagctacgcgacagccgacgggaggcagagaggttggtccgacaggccggcggcgggggcggtacaggcagccctaagctcgtggccttgaggttagagatgtcatccctgccagatttgacacctacttttaacaaactgtgcggaaacagccgccaaatggcttgtactcccataagctgcccaggcgaactatgtccgcaggataacggcactgcgtgcgggtctaggtgcaggggcgtgcttcccagggcaggaggtgcctttcttatggcaggacaagtagcagaacaactgcgcggctttaatgctcagctgcagcgcacacgccaaatgataagagctgctgaagagtccgctagtcagatccagtctagcgcccaacgactagagacccaggtctctgccagtagatcacagatggaagaggacgttcgtcgaactcggctgctcatccagcaggtgcgagatttcctgactgaccccgataccgatgccgctacgatccaagaggtgtccgaagccgttctcgctctctggctgcccacagatagcgctactgttctgcaaaagatgaacgagattcaggccattgcggccaggttgccgaacgtggacttggtcctgtcgcaaaccaaacaggacattgccagggcgcgtcggctccaggctgaagccgaggaagcaaggtcaagggctcatgcagtcgagggacaggtggaggacgtcgtgggcaatctgagacagggcaccgtggctctccaagaagcccaggacactatgcaaggcacttcacggtcactgaggttaatccaggaccgcgtggctgaggtgcaacaggtgctgcgacctgccgagaaacttgttactagcatgaccaaacaactaggtgatttttggactaggatggaagaacttaggcaccaggcgagacagcagggagctgaggccgtccaggctcagcaactggcagagggcgcaagcgaacaggccctgagcgcacaagaaggattcgagcgaatcaagcaaaaatacgccgagctcaaggatcggttaggccagtcatccatgttaggggaacagggtgcccggatccagagtgtcaagacggaggctgaagagctatttggcgagacaatggaaatgatggaccgcatgaaagacatggagctggagttgctacgcgggtctcaggcaatcatgctgcgaagtgccgacctcacggggctggaaaagcgagttgaacagatccgggaccacatcaatgggagggttctatattatgcaacttgcaaatag

SEQ ID NO: 121916 - DNA, 567 bp, Artificial Sequence
  Description of Artificial Sequence: Synthetic coding sequence
atgcgccctttctttctcttatgttttgccctacccggtctgcttcacgcccaacaggcgtgcagccgaggcgcatgttatccgccagtgggcgacctactggtaggccgaacccgctttcttcgagcctcctccacgtgtggtctcacgaaacctgagacctattgcacacagtacggcgagtggcagatgaaatgctgtaaatgcgactcacggcagcctcacaactattattcccacagggtggagaatgtggcaagcagttctggccctatgcgatggtggcaatcccagaacgacgtcaatcccgttagcctgcagctcgacctggaccgtagatttcagctccaagaggttatgatggaattccagggcccaatgcctgcaggcatgctaatcgagagatcttcggatttcggaaagacatggagagtttaccagtacctggcagccgattgtacatcaacattccccagggttaggcagggcaggccacagtcatggcaggatgtgcgttgccaatctctaccccagcgccctaacgcccggctcaatggtgggaaatag

SEQ ID NO: 121917 - DNA, 483 bp, Artificial Sequence
  Description of Artificial Sequence: Synthetic coding sequence
atgaatgagatccaggccattgctgctcgactccccaacgtagacctggtccttagtcagaccaaacaggacattgcccgggctcgaaggttacaggcagaggcggaagaggctcgatcccgcgcccacgctgtggaaggtcaggtggaggatgttgtaggtaacttaagacagggaactgtagccctgcaggaggcacaggacactatgcagggaacgtctcggtctcttcggttgatacaggaccgcgtggccgaggtgcagcaagtgttgagaccagctgaaaagcttgttacttccatgacaaagcagctcggtgatttctggaccagaatggaggagcttcggcatcaggcccgtcagcagggtgccgaagccgtccaggcacagcaactggctgagggggcctcagagcaggctctttctgctcaggagggcttcgagcgaatcaagcagaaatacgccgagttgaaagacagatag

SEQ ID NO: 121918 - DNA, 4830 bp, Artificial Sequence
  Description of Artificial Sequence: Synthetic coding sequence
atgcgcggcagtcatagagccgcgccagctctgcgtccacgtgggaggctgtggccggtgttagcagttctggcagcagctgcagctgctggctgcgcccaggctgcaatggacgaatgcactgacgaaggcggcaggcctcagcgttgcatgcccgaattcgtgaacgcggcatttaacgtgactgtggttgctacaaacacctgtgggacacctcctgaggagtactgtgtgcagaccggggtgaccggtgtgacaaagagttgccatctctgcgacgcaggtcaaccccaccttcagcacggcgcggcattcctcaccgactacaacaatcaggctgacactacttggtggcaaagtcagaccatgctggccggggtgcagtacccaagttcaatcaatcttaccctgcatctcgggaaggcttttgatatcacttacgtgcgcctgaaattccacacttcacggcctgaaagcttcgctatatataaacgcacaagggaggacggaccttggatcccttaccagtattatagtggctcttgtgagaatacatactctaaagccaatcgcgggttcatacggacggggggagacgagcagcaggcgctgtgcaccgatgagttttcagatatcagcccactaacaggaggcaacgtcgccttctccacgttagagggacggccatcagcctataacttcgacaattctccagtactacaggaatgggtgactgcaactgatattcgcgtgactctaaaccgtctgaacacctttggtgacgaggtatttaatgatcccaaggtccttaaatcctactactacgcaatcagtgacttcgctgttggcggtcgctgcaaatgcaatggtcacgctagcgaatgcatgaagaatgagtttgataagctggtctgtaattgtaaacacaatacttacggcgtggattgcgaaaaatgcctccccttttttaacgataggccatggcgcagggccactgcagagtccgcctccgagtgcctcccctgtgattgcaatggaagatcccaggaatgctatttcgaccccgaactgtataggagtacaggccacggaggacactgtaccaattgccaggataacaccgatggcgcccattgcgaaagatgcagagagaactttttcaggcttggaaataacgaggcctgctcgagttgccattgctcccctgtgggtagcctatccacacaatgtgattcctatggaagatgcagctgcaagccaggcgtgatgggagataagtgtgaccgatgtcagcctggcttccactctttaacagaggccggatgtaggccctgttcctgcgatccctcagggtccatagacgagtgtaatatagaaaccggccggtgcgtatgcaaagataacgtagaaggatttaattgcgagagatgtaaaccaggcttctttaacttggaaagttctaatcccagaggctgtaccccatgcttttgtttcggccattcttctgtgtgcaccaacgccgtgggatatagcgtctactctatttcctccaccttccagattgacgaggatgggtggcgggcagagcaaagagacggatcagaagcgtcactggagtggtcctcagagcggcaagacatcgcagtcatcagtgattcctattttccccgctatttcatcgcccccgctaaattcctcgggaagcaggtcctgtcctacggccagaatctgtcatttagtttccgcgtggaccgaagagatacaaggctcagcgccgaagatttggtattagaaggcgccggcctgagggtgagcgtgcctctgatcgcccagggaaactcatatccttctgagactaccgtgaagtacgtcttcaggctgcatgaggccacagactacccatggcgtccagctctgactccgttcgaattccagaagctcctaaacaacttaaccagcatcaagatccggggtacctacagcgagaggagtgccggctacctagatgacgtgaccctggcttccgctagacccggtcctggcgtccctgctacatgggtcgagtcatgcacttgtccagtcggatacggcggtcagttttgcgagatgtgccttagcggataccgccgggagacccccaacctgggcccatattcaccatgtgtactttgtgcctgcaatgggcactctgaaacctgcgatcccgaaactggagtatgcaactgtagagacaacacagctggaccccactgtgaaaaatgctctgacggctactatggtgattcaacagccggtacatcttcagattgtcagccgtgtccttgccctgggggaagctcttgtgctgttgtaccaaaaactaaggaggtggtttgtactaattgccccactggtactacgggaaagcgctgtgagctgtgtgacgatggctatttcggcgatcctctgggccggaatggtcccgtgaggctatgtcggctgtgtcagtgcagcgacaacattgatccaaatgctgtaggaaactgcaaccgcctgactggagaatgtctgaagtgcatttacaacacagccgggttttattgcgatcgatgtaaagatgggttctttggtaatccgctcgcaccaaatcctgcagataaatgtaaggcctgcaattgtaatctgtatggcaccatgaaacagcaatcatcctgtaatcctgttaccggacagtgcgaatgcctcccacacgtcaccggacaggactgcggggcttgcgaccctgggttctataatttacagtctgggcagggctgcgagcgctgcgactgtcatgctctgggctctacaaatggccagtgcgatattcgcactgggcaatgcgagtgccagccgggaatcactggccagcactgcgaacgatgcgaggttaaccacttcgggttcggccccgaagggtgcaaaccttgtgactgccacccagaaggctccctgagcttgcaatgcaaagatgatggccgttgcgagtgcagggaggggtttgtggggaatagatgcgaccagtgcgaagagaattacttctataatcgtagctggccagggtgccaggagtgtcctgcctgctaccgtttagtgaaagacaaggtggccgaccatcgggtgaaactgcaagagttggagagtcttattgctaacctcggcactggggacgagatggttactgaccaggcctttgaagatcggctgaaggaggccgagagggaagtgatggatcttctcagggaggctcaggatgttaaggatgttgatcagaacctcatggatcgcctgcagagagtgaacaacaccctttcatcacagattagtcgactacagaatatcagaaataccatagaggagacagggaatcttgctgagcaagctagggcgcatgtggaaaatacagaaaggttgatcgagatcgcgtctcgtgaactggaaaaggccaaagtggctgcagccaatgtttccgttacacagccggaatctaccggagatcctaataatatgacactccttgcggaggaggccagaaagctggctgaacgacataaacaggaggccgacgacattgtgagagtcgctaagactgccaatgacacgtccaccgaggcttacaacctcctactgagaacgctcgctggagaaaaccagacagcattcgaaatagaggagctgaacagaaagtacgaacaggcaaagaatatcagtcaggacctggaaaaacaggccgccagggtacacgaagaagccaagagggcaggcgacaaagcggtggagatttatgcctccgttgctcagctttctccgttggacagcgaaacactcgaaaacgaggctaataacattaagatggaagccgaaaatttggaacagctcatagatcagaaactgaaagactatgaagacctccgcgaggatatgagaggaaaagagctagaagtgaaaaatcttttagaaaaaggcaagactgagcagcagaccgctgaccagctgctggcaagagccgatgcagcgaaggcccttgccgaggaggcagccaagaaaggtagagacactctccaggaagcaaacgacatcctgaacaacctgaaggacttcgacaggcgcgtgaatgataacaaaaccgccgccgaggaggcgttgcgtaaaattccagctatcaatcaaacgatcacagaggccaatgaaaagacccgcgaagcacaacaggccctcggaagcgctgctgccgatgcaactgaagccaagaacaaggcccacgaagctgagcggattgccagcgctgtgcagaaaaacgcaactagtacaaaagccgaggccgagcgaacattcgccgaggtcactgacctcgataacgaggtgaataatatgctcaagcagcttcaggaagctgaaaaagaactgaagagaaagcaggacgacgcagatcaggatatgatgatggcggggatggccagccaggcagcccaagaagctgagattaacgcacggaaggctaagaattcggttacatccctgctgagcatcatcaacgacctcctggagcagcttggtcagttggacacagtcgacttgaataagttgaatgaaattgaaggcactttgaataaagcaaaggacgaaatgaaggtttccgatctcgatagaaaggtttcagacctggaaaatgaggccaagaagcaggaagcagccatcatggactataaccgggacattgaggagatcatgaaggatattcggaacctcgaggatatcagaaagacgctccctagcggatgcttcaacactccctccatcgagaaaccttag

SEQ ID NO: 121919 - DNA, 3582 bp, Artificial Sequence
  Description of Artificial Sequence: Synthetic coding sequence
atgcctgccctttggcttggctgttgcctgtgtttctcgttattgctccccgccgcccgagccacttcccggagagaagtctgcgactgtaacgggaagtcccgccagtgcatttttgaccgggaattacatcgtcagacggggaacggattccgatgcttgaactgcaatgataatacagacggcatacattgtgagaaatgtaaaaatggcttctatcgccatagggaacgagatcgctgcctgccatgtaattgcaactcgaaaggcagtctcagtgcccgatgtgataacagtggtaggtgttcctgtaaaccaggagtgacaggcgctagatgcgatcggtgcctgcccggcttccacatgctgaccgacgcaggatgcacccaagatcagcgactgctggattctaagtgcgattgtgaccccgccgggatcgctgggccttgcgatgctggtcggtgcgtgtgcaaacctgccgtaactggggaaaggtgcgacagatgtcgttctgggtattataacctggatggggggaaccctgaggggtgcacacaatgcttctgctatggccactcggcttcttgcaggtctagcgctgaatatagcgtgcacaaaatcacaagcactttccaccaggatgtggacggatggaaggcagttcagcgcaacggctccccagccaaattgcagtggagccagagacatcaggatgttttcagctccgcacaaagacttgaccccgtctattttgtggctccagctaagttcctcggcaatcagcaggtttcttacgggcagtctcttagttttgattaccgcgtggataggggaggtaggcacccaagcgcccatgacgtgatcttggaaggagctggcttgcgcatcacagcccccctgatgccactgggtaagaccctgccctgcgggttgacaaagacctatacgtttcgcctgaatgaacaccccagtaataactggtcgcctcagctgtcatacttcgaatacaggcgcctgctccgcaatttgacagcactgcgcatccgggcgacctacggagagtactcaactggatacatagataatgtaactttaatcagcgcccgaccagtttcaggggcccctgccccgtgggtggaacaatgtatctgtcctgtgggttacaaggggcagttctgccaagactgcgcatcgggctacaaacgggatagtgccagacttgggccctttggcacctgcattccctgcaactgtcagggcgggggcgcctgcgaccccgacacaggggactgttactctggcgacgaaaacccggatatagagtgtgcagattgtcctattggcttttacaacgatccacacgatcctagatcttgcaaaccatgtccctgtcataacgggttctcttgctccgtgatgcctgagaccgaagaggtggtgtgtaacaactgccctcccggcgtgactggtgccagatgcgagctgtgtgccgacgggtactttggcgacccattcggtgaacatggccctgttcgaccatgccagccgtgtcagtgcaataacaatgtggatcctagtgctagcggcaattgcgacagactgacaggtcgctgcttgaagtgcatccataacactgctggcatatattgcgaccagtgcaaagctggttactttggggacccgcttgcccctaaccccgccgataaatgtagggcctgcaattgtaacccgatgggcagtgagcctgtgggttgtcgttcagacggtacttgtgtttgcaagcccgggtttggaggccctaattgcgagcacggagccttttcatgcccagcctgttataaccaggtaaagatccagatggatcaatttatgcaacagctgcagcgtatggaagccctaatctctaaagctcaaggcggggatggagttgtgcccgacaccgagctcgagggtagaatgcaacaagctgaacaggcccttcaagatatccttcgcgacgcacaaatctccgagggcgcatctaggtctctgggtcttcagctcgccaaggtgcgcagccaggagaattcgtatcagtcccgactggacgatcttaaaatgaccgtggagcgcgtcagagcccttgggtctcagtaccagaatagagtcagagacacacatcgcctgattacacagatgcagctgtcgctcgccgagtccgaggcctcgctaggaaataccaatatccctgccagtgaccattacgtcgggcccaatggattcaaatccctagcgcaagaggccacaaggttagccgagtcacacgttgagtccgcctctaacatggaacaactgactagggagactgaggactattctaaacaggccctgagcctggtcaggaaggctctccatgaaggcgtaggcagtggaagtggaagccccgacggcgctgtagtccagggccttgttgagaaactggagaagactaagagcctcgctcagcaactcactagagaagccacccaggccgagatcgaagccgatagatcatatcaacacagcctgcggctactggactctgtcagtcgtctacagggagtgagcgatcagagcttccaggttgaggaggccaagcggatcaaacaaaaagccgattcacttagtagccttgtgacgcgacatatggatgagtttaaaaggacccagaagaacctgggaaattggaaggaggaggcccagcagctcttacagaatggtaagtccgggcgggaaaagtctgatcagcttctctcacgggctaacctcgcaaagtcccgggcgcaggaagccttgtcaatgggcaacgctaccttctacgaagttgagagcattctgaagaacctgcgcgagttcgacctgcaggtggataacagaaaagcggaggctgaagaggctatgaaacgtctgtcttacatctcccagaaagttagcgatgcatcagataagacacagcaagccgaaagggctctcggctccgcagccgccgatgcccagcgggcaaaaaacggcgccggcgaagccctagagatctcttcagagattgagcaggagataggcagtctgaatttagaggccaatgtcaccgccgacggcgcgctcgctatggaaaagggcctagcgtcactgaagtccgagatgcgggaggttgagggggaactggagcgcaaagagttagaatttgacacgaatatggatgctgtgcagatggtcatcaccgaagctcagaaagtggacacaagggccaaaaacgctggtgtcacaatccaggatacactgaataccttagacggattactgcacctgatggaccagcctctttctgttgacgaggaggggctcgtgctgcttgagcaaaaactcagccgtgccaagactcagatcaactcacagctgaggcctatgatgagcgagttagaggagagagcaagacaacaacgtggccacctccacctactagaaacatccatcgacggcatccttgcagatgtcaagaacctcgagaatattcgcgataacctacctccaggatgctacaacacacaggctctggagcagcagtag

SEQ ID NO: 121920 - DNA, 3336 bp, Artificial Sequence
  Description of Artificial Sequence: Synthetic coding sequence
atgccagcgctgtggctgggttgttgcctatgcttttccctgcttctcccagctgcccgggccaccagcaggagagaagtgtgtgattgtaacggaaaatccaggcagtgcatctttgatcgcgagctgcatcggcagactggcaatggctttaggtgcctgaactgtaacgataacaccgatggaattcattgcgaaaagtgcaaaaacgggttctataggcatcgggagcgagataggtgtctaccttgtaattgtaattccaaaggctcattgagcgcccggtgtgacaactcgggacgctgtagctgtaagccaggggtaacaggggctagatgtgatagatgtcttcctgggttccacatgctgaccgacgcgggatgcactcaagaccagcgtctcctggatagtaaatgtgattgcgaccctgctggcattgccggaccctgtgatgcaggcagatgcgtgtgtaaaccagccgtcactggcgaacgctgcgatcgttgtaggtccgggtactacaatctggacggtggaaacccagaaggctgcactcagtgcttttgttacggacactccgccagctgtcggtcttctgccgaatacagcgttcacaaaataacgagcaccttccaccaagacgtggacggatggaaggccgtacagcgaaacggatcacctgctaaactacagtggagccagaggcaccaggatgtgttctcttccgctcagagacttgacccagtctactttgtcgcgccagcgaagttcctgggcaatcagcaggtgtcttatggccaatcattatcttttgactaccgggtcgatcggggcggcaggcatccaagcgctcatgacgtgatactagagggcgccggattgaggataacagcaccgctaatgcccctgggcaagacgctaccatgtggcctgacgaagacctacacctttaggttgaatgagcatcccagcaacaattggtcaccccagttaagttactttgagtatcggcgactactgaggaatctgactgccttacgcattcgcgctacctatggggagtacagtacaggatacattgataatgtgacgctgattagtgctcggccagtctccggtgccccggcaccatgggtggagcagtgcatttgtccagtcggttataagggtcagttttgtcaggattgcgcctccggctacaaaagagacagtgccaggcttggaccattcggcacatgcataccctgtaactgccagggcggcggggcctgtgatccggatactggcgactgctattcaggtgatgagaaccctgacatcgagtgtgctgactgcccaatcggattctacaatgatccccatgatccacggagctgtaagccatgtccttgccataacggcttctcttgtagcgtcatgcccgagaccgaggaggtggtttgcaataattgccctccgggagtgacaggtgcgagatgcgaactgtgcgctgatggatactttggggacccttttggagaacacggtcccgtgaggccatgtcaaccctgccagtgcaacaataacgtggacccttccgctagcgggaactgcgaccggctgactggacgctgcctgaagtgcatccacaacactgctggcatctactgtgaccagtgtaaggccggatattttggggaccctttggctcccaacccagctgacaagtgtcgagcctgcaattgtaatcctatggggtcagaacccgtgggatgcagaagcgacgggacgtgcgtctgtaaaccaggttttggcggacctaactgcgaacatggcgcattttcttgtcctgcatgctataatcaagtgaagattcagatggaccaattcatgcaacaactgcaaaggatggaagcactgatatctaaggcacagggtggtgacggcgtggtcccagataccgagctggaagggcggatgcagcaggctgaacaggctctccaagatattctcagagacgcccaaatctccgagggcgcctcccgatccctcggcctgcaacttgccaaggttcgcagccaggagaacagttaccagtctcgcctggacgacctgaagatgaccgtggagcgggtccgggcactaggatcccagtatcagaaccgggtccgcgacacccatcgactcataacacagatgcaactgtccctggctgagtccgaggcgtccctggggaataccaacatcccagcctccgatcactacgtcggacctaacgggttcaagagtctggcacaggaagccacacggttagcggagagccatgtggaatccgcctcaaacatggagcaactaacgcgagaaaccgaggactacagcaaacaggccttgtcccttgtgaggaaagcgcttcatgaaggagtggggtccggttcagggtctcctgacggtgccgtggtgcagggacttgtggaaaagctggagaagactaaaagcttggcccagcagttgacccgagaggcaacccaggctgagatcgaagccgatcgtagctatcaacacagcctacgcttgctggacagcgtgtctcggctgcagggggtctccgaccagtcttttcaagtggaggaagctaagcgtatcaagcaaaaggctgactcactctcatctctggtgacacggcatatggatgagtttaagagaacccagaagaatttgggaaactggaaagaagaagcacagcagctgctgcagaacggcaaatcgggccgggagaagtccgaccagctgctcagccgggcaaatctggctaaatccagggcccaggaagcgcttagcatgggaaatgctactttttatgaagtggagtcgatccttaagaatctcagggagtttgacttacaggtcgataaccggaaggctgaggctgaagaggccatgaaacggctctcctacatctcccaaaaggtaagcgatgcctctgataagacgcaacaggccgagcgagcattgggctcggctgcagctgatgctcagagggccaaaaatggcgccggagaagctctggagattagcagcgaaatcgaacaggaaataggaagcctgaacctggaggcaaatgtcaccgctgatggggctttggcaatggagaagggcctggcgagcctgaaatccgagatgcgcgaggtggagggagagctggaaagaaaggagttagagttcgataccaatatggacgccgtccaaatggtcatcactgaggcacagaaagtggacacccgtgctaaaaatgcaggcgtcacaatccaggatactctgaacaccttggacggcttgctgcatctgatgggaatgtag

SEQ ID NO: 121921 - DNA, 3033 bp, Artificial Sequence
  Description of Artificial Sequence: Synthetic coding sequence
atgccagctctttggctcggctgttgcctctgtttctcgctattgctgcctgctgcccgagcgacttccagacgggaggtttgcgattgtaacggaaagtcacggcagtgtatctttgatcgagagctgcacaggcaaaccggcaacggtttcaggtgtctgaactgcaacgacaacacggacggtattcactgcgagaaatgcaagaacggcttctacaggcaccgggaaagagaccgatgcttgccctgcaattgtaacagcaagggctcactgtcagcgagatgtgacaacagcgggcggtgcagctgcaagcctggtgtgaccggagccagatgtgaccgctgcctcccaggcttccatatgctcaccgacgcggggtgcacacaggatcagcggctgctggatagtaagtgcgactgcgacccagcgggaattgccggtccttgcgatgctgggcggtgcgtgtgcaagccagccgttacaggagaacggtgcgaccggtgcaggagcgggtactacaacctggacggtggaaaccccgaaggctgcacacaatgtttctgctacggtcattcggcctcatgtcgcagctcggctgagtatagtgtacacaagattacaagtacatttcaccaagacgtcgacggatggaaggccgtccaacgaaacggttctccagctaaactgcagtggagtcagcgacatcaggatgtgttcagtagcgctcagcggctggatcccgtgtatttcgtagcaccagccaagttcttaggcaaccagcaggtgtcctacggccagtctctttccttcgactacagagtggatagagggggccgacaccccagtgcccacgatgttatccttgagggcgccggactgcgcatcacagcgcccctgatgccactcggcaagactctgccttgtggattgacaaagacctataccttccggctgaatgaacatccttccaataattggtcaccccagctgtcttattttgaatacagacgcctgctgcgcaacctgaccgctctccgcattcgcgctacctatggagagtatagcactggatatatcgacaatgttacgcttatttctgccagacccgtgtccggggcccctgcaccctgggtggagcagtgcatttgccccgtggggtataagggtcaattttgccaggactgcgccagcggttacaaacgcgacagcgcgagactgggcccctttggaacctgtattccatgcaactgtcagggaggtggcgcttgtgaccccgatactggagattgctattccggagacgagaatcccgatatcgaatgcgccgattgtccaatcgggttctataatgacccacatgacccccgctcatgcaagccctgcccttgccacaacggatttagctgtagtgtgatgcctgagaccgaagaagtcgtgtgcaataactgtcctcctggtgtaaccggcgcgcggtgcgagctttgcgccgatggctacttcggagatccgtttggtgaacatggacctgtgcgaccctgtcagccctgtcaatgtaacaacaacgtcgatccttcagcgagcgggaattgcgaccgcctgacgggtcgatgccttaaatgtatccacaacactgcaggcatttactgcgatcaatgcaaggctgggtattttggtgatccacttgccccgaacccagccgataaatgccgagcctgcaattgtaacccaatggggtcagagcccgtgggctgccggtccgatggtacctgcgtctgcaaacccggcttcggcggcccaaattgtgaacacggcgcgtttagctgtccggcttgttacaaccaggtcaagatccagatggaccagttcatgcagcagctgcagaggatggaggccctcatcagtaaggcccaaggaggagacggcgttgtacctgatactgaactcgaagggcgcatgcagcaggcggagcaggccctccaggacatcttacgcgacgcacagataagcgagggggccagcaggtccctagggctccaattggctaaggtgagaagtcaggagaactcctatcagagtcgcttggacgatctgaagatgactgtcgagcgtgtcagagcactgggtagtcagtaccaaaatcgagtcagagacacacatcggcttatcacgcagatgcagctaagccttgccgaaagtgaggctagcctggggaacacaaatatcccagccagcgatcactacgtgggcccgaacgggtttaagtccttggcccaggaggctactagactggccgaatctcacgtggagtcagcttccaatatggagcagcttactagagaaacagaagattactctaagcaggccctgagtcttgtgcgtaaggccctgcacgagggagttggctcaggctctggctcacctgatggagccgtggtgcagggcctcgttgaaaagctggaaaagactaaatccctggcccagcagctcacccgggaagcaacacaggccgaaattgaggcagaccgttcctatcagcatagcctgcgcttgctggatagcgtgtccaggctgcagggggtgtctgaccagagctttcaggtcgaagaagcgaagcgaatcaaacaaaaggccgattccctctccagcctcgtgacgagacatatggatgaatttaaacgtacacagaagaatctgggaaactggaaagaggaggcccagcagctgctccagaatggaaaaagcggcagggagaagtccgatcagctgttgagtcgggctaatctcgctaaatcccgcgctcaggaggctcttagcatggggaacgccactttttatgaggtggaaagcatcttaaaaaacttgcgggaattcgacttgcaagtagacaaccgtaaggctgaggcttttcccagccaggatcccgaccagcaacccaccgccgcccatgacgtccgagcaggaagagagggtacttcggctgaggggccgccaccgttcgctggcgataagcatcgttgggactcaggctag

SEQ ID NO: 121922 - DNA, 1590 bp, Artificial Sequence
  Description of Artificial Sequence: Synthetic coding sequence
atggccgccgccgccctgctgcttggtctggccttgcttgccccccgggccgcaggagcaggaatgggtgcctgttatgacggggcaggaagaccgcagagatgccttccagtgtttgagaatgccgcgtttggtcgtctggctcaggcctctcatacctgcggatcacctccagaggatttttgtcctcatgtcggagcagcgggcgcaggggctcattgccaaaggtgtgacgcggccgacccacaacgccaccacaacgcatcatatttgaccgacttccactcgcaggatgagtctacctggtggcagagccctagtatggcatttggcgtccagtaccccaccagcgttaatatcacattaaggctcgggaaagcctacgagattacctatgtgcgactgaaattccacaccagccggcccgagagttttgccatttacaaacgctcgcgcgctgacgggccatgggaaccttaccagttctattcggcatcgtgccagaagacttacggccggcccgagggacagtacttgcggcctggcgaggacgagcgagtcgccttctgtacttctgagttctccgatatctcacccctatcagggggaaatgtggctttctcaactttggagggcaggcccagcgcttacaatttcgaagagtcaccaggtttgcaggaatgggttactagcacggaactactcatttcccttgataggctgaatacctttggagatgacatcttcaaagaccccaaggtactccagtcttactattacgcagtgtctgatttctctgtcggcggtagatgtaagtgtaatggccatgcatccgaatgtgggcccgacgttgctggacagctcgcctgtaggtgtcagcacaacaccactggaaccgattgcgagagatgcctgcctttcttccaggaccgcccttgggcgaggggaactgctgaagccgcccatgagtgtttgccatgcaattgttctggccgcagtgaagaatgcactttcgacagagaactattcagaagcacagggcacggaggacggtgtcatcactgcagagatcacaccgccggacctcactgcgagcgctgccaggagaacttctatcattgggatcctaggatgccgtgtcagccttgcgactgtcagtccgccgggtcactgcatttgcagtgcgatgacacaggaacatgtgcctgtaaaccaactgtgacaggatggaaatgcgacaggtgcctgccaggatttcacagtctgtccgagggggggtgtcggccgtgcacatgcaatcccgccgggtcattagatacgtgtgaccctcggagtggccggtgcccctgcaaggaaaatgtggagggcaatctctgtgaccggtgcaggcctggcacttttaatctccagccgcataaccccgccggccgttcatgcaggtccagagctagtcgcgtcacatcacctcggagcgctcctacaaaccggacatggcgccctttctgcaccgcctgcccccgcacggttcccgcaggaagcgagggctgccctgacccacggcatacgctgccccatcttttgttcacatag

SEQ ID NO: 121923 - DNA, 4728 bp, Artificial Sequence
  Description of Artificial Sequence: Synthetic coding sequence
atggccgctgcagcgctgctcctggggctggcacttttggccccaagggccgctggggcagggatgggcgcatgttacgacggcgccggccgaccccagcgttgtctccccgtttttgagaatgctgccttcggccggctggctcaagcatcccatacctgcgggtccccccctgaagacttctgtcctcacgttggcgccgctggcgcaggcgctcactgccaaagatgtgatgccgctgatccgcagcgacaccacaatgccagctacctgacggactttcattcccaggacgagtcaacttggtggcagagcccaagcatggccttcggcgtccaatacccgacgtctgtgaatattacattgaggctggggaaagcttatgaaattacctatgttagactgaaatttcatacctccaggcccgaatccttcgccatttacaaaaggtcgagagcggatggcccttgggaaccctaccagttttattccgcgtcatgccaaaagacctatggacgccccgaggggcaatacctgcgaccaggcgaggacgaacgcgtcgcattttgtacatccgagtttagtgacatctctccccttagcggtggaaacgtggcattttccaccctggaggggcgtcccagcgcttataactttgaagaaagccctgggctccaagaatgggttacaagtacagagttgctaatcagtctcgacaggctcaacaccttcggggacgatatatttaaagatcccaaagttctccaatcctactactatgcagtgtctgactttagcgtgggcggccgatgtaagtgcaatgggcatgcttccgagtgcggtcctgatgtggccggtcaactcgcatgcagatgccagcacaacactacgggaaccgactgcgaacgctgcttgcccttctttcaggatcgcccatgggcaaggggaaccgccgaagcagcccatgaatgcctcccctgcaattgctcagggcggagcgaagaatgtaccttcgaccgcgaactgttccggtccacaggacatggcggtcggtgtcaccattgcagagaccacaccgctgggccccattgtgagaggtgccaggagaacttctatcattgggatccaaggatgccctgtcagccgtgtgattgtcaatcggccggttcactccacttgcaatgcgacgacacaggcacgtgcgcttgcaagccgaccgtaacgggatggaagtgtgaccgctgtctgccgggcttccacagtctgagtgaaggggggtgtcgaccatgcacctgcaatcctgctggatctctggacacatgtgatccccggagcgggcgttgcccttgcaaggagaatgtggaagggaatctctgcgaccgatgcaggccaggaacattcaatctacagccccataatcccgcaggctgcagtagctgtttctgttatggacactccaaggtttgcgcaagtacggcccagttccaggtgcatcatattctctctgactttcatcagggcgccgagggttggtgggccaggagcgttggtggctccgaacaccctccacagtggtcgcctaatggtgtgctgcttagtccggaagacgaagaagaactgactgctcctgaaaagtttttaggggatcaacgattttcatatggacagccactgatactcacgttccgggtgccacccggcgattctcccctccctgtgcagcttaggctggaagggaccgggctggctctttcactgaggcactctagcctctcaggtccccaggatgccggccatcccagggaagtagaacttagatttcacctgcaggagacaagcgaagacgttgcgcctcctctgcctcctttccatttccagcggcttctggcaaacctgacttcactcagattacgagtgagtccgggcccaagtccggctgggccagtgttcttaaccgaggtgcgactgactagcgcaaggcctgggttgtctccaccggcatcctgggttgagatctgttcatgcccaacaggttatactggccagttttgcgagagctgcgcgccaggttacaagcgcgagatgccgcagggcggcccttatgcgagttgtgtgccatgtacctgcaaccaacacggaacatgcgacccgaatactggaatttgcgtttgctcccaccatactgagggaccgagctgcgagcgctgtctgcctggtttttatggtaacccatttgccgggcaggcagatgattgccagccgtgcccctgcccaggtcagtccgcatgtactacaattcctgagagcagagaggtcgtctgcacacattgcccaccagggcaacgggggcgaagatgtgaagtgtgtgacgacgggttttttggcgaccccctggggctgtttggacatcctcaaccttgtcatcaatgccagtgctcaggcaatgtcgacccaaatgcagtcgggaactgtgaccccctctctggacactgtctgaggtgcttgcataacacgactggagatcactgcgagcactgtcaggagggattttacgggtcagccctggcacctcgccctgcggacaagtgcatgccctgttcttgtcatcctcaaggcagcgttagcgagcagatgccatgtgatccagtgactggtcagtgcagctgtcttccgcatgtaactgctagggactgcagtcggtgttatccaggattctttgacctacagcctgggagaggatgtaggagttgtaaatgtcaccctcttggcagccaagaagaccagtgccaccctaagaccgggcagtgtacttgtcgcccaggggtcactggtcaagcttgtgaccgctgccagctcggcttttttggtttcagtatcaaggggtgccgtgcctgtcggtgcagccccttaggcgctgctagcgcccaatgtcacgaaaatggtacttgcgtgtgccgcccaggtttcgagggttataagtgcgaccggtgccatgataattttttcctaaccgccgatggtacccattgccaacagtgccccagttgctacgccttagtcaaagaggaagccgctaagctgaaggccagacttacacttaccgagggttggctgcagggatccgattgcggttcaccctggggacccctggatatcctgctgggtgaagcacctaggggggatgtgtatcagggacatcatctcctgcctggcgctcgcgaggcattccttgagcagatgatgtccctcgagggagcagtgaaggccgctcgtgagcaattacagcggctgaataagggagcccggtgcgctcaagctggcagtcagaaaacctgtacccagctcgccgacctggaggcggttctagagtcttccgaagaggagattctacacgccgctgctattctggcaagcttagaaatcccccaggagggtccttcccagcctaccaagtggtcccacctggccacagaggcgcgcgcgctagcccgatctcatcgcgatacggcaactaagatcgcagccactgcttggcgcgcgctcctggccagcaacacatcctatgccctactttggaatctgctggaaggcagagtggcattagaaactcaacgagacctggaggataggtatcaggaggtgcaggccgcgcaaaaagcactccggactgcggtggcagaagtgctgcctgaggcggagtcagtcctagctacggtgcagcaggtgggcgcagacacggcaccctatttggctttgctggcctcaccaggggctctgcctcagaaatctcgggccgaggacctggggctcaaggccaaggcattagaaaagacggttgcctcctggcagcatatggctaccgaagccgccaggactctgcaaactgcagcccaggcaacccttcggcagactgagcctcttaccaagcttcatcaggaagcccgggccgccctgacccaggcttccagctccgtgcaagctgcaaccgtcacggtcatgggagcacggacgctcctggctgacctcgaaggaatgaagctgcagtttccccgccctaaagaccaggccgctctgcagagaaaagcggatagcgtctcggatcgattgttggccgacaccagaaaaaaaacaaagcaggctgagcgcatgttaggaaatgccgctcctctgtccagtagcgctaagaaaaaaggccgagaggcagaggtgctcgccaaagatagcgctaagttggctaaagcattactgcgggaacggaagcaggctcataggagagcatcccggctgacatcccagacgcaagcaaccctccagcaggcctctcagcaggtgctggcctctgaggctcggagacaagaactagaagaagcagaacgcgtgggcgcaggactttctgagatggaacagcagatccgcgaaagtaggattagcctagagaaggacatcgaaaccctgtccgagctactggcacggctgggcagtctggacactcaccaggcgcctgcccaggctctgaacgaaacacagtgggcactcgagcgcctgcgtctgcaattgggctcgcccgggtcattgcagcggaagctaagtcttcttgaacaagaatcacagcagcaagagctgcagatccagggctttgagagcgatctagccgagattcgggccgacaagcagaatctggaggccatcttgcattccttgcccgagaactgcgctagctggcagtag

SEQ ID NO: 121924 - DNA, 459 bp, Artificial Sequence
  Description of Artificial Sequence: Synthetic coding sequence
atgcgcctccctctgtctcacagccctgaacatgtcgagatggcacttcttagcaacatcctcgcggcttattcttttgtgagcgaaaacccagaacgggctgcactgtatttcgtctcgggagtgtgcatcggcctggtgctgaccttggcagccttagtgatccgtatttcctgtcatactgattgtaggcgtagaccaggcaagaagttcctgcaggatagagagtcctcttctgatagtagcgattccgaagacgggagcgaggacaccgtttcagatctgtccgttcgccgccacaggcgattcgagcggaccctcaacaaaaacgtcttcaccagcgccgaggaactagaacgcgcccagcgcctggaagaacgggagcggatcattcgggaaatatggatgaacggccagccagaggtaccaggcactcgctcgctaaacagatactattag

SEQ ID NO: 121925 - DNA, 1200 bp, Artificial Sequence
  Description of Artificial Sequence: Synthetic coding sequence
atggcgcagcgggccttcccaaatccttacgctgattacaataaaagtcttgcagaaggctatttcgatgccgcggggaggctgacacctgaattctcccaacgactgaccaacaaaatccgagagctgctgcaacaaatggagagaggtctgaagagcgccgatccccgcgatggaactgggtacacaggctgggcagggattgccgtgctgtacctacatctctacgatgtctttggagacccggcatatctccagttggcacatgggtatgtgaagcagtcacttaactgtcttacaaaaagaagcatcacgttcctctgcggtgacgcagggcctctagccgttgcggcagtgctgtatcataaaatgaataacgaaaagcaggcggaagactgcatcactcggcttattcacctgaacaagattgaccctcacgccccaaacgagatgctgtacggtaggatcggatacatctacgcgctgctatttgtgaataagaacttcggcgtcgagaagatcccgcagtcacatattcaacagatctgtgaaacgattctgacctcaggggagaatttagcacgcaaaagaaacttcactgctaagtccccactaatgtatgaatggtaccaagaatattatgtgggcgccgctcatggcctcgcgggaatctattattacctgatgcaaccctccctgcaggtttcccagggcaaactccactctctcgtgaaaccgtctgtcgactatgtgtgccagctcaagttccctagtggcaactacccaccatgtatcggggataacagggatctgttagtgcattggtgtcatggcgcgcccggcgtcatctatatgctcattcaggcctataaagtattcagggaggaaaaatatctgtgcgacgcttatcagtgtgcggacgtgatctggcaatatggactgctgaagaaaggatatggcctctgccatgggtctgctggcaacgcttacgcgtttctgacattgtataacctaacccaggacatgaaatacctctaccgggcatgcaagttcgcagaatggtgcctcgaatatggcgaacacggctgtcggaccccagacactcctttttccctgtttgaaggaatggccggcacgatttattttttggccgatctccttgtccctaccaaagctcgattccccgcgttcgaactgtag

SEQ ID NO: 121926 - DNA, 1200 bp, Artificial Sequence
  Description of Artificial Sequence: Synthetic coding sequence
atggctcaacgcgccttcccaaatccctatgccgactacaacaagtctctggctgagggttactttgatgccgccgggaggcttaccccggagtttagccagaggctgactaataagatccgggaacttctgcagcagatggagcgcggcctcaaatctgctgacccgcgggacgggacaggttatactggctgggctggcatcgcggtcttgtatctccacctttacgatgtctttggggatccagcctacctgcagctcgcccatggttatgtcaagcaatccctgaattgtcttactaagagatcaattacctttctatgtggggatgctggaccacttgcggtggccgccgttctgtaccacaaaatgaacaatgagaaacaggcagaagattgcattacgcggcttattcacctgaataagattgacccacacgcccctaatgagatgctgtacgggaggattggttacatttacgctttgctcttcgtgaacaagaacttcggcgtcgaaaaaattccccaatcccacatccagcagatttgtgagactattctgacaagtggagagaacctggctagaaaaaggaatttcaccgctaagtctcccctgatgtacgagtggtatcaagaatactacgtgggggcggctcacgggctcgctggcatctattactatctgatgcagccaagcctgcaagttagccaagggaaattgcacagcttggtcaagcctagtgttgactacgtgtgtcaacttaagtttccttccgggaattaccccccttgtataggcgataatagggacttgctggtgcactggtgtcacggagccccaggcgtgatctacatgcttatccaagcgtacaaagtcttccgggaggaaaaatacctgtgtgacgcctatcaatgtgctgacgttatctggcagtatggcctcctgaaaaaaggatacggcctgtgtcatggaagcgccggaaacgcctatgcctttctgaccctttataacctgactcaggacatgaaatatctgtacagggcatgcaagttcgccgaatggtgcctggaatacggcgagcacggttgcagaacccctgataccccttttagcctgttcgaaggtatggccggaacgatatactttcttgctgatttgctggtcccaaccaaagctcgcttccctgccttcgaactctag

SEQ ID NO: 121927 - DNA, 1200 bp, Artificial Sequence
  Description of Artificial Sequence: Synthetic coding sequence
atggcgcagcgggcatttcctaatccttatgcggactacaataaatctttggcagagggatatttcgacgccgcaggccgtcttacccccgagttctctcagaggctcactaacaaaatcagagagctgcttcagcagatggagcggggtcttaagtcagctgatcctagggacggaactggctacaccggttgggcagggatagccgtcctttatctgcatctttatgatgtgttcggagatcctgcctatttgcaactggcccatgggtacgtaaagcaatccctgaattgcctgacaaagcggtctatcacctttctctgtggagacgccggacccctcgcagtggccgctgtgctataccacaaaatgaacaacgagaagcaggctgaagactgcataacccggctgattcatctgaataaaatcgacccacatgcacctaatgagatgctgtacggtaggattgggtatatttatgctctccttttcgtgaataagaactttggcgtagagaagataccccagtctcatatccagcagatctgtgaaaccattctgactagcggcgagaaccttgctcgcaaaaggaacttcaccgccaaaagcccattaatgtatgaatggtaccaagagtactatgtgggggccgcccacggactggccggaatctattactacctcatgcagcccagcttgcaggtgtcgcaaggcaagcttcattccctcgtgaagccctccgttgattacgtgtgtcaacttaaattccccagcgggaactaccctccctgtatcggcgacaatcgcgatcttctggtacattggtgtcacggtgcccccggagtcatttatatgctcatccaggcttataaagtgtttcgcgaagaaaagtacctctgtgacgcctaccagtgtgctgacgtgatctggcaatatggtctgctgaagaagggctacgggttgtgccatggaagtgccggtaatgcatacgcatttttgacattgtacaatctcacgcaagacatgaaatacttgtatcgggcctgcaaatttgccgagtggtgtcttgaatatggggagcatggctgccgaacgcccgatactccattttctctctttgagggaatggccgggacgatctattttctcgccgacctcttagtgcctaccaaagccaggttcccggcttttgagctatag

SEQ ID NO: 121928 - DNA, 591 bp, Artificial Sequence
  Description of Artificial Sequence: Synthetic coding sequence
atggcccagagagcatttcccaacccatatgctgattataataaatcgctcgccgagggttatttcgatgctgcaggtagattgacaccagaatttagtcagcgattgacaaataagatcagagagcttcttcagcagatggagcgcggattgaaatctgccgacccccgcgacggaaccggatataccggctgggccggcattgctgtcctgtacctgcatctgtacgatgtttttggggatccggcctacctgcagcttgcccacggttatgtgaaacagtcccttaattgcctgacaaaaaggagcattacattcctttgtggcgacgctggcccacttgccgtagctgccgtcctttaccacaagatgaataatgagaagcaggctgaagactgcattacaagactgatccacctcaacaagatcgatccccacgctccaaacgagatgctgtatggacgaatcggttatatctacgcgctgctctttgtgaacaaaaactttggggtggaaaagattcctcagtctcatatccagcagatttgtgagacgatccttacatcaggcgaaaaccttgctcgcaaatag

SEQ ID NO: 121929 - DNA, 1200 bp, Artificial Sequence
  Description of Artificial Sequence: Synthetic coding sequence
atggcccagcgcgctttccctaatccctatgctgattacaacaaatccctcgcggaggggtacttcgatgcggccggtcgcctcacgccagagttttcacagaggctcacaaacaaaattcgggagttgctgcagcaaatggagcgaggtttgaaatcagcggacccgcgggacggaaccggctacacaggctgggccggcatcgctgtgctatacctgcacctgtacgacgtgtttggagatccggcatatcttcagctcgcgcatggttatgtgaaacagtccctaaattgcctgactaaaaggagcatcacctttttatgcggcgatgccgggcccttggctgtggctgccgtcctgtatcacaaaatgaataatgaaaagcaggccgaagactgtatcacaaggctcattcaccttaataagatcgaccctcatgctcccaacgagatgttatatggacggattggatacatttatgcactgctctttgtcaacaaaaactttggggtggagaagattccacagtctcatattcagcagatctgcgagacgattctcacgtccggagagaatctggcccgcaaacgcaattttacagcgaagagcccactcatgtatgagtggtatcaggagtactatgtgggagccgctcacggactcgcaggaatatactactacctgatgcagccttcgctacaggtttcacagggcaaattgcacagtcttgtgaagccgtccgtggactacgtgtgtcagcttaagttcccgtctgggaattaccccccctgcatcggcgacaaccgggaccttcttgtgcactggtgtcatggagcgcccggcgtgatctatatgttgattcaggcttacaaagtgtttagggaggagaagtatctgtgcgacgcatatcagtgtgctgacgtgatctggcaatatgggctccttaaaaagggatatgggctgtgtcacgggagcgcaggcaatgcatacgcattcttgaccctatacaatctgacccaggatatgaagtatctatacagagcttgcaagtttgcagagtggtgtttagaatatggggagcacggctgtaggacacccgacaccccattctccctattcgaagggatggcaggcacgatctacttcctggccgatctcctggtcccaacaaaagctaggttccctgccttcgagctttag

SEQ ID NO: 121930 - DNA, 1353 bp, Artificial Sequence
  Description of Artificial Sequence: Synthetic coding sequence
atgggagagaccatgagtaagcgactgaaactccacctcggaggggaagccgagatggaggagagagccttcgtaaatcccttccccgactacgaggcagctgctggggctctgctggcctccggggcagccgaagaaacgggctgtgtgagaccccccgccaccacagacgagcctggactgccatttcatcaagatggcaaaattatccacaacttcatccggcgcattcagacgaagattaaagatctgctgcagcagatggaagagggactgaaaaccgccgacccccatgactgttcagcttacaccggttggactggcatcgctctgttgtacttgcagctctacagagttacctgcgatcagacttatctgctgaggagtctcgactatgttaaaaggactctcaggaatctgaacggccgaagagttacttttctttgtggagatgccggcccccttgccgtgggtgctgtaatatatcacaagctgcgatccgactgtgaatcccaggaatgtgttaccaagctactgcagctgcagcgctccgtcgtatgccaggagtctgaccttcccgatgaactcctgtatgggcgcgcaggttatctgtacgctcttttgtacctgaatactgagatcggaccaggcaccgtctgtgaatccgcaattaaggaggttgtcaacgctattattgaatctggaaagaccctgagcagagaagagcgtaagacagagaggtgccccttactttatcagtggcatcgcaagcagtacgtgggtgcagcgcacggaatggccggaatatattacatgcttatgcaacctgctgccaaagtcgaccaagaaacactgacagagatggtgaagccaagcatcgactatgtgcggcataaaaaatttcgcagcggcaactacccttcttccttatcaaatgaaactgaccgactggtgcactggtgccatggtgcgcctggcgtgatccacatgttgatgcaggcctataaggtcttcaaagaagaaaagtatctgaaggaggccatggagtgctcagacgtaatttggcagcgagggctgctgcgcaagggatacggcatatgtcatgggactgccggtaatggatactcattcctctcgctctaccggctgacccaggataagaagtacctgtaccgtgcttgcaaattcgctgagtggtgcttagactacggtgcccacggatgtcggattccagatagaccttatagtctgttcgagggtatggctggcgcaatccatttcctgtcagacgtactagggccagagacttccagattcccggcctttgaattggacagttctaaacgcgactag

SEQ ID NO: 121931 - DNA, 2199 bp, Artificial Sequence
  Description of Artificial Sequence: Synthetic coding sequence
atgactgaaggcacatgcttgcggagacggggagggccatataaaacagagccagcaaccgacctcggaaggtggaggctcaattgtgagcggggccggcaaacgtggacgtacctgcaggatgaacgggccggaagggagcagactggcctggaagcctacgcccttggcctggacaccaaaaactattttaaggatctaccgaaagcacatacggctttcgaaggcgctttaaacggcatgactttctacgtgggtctccaggccgaggacggccactggacaggcgactatggtggccccctgttccttttgcctgggctactcattacctgccacgttgctcgcattcctttgcccgccggttaccgcgaagaaatcgttagatatttaagaagtgttcagctgcccgacgggggatggggtctgcatatcgaggacaagagcactgtcttcgggaccgcgttgaattacgtcagtctaagaatactgggagtcggcccggacgacccagacctcgtgcgggcgagaaacattctacacaaaaaaggaggcgctgttgcaataccatcttggggaaagttctggttggccgtgctgaacgtttatagctgggagggtctgaacactctttttcccgagatgtggttatttcctgactgggcgccggcacacccttcaacgctttggtgtcactgtcgccaggtgtacctgccaatgagttattgctacgccgtgagattgtctgccgctgaagatccgttggtacagtcacttaggcaggaactgtatgtagaagacttcgccagcatcgattggctggctcagcgcaataatgtcgcacccgatgaactctacactcctcatagctggctactgcgagtcgtctatgccctgctgaacctgtacgaacatcaccactcggcacacctcaggcagcgagcagtgcagaagctttacgagcacatcgtggccgacgatcgtttcaccaaatccatttccattggacccatatcaaagaccataaacatgctggtcagatggtacgttgacggaccagcctccacagcatttcaggaacacgtgtccagaattccggactacttgtggatgggattggacgggatgaaaatgcaggggaccaatggctcccagatttgggacacagcctttgcaatacaggctctgctcgaggccggcgggcatcaccgacccgagttcagttcttgcctccagaaagcacatgagttcctccgtctctcacaggtccctgacaacccgccagactaccaaaaatactaccggcagatgaggaaaggggggttttctttctcaaccctcgattgtggctggatcgtatccgactgcaccgcagaggcattgaaggcagtcctcctcctgcaagaaaaatgcccacacgttacagagcatatccctagagaaaggttgtgtgatgcagtcgccgtgttgcttaatatgagaaatcccgatggtggcttcgctacatacgaaactaagagggggggccacctgctggaacttctgaatccgtctgaggtgttcggggacattatgatcgattatacttacgtggagtgtacctccgcagtaatgcaagcactaaaatacttccacaaacggttcccagaacatagggccgcagagatcagggaaaccctgacgcagggactcgagttctgccgacgtcagcagagagccgatggctcttgggagggctcttggggggtatgttttacctatggaacgtggtttggccttgaagcctttgcctgtatggggcagacttatcgcgacggtaccgcttgcgcagaggtgtccagggcctgtgattttttactctctcgccagatggctgacggggggtggggggaggatttcgagtcttgcgaggagcgccggtacctccagtctgcacagtctcagattcataacacatgctgggccatgatgggcttgatggctgtgcgccacccggacattgaagcacaggagaggggtgtccgctgcttgcttgaaaagcagctgcctaatggggattggccgcaggagaatatagccggcgtatttaacaaatcatgtgcaatcagttatacctcttacagaaacatctttccaatctgggcgcttggccgttttagccagctttatcccgagcgcgctctcgctggccacccctag

SEQ ID NO: 121932 - DNA, 2199 bp, Artificial Sequence
  Description of Artificial Sequence: Synthetic coding sequence
atgactgaagggacctgcctcaggagaagggggggcccctacaagacagagcctgccactgatctggggcggtggcggctgaattgcgagagaggtcgccaaacctggacatacctccaggacgaaagggcgggacgagagcagactggtctggaggcttacgctctgggcttggacacgaagaattacttcaaagatctgcccaaagcacacacagcgttcgaaggagcccttaatgggatgaccttttatgttggactgcaggctgaggacgggcactggacaggtgactacggcgggcctctttttctgctgcccggcttgctgatcacatgccacgttgctcggattccactccccgccggttacagggaggaaattgtgcgatacctgcgctcggttcagctgcctgatggaggatggggcctgcatatcgaggataagtccactgtgttcggcacagccttgaactatgtgagtttgcgcatcctgggtgtagggcccgacgatcccgatctagtccgggcgcggaatatcctgcacaaaaaaggcggagccgtcgccattccttcatgggggaaattttggcttgccgttctgaatgtatactcttgggaaggactgaatacgttgtttcccgagatgtggctcttccccgattgggcaccagctcacccctcaactctctggtgccattgtcgccaggtgtatctgccaatgtcttactgttacgctgttcggctgagcgcagctgaagatccgcttgtgcagtcactgagacaggaactatacgtcgaggacttcgcttcaatcgattggctggctcagcgcaataacgtggcccccgatgagctgtacacaccccacagttggctgctgcgcgtcgtttacgctcttttgaacctttacgagcaccaccatagtgcacacctgaggcagagagccgtgcagaaactttatgagcacatcgttgccgacgataggtttaccaaatccatctctatcggccctatctctaagactatcaacatgctggtccggtggtacgtggatggccctgcctctaccgcctttcaggagcatgtatctcgaatcccagactacctgtggatgggactggacggcatgaaaatgcaaggcaccaatgggtcccagatatgggatactgcgtttgctatccaagctcttctggaggcaggggggcaccatagacctgagttcagtagctgtctgcagaaagcgcatgagtttctcaggctctctcaggtgcccgacaatcctcctgattaccaaaaatattaccgtcagatgaggaaggggggcttcagctttagcacactagactgcggttggatcgtgtctgactgcacagcagaagccctgaaagccgttctccttctgcaggagaaatgcccccatgtcacagagcatatcccacgggaaaggctatgcgacgctgtggcagtgctcttgaatatgaggaaccccgatggaggcttcgctacgtacgaaaccaagcgcggaggccacttactggagttgctgaatccaagtgaggtgtttggcgatattatgatcgactacacgtacgtggaatgcacatctgccgtgatgcaggctctgaaatatttccataaaagatttcccgaacaccgggcagccgagatacgggagaccttaacgcagggactggaattttgtcgcaggcagcagagagccgacggatcctgggagggtagctggggggtctgcttcacctatggcacgtggtttggactggaagcttttgcctgcatgggccagacctatcgcgacgggacagcctgtgccgaggtttctcgagcgtgtgattttctgttgtcccggcaaatggctgacggggggtggggagaggacttcgaaagctgcgaagaaagaagatacttgcagtcggcgcagtctcagattcataacacttgttgggctatgatgggcttaatggctgttaggcaccccgacatcgaagcccaggagcgcggcgtccggtgcctgctggagaaacagctgcctaacggcgattggcctcaggagaatatcgccggagtgtttaataaatcatgcgctatctcatacacctcatatagaaacatattccctatctgggccttaggtcggttttctcagctctaccctgaacgggcactggcgggccatccgtag

SEQ ID NO: 121933 - DNA, 1959 bp, Artificial Sequence
  Description of Artificial Sequence: Synthetic coding sequence
atgaccttttatgtgggtctacaggctgaagatggccactggaccggagattacgggggacccctgttcctgctgcctggcctcctcatcacctgccatgtagcccgcatcccgctcccagcggggtacagagaagaaatagtaagatacctccgcagcgttcagctgcctgatggaggctggggtctgcatatcgaggacaagagtacagtcttcgggaccgctctcaactacgtctcccttaggatccttggggtcgggccagacgaccccgacctcgtaagagcgagaaacatccttcacaagaaaggcggagccgttgccatcccatcctgggggaaattttggctggccgtgcttaacgtttactcttgggaaggtctgaacaccctttttccggagatgtggctgttccccgactgggccccagctcacccctccactctttggtgccactgtagacaggtttacctgcccatgagttactgctacgctgtcagactgtcggcagctgaggatccgctggtccagtcccttcgtcaggaactttacgtggaagatttcgcatccatcgactggctcgctcagcgcaacaatgtggcccccgatgaactctatacacctcattcatggttattacgagtggtctatgcactacttaatctgtacgagcaccaccattccgcacatctgcgacagagagctgtgcagaaactctatgagcatattgttgcagacgatcggtttactaaaagtattagcatcggcccaatctcaaaaacaataaatatgcttgtgaggtggtatgttgatgggccggcctccaccgctttccaggagcacgtcagccgaattcctgactacctctggatgggactcgacggaatgaagatgcagggaacaaacggtagtcaaatatgggacactgccttcgcaatccaagctctgctagaagcagggggccaccatcgacctgagttttctagctgcctgcagaaagcccatgagtttttaagattgagtcaggtcccggataaccccccggactatcagaagtactacaggcagatgcgaaaaggcggtttttctttttcaaccctcgactgtggctggatcgtatcagactgtaccgctgaggctctgaaggccgtgctgctgctccaggagaagtgtccccacgtgacggaacatatcccccgggagagactttgcgacgccgttgccgtgctgctgaacatgcgcaaccctgacggcggctttgcaacatatgagactaagcggggcggccatctgctggaattgctcaatccctcggaagtgtttggggatatcatgatcgattacacgtacgtcgagtgtacatctgcagtcatgcaggcccttaagtactttcataagcgttttccggaacaccgggcggccgagattagggaaaccctaactcaaggtctagagttttgccgcaggcagcaacgtgccgacggatcatgggagggaagctggggcgtgtgtttcacatacggcacatggttcgggttggaggctttcgcctgtatgggacaaacgtatcgggacggcaccgcgtgcgcagaggtgtctcgagcctgtgatttcctgctgagccggcagatggccgacggtggctggggggaggatttcgaaagttgtgaagagcgtagatacctccagagcgcacagtcacaaatccataatacttgttgggccatgatggggttgatggccgtgcgtcatccagacattgaggcgcaggagcggggtgttcggtgtttgctggaaaagcagctcccaaatggagactggcctcaggagaatatcgccggagtgttcaataagtcatgcgccatctcgtatacaagctatcggaatattttccccatttgggctctgggtcgctttagccagctctatcccgagcgcgccctcgccggtcatccctag

SEQ ID NO: 121934 - DNA, 2166 bp, Artificial Sequence
  Description of Artificial Sequence: Synthetic coding sequence
atgaccgaggggacctgcctaaggcgccgtgggggtccctacaaaaccgagcctgcaacagacctaggacgctggcgactaaattgtgagcgcgggcgccaaacctggacctatttgcaggatgagcgggccggtagagagcagaccggtctagaggcgtacgcattgggactggacactaagaattattttaaagatttgccaaaggcacatacggccttcgagggggccttgaacggaatgaccttttatgtcggcctccaggccgaggatggccactggactggggattatggtgggcctctctttttgctgcccggcctgctcatcacctgccatgttgcccgaatccccttgcctgctggatacagagaggaaattgtgagatatcttcgccacattgaggacaagagcaccgtattcggaacagccctgaactacgtttccctccgcattctcggagtaggccctgatgatcccgaccttgtgagggcccgaaatatccttcataaaaaggggggagccgtcgctattccatcctggggcaaattttggctcgcagtgctcaatgtctatagctgggagggactgaatacactatttcctgaaatgtggctgtttcccgactgggctcctgcccacccgagcaccttatggtgccactgtaggcaagtgtatctgcctatgagttattgttatgccgtgagactgtctgccgctgaagacccacttgtacagtcgcttcgccaggaactgtatgtggaggatttcgcctccattgactggctggctcagcggaacaatgttgcccctgatgaactctacaccccccatagttggctcctcagggtggtctacgcgttgctgaacttgtacgagcaccatcacagtgcccaccttaggcagcgggcggtccaaaagttgtacgaacacattgtagccgacgatcgttttacgaagagtatctctattggacccatatctaagactatcaacatgcttgtgaggtggtatgtcgatggtcctgcatcaactgccttccaagaacatgtgtcgagaatcccagattatctctggatgggattggacggaatgaaaatgcagggaaccaacggctcgcagatttgggataccgcttttgcgatccaagcgttactcgaggccggtggtcatcaccggcccgagttctcgtcttgtctgcagaaagctcacgagtttctgcgactcagtcaggtgccggacaatcctccagattaccagaagtactaccgccagatgaggaagggagggttctccttctcaaccctcgattgcggatggattgtttcagactgtactgccgaggccctcaaagccgtgcttctgctgcaagaaaaatgtccgcatgtgaccgaacacataccgcgagagcggctgtgtgatgctgtagccgtgctgcttaatatgcgcaaccccgatggagggttcgccacttacgagacaaaacggggcggccatctgctggagttacttaacccgtccgaggtgttcggcgacattatgatcgattatacgtacgtagagtgtacttcagctgtgatgcaggcccttaaatattttcataagcgctttccagagcacagagctgccgaaatcagagagacactgactcaagggctcgaattttgccggcggcagcagcgcgcagacgggagctgggagggctcttggggggtctgttttacatacggcacctggttcgggctagaggcattcgcgtgcatgggccaaacatatagagatggaacagcgtgcgccgaagtgtcccgggcgtgtgacttccttttatcccgtcagatggccgatggtggatggggagaggactttgagtcatgtgaggaacgaagatatttgcagagcgctcagtctcaaatccacaatacatgctgggctatgatgggcctcatggccgtgagacaccccgacatcgaagcccaggaacgtggagtgagatgtcttctggagaaacagcttcctaatggagactggccccaggagaacatcgccggagtcttcaataagtcctgcgccataagttatacatcttataggaacatcttccccatttgggcccttggccgcttttctcagctgtacccggaaagagcgttggctggtcatccatag

SEQ ID NO: 121935 - DNA, 1977 bp, Artificial Sequence
  Description of Artificial Sequence: Synthetic coding sequence
atgggaaggaggcgagcccccgcaggaggatccctggggcgtgccctgatgcgccatcagacacagcggtcaagatcccacaggcacacagatagctggcttcatacaagtgagttgaatgatggctatgattggggcaggcttaatctccagagtgtgactgagcaaagcagcctcgacgacttcctggccaccgccgaacttgctggcacagagttcgttgcagaaaagttgaacatcaagtttgtgcctgccgaagcacggaccgggcttctgtcctttgaagagtcccaacgcataaaaaagctgcacgaagagaataagcagttcctgtgtataccacgccggcccaactggaaccagaatacaactccagaggagttgaagcaagcggaaaaagacaactttctcgagtggcggaggcagcttgtgaggcttgaagaggaacagaaactgatactcacccctttcgagcggaacctcgatttttggcggcagctgtggcgggtgattgaaaggagtgatatcgtggttcagatagtcgacgccagaaaccccctgctcttccggtgtgaggacctcgaatgctatgtgaaggagatggacgccaataaggaaaacgtgatactaatcaataaggcggatctcctgaccgcagagcagagaagcgcttgggctatgtatttcgagaaggaagacgtgaaagtgatcttttggagcgccctggccggagcgatacccctgaatggagattctgaggaagaagccaaccgggacgaccgtcagtccaatacgaccaagttcggccatagcagttttgaccaggccgagatctcgcattcggagtccgagcacctccctgcgagggactccccttccctgtccgagaacccaactactgacgaggacgactcggagtacgaggattgcccggaggaggaagaagacgactggcagacatgctctgaggaagacggacccaaggaggaggattgtagccaggattggaaagagtcctccaccgcagactcagaggcacgtagtcgtaagacgccccagaagcgacagatacacaattttagccacctggtgtcaaaacaagagctgctcgagttgtttaaagaacttcacacaggtagaaaggtgaaagatgggcaactgactgttggtcttgtgggctatccaaacgtgggcaagagtagcactattaatactattatgggcaacaaaaaagtgtctgtatcagccactccaggccacacaaagcatttccagaccctgtatgtagaacctgggctttgtctctgtgattgtccaggactggtaatgccatcctttgtgtctactaaggcggagatgacctgcagcggcatcttgccaattgaccaaatgagggatcacgtccctcctgtcagccttgtctgtcaaaatatacccagacatgtgcttgaagctacctacggcattaacattattaccccaagggaggacgaggacccgcatcgcccgcctacgtccgaggagctgctgaccgcttatggttacatgagaggttttatgaccgcccatgggcaaccggatcagccaagatccgctcggtacatcctgaaagattatgtgtctggcaaactactctactgtcatccaccgcctggcagagaccccgttacatttcagcatcaacaccagcggctccttgagaacaagatgaactctgacgagatcaagatgcaactgggaaggaacaagaaggccaagcagatcgagaacatagtcgacaagacttttttccatcaggagaacgtacgggcacttaccaagggagtgcaggctgtcatgggatacaagcccggcagtggcgttgtaacggccagcacagcgtcctctgaaaacggagccgggaaaccttggaaaaaacatggcaaccgcaataaaaaggaaaagtcgagacggctctacaagcacctggacatgtag

SEQ ID NO: 121936 - DNA, 333 bp, Artificial Sequence
  Description of Artificial Sequence: Synthetic coding sequence
atgagctgtcagcagagtcagcagcagtgtcagcctccacccaaatgcaccccaaagtgtccgcccaagtgtcctactcctaagtgcccccccaagtgcccacctaaatgccccccggtaagctcttgctgttctgtgagctctggtggatgttgcggctcgtcatccggtggagggtgttcctcgggcggcggcggctgctgcttatcccaccatcgaagacaccgctctcaccgtcacagactgcagagcagcgggtgttgcagccagccctctggaggttccagttgttgcgggggcgattcgggccagcatagcggcggatgttgttag

SEQ ID NO: 121937 - DNA, 333 bp, Artificial Sequence
  Description of Artificial Sequence: Synthetic coding sequence
atgtcctgccagcaaagccagcaacagtgtcaaccacccccgaaatgcactccgaaatgcccccctaagtgtccaacccccaaatgtccccccaagtgtccccccaaatgccccccagtctccagctgctgtagtgtgagctccggcgggtgttgcggcagttcatcaggaggcgggtgctcaagcggtggtggcggatgttgccttagccatcaccggcggcacaggtcccacagacaccgcttgcaaagcagtgggtgttgtagccaacccagcgggggctcctcctgttgcggaggagatagcggacaacactccggaggatgctgttag

SEQ ID NO: 121938 - DNA, 357 bp, Artificial Sequence
  Description of Artificial Sequence: Synthetic coding sequence
atgtcttgtcagcagaaccagcagcagtgccagcccccacccaaatgtatccctaagtgcccgccaaaatgcttaacaccacggtgcccacccaagtgtccgccgaagtgtcccccggttagcagttgttgctctgtatcgagcggaggctgttgcgggtccagtagcggcggaagctgcggctcctctagtggcggctgctgtagcagcggaggtggcgggtgttgcttgtcccaccacaggcgccgcagatcacattgccataggccacaaagtagtgggtgttgtagccagccttcgggtggatcttcatgttgcggcgggggatctggccaacacagcgggggctgctgttag

SEQ ID NO: 121939 - DNA, 333 bp, Artificial Sequence
  Description of Artificial Sequence: Synthetic coding sequence
atgagctgccagcaaaaccaacagcagtgccagcctccaccaaagtgtatcccaaagtgtccgccaaagtgtctgactccccggtgtccaccaaagtgcccacccaagtgtccccctgtgtcttcctgctgttcagtgtcctctggcgggtgctgcggatcgtctagcggcgggtgttgctcatccggtggtgggggctgttgcctgtcacaccatagaaggagacgctctcactgtcataggccccaatcctcaggatgttgttctcagccctccggaggatcttcctgctgtggaggtggcagcgggcagcattcaggaggatgttgttag

SEQ ID NO: 121940 - DNA, 357 bp, Artificial Sequence
  Description of Artificial Sequence: Synthetic coding sequence
atgagttgtcaacagtcccagcagcagtgccaaccccctcctaagtgcacacctaagtgtccgccaaagtgcccaacaccaaagtgcccgcccaagtgtcctccaaagtgtccacccgtcagctcttgctgcagcgtctcaagtgggggctgctgtggctctagttctggcggcagctgcggctccagctcaggcggttgttgttccagcggcggagggggctgctgcctaagccaccatcggaggcgccgctcccactgtcaccgcccacagtccagcgggtgttgtagtcaaccttcgggcgggagtagctgttgtggcggtggatcaggccaacacagcggaggatgttgctag

SEQ ID NO: 121941 - DNA, 345 bp, Artificial Sequence
  Description of Artificial Sequence: Synthetic coding sequence
atgagctgccagcaaagccagcaacaatgccagcctccccctaagtgcactcccaagtgtacccccaaatgtcctgctccaaagtgtccaccaaaatgccctcccgtgagctcatgctgttcagtttctagcggcggatgctgcggctcctcttcaggcggcggctgcgggtctaactcaggcggttgttgcagttcggggggaggtggttgttgtctgtctcaccacaggcgccatcggagccatcggaggcgacctcagagctccgattgttgcagccagccctcgggcgggagtagttgttgcggtggggggagtagccagcactctgggggatgttgctag

SEQ ID NO: 121942 - DNA, 357 bp, Artificial Sequence
  Description of Artificial Sequence: Synthetic coding sequence
atgagctgccaacaatcccagcaacagtgccagcctccgcctaagtgcacaccaaagtgtccaccaaagtgccccactccaaaatgcccgccgaagtgccctccaaagtgcccacctgtgtcttcatgctgctccgtctcctcaggtggatgctgtggcagctcatccggcggatcttgcggatcctccagcgggggctgctgctcgagcggaggcggaggctgttgcctgtctcatcaccgccaccataggtcacacagacacagacctcagtctagcgattgctgtagtcagccttctggcggttcctcttgttgtggaggcggatccggacagcatagcggcggctgctgttag

SEQ ID NO: 121943 - DNA, 357 bp, Artificial Sequence
  Description of Artificial Sequence: Synthetic coding sequence
atgtcgtgccaacaaagtcagcagcagtgccaacctccacctaagtgcactccaaaatgccctccgaagtgtcctacccctaaatgtccccccaagtgtcctcctaaatgtccgccagtatccagctgttgctcagtttcgagcggggggtgctgcggcagctcatctggtggctcttgcggatcctcgagtggtggctgctgtagcagtggtggaggcggctgttgcctgagccatcataggcatcataggtcccaccgccatcggccgcaatcgtccgactgctgctctcaaccatctggggggagctcatgttgcgggggtggtagtggacagcactcagggggatgctgctag

SEQ ID NO: 121944 - DNA, 357 bp, Artificial Sequence
  Description of Artificial Sequence: Synthetic coding sequence
atgtcatgccaacaaagtcaacagcagtgccagccgccacccaaatgtacaccaaaatgcccgccgaagtgccctaccccaaagtgcccacccaaatgtccgcctaagtgcccccctgttagttcgtgttgttccgtgagctccgggggatgttgcgggtcctcgtccggcggatgctgcagtagtggggggggaggttgttgtagctctgggggtggcggatgttgcctgagtcaccaccggcggagacgatcacaccggcaccgcccccaaagctcggactgttgctctcagccttctgccgggtcttcctgttgcggtggcggctccgggcagcactctgggggatgctgttag

SEQ ID NO: 121945 - DNA, 321 bp, Artificial Sequence
  Description of Artificial Sequence: Synthetic coding sequence
atgtcttgccagcagaatcaacaacagtgtcagcctcctcccaagtgcccgcccaaatgcccacccaaatgtcctcctaaatgtcgtccgcagtgtccagcaccctgtcctcccccggtgtcatcatgctgcggcccttcatctggcggctgttgtgggtcgagttctggcggttgttgctcctccggtggcggaggctgttgtctaagtcatcaccggccccggctattccatcggcatcggcatcagagtcccgactgttgcgaatgtgagccctcgggcggctccggctgttgtcattcttcaggggattgctgttag

SEQ ID NO: 121946 - DNA, 333 bp, Artificial Sequence
  Description of Artificial Sequence: Synthetic coding sequence
atgagctgccaacagaaccaacaacagtgccagccacctccaaaatgtccacctaagtgtacccctaagtgccctcctaagtgccccccgaagtgccttccccagtgccctgctccttgctcccccgctgtgtcttcgtgttgcggtcccataagcggcggttgctgtgggccctcctctggcggatgctgcaactctggtgccggaggatgttgcctttctcaccaccgaccaaggctctttcaccggcgcaggcaccagagtcccgattgttgcgaaagtgagccttcaggcgggtccgggtgctgccactcaagcggaggatgttgctag

SEQ ID NO: 121947 - DNA, 333 bp, Artificial Sequence
  Description of Artificial Sequence: Synthetic coding sequence
atgtcctgccaacagaaccaacagcaatgtcaaccaccaccaaaatgtcctcctaagtgcacacctaaatgccctccaaagtgtccaccgaaatgccttccacagtgcccagccccatgctcacccgctgttagcagctgttgcggtccaatatcagggggatgctgtgggccttctagcggtggctgctgcaactccggcgccggaggttgttgtctgtctcaccacaggccacgcctgtttcaccgacgacgtcaccagtcgccggattgctgcgaaagtgagccttccggcgggtccggctgttgtcactcctccggcggctgttgttag

SEQ ID NO: 121948 - DNA, 333 bp, Artificial Sequence
  Description of Artificial Sequence: Synthetic coding sequence
atgagctgccaacagaatcagcagcagtgccagccgcccccaaaatgtccaccgaagtgcactcccaagtgtccacctaagtgccctcctaaatgcccgccacagtgtcccgccccctgcttccctgccgtgtctagctgctgcgggcccagctccgggtcgtgttgcggccctagcagcggcggctgctgctcgtctggcgccggcggatgctccttgagccaccatcgacctcggctgtttcataggcgcagacatcaatccccagactgttgcgaatctgaaccctctggcggttctggctgctgtcacagtagcggaggatgctgctag

SEQ ID NO: 121949 - DNA, 333 bp, Artificial Sequence
  Description of Artificial Sequence: Synthetic coding sequence
atgtcttgccaacagaaccagcagcaatgtcaaccaccccccaagtgcccccccaaatgtactccaaaatgtcctcctaagtgcccccccaagtgtccaccacagtgtcccgccccatgttcgccagctgtgtcgagctgctgtggcccgtcgtccggctcttgttgcgggccgagcagcggcggctgctgctcttccggaggcggcggctgctgtctatcgcatcacagaccacgcctctttcatcggcgcagacaccaatcccccgattgttgtgaatctgaacccagtggtgcctcaggctgctgccactcctcaggcggctgttgctag

SEQ ID NO: 121950 - DNA, 270 bp, Artificial Sequence
  Description of Artificial Sequence: Synthetic coding sequence
atgtcctgtcagcaaaatcagcaacaatgtcagccccccccaaaatgccccgccaaatcaccagctcaatgtctgccacctgcgagcagctcatgtgctcccagttccggcggctgtgggccgtcttctgagagaagctgctgcttgtcacaccacagatgcaggcgaagccacaggtgccgttgtcagtcgtccaacagttgcgaccgcggctctggccagcagggaggctcttctagctgtggccactctagtgccggctgctgctag

SEQ ID NO: 121951 - DNA, 288 bp, Artificial Sequence
  Description of Artificial Sequence: Synthetic coding sequence
atgtcgtgtcagcagaaccagcagcagtgccaacctctccccaaatgtccatctcctaaatgtccgcctaaatcctccgcacagtgtctgccccccgcctctagctgttgcgctccacgaccgggttgctgcgggggtccgagctcagaggggggatgctgcctaagtcaccatcgctgctgcagatcccatcgatgccggagacagtccagtaattcttgcgatcggggttctggacagcaggatggcgcgtccgattgcggctacggcagcgggggctgttgttag

SEQ ID NO: 121952 - DNA, 285 bp, Artificial Sequence
  Description of Artificial Sequence: Synthetic coding sequence
atgagttgtcagcaaaaccaacagcagtgtcagccaccaccatcctgtcctagcccaaagtgcccccctaaatctcccgcccagtgcttgcctccaccttcttccgactgcgcgctgtcatcgggcggctgtggaccaagtagtgagtctggctgctgtctgagtcatcaccgacacttcagaagccatcagtgccgtagacagcgctctaatagctgtgatcggggttccggacagcagggtggggggagttgcagaggccacgggagtggaggttgttgctag

SEQ ID NO: 121953 - DNA, 279 bp, Artificial Sequence
  Description of Artificial Sequence: Synthetic coding sequence
atgagctgtcagcagaatcaacagcagtgccagccaccaccgaagtgtcctagccctaaatgccctccaaaatccccagtgcagtgcctgccacccgcttcttctggatgtgccccatcaagcggtggatgtggaccgagctccgaaggcggctgctttctgaaccatcataggagacaccacagatgcagacgccagagacctaactcgtgcgataggggatctggccaacaaggcggtgggtctgggtgcgggcacggtagcggcggctgctgttag

SEQ ID NO: 121954 - DNA, 279 bp, Artificial Sequence
  Description of Artificial Sequence: Synthetic coding sequence
atgtcatgccaacagaatcagaagcagtgccagccaccaccaaaatgtccttccccaaagtgcccacctaaaaatcccgtgcagtgcctacccccggccagtagtgggtgcgcaccatcttccggcggttgcggtccatcctcagaggggggatgtttcctaaaccatcataggcggcaccaccggtgccggcggcagagatcgaattcatgcgatcgcggaagcggacaacagggaggcggcagcggatgctgtcatggctcgggcgggtgctgctag

SEQ ID NO: 121955 - DNA, 300 bp, Artificial Sequence
  Description of Artificial Sequence: Synthetic coding sequence
atgtcctgccagcaaaatcaacagcagtgtcagccaccgccaaagtgccccatccctaagtacccacccaagtgtccgtcaaagtgtgcctccagttgccccccccccatctccagctgctgcggttccagctcgggagggtgcggctgctgtagctccgaagggggggggtgctgtctgtctcatcaccgtcatcacagatcccattgtcacaggccaaaatctagcaattgctatggctctggtagtggtcagcagtccggtgggagcggctgttgtagtggtggcggttgttgttag

SEQ ID NO: 121956 - DNA, 300 bp, Artificial Sequence
  Description of Artificial Sequence: Synthetic coding sequence
atgagctgtcaacagaatcagcagcagtgccagccacccccgaagtgccccattcccaagtatccacccaagtgcccaagcaaatgtgcaagtagttgtccaccacctatttcaagctgctgcggttcgtctagtggcggatgtgggtgctgctcttcagaaggcggaggatgttgcctgtcccaccacagacatcacagaagccactgtcaccgacctaaaagcagcaattgctacggctccggttctggacagcagagcggcggctccggctgttgtagtggcggaggttgctgctag

SEQ ID NO: 121957 - DNA, 357 bp, Artificial Sequence
  Description of Artificial Sequence: Synthetic coding sequence
atgagctgtcagcagagtcagcagcagtgccaacccccgcctaaatgcacacccaagtgtcctcctaaatgtacccccaagtgcccaccaaaatgtcctccaaaatgtcctcctcagtgctctgctccctgcccaccccctgtgagtagttgctgtggctcctccagcgggggatgctgtagctctgaaggagggggttgctgtctttctcatcatcgaccacgtcagtcactccgtcgaagacctcagtcatcctcctgttgcggctcaggctctggtcagcagagtggtggctccagctgctgccacagctcgggcggctcaggctgctgccactcctcaggcgggtgttgttag

SEQ ID NO: 121958 - DNA, 297 bp, Artificial Sequence
  Description of Artificial Sequence: Synthetic coding sequence
atgagttctgatgataagtctaaaagtaatgacccaaagaccgaaccaaaaaattgtgacccaaagtgtgaacagaaatgcgaatctaagtgccagccctcctgtctgaaaaagcttctccagaggtgtttcgagaagtgcccttgggagaaatgccctgccccccccaaatgtctcccctgtcctagtcaatcaccgagctcctgcccaccacagccatgtacgaagccttgccccccaaaatgtccatcatcatgtccccacgcttgtcctcccccatgcccacctcccgaatag

SEQ ID NO: 121959 - DNA, 1860 bp, Artificial Sequence
  Description of Artificial Sequence: Synthetic coding sequence
atgtgctcttgtcataaaggctatacaagaactcctgatcataaacactgtcgggacattgatgagtgccagcagggtaacctgtgcgtgaacggtcagtgtaagaacacagaaggaagctttcgctgtacctgtggacaggggtatcagctgtctgccgctaaagatcagtgcgaagatatagatgaatgccaacatcggcatctgtgtgcccatgggcaatgccgtaatacagaagggagctttcagtgtgtctgtgatcagggatatcgggcctcaggactcggcgaccactgcgaagacatcaacgagtgcctggaggataagtcggtctgtcaacgtggagattgtatcaacaccgccggctcctacgattgtacatgcccggacggatttcaattggacgacaacaagacgtgccaagacatcaatgagtgcgaacaccccgggctgtgcggaccacagggggaatgcctgaatacagaaggctccttccactgcgtatgtcagcagggcttctccatatccgccgatgggcggacttgtgaggatgtgaacgagtgcgagctgctgagtggcgtgtgcggagaagccttttgcgagaatgtggaggggtctttcctgtgtgtttgtgcggatgagaatcaggaatactcgccaatgaccggccagtgccgctcacggactagcactgatctcgatgtggacgtcgaccagccaaaggaggagaagaaggagtgttactataaccttaacgacgcctcactgtgcgataacgttttggcacccaacgttaccaagcaagaatgctgttgtacttcaggagtgggctggggtgataactgcgagatctttccttgccctgttctcggtactgctgaatttacagagatgtgtcctaaagggaagggcttcgttcccgctggcgaatcttctagtgaagcaggaggagagaactataaagatgctgacgaatgccttttgttcgggcaggagatatgtaagaacggattttgtctgaatacgcgacctggatacgagtgttattgtaagcagggaacttactacgaccccgtcaaactgcagtgtttcgatatggatgaatgccaggatccctcctcctgcattgacggacagtgcgtgaacactgagggctcttacaattgcttctgtacccacccaatggtgttggacgcttcagagaaacgctgcatccggccagccgaaagtaacgagcaaattgaggagaccgatgtctatcaagacctatgttgggagcacctgagcgatgagtacgtttgctcccgccccttagtcgggaagcagacaacgtatactgaatgctgttgtctgtatggagaagcttgggggatgcagtgtgccctgtgtcctcttaaagattccgacgattacgcgcagctgtgcaatatccctgtgacgggccgccgccagccatatggtagagacgctctggtcgactttagcgagcagtatacacctgaggccgacccctattttattcaggatcgcttcttgaattcctttgaggagctgcaggcagaagagtgcggaatccttaatggctgtgagaacggcaggtgcgtgagggttcaggaaggatatacgtgtgattgcttcgacgggtaccacctggatacagctaagatgacttgcgttgacgtgaacgagtgcgatgaactgaataataggatgagtctgtgtaaaaacgctaagtgtatcaacacagatgggagctacaaatgtttgtgcctcccggggtacgtcccctcggataagcccaactattgtacccctcttaacactgctctgaaccttgagaaggactccgaccttgagtag

SEQ ID NO: 121960 - DNA, 5169 bp, Artificial Sequence
  Description of Artificial Sequence: Synthetic coding sequence
atggcaggggcctggctcagatgggggctgctcctctgggcgggccttttagcttcctctgcccacggccgcttaaggaggattacgtacgttgtgcaccccggtccggggctcgcagctggagctcttcccctgagcggaccccctaggagcagaacctttaatgtggcactgaacgcacgatattcccgtagttcagctgctgctggcgccccatctcgcgcctcccccggcgtaccctcggagcggaccagacgcacatccaaacccgggggggccgccttgcagggtctgagacctccccctcccccccctcccgagcccgcaaggcctgcggttcccggcggacagctgcaccccaacccggggggacaccctgcagccgcccccttcactaagcaagggaggcaggttgtcagatccaaggtccctcaagaaacgcagtctggaggcggtagtaggctgcaagtacaccaaaaacagcagcttcaaggtgtcaatgtgtgtggaggccggtgctgccacggatggtctaaggctcctgggtctcagcgatgtaccaagccgtcctgcgtgccaccgtgtcagaatggcggcatgtgtctacgaccgcaattatgtgtctgtaaacctgggacaaaggggaaagcatgcgagaccattgctgcacaggacacaagctctcccgtcttcggtggtcagtcccctggcgctgcaagctcgtgggggccgcccgaacaggcagccaaacacacatcctcaaagaaggccgacacattaccgcgagtgagtcctgtcgcccagatgaccctgacattgaaaccaaaaccgtctgtcggcctgccccagcagatccattcacaggtaactccacttagctcacaatctgtggtgatccatcacggccagacacaggagtatgtgctcaaacctaaatacttccctgcccagaaaggcatcagtggagaacagtcgacagaaggcagcttcccactaagatatgtgcaggaccaggtcgctgcaccctttcagttgtccaaccatactggtcgtattaaggtggtcttcactcctagcatctgcaaggtgacatgcaccaagggcagttgtcagaattcctgtgaaaaaggtaatactacaactctgatcagcgagaatgggcacgcagccgatacacttactgctaccaacttccgggtcgttatttgccacctaccttgtatgaatggcgggcagtgttccagtcgcgacaaatgccaatgccctcctaatttcacaggcaagctgtgccaaattcctgtgcatggggcatcggtccctaagctctaccagcattcgcaacaacccggaaaggctctgggtacccacgtgattcattccacacacacattgccactgactgttacatctcaacaaggagtgaaagtaaaatttccaccaaatattgttaatattcacgtcaagcaccctcctgaagccagtgtgcagatccaccaagtgagtagaatcgatgggcctacagggcagaagacaaaggaggcacagcctggacagtcccaggtgagctaccagggtcttcctgtgcaaaagacacagactatccattccacatactctcatcagcaagtgatcccacatgtttaccctgtggctgcgaagacccagctgggacgatgctttcaggaaacgattggaagccagtgtggaaaagccctgcccggcctgtccaaacaggaggattgctgtgggactgtgggaaccagctggggctttaacaaatgccagaagtgcccgaagaagccttcttaccacggatacaatcagatgatggaatgtctccctggctacaagcgtgtgaacaacacattttgtcaagatattaacgagtgccagcttcagggagtgtgtccaaatggtgaatgcctaaataccatgggctcatacagatgtacatgtaagatcgggttcggtccagacccgacgttttcctcctgtgtccctgatccacctgtaattagtgaggagaaaggaccctgctatcgacttgtctcatcaggtaggcagtgcatgcatcctttgagtgtgcacctgacaaaacagctgtgctgttgtagcgtcggaaaggcctggggaccccattgcgaaaagtgccccctccctggcaccgccgcattcaaggaaatttgccccggtgggatggggtatacagtgagtggggtccataggaggcgcccgatccatcaccatgtcggcaaggggcctgtcttcgttaaaccaaagaacacgcagcctgtggcgaagagcactcacccgccccctctgcccgccaaggaggagcccgtcgaggccctcacattctctcgcgagcacggacccggggtggcagagcccgaggtcgcaacggcaccacccgagaaagaaattccctctctcgaccaggaaaaaaccaagctcgagccaggccaaccgcagttgtctccaggtataagcactattcatctccatcctcaattccccgggatagttatcgaaaaaactagtcccccagtcccagttgaggtggccccggaagcttcaacctccagcgcttcacaggtaattgctcccacacaggtgacggagatcaatgagtgcacggtcaatcctgacatttgtggcgcagggcattgcattaatcttcccgtccggtatacatgcatttgctacgaaggatatagattctctgagcagcagcggaaatgtgtggatattgatgaatgtacccaggtgcagcacttgtgtagccagggaaggtgcgagaacactgaaggatctttcctatgcatttgcccagcgggctttatggcgtccgaggagggtaccaattgcatcgatgtagacgagtgcctgcggcccgatgtgtgtggagaaggccattgtgttaacactgttggagctttcagatgcgagtattgtgattctggctatcgaatgacgcagcgtggaagatgtgaagacatcgacgaatgtctgaatccctccacctgtcctgacgagcagtgcgttaatagccctggcagctaccagtgcgttccctgtacagagggctttcggggctggaatggccagtgcctcgacgtggacgagtgcctggagcctaatgtctgcgcaaatggcgactgttctaaccttgagggctcatatatgtgcagctgccataagggctacacccggacacccgatcataaacattgtcgggacattgacgaatgtcagcagggtaacctctgtgtcaatggtcagtgtaaaaacaccgagggcagttttagatgtacatgtgggcagggctatcagctctcagccgccaaagaccagtgtgaagatattgacgagtgtcagcataggcacctgtgcgcacatggccaatgcagaaatactgagggctcatttcagtgtgtatgcgaccagggatacagggcgagcggattgggagatcactgtgaagatataaatgagtgtcttgaggacaaaagcgtctgccagcggggcgattgcataaatacagctggtagctacgactgtacatgtcctgatgggtttcaattggacgataacaaaacatgccaagatatcaacgagtgcgaacaccccggtctgtgtggcccccagggggaatgcctgaacactgagggatcatttcattgcgtctgtcaacaggggtttagtatcagcgccgatgggcgaacctgtgaggacatcgatgaatgcgtgaataatacagtgtgcgatagccacggcttctgcgacaataccgcaggttcatttaggtgcctctgctaccagggtttccaagcgccccaagatggacaggggtgcgtggacgtcaacgaatgtgagctactctctggagtgtgtggcgaagcattttgtgaaaacgtggaaggctcgtttctgtgtgtctgtgctgacgaaaaccaggagtactctcctatgacgggccagtgcagaagcaggacatctacagatctagacgtcgacgtcgatcaacccaaggaggaaaagaaagaatgctattataacttgaacgatgctagcctgtgcgacaatgtgctcgctcctaacgttactaaacaggagtgttgttgtacttccggagtgggctggggggacaattgcgaaatcttcccatgtccagtcctgggaacagccgagtttacagaaatgtgcccaaaaggaaagggttttgtgcccgcaggagaatctagctctgaggctgggggcgagaactataaagacgcagacgagtgtcttctcttcggccaggaaatttgcaaaaacgggttttgcctgaacaccagacccggttatgaatgttactgcaagcagggtacatactacgatcccgtgaaactccagtgcttcgacatggatgaatgtcaggatccctcaagttgtatcgatggccagtgtgtgaacacagagggatcatacaactgcttctgtacccaccccatggtgctggacgctagtgaaaagcggtgcattcgacctgccgagagtaatgagcagatagaagagacggatgtgtaccaggatctctgctgggagcacttgtctgacgaatacgtgtgtagccggccccttgtcgggaagcagaccacttatactgaatgttgctgcctctacggcgaggcctgggggatgcagtgtgccctttgcccccttaaagacagtgacgactacgctcagttgtgtaacattccggttacagggcgacggcagccgtatggcagagacgctctggtggactttagcgagcaatacacccctgaagccgatccgtacttcatccaagacaggttcctcaactcttttgaggaactgcaggcagaggagtgtggaattctgaatgggtgtgagaatggcaggtgcgtgagggtgcaggagggctatacttgcgactgcttcgatggctaccacctcgatacagccaaaatgacttgcgtggacgtgaacgagtgtgacgaactaaacaaccggatgagtctgtgcaagaatgcgaaatgtattaatacagacgggtcctataaatgtctgtgtctgcccggttacgtgccctcagacaagcctaattactgcacccctttaaatacagctctgaatctggaaaaggactcagatctagagtag

SEQ ID NO: 121961 - DNA, 4191 bp, Artificial Sequence
  Description of Artificial Sequence: Synthetic coding sequence
atggacactaaactcatgtgtctgttgttcttttttagcctgccacctctgcttgtgtctaaccacactgggcgtatcaaggtcgtattcactccctctatttgtaaggtgacatgcacaaaggggtcctgccagaactcctgtgaaaaaggcaacactactacgctgattagcgagaatggccatgccgccgatacactgacagcgacaaatttccgtgtggtgatctgccacctcccttgtatgaatggcggccagtgctccagccgcgataagtgtcagtgcccgcctaattttaccggaaagctctgccagattcctgttcatggggcttcagtgcccaaactctaccaacacagtcagcaaccggggaaagccctcggaactcatgtgattcattcaacacacacattgcctcttactgtgacctcacagcagggcgtgaaggtgaagttcccccctaacatagtgaacattcacgtcaagcatccccccgaagcttccgtgcagatccaccaggtgtcgagaatcgacggtccaacaggccagaaaacaaaggaggcccaaccaggacagtcccaggtttcgtatcaaggattacccgtgcagaagacacagaccatccactcaacttattcacaccagcaggtgatcccacacgtctatcctgtggccgcaaaaacccagttgggccggtgctttcaagaaactataggatcccagtgcggcaaagctctacctgggcttagcaaacaggaggactgctgcggcacagtgggcacctcctggggcttcaacaaatgccagaagtgccccaaaaaaccctcctatcatggctataatcaaatgatggagtgcctgcctgggtataaacgcgtgaataacacgttttgccaggatattaatgagtgccagctccaaggagtgtgccctaacggagagtgcctgaacaccatgggcagctaccgctgcacgtgcaaaatcgggttcggcccggatccaacattctcctcctgcgtgcccgaccctccggttatcagtgaggagaaggggccctgctaccgcctggtatcatccggccggcaatgtatgcatcctttaagtgtacaccttaccaagcagctgtgctgttgctctgttggtaaggcctgggggccccattgcgagaaatgccccttacccggaacggccgcgtttaaagagatttgccctggcgggatgggatacacagttagcggagtgcaccgacgacgccccattcaccaccatgttggaaaggggcctgttttcgtcaagccgaaaaacacccaacccgtagcgaaaagtacgcaccccccaccactgccagccaaggaggaacccgtggaggccctcacctttagcagggagcatggacccggggttgcagagcctgaggttgcaacagcgcctccggaaaaagaaatccctagtcttgaccaggagaagaccaagctggaacctggccagccacagctcagtccaggtatcagcacgatccatctgcaccctcagtttcctggcatagtcattgaaaaaaccagtcctcccgttcccgttgaagttgctcccgaagctagtacatcctctgccagtcaggtaattgcccctacgcaggttacagagatcaatgaatgcactgttaacccagacatttgtggcgccggacactgcattaatctcccagtgcgatacacttgtatatgctacgaaggttatcgattcagtgagcagcagcggaaatgtgtggatatcgacgagtgtacgcaggtccagcacctgtgctcacagggacgatgcgaaaatactgaggggagctttctgtgtatttgccccgcaggcttcatggcttctgaagaagggaccaactgtatcgacgtggatgagtgtttaagacctgacgtctgcggggagggtcattgtgtgaataccgtcggtgccttccggtgcgagtattgtgactcggggtatcggatgacccagcggggacggtgtgaagatatcgatgaatgtttgaatccttccacttgtcccgacgagcaatgtgtcaactcaccgggaagctatcagtgtgttccttgcacagaagggtttcgcggctggaacggtcaatgtctggacgtggacgaatgcttagagcctaatgtgtgcgccaatggcgactgtagcaatctcgagggctcttacatgtgttcttgccacaagggctacacacggacccccgaccacaagcattgccgggatattgacgagtgccaacagggaaacctttgcgtgaatgggcagtgcaaaaatacagagggttcgttccgttgcacctgcggccagggataccagctgtccgcagccaaagaccagtgtgaggacattgatgagtgccagcacaggcatctctgtgcccacggtcaatgccgcaataccgaggggtctttccagtgcgtgtgcgaccagggatacagggcctcaggtcttggcgaccactgcgaggacatcaatgagtgcctggaagataaaagcgtctgtcagagaggggactgcatcaatactgcaggcagctacgattgcacatgcccggacggcttccaactggacgataacaaaacatgccaggatatcaacgaatgtgagcacccggggctctgtggtccccagggcgagtgtcttaataccgaaggcagttttcattgcgtgtgtcagcagggctttagcatttctgcagacggccgtacttgcgaagacatcgacgaatgcgttaacaataccgtttgtgacagccacgggttttgtgacaacacagccggatctttccgatgcctctgttaccagggattccaagcaccacaggacggacagggatgcgtggatgttaatgaatgtgagctgctctcgggcgtttgtggcgaagcattttgtgaaaacgttgaagggtcttttctctgtgtgtgtgccgatgagaatcaagagtacagtcccatgacaggacagtgtagatctcgcacgtccactgatcttgacgtagacgtggatcaaccaaaagaggaaaagaaggagtgctattacaatctgaacgacgcctctctctgcgacaacgtgctggcccctaatgtcacaaaacaggaatgctgttgtacttctggcgtaggctggggagataattgcgaaatatttccttgtcctgtcctggggactgcagaatttacagaaatgtgtccaaagggaaaagggtttgtccccgcaggagaaagctctagcgaggccggtggcgaaaattacaaggatgcagatgagtgcctgctgtttggtcaggagatctgcaaaaacggattttgcctcaacactaggcctggttatgaatgctattgcaaacagggcacctattacgacccagtgaaattgcaatgctttgacatggacgaatgccaggatccttcctcttgcatagatggacagtgcgtcaacacagagggttcctacaattgtttttgtacgcaccctatggtcttggatgccagcgagaagcgctgcattaggccggctgaaagcaacgaacaaattgaggaaacggatgtttatcaagacctttgctgggagcatctctccgatgagtacgtctgctcccgtccgctggtcggtaaacagaccacttatactgagtgttgttgcctctacggagaggcctgggggatgcaatgtgccctctgcccccttaaggacagcgacgactacgcccagctgtgtaacatccctgtgactgggagaaggcaaccttatggaagggacgctctcgttgacttttccgagcagtatacccccgaagctgacccatatttcattcaggaccgattcctcaatagcttcgaggagctgcaagctgaggagtgcggaatcctgaatggctgtgagaacggccggtgtgtccgtgtgcaggagggttatacctgcgactgttttgacggatatcacctggatactgcaaagatgacctgtgtcgatgtcaatgagtgcgatgagcttaataataggatgagcctgtgcaaaaacgcgaagtgcattaacacagacggaagctacaaatgtctatgcctgcctggttatgtgccctccgataagccaaactactgtacaccactgaataccgcgctgaatttggaaaaagacagtgatctggaatag

SEQ ID NO: 121962 - DNA, 5166 bp, Artificial Sequence
  Description of Artificial Sequence: Synthetic coding sequence
atggctggcgcttggctccgttggggcctgttattgtgggcaggactgttagcttcaagcgcccacggtcgtctgaggaggatcacctacgtcgtccatcctggtccgggcctcgcagccggggcactccccctcagcggcccaccgagaagcagaactttcaatgttgcactcaacgcacgctactcacggtcgagcgccgccgcgggcgccccatctagagcttcccctggcgtacccagcgaaaggacacgaagaacatctaaaccagggggtgctgccctccaaggcctccgaccaccccctccacccccaccagagcccgctaggcccgcagtgcctggcgggcaacttcacccaaatcctgggggccacccagccgcggctccttttacaaagcagggtcgccaagtggtgagatcaaaagtcccgcaggagacccaatctggcggtggtagccgcttgcaggtgcatcaaaaacaacaactgcagggcgtaaatgtctgcgggggaagatgctgccacggctggtccaaagcgccagggtctcagagatgtacaaaaccctcttgtgtgccaccctgtcagaatggcggtatgtgccttcgaccacaactatgtgtgtgtaagcccggcacgaagggaaaggcttgcgagactatcgccgcccaagacaccagctcccccgtgttcgggggacagtcccccggtgcagccagtagctgggggcccccagaacaggccgccaaacatacgtcgtctaagaaggccgatactctccctcgggtctctccagtggcacagatgactttgactctgaaacctaagccatcagttggcctcccccagcagattcattcacaggtgacccccctgtcttcacaatccgttgttattcaccatgggcagacccaggagtacgtactgaagccaaaatacttcccagcgcagaagggcatttcaggagaacaaagcactgagggatccttcccactgagatacgtgcaggaccaggtggccgcccctttccagctctccaaccatacaggcagaatcaaagtcgtgttcacaccaagtatttgcaaagtaacctgcacaaaaggatcctgtcagaatagctgtgagaaagggaatactacaaccttgatttcagaaaacggacacgctgcggacacactgactgctacaaatttccgcgtggtgatttgccatttaccatgtatgaacggaggccaatgctctagccgcgataaatgtcagtgccctccgaatttcacgggtaagctctgccagatccctgtacatggtgcgagcgtcccaaaactgtaccagcactcacagcagcccgggaaagcactcggaacccacgtcatccactcgactcatacgctgccactcaccgtgacctcacaacagggggtcaaggttaagttccccccgaatatcgtgaatatacacgttaaacatccccccgaggccagcgtgcaaatccatcaagtgagccgcatcgatgggcccacagggcagaagacaaaagaagcccagccgggacagtcacaggtctcctatcagggccttccagtccagaagactcagaccattcattccacttactcccatcaacaggtcatccctcacgtctacccagtggccgcaaagacccagttaggacgctgctttcaggaaactatcgggagccaatgtggtaaagctcttcccggcctgtcgaagcaagaggattgctgcggaaccgtcggtactagttgggggtttaataaatgtcagaaatgccctaaaaagcccagctaccacggatacaaccagatgatggagtgtctcccaggctataaacgtgtcaacaataccttttgtcaggatataaacgaatgccagttacagggagtgtgtcctaatggggaatgtctgaacaccatgggttcctatcgctgtacatgcaaaattggattcggcccagaccctaccttctcctcttgcgtcccagacccgcccgtgatttccgaagaaaagggtccttgctataggctcgtgagcagcggtcgccagtgtatgcatccccttagcgtccatctgactaagcagctgtgttgttgtagcgtgggcaaggcttgggggccacactgtgaaaagtgtcccttgcccgggactgccgcatttaaagaaatctgtcccggcggtatgggctatacagtgagcggagttcacaggcgacggccaattcatcaccacgtggggaaaggcccagtgtttgtaaaacccaaaaatacacagccagtagctaaatcaacacaccctcctccattgcccgctaaggaggaacccgtagaggccctcactttcagtagggaacatggacctggagtagcagaacctgaagtcgctaccgcgcctcctgaaaaggaaatcccctctctggatcaggaaaaaactaaactggaacccgggcagccacaactgagcccgggcatctctaccatccacctgcacccccaattccccgtggtcatcgaaaagacatccccaccagtcccggtggaagtggcaccagaagctagtacaagtagtgcgtctcaagtgatagcaccaacccaagtaacagagataaatgaatgtacagtgaaccccgatatatgcggcgctggccattgtattaatctgcccgtaagatatacttgtatatgctatgagggttatcgcttctcagagcagcagcgtaaatgtgtcgacatcgatgaatgcacacaagtgcagcatctctgcagccaagggcggtgcgaaaacactgagggctctttcctttgcatctgccccgctggctttatggcttccgaggaaggcaccaattgtatcgatgttgatgaatgcctgcggcctgatgtgtgcggggaaggtcattgtgttaacaccgtcggagcctttagatgcgagtattgcgatagcggctatcgaatgactcaaagggggcggtgtgaggacattgacgagtgcctgaatccgtccacatgtccagatgaacagtgtgttaactctccaggcagctaccagtgtgttccgtgcaccgaagggtttcgagggtggaacgggcagtgcttagacgtcgacgaatgcctcgaacccaacgtatgtgctaatggcgattgcagcaatttagagggctcctacatgtgttcctgtcacaaagggtatacacgtaccccagatcacaagcactgcagggacatcgatgagtgccagcagggtaatctgtgcgtgaacggccagtgtaagaacaccgaaggatcctttcgctgcacctgcggacaaggataccaattatcggcagctaaagaccagtgcgaggatattgacgaatgccaacaccgccatctgtgcgctcacggccagtgcaggaacaccgagggctcgttccaatgcgtttgcgatcagggttatagggcaagcggattaggagaccactgcgaagacattaacgagtgcctcgaggacaaatcagtttgtcagagaggagactgtatcaatacagccggcagctacgattgcacatgcccagatggattccagctagacgacaacaagacgtgccaggacattaacgaatgcgagcaccctggcctgtgtggcccacagggagagtgtttaaacacagaaggcagcttccactgcgtatgccagcaaggttttagtataagcgcagacgggagaacttgtgaggacattgacgaatgcgtcaataacacagtgtgcgacagccacggcttctgtgacaacacggccggctcattccggtgtttgtgttatcagggctttcaggccccacaggacggccagggatgcgttgatgttaatgaatgtgaactgctgtccggagtgtgcggcgaggccttctgcgaaaacgtggagggcagctttttgtgcgtatgtgccgatgaaaatcaggaatacagccccatgacaggtcagtgcagatcccgcactagtacggatctggatgttgacgtcgaccagcccaaagaggagaaaaaggaatgctactacaacctcaacgacgcatctctgtgcgacaatgtgctagcacctaatgtgacaaaacaggaatgttgttgtaccagcggagtggggtggggcgacaactgtgaaattttcccttgtccagtcctgggaaccgcagaatttacggagatgtgtcctaaggggaaggggtttgttcctgcaggggaatcaagcagtgaagctggcggcgaaaactataaggatgccgacgagtgcctgttgtttggacaagagatctgcaagaatggtttttgtctgaatacaaggccaggctacgaatgttactgcaaacaagggacttattatgatcccgtgaaacttcagtgctttgatatggatgaatgtcaagaccccagctcctgcatcgacggccaatgcgttaatacagaagggagttacaactgtttctgcacacatccgatggtgttagacgccagcgagaagagatgcatccggcccgccgagtccaacgaacagatcgaagagacagacgtataccaggacctctgctgggagcacttgagcgacgaatacgtgtgttccaggccactcgtgggcaagcagacgacctacactgaatgctgctgcctctatggggaggcctgggggatgcagtgcgccctctgtccactcaaagattccgatgattacgcacaactgtgcaatatccctgtgaccggtaggagacaaccttatgggcgcgatgctctggtggattttagcgagcagtacaccccagaggcagacccttacttcattcaagatcggtttctgaactcattcgaagagctgcaggctgaagaatgtggaattctcaatggctgcgagaatgggcggtgtgtaagggttcaggagggatacacctgcgactgctttgacgggtaccatctagatactgctaagatgacgtgtgtggacgttaatgaatgcgacgagctcaacaacaggatgtcactgtgcaagaatgcaaaatgtatcaatacggatggtagttataagtgtctgtgtctgccaggctacgttccctccgacaagcctaattactgtacgccactgaataccgccctgaatctggagaaggatagcgatttagagtag

SEQ ID NO: 121963 - DNA, 4188 bp, Artificial Sequence
  Description of Artificial Sequence: Synthetic coding sequence
atggatacgaaactgatgtgcctgttgttttttttttctttgccccccctactcgtgagcaatcacaccggtagaattaaagtcgtcttcactccctctatctgcaaagtaacatgcactaagggcagctgtcaaaatagttgcgaaaaaggcaacacaaccactctcatctctgagaacgggcatgccgccgatacgctcaccgctactaactttcgggtcgtgatttgccacctaccctgtatgaacggaggacagtgtagcagtagggataagtgtcagtgccctcccaattttaccggcaaactgtgccagatcccagtccacggtgccagcgttccaaagctttaccagcattctcagcagcccgggaaagccctcggcacccatgtcatacacagtactcatactctgcccctgaccgtgacctcccagcagggtgtcaaggtcaaatttccccctaacatcgtgaacatccacgttaagcatccgcctgaagcaagtgtccaaattcaccaagtatcccggattgacgggcccaccggacagaaaaccaaagaggcccaaccaggtcagagccaggtgtcataccaaggtctcccagttcaaaaaacgcagacaattcactcaacttactcgcatcaacaggtgatcccacatgtttaccctgtggctgcaaaaacccagcttggcaggtgtttccaggaaaccattggatctcagtgcggtaaggccctcccgggcctgagcaagcaagaggattgctgtggcaccgtgggtacgagctggggcttcaacaagtgccagaagtgtccaaaaaaaccttcctaccacggatacaatcaaatgatggaatgcctcccaggatacaagagagtgaataacacattctgccaggacattaatgagtgccagctgcagggagtgtgtcctaacggggagtgtctgaacactatgggcagctaccgttgtacttgtaagatcggatttgggcctgatcctacgtttagttcatgtgtgccagatccccccgtcatcagtgaagaaaagggaccatgttatcgccttgtaagttcggggaggcagtgtatgcacccgctctcggtccacttaaccaagcagctctgttgctgctccgtgggcaaagcctggggaccccattgcgaaaaatgtcctttgcccggaacggctgccttcaaggaaatttgccccggaggcatgggctataccgtcagcggcgttcacaggcggagacccattcaccaccatgtggggaaaggaccagtcttcgtcaagccaaaaaacacacaacccgtggccaagtctacgcacccaccaccactgcccgcaaaagaggagcccgtcgaggcccttaccttttctagagagcacggaccaggcgtcgcggagccagaggtggccacagcaccccccgagaaagagattcccagccttgaccaggagaaaactaagcttgaacccggccagccccaattaagccctggtattagtaccatccatctgcatccccagtttccagtggtgatcgaaaagacctctcctccagtgcccgtggaagttgcccctgaggcatccactagctctgcatcgcaggtgatcgcccccacccaggtaaccgaaattaacgaatgtaccgtcaatcctgacatctgtggagctgggcactgcattaacctccccgtgagatatacctgcatctgttacgaaggctataggttctcagagcagcagcgaaaatgtgtggacatcgacgagtgtacccaagttcagcatttatgttcccaaggtaggtgcgagaatacggaaggctcgtttctctgcatatgtcccgccggattcatggcctcagaagagggaaccaactgtatagatgtggacgagtgcttacgccccgatgtgtgcggggaagggcactgcgtgaataccgttggtgcgttccgctgcgagtattgcgacagtggataccgcatgacccaaaggggcaggtgcgaggacatcgacgagtgcctgaacccgtccacatgccccgacgagcagtgtgtgaactcacccgggtcttatcagtgcgtaccttgtaccgagggcttcagaggctggaacgggcaatgcctagacgtcgacgagtgtttggagcctaacgtttgcgccaacggagactgctccaacctggaaggctcatatatgtgttcgtgccacaagggatacactcggacacctgatcataaacactgtcgcgacattgatgagtgtcagcagggcaatctgtgtgtaaatggccagtgtaagaacacagaaggatcctttaggtgcacttgcggccagggataccaactgagcgccgctaaggaccagtgcgaggacatcgacgaatgtcagcaccggcacctttgcgcacacggacagtgtaggaacactgaaggcagcttccagtgtgtgtgcgaccagggttatagggccagcgggctcggagatcattgcgaggacataaacgagtgcctggaagataagagcgtgtgccagcggggagattgcatcaacaccgccggatcatacgattgtacatgccctgatgggttccagctcgatgacaacaagacctgtcaagatatcaacgagtgcgagcacccaggcctttgtggcccccagggtgagtgtctgaataccgagggaagcttccactgcgtctgccagcagggcttctccattagcgcagatgggcgaacatgtgaagacattgacgagtgtgtaaacaacacagtctgtgatagccatgggttctgcgataacactgcaggttcctttcgatgtctgtgctatcagggtttccaggcaccgcaagatgggcagggatgcgtggacgtgaatgagtgcgagctgctttcaggagtctgtggtgaggctttttgcgagaacgtggaagggtcattcttatgtgtgtgcgcggacgagaaccaagaatacagcccgatgacaggccagtgcagatcacgaacctccactgatctggacgtagatgtcgaccagcccaaagaagagaagaaggaatgttattacaacctgaatgacgctagcctgtgtgacaacgtgctagcccctaatgtgaccaaacaggagtgctgttgtacatccggagtgggctggggagataactgcgagatctttccttgccctgtcctgggcactgccgagtttaccgagatgtgccctaagggtaaaggcttcgtgcccgctggcgagagttcatctgaggcagggggggagaattataaggacgcggacgaatgtctcctcttcggacaggaaatctgcaagaatggattctgcttaaatacccgcccaggttacgaatgttactgtaagcaaggcacttattacgacccagttaaattgcaatgttttgacatggacgaatgccaggatcccagctcgtgtatagacggacagtgtgtaaatacagaaggcagttataactgcttctgtacacaccccatggtgttggacgcctctgaaaagcgttgcattcggcctgccgaatctaatgaacaaatagaggagactgatgtgtaccaggatctttgctgggagcatctttccgatgaatatgtgtgtagtcggccactcgtgggtaagcagactacatatacagaatgttgttgcctgtatggcgaggcgtggggtatgcaatgtgctctgtgcccactgaaggactctgacgattatgcacagctgtgcaacattcctgttacaggtcggcgtcagccctacgggagagacgctctggtcgattttagcgagcagtatactccagaggctgacccatatttcattcaggaccgatttctcaactccttcgaagagcttcaggccgaagagtgtggaatcctcaacggctgtgagaacggccgatgcgtgagggtgcaggagggctatacctgcgattgctttgatggctaccaccttgacacagctaagatgacctgcgttgacgtaaatgagtgcgatgaactgaacaaccgtatgagcctctgtaaaaatgctaaatgcatcaatacggacggctcgtacaaatgtctgtgcctgcccggctacgttccaagtgacaaaccaaactattgcaccccactgaataccgctctcaatcttgagaaagacagtgacctggagtag

SEQ ID NO: 121964 - DNA, 4062 bp, Artificial Sequence
  Description of Artificial Sequence: Synthetic coding sequence
atggacacgaagttgatgtgtctgctgttttttttctccttgccacctctcctagtgtctaatcataccggacgcatcaaagttgtgtttaccccaagtatttgtaaagtcacatgtacaaagggctcttgtcagaactcctgcgaaaagggtaacaccacaaccttgatcagtgagaacgggcatgctgccgacaccctgacggctacaaacttccgcgttgtcatctgccatctgccctgcatgaatgggggccagtgcagtagccgggacaagtgtcagtgtccaccaaattttacaggaaaactgtgtcaaattccagtgcacggcgccagtgtgcctaagttatatcaacactcacagcagcccggaaaagccctcggcactcacgtgatccactccacccacacactccctttaaccgtcacctctcagcaaggcgtgaaggttaagtttcctcccaatatagtaaacatccacgtgaagcatccgccagaggcttcagtgcagattcatcaggtgagccggattgatggcccgacgggacagaagacaaaggaagctcagcccggacagtcccaggttagttatcagggcctgcccgtccaaaagacgcagaccattcattccacgtatagtcaccagcaggttatcccgcacgtctacccagtcgcagccaaaactcagctgggcagatgctttcaagaaaccatcgggagccagtgcggcaaggcgctgcccggattgtcaaaacaggaggactgttgcggaactgttggcacatcatgggggttcaacaagtgtcaaaagtgtcctaagaagcctagttaccatggttacaatcaaatgatggagtgcctgcctggatacaaaagggtcaacaacacattctgccaggatatcaacgagtgtcaactccagggggtatgccccaacggcgagtgcttgaacacgatgggcagctaccgttgtacctgcaaaatcgggtttggaccggatcccactttctcatcttgcgtgccagacccacccgtgatctccgaagaaaagggaccctgctataggctggtgtcttctggccgccagtgcatgcaccctctgtccgttcacctgaccaagcagctgtgctgttgttcagtgggcaaggcatggggcccacactgtgagaagtgtcctcttcctggtaccgccgccttcaaggaaatctgtcctggtgggatgggctacacagtcagcggggtccatcggcgtagacccatccatcaccatgtggggaagggaccggtctttgttaagcctaaaaacactcagcctgtggcgaagagcacccaccccccccctctccctgccaaggaggaacctgtcgaggctcttaccttcagccgggagcacgggcccggcgtggcagagcctgaagttgcaacggccccacccgagaaagaaatcccgtctctagaccaagagaagactaagctcgagcccggccagcctcagctgtcccctggcatttccaccatccatcttcacccacagttccctgtggtaatagaaaaaaccagcccgcctgttcccgtggaagtagctcccgaagcttctacttcaagcgcctcacaggtgatagccccaactcaagttacagagatcaacgaatgcaccgtgaatccggacatttgcggggccggtcactgtatcaatctgccagtccggtatacctgcatctgctacgaaggctacagattctcagagcagcaaagaaaatgcgtcgatatcgacgagtgcacgcaggtgcagcacctgtgctcccaaggcagatgtgagaataccgaaggcagcttcctctgcatttgtcctgccggattcatggcctcggaggaaggcacaaactgcatagatgtggacgagtgtctccgcccagatgtgtgtggagaagggcattgcgtcaatactgtgggagcatttaggtgtgaatactgcgactccggttataggatgacgcaaaggggtaggtgtgaggatattgatgaatgtctgaaccccagtacatgcccagatgaacagtgcgtcaattcgccgggttcctatcagtgcgtcccctgcactgagggcttccgagggtggaacgggcaatgcctggatgttgacgagtgtttagagcccaatgtttgtgccaacggcgattgtagcaatctcgaagggagctacatgtgttcctgccacaaagggtacactaggacacctgatcataagcactgcagggacatcgacgagtgccagcaggggaacttatgtgttaacggtcaatgcaagaatacagaggggtcctttcggtgtacctgcggccagggataccagttatccgccgccaaggaccagtgcgaagacattgatgagtgccagcaccgccatctgtgcgcccacgggcagtgccgcaacaccgagggaagctttcaatgcgtatgcgatcagggataccgagcgtctgggttaggtgatcattgtgaagacattaacgagtgtctcgaggataagagtgtatgccagcggggcgactgtattaacactgccgggtcttatgactgtacttgccccgatggcttccagctcgatgataataagacatgtcaggatattaacgagtgtgaacatcccgggctatgtggcccacaaggggagtgtctgaacacagagggatcatttcactgcgtttgccagcagggctttagcatatcggctgacgggcgcacttgcgaagatgtgaatgagtgtgaattattgagcggtgtttgtggagaagctttttgtgagaatgtcgagggctcttttttatgcgtctgcgccgacgaaaatcaggaatattcacctatgactggtcagtgcagatcaaggacctcgacggatttggatgtggacgtcgatcagcccaaagaggaaaagaaggagtgctactataacctaaatgatgcttcactttgtgacaatgtgcttgcgcccaatgtgacaaaacaagaatgttgttgcacatccggcgttggctggggtgacaattgtgagatctttccctgtcctgtgctgggaaccgccgagtttacagagatgtgtcctaaaggaaaaggcttcgttccggctggggagtcgagctccgaggctgggggcgagaattataaagacgccgatgagtgtctgctctttggacaggagatatgcaaaaacggcttttgcttaaacactcggcctggctacgagtgttattgtaaacagggaacatattacgatcctgtgaagctccaatgctttgacatggacgaatgtcaagacccctctagttgcatcgacggccagtgtgtaaatacagagggatcttacaattgtttctgcacccatcccatggtgctggacgcttcagagaaaagatgtatccgtccagccgaaagcaacgaacagatcgaagaaaccgacgtctaccaggacctgtgttgggaacacctcagtgacgagtatgtatgcagcagacccctggtgggaaaacagactacatacaccgagtgttgctgtctgtatggcgaagcctggggcatgcagtgcgctctttgtccactgaaggactctgacgactatgctcagctgtgcaatattcccgtgacagggagaaggcagccctacgggcgtgatgccctggtggatttcagcgaacaatacacccccgaggcggatccctatttcattcaggatagattcctgaactcctttgaagagctccaggcagaggaatgcggtattcttaatgggtgcgaaaatgggaggtgcgtgcgcgtgcaagaaggttatacttgcgactgcttcgacggataccacctggacactgcgaagatgacgtgtgttgatgtgaacgaatgcgacgaattaaacaaccggatgtccctgtgtaaaaacgccaaatgcatcaataccgacggatcgtataaatgcctctgtttgcccggatacgtccccagcgacaagcctaactattgtacacccctgaatacagcacttaatcttgagaaagactccgatctggaatag

SEQ ID NO: 121965 - DNA, 4029 bp, Artificial Sequence
  Description of Artificial Sequence: Synthetic coding sequence
atggacacaaagttgatgtgtctgctctttttcttctctctgccaccactgctggtatccaaccatactggcaggatcaaggtggtattcacccctagtatttgcaaagtcacgtgcaccaaaggatcttgtcagaatagctgcgagaaagggaacacaaccaccttgatcagcgaaaacggacacgcggctgatacactcacagcaaccaactttcgcgtcgtcatatgccacctcccttgcatgaatggagggcaatgttcttcgcgtgataaatgccagtgtcctcccaattttactggaaaattatgccaaatcccggtgcatggcgccagtgtgccgaaactgtaccaacacagccagcagcccggaaaagctctggggacacacgtaatacactccacgcatactttgcctctgaccgtcacctcccagcagggtgtgaaagtgaagtttccaccaaatattgtcaacatacatgtaaaacaccctccggaggctagcgtgcagatacaccaggtgagtcggatcgacggtcccaccggccagaaaactaaagaagcacagccgggacaaagccaggtctcctatcagggattgccagtgcaaaaaactcaaacgatccattcaacatatagccaccagcaagttattcctcatgtgtatcctgttgctgcaaaaacgcagctagggagatgctttcaggagaccatagggtcccagtgcggtaaagctttgccgggcctctcaaagcaggaagactgttgcgggacggtcggaaccagctggggtttcaacaagtgccagaagtgcccaaagaaaccctcctatcacggatataaccagatgatggaatgcttgcctggatataagcgggtgaacaataccttttgccaagacattaacgagtgtcagctccaaggagtttgtcctaacggcgagtgcctgaatacgatgggctcctataggtgcacctgtaagatcggttttggtccggaccctacattcagctcctgtgtgcctgaccccccggtcatcagcgaagaaaaggggccatgttatcgtctcgttagtagcggaaggcagtgcatgcacccattgtcagtacatctcactaagcagctatgctgctgctctgtcggcaaagcatggggccctcattgtgaaaaatgtcctctccctggaacggccaaagaagagcccgtcgaagcattgacattctcccgtgagcacggccccggcgtggccgagcctgaagtggcgacagcgccgcccgagaaagagataccatcacttgatcaggaaaagactaagttggagcctgggcagcctcaactgagtccagggatctctaccatccacctgcaccctcagtttccagtggtgatcgagaagacatccccacccgtgcccgtggaagtggcccccgaggcttcgacctcctcggcctctcaggtcattgcccctacgcaggttacagagatcaacgagtgcacagtcaatcctgacatctgcggcgccggtcactgcataaatcttccagtacgctacacctgtatttgttacgaaggttataggttttcagagcaacaacgaaagtgcgtggacattgatgagtgcacacaggtgcagcacctctgttctcagggccggtgcgagaacactgagggtagcttcctgtgtatctgcccagcagggtttatggcatcagaggaaggcactaactgcatagatgtcgacgaatgtctgaggcctgatgtgtgtggcgaaggacactgtgtaaataccgtaggcgcctttcgatgcgaatactgtgattcagggtacagaatgacccaaagaggaaggtgcgaggatatcgacgagtgtctgaacccgtcaacctgtcctgacgaacaatgcgttaactctcctggaagctaccagtgtgttccctgtactgagggttttcgtggatggaatgggcagtgcctggacgtggatgaatgtctcgagccgaacgtgtgtgcaaacggtgattgctccaacttggaaggctcttatatgtgctcttgtcataaaggctacacgcggacaccggatcacaagcactgtcgcgacatcgacgagtgccagcagggtaacctctgtgtcaatgggcagtgcaaaaatacagagggctcctttcgatgtacctgcggacagggataccagcttagcgctgcaaaagatcagtgtgaagacatagacgagtgccagcacagacacctttgtgcgcacggtcaatgcagaaacacagagggcagcttccaatgcgtgtgtgatcagggctaccgagcctctggactcggcgaccattgtgaggatattaatgaatgtttagaagataagtctgtctgccagcgaggtgattgcatcaatacagcgggaagctatgattgtacttgcccggatggctttcagttggacgataataagacttgtcaggacatcaacgagtgtgaacaccccggcctctgcggtccccagggggagtgccttaatactgaggggagtttccactgcgtgtgtcagcaggggttttctatttctgctgacggaagaacatgcgaggatatagacgagtgtgtgaataataccgtatgcgacagccatgggttttgtgacaataccgccggttcctttcgctgtctgtgctaccaggggttccaagccccacaagacggccaggggtgcgtcgatgttaacgagtgtgagctcctttctggtgtttgcggagaagctttctgtgagaacgtagagggctccttcctgtgtgtatgtgccgacgaaaatcaggaatactcgcctatgaccggacaatgtagatcccgcacctctactgatctagatgtcgatgtagatcagcccaaggaagaaaagaaagagtgttattacaacctaaacgacgcatccctgtgtgacaatgtcctcgcacccaacgtgaccaagcaagagtgttgctgcacatctggggttgggtggggtgacaactgcgaaatttttccgtgcccggtgctcgggaccgccgagtttacagagatgtgccctaaaggcaaaggctttgtgccggctggagagtcctctagcgaggcggggggggagaactacaaggatgcagatgagtgtttgttgttcggtcaggagatctgcaaaaacggcttctgcctgaacacaagaccgggctacgagtgttactgtaaacaaggcacctactacgatcccgtcaaactccagtgtttcgacatggatgagtgccaggacccttcttcctgcatcgacggacagtgtgttaatactgagggatcttacaattgtttttgtacacaccctatggtcctcgatgcctcagagaagcgctgcataaggcctgccgaatccaacgagcagatcgaggagacggacgtgtatcaggacctctgctgggagcatctgtcggatgagtacgtgtgttctaggcccctggttggtaagcaaacaacctatacagagtgttgctgtttgtacggagaggcctgggggatgcaatgtgctctgtgccctctgaaagacagcgatgactacgcgcagctctgcaacatccctgtgaccggaagacgccagccctacggacgtgatgccctggttgatttctcagagcagtatacacctgaggcagatccctactttatccaggatagatttttaaatagctttgaagagctgcaggcagaggaatgtggtatcctcaacgggtgcgaaaatggaaggtgtgtgcgggtccaggagggctatacttgtgactgttttgatggttaccacctggacaccgccaagatgacgtgtgttgacgttaatgagtgcgatgagctgaacaacaggatgtccctgtgtaagaacgctaagtgcattaacactgacgggtcttacaagtgtttgtgtctgcctggttacgttccatctgacaagcctaactactgcacgccgcttaatacagctctcaacttggagaaggacagcgacctagagtag

SEQ ID NO: 121966 - DNA, 5466 bp, Artificial Sequence
  Description of Artificial Sequence: Synthetic coding sequence
atgaggccacgaactaaagcccgcagcccaggcagggcgttgcgcaatccatggagagggtttctcccactcacactggctctgttcgtaggggccggccacgctcagcgggaccccgttggacggtatgagccagccggcggcgatgctaacaggctgcgacgacctggtgggagctatccagccgctgccgcagcaaaggtgtacagtctgtttcgggagcaggacgctccagtggcaggtctgcaacctgtggaacgagcccagccaggatggggatccccccgaaggccgactgaggccgaagcgagaagacctagccgcgctcaacaatccagaagggtgcagccacccgctcaaacccgcagaagtacgcccctgggtcagcagcagcccgccccacgcacccgcgccgctcccgccctgcctcgcttaggcactcctcaaagatcaggcgccgcaccaccgaccccaccccgggggcgactgaccgggcgaaatgtttgcggcggtcagtgctgcccaggttggaccacggcaaatagcacgaaccactgcatcaaacctgtgtgcgaaccgccctgtcagaatcggggcagttgctcgagaccccaattgtgtgtgtgtcgttccgggttccggggcgcaaggtgcgaagaggtgatccccgacgaagagtttgatccacagaactccagactggccccacgacgctgggccgaaaggtccccaaacctgcggaggagtagcgcagcgggcgagggaactctcgctcgggctcaaccgcctgcacctcagtcaccgcctgcgccgcagagtcctcccgccggcacactgtccgggctctcacagacccacccatctcagcagcacgtgggcctctctcgaactgttaggctgcaccctaccgcgacggcaagctctcagctgtctagtaatgcccttcctcctgggccagggctcgaacagagggacggaactcagcaggctgtgcccctcgaacacccaagctctccttgggggttgaatctcacagagaagatcaagaaaattaaaatcgtgtttacccctacgatttgcaaacagacttgcgcaaggggacattgtgctaatagttgtgaacggggagacaccaccactctgtacagtcaaggcggacatggacacgaccccaagagcgggttccggatctatttttgccagattccatgtcttaatggaggtcgctgcataggcagggatgaatgctggtgccctgctaacagtaccggaaagttttgtcatctgcccataccccaacctgatagggagcccccagggagagggtcacgcccccgagcactgttggaagcccctctgaagcaatcgaccttcactctgccattgagtaatcagctagcgagcgtgaatccctcgcttgtcaaagtgcacatccatcacccacccgaagcatctgtgcagattcatcaagtggcccaggtcaggggtggagtggaggaggcccttgtggaaaacagtgtcgagactagacccccaccctggttgccagcgtcacccgggcacagcctgtgggactcaaacaacatccccgcaaggtcgggtgagcctccgcgtcctctccctcctgccgcaccccggccccgtggcctgttagggcgctgctatctcaatacagtgaacggccagtgcgcaaatccattgctcgaattaaccactcaggaggattgctgtggatctgtaggggctttttggggcgtgaccctgtgtgccccttgtccccctagaccagcatcccccgtgatcgagaacggccaactcgagtgccctcaggggtacaagcggttgaacctaacccattgccaggacataaacgagtgccttactctcggactgtgcaaagatgctgagtgtgtaaataccagaggaagctacttgtgcacatgccggcccgggttgatgctggatccctcccgcagtaggtgcgtgagtgacaaggccatcagcatgctgcagggcttatgctacaggagtttgggaccagggacttgtacattacccctagcacagagaattaccaagcagatctgttgctgctcccgcgtaggcaaggcctggggaagcgaatgtgagaaatgtcctctcccaggtacagaggccttcagggaaatatgcccagcggggcacggatatacctatgcaagctctgacattcgtctgagcatgcggaaagctgaagaggaggaactggcccgtcccccccgggagcagggccagagatccagcggagccctccccggacctgccgaacggcagccactgcgggttgtgaccgacacttggctggaggcggggacgatcccagacaagggagactcccaggccggtcaagtgacgacatccgtgactcacgcgcccgcctgggtgacgggcaacgcaactacccctcccatgcccgagcagggaattgcagagatccaggaggaacaagtcacgcctagtactgacgtgcttgtgaccctgagtactccagggattgataggtgtgctgcgggagcaacaaatgtgtgtggcccaggcacctgcgtcaatctgcccgatggataccgttgtgtgtgctcccctggctaccagctgcatcctagccaagcttactgtacagatgataacgaatgtcttagagacccgtgcaagggcaagggcagatgtattaatagggtgggaagttattcctgcttttgctatcctggctacaccctggcaacgagcggcgctacacaggagtgccaggatatcaatgaatgcgagcaaccgggggtttgctctggcggtcagtgcacaaatactgaaggctcatatcactgtgagtgcgaccaagggtatataatggtacggaaggggcactgccaggatatcaatgaatgtcggcacccaggcacatgccccgatggccgctgcgttaacagcccagggagctatacttgtctggcctgcgaggaagggtacagagggcagagcggcagctgtgtagatgtcaacgaatgtctgactcccggagtatgtgctcacggtaagtgtactaatctcgagggttcctttcgctgttcttgtgaacagggatatgaggtcactagtgacgaaaagggatgccaagacgtcgatgagtgcgccagcagagcctcatgtcccaccggtctttgtttaaatacagagggtagcttcgcatgcagcgcctgtgagaatggctactgggtcaatgaagatgggaccgcctgtgaagatctggatgagtgcgctttccccggagtgtgtcccagcggcgtgtgtactaacacagcagggagtttctcatgcaaagactgtgatggcggctacagaccaagtccgctgggagattcatgtgaagatgtcgatgaatgtgaggacccacagagttcctgccttggcggtgaatgtaaaaataccgtggggtcttaccaatgtctttgccctcaaggatttcagctagccaacggcaccgtatgtgaagacgtgaatgagtgcatgggcgaagagcactgtgcaccacatggggaatgtctaaactctcacggtagtttcttctgtctgtgtgcaccaggattcgtcagcgcggagggcggaactagctgccaggacgtcgatgagtgtgccacaaccgatccatgtgtgggaggacattgcgttaacacagaaggaagcttcaactgcctctgcgaaacagggtttcaaccctccccagaaagcggcgaatgcgtagatatagatgaatgcgaagactacggggacccagtgtgcgggacttggaagtgtgagaacagcccaggatcataccggtgcgtgctgggctgccaaccggggtttcacatggccccaaacggcgattgtatagacattgacgaatgcgcaaacgacaccatgtgcggatcacacggcttttgcgataacactgacgggtcttttcgctgcctttgcgatcaaggatttgaaatttcccccagcgggtgggattgcgtcgatgtgaatgagtgcgagctgatgttagctgtttgcggcgcagcgctctgcgaaaatgtcgagggcagttttctatgtctgtgtgcatctgacctggaagaatatgatgcacaggaaggtcactgtaggccacgcggagcaggtggacagagtatgtccgaggcgccaaccggagaccatgcccctgcaccgactagaatggattgctattccggccaaaagggccacgctccttgctcctccgtcctggggaggaatactacccaggccgagtgctgttgcactcagggcgcttcatggggagacgcgtgtgatctgtgcccctctgaagattcagctgaattcagcgagatatgcccttccggaaaggggtacattccggtggaaggcgcctggacatttggacagactatgtacactgatgctgatgaatgtgtgatctttggacctggcctttgccccaatggccgatgtctgaatactgtccccggatacgtttgtctgtgcaaccctggatttcactatgacgcctcacacaagaaatgtgaagaccacgatgaatgccaagacctggcttgcgagaacggagagtgtgtgaacaccgagggcagcttccactgtttttgctccccgccgctgaccctcgatctctctcagcagcgctgcatgaacagcacctcctccactgaggacctcccagaccatgacatacatatggacatatgttggaaaaaggtcacaaatgatgtttgcagcgagcccttacgcggacatcggaccacttatacagaatgctgctgccaggatggggaggcttggtctcaacaatgtgccctgtgtcctcccagatcctctgaggtatatgcacagctatgtaatgtggcccgcattgaggcagagagagaggctggagtgcacttccggcccggctacgagtacgggccaggacctgacgatctgcattattccatctacggtcccgatggggcccccttttacaattacctcggcccagaagatacggtccctgagccagcgtttcccaataccgccggacatagcgctgacaggacacctatcctggagtcacctctgcaaccttcagagctccagccacactacgtggcatcccatcccgaaccacccgctggattcgaggggttgcaggctgaggaatgcggcattttgaatggctgcgaaaatgggcggtgcgttagggtccgggagggatacacatgcgactgcttcgagggattccagttggatgctgcccacatggcctgcgtagatgtaaacgagtgcgatgacctcaacgggcccgccgttctgtgtgttcacgggtactgcgagaataccgaaggctcctaccggtgccactgttcgcccggctacgtggctgaggctgggcctccccattgcacggccaaggagtag

SEQ ID NO: 121967 - DNA, 3912 bp, Artificial Sequence
  Description of Artificial Sequence: Synthetic coding sequence
atgccaggaccccggggcgccgccgggggtctcgcgccagaaatgaggggggccggggccgcagggcttcttgcccttttactgctcttactcctgctgcttctcggtctcggtggcagagttgaaggtggccccgcaggcgagcgcggcgctggtggaggtggagcactggcccgggaacgctttaaggttgtttttgccccagttatctgcaagcggacttgtcttaaggggcagtgtagggatagctgccagcagggctcaaatatgacgctcatcggagaaaatggacactctacagacacactcactggtagcggcttcagggtggtggtctgccctctgccctgcatgaacgggggccaatgcagctcaaggaaccaatgtctttgcccccccgattttaccgggcggttctgtcaggttcccgccggaggcgctggtggaggtactggggggagtggccccggtctatcgaggacaggggccttgtcgaccggcgcccttccaccactggcgccggagggtgattcagtggccagcaagcacgccatttatgccgtgcaggtcatagctgacccccctggcccgggcgaggggccacctgcccagcatgctgctttcctcgtgcccctgggacctggtcaaatctcagcagaggtccaggcacccccacctgtcgtcaatgtaagggtgcatcacccccctgaggcgtctgtgcaggtacaccgaattgagagctctaacgctgagagcgcagctccaagccagcatctcctgccccaccctaaaccaagccaccctcgcccccctacgcagaaaccactgggacgttgttttcaggacacactccccaagcaaccttgtgggtcgaaccctctgcctgggctaaccaagcaagaagactgttgcggttccattggaaccgcttggggtcaatcaaaatgtcacaaatgtccgcaactgcaatacactggcgtccagaaacccgggcctgtccggggtgaggtgggggccgactgccctcagggatacaagcggctcaattccacccactgccaggacattaatgaatgtgccatgccaggggtgtgtaggcacggagattgcctaaataatccgggatcctacaggtgcgtttgtcccccaggccactcccttggccccagcaggacccagtgtattgcagacaagcctgaggagaagagcctttgttttaggctcgtaagcccagagcatcagtgtcagcacccactgacaacccgtttaacccgacaactatgctgttgttcggtgggaaaggcctggggtgcccgttgtcagcgctgtccgacggatggtacagcagcctttaaagagatatgcccagccggcaaaggctaccacattctcaccagtcaccagaccctgaccattcagggcgaatcagactttagcttgttccttcacccagacggtcccccgaagcctcagcagcttccagagtctcccagccaggccccacctccagaagacacggaagaggagcgcggagtgacgactgactcccctgtaagcgaggagcgtagtgtgcagcaaagccaccccacagctactacaacccctgcacgaccctatcccgagctcatttcccgcccctcaccgcccacaatgcggtggttcctgccagatctcccgccttctcgctccgcagtagagattgctccaacacaggtcactgaaaccgacgagtgccggttgaatcagaacatatgcggtcacggagagtgtgtccctggcccccccgattacagctgccactgcaatcccgggtatcggagccatccccaacaccggtactgtgtagacgtaaacgagtgcgaagctgaaccatgtgggcccggacgcggcatctgtatgaacacaggcggatcatataactgtcattgcaaccgcggttaccgcctgcatgtgggcgctggaggccggagttgtgtagacttgaacgagtgcgccaagccccacctgtgtggtgatgggggcttctgtatcaatttccctgggcactacaagtgtaattgttaccccgggtatcggctaaaggcttcccggccacccgtttgcgaggacatcgatgaatgcagagatccctcatcctgtcccgacggaaagtgcgaaaataagcccggaagctttaaatgcattgcctgccaaccgggctataggagtcagggcggcggagcttgccgcgacgtcaatgagtgtgcggaaggttcaccttgctctcccggctggtgtgagaatctgccaggatcatttcggtgtacgtgcgcccaaggttacgcccctgcccctgacggtaggagctgcctcgatgtggacgaatgtgaagctggtgacgtctgtgataacggcatctgctcaaacactcccggaagcttccaatgccagtgcctctctggctatcacctgtctcgagatagaagtcactgtgaagatatagacgagtgcgattttcccgcagcttgtattggaggggactgcatcaacaccaacggatcgtatcgctgcctgtgtcctcagggtcatcggctggtgggaggcaggaagtgccaggatattgacgagtgctcacaggacccctcactgtgtttaccacatggtgcatgtaaaaatctacagggtagttacgtctgtgtgtgcgacgagggcttcacacctacccaggatcagcacggatgtgaagaggtcgagcaacctcatcacaagaaggaatgctatctgaatttcgatgacaccgtcttctgtgattcagtgctggccacaaatgtgacccagcaggagtgttgctgctccttgggagcagggtggggagatcactgcgagatatacccctgccccgtctacagttccgccgagtttcactctctgtgtccggatggcaaggggtatacacaggacaacaacattgtgaactacggcattcccgcccatagggacatcgatgagtgtatgctgtttgggtctgaaatctgtaaagagggtaaatgtgtcaatacacagccaggctatgagtgctactgcaaacaaggattctactacgacggcaatctccttgagtgtgtagatgtcgacgagtgcttagacgagtcgaattgtcgaaacggcgtgtgcgaaaatacgcggggaggctatcggtgtgcatgtactccgcccgccgagtattctcctgcccagcggcaatgtttatctcccgaggagatggatgtggatgagtgtcaagatccggccgcttgtcggcccggacggtgcgtcaaccttccgggaagctacagatgtgagtgtaggccaccctgggtcccgggtccgtctggccgggattgtcaactgcccgaatcacctgctgagagagccccagaacgtcgcgacgtatgttggtctcagaggggcgaagatggcatgtgcgcaggtcctctagccggaccagctcttacgttcgacgactgctgttgccgtcagggtagagggtggggcgcccagtgtcggccgtgcccaccgagaggcgcaggctctcattgccctacttcccagtcagaatcaaactctttctgggatactagccctcttctgctgggaaagcctcctcgagatgaagattcatctgaagaggattctgatgagtgcagatgtgtatccggccggtgcgtccccagaccaggtggagccgtgtgcgagtgccctggaggctttcagctggatgcaagcagagcccgctgcgtggacattgatgaatgcagagagttgaaccagcgaggtctgctttgcaaatcagaaaggtgcgtcaacacttccggatcatttagatgcgtctgtaaagctgggtttgctaggtctcggccccacggggcatgcgtgcctcaacgcaggagatag

SEQ ID NO: 121968 - DNA, 792 bp, Artificial Sequence
  Description of Artificial Sequence: Synthetic coding sequence
atgctcttcggcagcgagatttgtaaagaaggaaaatgtgttaacacccagcctgggtatgaatgctactgcaagcagggattctattacgacggtaatttgttggaatgtgtggatgtagatgagtgtttggacgagtctaattgtaggaacggtgtctgcgagaacactcggggtggataccggtgtgcttgcacacctccagctgagtactcgccggcccagcggcagtgcctcagtccggaagagatggatgtggacgaatgccaggatccagcagcctgtagacccggccggtgtgtgaacctgcccgggagttaccggtgtgaatgtaggcccccgtgggtgcccggccccagtggaagggactgtcagcttcccgaaagccccgcagagagagctccagagcggagggacgtgtgttggagccaacggggagaggatgggatgtgcgcgggaccactagcagggcccgctctcactttcgatgactgctgctgcagacagggaagaggctggggcgctcagtgccggccatgtccccctcgcggggcaggcagccactgtcccacaagtcagagtgagtcaaattcattttgggatacaagccccctactgctgggtaaaccgcccagggatgaagatagctcagaggaggacagcgatgaatgtcgctgcgtgtcggctgccgcctgccggggtagagctgccccatgtgcttcagtcccagctgccagctctagtaccccgcctgccccggcagcgtggataagcacttcggctgagtcatag

SEQ ID NO: 121969 - DNA, 3771 bp, Artificial Sequence
  Description of Artificial Sequence: Synthetic coding sequence
atgcctggcccaaggggcgctgcaggcggacttgcccctgagatgcgcggggcaggcgctgccgggctgctcgcattattgctcttgctgctgctattgttattgggactgggcggacgagtggagggtgggccggcaggcgagaggggtgccggtggggggggggcgctcgccagagaaaggttcaaagtcgtttttgcacctgtgatctgtaagcgcacctgtctcaaaggacagtgcagagattcatgtcaacagggaagcaacatgacgctgatcggcgaaaacggccacagcaccgacactctgaccggcagtggattccgcgttgtagtgtgtcccctcccctgtatgaacggtggccagtgcagctcgcgtaaccagtgcctctgtccccccgattttacaggaaggttctgccaggtgcccgccgggggcgctggcggggggaccggcggctccgggcctggactttctcgaactggcgctctgagtacaggggctctgcctcctctcgctcctgaaggagactccgtggcttccaaacacgcgatttatgctgtgcaggtcattgccgaccctcctggccccggagaaggcccacctgcacagcacgctgccttcctcgtccctttgggtcccggccagatatctgcggaggtgcaagccccaccccccgttgtgaacgtgcgcgtgcatcatcccccagaggcttccgtgcaagttcataggattgagtcttcaaacgcagagagcgccgcccctagccaacacttgctaccccaccccaaaccaagccaccctagaccaccaacccagaagcctctcggccgctgctttcaagatacactcccaaagcagccatgtggcagtaatcctctgcctggactgaccaagcaggaggactgctgcggatccattggcactgcgtgggggcagagtaaatgccataaatgtccgcagttgcagtacactggagtgcagaaacccggccccgtgaggggtgaggtgggagccgattgccctcagggttataagagattaaactccacccattgccaggatattaacgaatgtgctatgcctggcgtgtgccgtcacggagattgtctgaataacccgggctcctaccgctgcgtttgcccacctggccacagcctagggccatctcgaacacaatgcattgccgataagcctgaggaaaaatctctgtgtttcagattggtgtcacctgagcatcagtgtcagcatcccctcacaacccgcttgacccgccagctctgctgctgcagcgttggcaaggcatggggggcacgatgtcagcgatgccccaccgacgggacagctgccttcaaggaaatatgccctgccgggaagggatatcacattctgacaagccatcagaccctcactattcagggcgagtccgacttctccctcttcctgcacccggatggaccacccaagccacagcagcttcccgaaagtcctagccaggcacctccgcccgaagataccgaggaagagcgcggcgtcactaccgacagccccgtgtccgaagagcgtagcgtgcagcagtcccaccccacagcaaccacaacacctgcccgtccatatccagaattgatatcaagacctagtccccccacaatgaggtggttcctgcctgacctccccccctcccggtctgctgtcgagatagcacctacgcaagtgaccgaaaccgacgagtgcagacttaatcaaaatatctgtgggcacggggagtgtgtgcccggccctccagactactcatgtcactgcaacccaggctatcgctctcaccctcaacataggtactgtgtggacgtaaatgagtgtgaagcggagccctgcggaccaggccgaggtatttgcatgaacactgggggctcatacaattgccattgtaacagggggtataggctgcacgttggcgccggcggcagatcctgtgttgacctgaatgagtgcgccaaaccacacctctgcggggatggcggattttgtattaacttcccagggcattacaaatgcaactgctacccggggtataggctcaaggcctcccggccgcccgtttgtgaagatatcgatgagtgcagggacccttcgagttgccctgatggtaagtgtgagaacaaaccaggttcattcaagtgcatagcatgccagcccggttaccgttcacaaggaggcggtgcctgtcgcgacgtgaatgagtgcgccgaaggaagtccatgtagccccggctggtgcgagaatctgccaggcagctttcggtgcacatgtgctcaggggtacgcacctgccccagacgggcggtcgtgtctggacgtggacgagtgtgaggcaggtgatgtttgtgataacggcatatgtagtaacacccctggcagcttccaatgtcagtgcctcagcggctatcacctcagccgcgaccgttctcactgcgaagacattgatgagtgtgacttcccggccgcttgtattggaggcgattgtatcaatactaacggaagctaccgctgcctttgcccccagggacacagacttgtggggggccgtaagtgccaagacatcgacgaatgcagccaggatccatcactctgccttccacacggcgcttgtaagaatctgcagggatcttatgtctgtgtctgcgacgaaggtttcacaccaacacaggatcagcacggatgtgaagaagttgaacagccacatcataaaaaggagtgttatcttaattttgacgatacagttttctgtgacagcgtcttggccactaacgttacacagcaggaatgctgttgttcgctgggcgccggctggggcgatcattgtgagatctacccctgcccagtatattcttccgcggaattccattcattgtgccctgatgggaaaggatatacacaggataacaatatagtaaactatggcatccccgctcatcgggatatcgatgagtgcatgctctttgggtcagagatttgtaaagaaggcaagtgtgttaatacccagcccgggtacgagtgttactgtaaacaggggttttattatgacggtaatttgcttgagtgcgtcgatgtcgatgagtgtctcgacgaaagtaattgtcggaacggcgtgtgtgagaatactagaggcgggtaccggtgtgcttgcaccccacccgccgaatatagtcccgcccagagacagtgtctgtcccccgaggagatggaaagagcccccgagcggcgcgatgtgtgctggagccaacggggggaagatggaatgtgcgcaggaccacttgctggccccgctttgacgttcgacgattgttgttgtcgtcaaggcaggggatggggagcccagtgcagaccctgtcctcccagaggggcggggtcccattgccccactagtcagagtgaaagcaactctttctgggacacctcaccccttctgctgggtaagccccctagggatgaggacagttcggaggaggatagcgatgaatgcaggtgcgtgagtgggcggtgcgttcctagacccgggggggcagtgtgtgaatgcccaggaggattccaactcgatgcatcccgggccaggtgtgtcgatatcgatgaatgtagggaactgaaccagagaggcttgttatgcaagtctgaacgttgcgtgaatacatcggggtctttccgatgcgtctgtaaagccgggttcgcaaggagccgccctcacggggcatgcgtgcctcagagacgtagatag

SEQ ID NO: 121970 - DNA, 921 bp, Artificial Sequence
  Description of Artificial Sequence: Synthetic coding sequence
atgctctttggatcagaaatctgcaaggagggcaaatgtgtcaacactcagcccggctatgagtgttactgtaaacagggattttactacgacggcaacctgctcgagtgtgtggatgttgatgagtgcttggatgagtctaattgtagaaatggggtctgcgagaacacaaggggcggatacagatgcgcatgcacccctcctgccgagtattccccggctcagagacagtgtctcagccccgaagagatggatgtggatgagtgccaggaccctgccgcctgccgccctggccgatgtgtcaatttgccaggttcatatagatgcgagtgcaggcccccctgggtccccggtccttctggacgggactgtcagctcccggagagtccagccgagcgcgcccctgagaggcgggacgtgtgttggagccagcgcggcgaagacggtatgtgtgccgggccactcgcgggcccagccctgaccttcgacgactgctgctgccgacaaggccggggctggggcgctcagtgtcggccatgccctccccggggagccgggagtcactgccctacttctcagagtgaatctaattcattctgggatacatcccctcttttgctaggaaagccaccacgcgacgaagattcatccgaggaggactccgatgagtgcagatgtgtctctggacggtgtgtgccacgaccaggcggcgcggtctgtgaatgtcccggtggattccagctggatgcctctcgcgctcgatgtgtggacattgatgagtgtagggaactcaatcagagagggttgctatgcaagtctgagcgctgcgtcaacaccagcggctcctttagatgtgtatgcaaagccggtttcgcacgatccaggccacacggggcctgtgtcccacagagacggcggtag

SEQ ID NO: 121971 - DNA, 3414 bp, Artificial Sequence
  Description of Artificial Sequence: Synthetic coding sequence
atgaccctaatcggtgagaatggacactccacggacactctcacgggatccggttttcgtgtcgtagtttgtcctctgccatgcatgaacggggggcagtgctcttctcggaaccagtgcctgtgcccccccgacttcacggggaggttttgtcaagtgcccgccgggggagctggtggaggaaccggcggcagcggtcctggactgtccaggacaggcgcactgtctacaggcgctctgcccccacttgcccccgagggcgactccgtggcctccaagcacgctatctacgccgtgcaagtaattgcagacccccctggacccggagaaggcccccccgcccagcacgccgcttttctggtaccactgggcccggggcagatttccgccgaagtacaggctccgcctccagtggtgaatgtgcgtgtgcaccatccaccggaagcgagtgtacaggttcataggatagagtcatccaacgccgagtcagcggccccctctcaacacctactgccacaccccaagccatctcatcccagaccacccacacagaagccactgggcaggtgttttcaggacaccttgccgaaacagccttgcgggagtaaccctctaccaggcttgactaagcaagaagattgctgtgggagtatcgggaccgcttggggacagagcaaatgccacaaatgcccccaactgcagtataccggcgtccagaagcccggacctgtgagaggcgaggtgggggccgattgtccccagggatacaagcgcttaaattccactcattgtcaggacatcaatgaatgtgctatgccaggagtctgtaggcacggagattgcctgaacaacccgggcagctacaggtgcgtttgcccgccaggccacagtttaggaccctcaaggactcaatgtatcgccgacaagcctgaggagaaaagcttgtgctttcggcttgtatctcccgagcaccagtgtcagcatccgctgaccactaggctcacccggcagctgtgctgttgctctgtggggaaggcatggggtgctcgttgccagcgatgtcccaccgatgggacagccgcctttaaagaaatctgtcccgctgggaaggggtaccatatactgacctctcaccagacactcaccatccagggagagtcagatttctccctgttcctgcatccagatgggccaccaaagccccagcagctgccagaatctccttcccaggcgcccccacctgaggacacagaagaggagcggggcgttacaaccgattcacccgtaagcgaggagcggtctgtgcagcaatctcatccaaccgctactaccacgccagctaggccatacccagaactcatctcccggcccagtcccccaaccatgcgctggtttttgcctgatctgccgccctcacggtcagctgttgaaatagctcctacccaggtgaccgaaactgacgagtgtcggctgaaccaaaacatctgcgggcatggtgagtgtgtgcccggtccccctgactattcttgccattgcaatcctgggtacagatctcacccacagcacaggtactgtgtggacgtgaatgagtgcgaggctgaaccatgtggcccaggcaggggcatctgtatgaatactgggggatcttacaattgtcactgtaacaggggatatcgattgcacgtcggggccggagggagatcatgtgttgacttaaatgaatgtgccaaaccgcatctctgtggtgacgggggtttctgtattaatttccctgggcactataagtgcaactgctatcctggttataggttgaaagcctcgcggcctcccgtctgtgaagatatagacgagtgcagggatccctcaagttgtccagatggcaagtgcgaaaacaagccaggcagcttcaagtgtatcgcatgccagcctggttacagaagtcaggggggcggtgcctgccgcgacgtgaacgagtgcgctgagggctcaccatgctcccctgggtggtgcgagaacctgccaggatcattccggtgtacatgtgcgcaggggtacgcacctgcacctgacggtagatcatgccttgacgtcgacgagtgtgaagcgggagacgtctgtgataacggcatatgcagcaacacaccaggctcgtttcagtgccagtgtttatctggataccacctgagcagagaccgctctcactgcgaagatatcgatgagtgtgacttcccagccgcctgcatagggggggattgcatcaataccaatggttcctatagatgtttgtgcccgcaaggacacagattggtgggcggtaggaaatgtcaggatatagacgagtgctctcaggaccctagcctgtgtcttccacacggggcttgcaaaaacctacagggttcatacgtatgtgtgtgcgacgagggattcactcctacccaagaccagcacgggtgcgaggaagtggagcagccccaccacaagaaggaatgctacctcaactttgatgatacagtcttttgtgactctgtgctcgccaccaacgtgacccagcaagagtgttgctgttctctgggtgcaggctggggcgaccactgtgagatctacccatgtcctgtctatagcagcgcagagtttcactccctgtgtcctgacggcaagggatacacacaggacaataatattgtcaattacggtatacctgcccacagagacatagacgaatgcatgcttttcgggtctgaaatctgtaaggagggcaagtgcgtgaatacacagccaggatatgaatgttactgcaagcagggcttttactatgatggcaatctcctagaatgtgtggacgtggatgagtgcctggacgagtcaaactgcagaaacggggtctgtgaaaacactagaggaggatacagatgtgcttgcacacctccagccgaatattctcccgcacagaggcagtgcctgtctccagaagaaatggatgttgatgaatgccaagatccagccgcttgtcgtccggggagatgcgtgaacttacccggctcttaccgctgcgaatgcagacctccctgggtgccagggccatcaggaagggattgtcagctgccagaatctcctgcagagagggccccggagcggcgggatgtttgttggtcacagagaggagaagacggtatgtgtgcggggccacttgcagggccagcattgacattcgacgattgttgctgccggcagggtagaggctggggtgcacagtgccggccctgtcccccccgcggcgctggttcacactgcccaacatcccagtctgaatctaatagcttttgggacacatcacccctgttacttggtaaaccccctagagacgaggactcctccgaggaagattctgatgaatgtagatgcgtgtcaggttag

SEQ ID NO: 121972 - DNA, 2202 bp, Artificial Sequence
  Description of Artificial Sequence: Synthetic coding sequence
atgcccgccgagacggatgagtgccggcttaatcagaatatttgcggtcatggagaatgtgtacctggtcctcccgattactcatgtcactgcaaccccggctacagatcacacccccaacaccggtattgcgtggacgtcaacgaatgcgaggccgagccctgcggcccgggtaggggcatctgcatgaatactggtggctcatataattgccattgcaatagagggtatcggctgcatgtgggtgctggcggtcgatcctgcgttgacttaaacgagtgcgccaaaccccacctttgcggcgacggtggattctgtattaactttcccgggcactataagtgtaattgttaccccggttaccgcctgaaagcctcccgacctcctgtatgcgaggatattgacgagtgccgagacccctccagctgccctgatggaaaatgtgaaaacaaaccaggcagtttcaagtgtatagcctgccaacccggctatcgttcacagggcgggggagcttgccgagatgtcaatgaatgcgcagaaggatctccttgcagtcctgggtggtgcgagaatcttcccggttcctttaggtgtacatgcgctcaaggctacgcgccagctccagatggccgttcttgcctggacgtggatgagtgtgaagctggagacgtctgtgataatgggatttgctcgaatacaccgggcagtttccaatgccagtgcctcagtgggtaccatctgtcccgggatcgctctcactgcgaggatatcgacgaatgcgacttccctgctgcctgtatcgggggagactgtattaataccaacggcagctaccggtgcctgtgtccccaaggtcacagacttgtcggcggaaggaagtgtcaggacattgatgaatgctcccaagatcccagcctctgtctccctcacggcgcatgtaagaaccttcaaggctcatacgtctgcgtttgtgatgagggcttcacacctactcaagaccagcatgggtgcgaggaggtagagcagccacatcacaagaaggaatgttacctcaactttgacgacacagtcttttgtgacagcgttctggctactaacgtgacacagcaagagtgctgttgcagtctcggcgccggctggggcgatcattgcgagatctatccatgtcctgtgtattcctcagcagaattccactcattatgtcctgatggtaaagggtatactcaggacaataatatagtgaactatggaatccctgcacacagagatattgacgagtgcatgttattcggaagcgagatttgcaaggaaggcaaatgcgtgaatactcagccggggtacgaatgttactgcaaacaagggttctattacgacggaaatctgctggagtgcgtggatgtggatgagtgccttgatgaatccaactgtagaaatggtgtgtgcgagaacacccgcggtggctaccggtgtgcttgtacccctcccgcagagtatagtccagctcaacgccagtgtctgtcccccgaggagatggatgtggacgagtgccaagaccccgccgcttgtcggccaggccgttgcgtaaacctcccaggcagctacagatgtgagtgtcggcccccgtgggttcccgggccatcaggacgggattgccagttgccggagagcccagccgaaagggccccggagcgacgggatgtgtgctggagccagcgtggcgaagacgggatgtgcgcaggtcccctggccggacctgctctgacgtttgacgattgttgctgtagacagggccggggctggggagcccagtgtcgaccatgcccgccaaggggcgccggaagtcactgtcctacttcccagagcgaatctaactcattttgggacacatcccccctgttattaggaaagcccccacgcgatgaggatagctcggaagaagacagtgatgagtgtcggtgtgtgtctggtcgatgtgttccaaggccgggcggggcagtgtgcgagtgccccggcgggtttcagctggatgcgagtagagcgcggtgcgtggacatcgacgagtgtagggagctgaatcagagaggtcttctgtgcaaaagtgagagatgtgtgaacactagtggttctttcagatgcgtatgcaaggctggcttcgcccgatcccgcccccatggtgcctgcgttccacagcgaagaaggtag

SEQ ID NO: 121973 - DNA, 2649 bp, Artificial Sequence
  Description of Artificial Sequence: Synthetic coding sequence
atgacactcattggagagaacggtcatagcactgataccctgaccggttccggattccgcgtagcagacaaacccgaggagaagagcctgtgttttagattggtgtcccctgagcatcagtgtcaacaccctctgaccactagactcactcgccagctctgctgttgttccgtggggaaggcctggggcgcgaggtgccagcgctgccccactgacgggaccgcggcttttaaggaaatatgcccagcaggtaaaggctaccatattctaaccagtcatcaaacattgactattcaaggagagagcgatttcagcctgttcctccatccggatggcccccctaagcctcagcaactgcccgagtctcctagccaggcgcctcctcccgaagataccgaggaagagcgaggggtcacaacggactcccctgtgtcagaggagcggagcgtccagcagtctcaccctacggctacgactacacctgctcgtccgtaccctgaactgatttcccgaccctctccaccaacgatgagatggtttctgcccgacctgccgccatcccggtcagccgttgaaatagcccccacacaggtgactgaaactgacgaatgtaggttaaaccagaacatatgcggtcacggagagtgtgtgccaggacctcccgattactcttgtcactgcaatcctgggtataggtcgcaccctcagcaccgctattgtgtggatgtgaacgaatgtgaggcagaaccttgcggacctggccggggaatctgcatgaacactgggggatcctacaactgtcactgcaatcgggggtacagactgcatgtcggtgctggcggtcgtagctgtgtcgatctgaatgagtgcgctaaacctcacttgtgcggcgacggtggtttttgtatcaactttcctggccattataagtgcaactgctaccccgggtaccgactgaaggcctcgagaccaccagtttgtgaagacattgacgagtgccgggatccttcctcatgtcccgatggcaagtgtgaaaataaacccggcagtttcaagtgcatcgcttgtcagccaggctacagaagtcaagggggtggagcctgccgtgacgtgaacgagtgcgccgagggcagcccatgcagtccagggtggtgtgaaaacttacctgggagctttagatgcacttgcgcccaaggctacgcccctgcccctgatggtcggtcatgcttggatgtggacgagtgcgaggccggggacgtatgtgacaacggtatttgctcaaacacgccagggtccttccaatgccagtgtttatccggctatcatctgtcaagagatcgaagccattgtgaggatatcgacgagtgtgactttccagccgcatgcatcggcggcgactgcatcaataccaatgggtcctatagatgtttgtgtccacagggtcatagactggtgggaggtcggaaatgccaggacatcgatgagtgcagtcaggacccatcgctgtgcctccctcacggggcctgtaaaaatctccaagggtcttacgtctgtgtgtgcgatgagggctttacgccaacccaggatcagcatggctgtgaggaagtggaacagcctcatcataaaaaagaatgctacttgaattttgacgacaccgtattctgtgattctgtccttgcaactaatgtaactcaacaggaatgctgttgtagcctaggcgctggatggggagaccactgtgaaatttacccctgccctgtgtacagctcagccgaatttcacagcctttgccctgacggcaagggatacactcaggataataatatcgtgaattatggcatccccgcacatagagacattgacgaatgtatgctgtttggctcagagatttgcaaggaggggaagtgtgttaatactcagcctggatacgagtgctactgcaagcaagggttctattatgacgggaacctgctggagtgcgtggacgtggacgagtgtttagacgaatctaattgccggaacggtgtctgcgaaaacactcgaggaggatatcgctgcgcatgtacccctccggccgaatactcaccggcccagcgacaatgtctgtctccggaggagatggagcgggctcccgagcggagagacgtttgctggtctcaaaggggggaagacggtatgtgtgcaggacccctggcagggcctgcactgacatttgacgattgttgttgtagacaaggtcgagggtggggggcgcagtgccgaccttgcccgcctcggggcgccggctcgcactgtccgacaagccaaagtgagagtaactccttctgggacacatcgcccctgttgctgggtaagccccctcgcgatgaagattcatcggaggaagattccgacgagtgtagatgcgtgagtggccggtgtgtgcctaggcctggcggcgccgtgtgtgaatgccctggtgggtttcagctggatgcatcccgggcgcgttgtgttgacattgatgagtgtagagagctgaatcagcgcggtctgctgtgcaagtccgagagatgtgttaatacaagcgggtcattcagatgcgtgtgcaaagcagggttcgctcgctccaggccacacggagcatgtgtgccccagcgccgccggtag

SEQ ID NO: 121974 - DNA, 4761 bp, Artificial Sequence
  Description of Artificial Sequence: Synthetic coding sequence
atgggcgatgtgaaagccttattgtttgtggccgctgcccgcgcccgacgactcggcggcgcagcggcctcagaaagccttgcagtatcggaggctttctgccgcgtccggtcatgccaacctaagaaatgcgccggaccccaacgctgcctaaacccggtcccggcagtgccctccccatctccaagcgtccgaaaaaggcaggtgtccctaaactggcaaccactcaccctgcaggaggctagagcactgcttaagcgcaggcggccaaggggaccagggggccggggtctgctccgcagacgcccgccacagagggcacctgccgggaaggcaccagtgctgtgccctcttatctgtcataacggaggagtatgcgtgaaacctgaccggtgtctgtgccccccagactttgctggaaagttttgtcaactgcactcaagtggcgcaagaccgcccgctcctgctgtgccggggttgacgcgcagcgtgtacaccatgcctctcgcaaaccaccgggacgacgagcacggagtggcctctatggtgtcggtccacgttgaacaccctcaagaggccagcgtggtggtgcatcaagtggagagggtgtccgggccgtgggaggaggctgatgcagaagcagtcgcaagggccgaagccgcagcaagggccgaggccgctgccccatataccgtcctggctcaaagcgcccctcgcgaagacgggtactcggacgcctctggttttgggtactgttttagagaactgagaggaggagagtgcgcgtctcctctgcccggcctcagaacacaggaagtgtgctgcaggggcgcggggttggcatggggcgtgcacgactgtcagttatgctcggagcgacttgggaattcagagcgagtctccgcccccgacggaccctgcccgaccggctttgaaagagtaaatggatcctgcgaggacgtcgacgagtgcgccaccgggggacgctgtcaacacggcgagtgcgccaataccaggggaggatatacatgcgtctgtccagatgggttcctgctggactcttccagatcgagctgcatttcccagcatgtgatttccgaagctaaggggccctgttttagagtccttagggatgggggctgctctctccccattcttcgtaacattacaaagcagatctgctgctgttccagagtaggcaaagcctggggaagaggttgtcaattatgtccccctttcggatctgaaggttttcgggagatctgtcccgctggtcccggttaccattatagcgcatctgaccttcggtacaacacgcgccctctgggccaggaaccacctcgggtatcactgtctcagcctagaacactccccgcaaccagtaggccgagtgccggctttctgcctacgcaccgtctggaaccgcgtcctgagccccgcccagatcctcgtccaggacccgaacttcccctgccttctatccccgcctggaccggtcctgagatccccgaatccggaccatcctctggcatgtgccagcggaaccctcaggtctgtgggcccggaaggtgtatctcacggccatccggctatacgtgcgcatgcgactcagggtttcgactcagcccccaaggcactaggtgcattgacgtggacgaatgtagacgagtaccacccccctgcgcccccggcagatgtgagaactcccctgggtcatttagatgtgtttgtgggcctggctttagggcaggcccaagggcagccgagtgcctggatgtggacgagtgtcaccgggtgccccctccgtgtgatctaggacggtgcgagaacaccccgggctcctttctctgtgtctgcccagccggttaccaggccgcaccacacggggcttcatgtcaggacgtggatgaatgcacacaaagtcctggcttatgcggacgtggagcctgtaaaaacctgccagggtcctttagatgtgtatgcccagcaggatttcgtgggtcagcctgcgaggaggacgtggacgagtgcgctcaggaaccccctccatgtggacccggacgatgtgacaacacagcaggctcctttcattgtgcatgtcccgcgggctttaggtccagaggccctggagcgccctgtcaggatgtggacgagtgtgctcggtccccccccccctgtacgtatggacgctgcgaaaacactgaaggctcttttcagtgtgtttgcccgatgggcttccaacccaacaccgctgggtcggaatgcgaagacgtggatgagtgtgaaaaccaccttgcctgtcccggccaggagtgcgtaaattccccagggagcttccagtgccgcacttgtccctctggccatcatctgcataggggacggtgtacagacgtcgatgaatgtagcagcggcgcccccccctgcgggccccacggacactgcactaacaccgaaggctccttccgttgttcttgtgcacccggctaccgggcgcctagcgggcgaccagggccatgtgccgacgtgaatgaatgtctagagggggacttctgctttccccacggcgagtgtttgaacacggacggctcctttgcttgcacatgtgcacccggctaccgcccaggcccccggggggcctcttgcctggatgttgacgagtgtagtgaggaggatctgtgtcaaagcgggatttgtaccaacaccgacgggtcatttgagtgtatttgcccgcccggacatcgggcgggcccagacctggcatcttgtctcgacgtggatgagtgcagagagcgaggccctgctctatgcggctcccagagatgcgaaaacagtcctggtagttacagatgcgttcgcgactgcgaccctggctatcacgccggcccggaggggacctgcgatgatgttgacgagtgccaggagtacggacctgagatctgtggcgcccagaggtgtgaaaacaccccaggtagctaccgttgcacccccgcctgcgaccccggctatcagcccacacctggtggcggctgccaagacgtagacgaatgcagaaaccgaagtttctgcggagctcacgctgtctgccaaaatctgccaggttcttttcagtgcctgtgcgaccaatatgaaggggccagggacggcagacactgtgtggacgttaatgaatgcgaaaccttacagggggtttgtggcgctgcgctatgcgagaacgtcgaggggtcgttcctgtgcgtgtgccctaactctccagaggaatttgacccaatgacgggacggtgtgtgcctcccagaacctccgccggtaccttccccggttctcaaccccaagccccagcgagcccagttctgccagctcgtcccccccctcctccgcttccacgccgcccttctacccccaggcagggcccagttggaagtggccggcgcgaatgttatttcgacactgctgcaccagatgcttgcgataacatacttgcacgcaatgtcacatggcaagagtgctgttgcaccgttggtgaggggtgggggtccggatgcagaatccaacaatgcccaggaaccgagactgctgagtaccagagcctgtgtccacacggaagaggatacctggcccccagtggagatctgtctctccgaagagacgtggatgagtgtcagctttttagggaccaggtgtgtaagtctggggtctgtgtcaacactgctccaggctacagttgctattgctcaaacggttactactatcacacacagagactagagtgcatcgataatgatgaatgcgctgacgaagagcctgcatgcgagggcggtcgatgcgtcaatactgtgggctcatatcactgcacttgtgagcccccgctggtgcttgatggatctcagagaaggtgcgtaagtaatgagtcccagagtttggacgataacttgggtgtctgctggcaggaggtcggtgccgacctcgtgtgttcacatccccgccttgatcgccaggcaacatatactgaatgctgctgtctctatggggaggcatggggaatggactgcgctctgtgccctgcacaagactcggacgacttcgaggcgctctgtaatgtgctgcgcccacctgcctacagtcctccccgtcctggcggatttggactgccatatgagtacgggccagatctagggcccccatatcagggcttaccctacgggcctgaattgtaccctccacctgcactcccttatgacccatatccacctcccccagggcccttcgcccggagggaagccccttacggagctccaaggttcgacatgcccgactttgaggacgatggcggcccttatggggaatccgaagctccggcaccgccaggtccagggactcggtggccatatcgctcgcgggataccaggagatctttcccggagcctgaagagccacccgagggaggctcctacgcggggagtctagccgaaccttatgaagagctggaagcagaggagtgcggaatcctcgacgggtgcactaatggaagatgcgtacgcgtgccagaaggctttacttgtcgttgcttcgacggttacaggttggacatgactcggatggcgtgcgtggacattaatgaatgcgacgaggcagaagccgcttcccctctatgtgttaatgcgagatgcctcaacaccgatggttcctttagatgtatctgcaggcccgggtttgcccccacccaccagccacatcattgtgctcctgcacgcccaagggcctag

SEQ ID NO: 121975 - DNA, 561 bp, Artificial Sequence
  Description of Artificial Sequence: Synthetic coding sequence
atgttaggcggggcaggaggagggccaggccttaggacaccttgccccgccgacgtggatgaatgttccgaagaagacctctgccagagcggcatatgcacaaacacagacggaagcttcgagtgtatctgtcccccgggccaccgcgctggcccagatcttgccagttgcctggatgtcgatgaatgtcgcgagcggggtcctgccctgtgtggcagtcagcggtgtgagaactctcctggaagttacagatgtgtgcgagattgcgatccaggttaccacgccggacctgaaggcacctgcgatgatgttgacgaatgcaggaacagaagcttctgcggcgcacatgccgtatgccagaatcttcctggatccttccaatgtctatgcgatcagtacgagggagcaagggatggcagacattgcgttgatgtcaacgagtgcgagacccttcagggagtgtgtggggcggcattgtgcgagaacgtcgagggatcattcttgtgtgtgtgccctaacagccctgaagagtttgaccctatgaccggaaggtgtgtttag

SEQ ID NO: 121976 - DNA, 4872 bp, Artificial Sequence
  Description of Artificial Sequence: Synthetic coding sequence
atgccaaggcccggtacttcaggacgcagacccctgctgcttgttctactactgcctctgtttgccgccgccacttcagctgcgagcccctctcctagcccttctcaggtcgtggaagtcccaggggtaccatccagacctgcctctgtcgcagtttgtaggtgctgccctggccaaactagccggcggagccggtgcattcgcgccttttgcagggtgcgctcctgtcagccaaagaaatgcgctggcccccagcggtgcctgaaccccgtcccggcagtaccttcacctagtccgagtgtgcggaagaggcaggtctcactcaattggcagccgctgacactccaggaagctcgagctctcctgaagaggcgacgtccacgcggccccggcggccgagggctcctgcggcgcaggccacctcaacgggcccctgcggggaaggcaccagtactttgccccctgatttgccacaatggaggagtctgcgtgaagcccgacaggtgcctttgccccccggatttcgctggcaaattttgccaactgcacagctctggcgcccggccacccgcccccgcagtgcccggtctgactcgctccgtgtacacgatgcctctagctaatcatcgcgatgacgagcatggggtggccagcatggtgtctgtccacgtcgagcacccacaagaagctagtgttgtcgtccaccaggtagagcgcgtgtctggaccgtgggaagaggctgacgctgaggccgtggccagagctgaggcggcagcaagagccgaagcagcagcaccatataccgttctggctcagtctgccccaagggaagacggctacagcgatgcttccggcttcggatattgttttagagagttaagaggaggtgagtgtgcctcccccctcccaggtttgcggacccaggaggtgtgttgccgaggagcgggcctggcatggggcgttcacgactgccagctatgctctgagcggttaggaaactcagagcgggtcagcgcccctgacggcccctgccccacaggcttcgagagggttaatggttcttgcgaagacgtcgatgaatgtgcaactgggggaagatgccagcacggggaatgcgcgaatactcgagggggttacacatgcgtgtgtcccgatggatttttacttgactccagccgctcctcatgcataagccagcacgtgatcagtgaagcaaaaggcccttgttttcgagtgctgcgcgacggcggctgcagtctgccgatcttgcgcaatattacaaagcagatttgttgttgtagtagggtgggaaaagcatgggggcgaggctgtcagctgtgtcccccgttcggaagcgagggcttccgggaaatatgtccagcagggcccggctaccactacagtgctagcgatcttcggtataatacccgtccattaggacaggagccaccccgcgtgtccctgtcacaaccacgtacccttcccgccaccagtcggccttctgccggcttcctgccaacccatcgcctggagcctcggcctgaacctcgccccgaccccaggccggggcctgaacttccgttgccgtccattcctgcctggacaggacccgaaatccctgagtccgggccgagcagcggcatgtgtcaacgaaacccacaggtttgcggccctggccggtgtataagtagacctagcgggtacacttgcgcctgtgattccggcttcagattgtctccccaggggacacgctgcattgatgtcgatgagtgcaggcgggttccccccccctgcgctcctggaagatgcgaaaattctccagggtcctttcggtgcgtctgcggccccggattccgggccggaccccgcgcagctgagtgccttgacgtagatgaatgccatagggtcccacctccttgtgacttgggacgctgtgaaaatacccccggctcattcctgtgtgtgtgtccagctggttaccaagccgcaccgcacggtgcctcatgccaagacgtcgacgaatgcacgcaaagtccaggcctttgtggacgcggggcctgtaaaaaccttcccggatctttcagatgcgtgtgcccagccggattcaggggatctgcttgcgaggaagacgttgacgagtgcgctcaggagcctcccccgtgtggtcctggcagatgtgataacaccgccggtagcttccactgcgcgtgtcccgcaggcttcaggagtcgcggacccggggccccgtgtcaagacgtggacgagtgcgccaggtctcccccaccctgcacctacggtcggtgtgagaacactgaaggcagtttccaatgcgtgtgtcctatgggcttccaaccgaacacagccggcagcgagtgtgaggacgttgacgagtgcgaaaatcatctcgcctgtccaggccaggagtgtgtcaactccccagggagcttccagtgcaggacctgccctagtgggcatcatctgcacagggggcgctgcacagatgtcgacgagtgcagctctggggctcccccgtgcggacctcatggacattgcaccaataccgagggttcatttcgttgctcctgtgctccgggttacagagccccgtcaggacggccagggccttgcgcagacgtgaacgagtgtcttgagggagatttttgttttccccacggtgagtgtctaaatacagatggttctttcgcctgcacatgcgcacctggctacagaccaggcccacgtggagcgtcttgtctggatgtagatgagtgttccgaggaagatctgtgccagtcagggatttgcaccaatactgatgggtccttcgaatgcatttgcccccccgggcaccgagccggccccgacttggcgtcgtgcctggacgtggatgagtgcagagagagaggtcccgccctttgtgggtcccagaggtgcgagaacagtcccgggtcatatcgatgcgtccgtgattgtgacccaggctaccacgcaggccctgaaggcacgtgcgacgatgtagatgaatgccaggagtatggaccggagatttgtggtgcccagaggtgcgaaaacaccccgggctcctacagatgtaccccagcttgcgaccccgggtaccagcctacgccggggggtggatgccaagatgtcgacgagtgtcgtaataggagtttttgcggtgctcatgcagtatgtcagaatttgccagggagcttccagtgtctctgcgaccagtatgaaggggcccgcgacggccgccattgcgtagacgtgaacgagtgcgaaaccctgcagggggtctgcggggcagcattgtgcgagaacgtggaggggagttttctgtgcgtctgccctaactcccccgaagagttcgaccctatgactgggagatgcgtgccacccaggacgtcagctgggacatttccaggatctcaaccacaggccccagcctccccagtgctccccgctcgaccgcctccacccccactaccgaggagacctagcacgccccggcagggccctgttggaagcggccgcagggagtgctattttgatacagccgctccagacgcctgtgataacattttggcccggaacgtgacctggcaggagtgttgttgcaccgtcggagaaggctggggctcaggctgccggatacaacagtgccctggcaccgagaccgccgagtaccaatctctctgccctcatggacgcggctacctggcaccaagtggagacctatctcttcggagggatgtggacgagtgccagctgttcagggatcaggtatgcaagagcggcgtctgcgtgaacaccgctccggggtactcgtgctactgcagtaacggttactattaccacacacaaagattggaatgtatagacaatgatgagtgtgccgacgaggaaccagcatgtgaggggggacgatgtgtgaacactgttggctcgtaccactgcacctgcgagcctcccttggtgctcgatggttcacagcgccgctgcgtgtccaatgagtctcaatctttagatgacaacctgggtgtgtgctggcaggaggtgggtgccgacttggtgtgtagccacccgcgactggataggcaagcgacttatactgaatgctgttgcctgtacggagaagcctggggcatggattgcgcactgtgtcctgcacaggactctgacgactttgaggctttgtgcaacgtgctccgccctccagcatactcccctcctaggccgggaggtttcggcctcccttacgaatatgggcctgacctgggcccgccctaccagggattgccttacggacctgaattgtatccaccccccgctctgccttatgacccgtatccgccaccccccggtccattcgccagacgagaagccccttatggggccccgcgcttcgacatgccagactttgaggacgatggcgggccttatggcgagagcgaggcccctgctccgcctggtcccggcacgagatggccttaccgatctcgcgacacacgcaggtccttcccggagcccgaagaaccaccggaagggggatcgtacgccggaagcctggccgaaccatacgaagagctcgaagctgaagagtgtgggattctagatgggtgcaccaacggacgatgcgtgcgcgtgcctgaaggattcacttgtcgatgttttgacggctatagacttgacatgaccagaatggcttgtgtggacattaatgaatgcgatgaggctgaagcagcaagccctctatgtgtgaatgctcggtgtctgaatactgacggctctttccgctgtatatgcaggcctggattcgcacccacgcaccaaccccaccactgcgctcccgccagaccccgggcatag

SEQ ID NO: 121977 - DNA, 1155 bp, Artificial Sequence
  Description of Artificial Sequence: Synthetic coding sequence
atgactgggaggtgcgtgcctccgcggacatccgccgacgtggatgaatgtcaactgttcagagaccaggtgtgtaagtctggggtttgtgtgaataccgcacctggctatagctgttactgcagcaacggctattattaccatacacaacgccttgaatgcatcgacaacgacgaatgcgctgatgaggaacctgcttgcgagggtggacgttgcgttaacaccgttggatcctatcattgcacctgcgagcctccactggtgttggatggttcacagcggcgatgcgtgagcaatgagtctcagagtttggacgacaatctcggagtctgctggcaggaggtcggagctgatctggtttgcagtcacccacgcctcgaccgacaggcgacgtatacagagtgctgctgcctctatggggaggcatgggggatggattgcgccctgtgtcccgcgcaagacagcgatgacttcgaggccctctgcaacgtgctgcgtccccccgcttattcacccccaaggcctggggggttcgggctcccatacgagtatggccccgacttaggcccgccataccagggcctgccctatgggccagaactgtatcctcccccagccttgccatacgacccctatccaccacctccaggaccgttcgctagacgagaggccccatacggggcaccgcgttttgacatgccagatttcgaagacgacggaggcccatatggagaaagcgaggctccagcccctccagggcctggcaccaggtggccttaccggtcaagggacacgaggcgttcattccctgaaccagaggagccaccagaaggggggtcatacgccgggagtcttgccgagccctatgaggaacttgaggctgaagaatgtggtattcttgacgggtgtactaatggtcgctgcgttagagtgcccgaggggttcacttgccggtgctttgatggatataggctggacatgacaaggatggcctgcgtagatatcaacgaatgtgacgaggcggaggcagccagtcccctgtgcgtgaacgcccgatgcctcaatacggatggcagcttcaggtgtatctgcagaccggggttcgcacctacccatcagcctcatcattgcgcccctgctagacctcgcgcgtag

SEQ ID NO: 121978 - DNA, 4671 bp, Artificial Sequence
  Description of Artificial Sequence: Synthetic coding sequence
atggccggtggtgtgcggctgctgtgggtgtcactgctcgtccttctggctcaactgggtccccaacccggcctgggacgcttgggggaaaggctgcgggtgagattcacgcctgttgtttgcggattacggtgcgtccacggaccaactggcagcaggtgtacacctacttgcgcaccccggaatgcgacctctgttgactccggggcccctggcggtgctgcaccaggcggccccggtttccgggcttttctctgtcccttgatttgccataatggcggggtgtgtgtgaagcccgaccgctgcctgtgcccacctgacttcgccggcaagttctgtcagttgcacagctctggtgctagacccccagccccggccgtgcccgggctgaccagatctgtatacacaatgccgctcgcgaatcacagggatgatgaacacggtgtggcatccatggtctctgtccatgtcgaacacccacaggaggcctcggtggtcgtgcatcaggttgaaagagtgtctgggccatgggaagaggccgatgccgaggcagtggctagggccgaagccgctgcgcgcgccgaagcagctgccccatacactgtgcttgctcaatccgccccgcgggaggacggctacagcgatgcttccggcttcggctactgctttagagagttaaggggcggcgaatgtgcctcaccccttcccggactgcgtacccaggaggtgtgttgtcgtggagccggactggcctggggggtccacgactgtcagctctgctcagagcgactaggtaatagcgagcgggtatccgccccagatggaccatgccctactggattcgagcgcgtgaatggaagttgcgaggacgtcgacgagtgtgccaccggaggccgctgccagcacggggaatgtgcaaacaccagaggcggttacacatgcgtatgtccagacggattccttctggattcaagccggtcttcgtgtatttcccagcacgtgatttccgaggcaaaagggccctgtttccgcgttctccgagacggcgggtgctctttaccaattctaagaaatatcaccaaacagatatgctgttgcagccgcgtcggcaaagcttggggaaggggatgccagttgtgcccaccttttggctccgagggatttcgcgagatctgcccggctggccccggttaccactattcggcctctgaccttcgctataatacacgacctctggggcaagaacctcctcgggtgtctctttctcaaccccggactctccccgcaaccagcaggccttccgccggatttctgcctactcacagactcgagccgcggcccgagccccgccccgatccccgcccgggccccgagctgcccctgccctctatacccgcctggacagggcctgaaattcctgagtcaggacctagtagcgggatgtgtcaaagaaatccgcaggtctgtggacccgggcggtgtatttcacgcccatctggttatacctgcgcctgcgactcaggattcagactcagcccccagggaacaaggtgtatcgacgtggacgagtgccgccgggttcctcctccctgcgctccgggtcgatgcgagaactcccccggttcttttagatgtgtctgcggacccggctttcgagctggccctcgcgctgctgagtgtctagacgtcgatgagtgccacagagttccacccccttgcgacctcggacgctgcgagaacactcctgggagtttcctttgcgtttgtcctgcagggtaccaggccgcaccacacggagctagctgccaggatgtggatgagtgtacccagtctccaggactctgcggaaggggagcttgtaagaacctccccggatcctttcggtgtgtctgtcccgctggcttcagagggtccgcttgcgaggaagacgtggatgagtgtgcccaggagcccccaccttgtgggcccggacgctgcgacaacaccgccggctcgtttcactgtgcctgcccagcaggcttccgaagcagaggacctggagccccatgccaggatgttgatgaatgcgcccggagtccccccccctgtacctacggacgctgcgagaacacagagggttctttccaatgcgtgtgtcctatgggatttcaacctaatacggctggtagcgaatgcgaggacgtagacgagtgtgagaatcacctggcctgcccgggccaagagtgcgtcaactcccccggatcctttcaatgcaggacctgtccatctgggcatcacctacatcgagggcggtgtactgatgtagacgagtgtagcagtggcgcaccaccctgcggccctcacggccattgcacaaatactgaaggctccttcaggtgctcctgtgcccccggctaccgcgctcccagcggccgtcccggaccatgtgccgatgtgaacgaatgccttgaaggggacttctgctttcctcacggagagtgtctcaacacggatggctcttttgcttgcacctgtgcacccggttatcgaccaggcccgcgcggtgcctcctgtctggatgtagatgaatgcagcgaggaggacctgtgccaatcaggaatctgcactaacactgatgggtcatttgagtgcatttgtcctcccggccacagggctggacccgacctcgcttcctgcctggacgttgatgagtgccgagaacgcggccctgcactatgcggatcccagcgttgtgaaaattccccaggtagttatcgatgtgttcgagactgtgacccaggttaccatgctggaccagagggcacgtgcgacgacgtagacgaatgccaagagtatggacccgaaatctgcggcgcccagcgatgtgagaacacaccagggagctatcgttgcacgccagcctgcgaccccgggtatcaacctactccaggcggcggatgtcaagacgttgatgaatgcaggaataggtcattttgtggtgcgcacgcagtgtgccagaatttgcccggaagctttcagtgtctgtgtgatcaatatgaaggcgctcgagacggtcgtcattgtgtcgacgtcaacgagtgtgagacactacaaggcgtctgtggcgccgctttatgtgaaaacgtggagggatcctttctttgtgtttgtcctaactcccccgaggagtttgaccccatgaccggacgatgtgtgccaccccgtacatccgcagggactttccctgggtcacagcctcaagcccccgctagcccagtgctgcctgcccgcccacccccccccccgctgcctcggcggccttctaccccacgccaaggccctgtcgggagcggacgccgcgagtgttacttcgataccgctgctcccgatgcctgtgacaacatccttgcccgcaacgtgacctggcaagaatgttgttgcacagtgggtgagggctgggggagtggctgtcgcattcagcagtgtcctggaacggagaccgccgaatatcaaagcctgtgcccacacggtcggggctacctggctccatctggggacctgagcctgaggcgggatgtggatgagtgccagctcttccgcgaccaggtctgcaagtccggtgtttgcgttaatacggcacctgggtattcttgttattgctccaatggctactactaccatacacagaggctggaatgcatcgacaatgacgaatgcgcagatgaagagcctgcctgcgaaggagggcggtgtgtgaacacggtaggcagctaccactgcacctgcgagccgccgctggttcttgacggttctcaaaggcgatgcgtgtctaatgagtctcagtcactggatgacaatctgggcgtgtgttggcaagaagtaggggccgatctggtgtgtagtcacccccgtctcgacaggcaggccacgtacaccgagtgttgttgcctttatggggaagcttggggtatggattgcgctctctgccctgcccaggatagcgatgactttgaggcactgtgcaatgtgctccgccccccagcatacagccctccaaggcccggcggcttcgggctcccttacgagtatggacccgaccttggaccaccctatcagggactgccttatggacctgaactctaccctcctcccgctctgccttatgatccctatccgcctccccctggtcccttcgcacggagggaggcgccttacggcgctcctcggtttgacatgccagactttgaggatgacggcgggccttatggcgagagtgaggcgcccgcacccccgggccccgggactaggtggccttaccgttcacgggataccagaagaagttttcctgaaccagaggaaccccctgagggaggatcctatgctgggtcgctggccgaaccttatgaggaactcgaggccgaggaatgcggcatactggacggctgcaccaacggtaggtgcgtgcgcgtcccggaaggcttcacttgcaggtgtttcgacggctatcgcctggacatgactcgtatggcctgtgttgacattaatgagtgcgatgaggctgaagccgcctctcctctatgcgtaaacgctagatgtctgaacactgacggatcttttaggtgtatctgcaggcccggctttgcccccacccaccagccccaccattgtgcccccgcacgccctcgcgcttag

SEQ ID NO: 121979 - DNA, 2700 bp, Artificial Sequence
  Description of Artificial Sequence: Synthetic coding sequence
atgtgccagaggaatccccaggtgtgtggtcccggtagatgcatttcccgacccagcggctacacatgtgcgtgtgactcaggattccgcctcagtccacaaggtacgcggtgcatcgatgtagacgagtgtagacgagttccccccccgtgcgctcccggacgatgtgaaaactcgcctggatccttccgatgcgtctgcgggccaggatttagggctggcccccgcgcagcggagtgtcttgatgttgatgagtgtcatagggttccgccgccgtgcgatctggggaggtgcgagaacacaccaggttcttttctctgtgtgtgcccagcagggtatcaagcagctccacacggagcctcgtgtcaggatgtcgacgaatgtacccagtcgccaggcctgtgcgggagaggagcttgtaaaaacctgcccggtagttttagatgcgtgtgtccagctggctttcgtgggtccgcgtgcgaggaagacgtggatgaatgcgcccaagaacctcctccctgcggacccggacgctgtgacaacacggcaggatccttccactgcgcctgtcctgccgggttcaggagcagggggcccggtgccccgtgtcaagatgtggacgaatgtgccagatctccccctccctgtacgtatggaaggtgcgagaataccgaaggttctttccagtgtgtgtgcccaatgggcttccaaccaaacacagccggaagcgagtgcgaagatgttgacgagtgtgaaaaccatttggcttgcccggggcaggaatgtgtcaattctcctgggtcctttcagtgtcgaacatgcccctctggccaccacctgcatcgagggcggtgtaccgacgtagatgaatgtagctcaggagcccctccatgcggtcctcatggtcactgtaccaacacggagggctctttcagatgctcttgcgctcctggctatcgcgctccaagtgggaggccgggcccctgtgccgacgtcaatgaatgcttagagggagacttttgcttcccccacggtgagtgtctcaataccgatggctctttcgcttgcacctgtgctcctggctacaggcctggcccaagaggcgctagttgtctggacgtagatgagtgctcagaagaggacctttgccagtcaggcatttgcaccaacactgatgggtccttcgagtgcatatgcccacctggccaccgtgcaggacccgatctggcatcttgtctggatgtagacgaatgcagagagagaggcccagcactgtgtggctcccagagatgcgagaactctccaggttcttaccgctgtgttagagattgcgacccagggtaccatgccggcccagaggggacatgcgacgatgttaacgaatgtgaaacgttgcagggcgtgtgtggcgccgctttatgcgaaaacgttgagggttctttcctctgtgtctgcccaaacagccctgaggagtttgatcccatgacagggcggtgtgtgccaccccggaccagtgccgggacttttcccggcagtcagccacaagcccccgcctctcctgttctgcctgcccgccctccaccgcctcctctgccgagacggccctccacgccacgccagggtcccgtgggaagtggccggcgggaatgttactttgacactgccgcccccgatgcttgtgacaacattctggcaagaaatgtgacttggcaggaatgttgctgtactgtcggggaagggtggggaagtggatgtcgaattcagcagtgcccaggaacagagacagcagagtatcagtcactctgcccgcacggaagggggtatttggcgccttccggggacctcagcttgaggcgtgacgtggatgagtgccagctgttccgggaccaggtctgtaagagcggcgtctgtgtgaacacggctccggggtactcctgttattgttcgaatgggtattactaccacacccagcggttagaatgcatcgataacgatgagtgcgctgacgaagaaccagcgtgcgagggagggcgctgcgtgaatacagttggctcctaccattgcacttgcgagccccccctggtcctggatggaagtcaacgccggtgcgtgagtaacgagagccagagccttgatgacaatctcggcgtttgctggcaggaggtgggggccgacctcgtttgcagccacccacggcttgaccgacaagccacatacacagagtgttgctgcttatacggcgaggcctgggggatggattgcgccctgtgccccgcgcaggactctgacgacttcgaggccctgtgtaatgtgttacggcctcctgcctattcccctccaagaccaggaggctttggactcccttatgaatatggccctgaccttggcccaccataccaggggttaccctatggaccagagctctacccaccccccgcccttccctacgatccctaccccccgcctcctggcccgtttgcgaggcgcgaggccccatacggagctccccgttttgacatgccagacttcgaggacgatggtggaccctatggcgagagtgaagcacccgcccctcctggacccggtacccgatggccctatcggtctagggacacccgcaggagctttcccgagccagaagaaccaccagagggtggctcttatgcaggaagcctggcagagccctacgaagaactgtag

SEQ ID NO: 121980 - DNA, 639 bp, Artificial Sequence
  Description of Artificial Sequence: Synthetic coding sequence
atgtggaccagcgccaccgcctgtagacggcgcgtgaccagtggcgcggcccggactcggcaggccgcgtcttgtgcgtgtgcaccacctggaacccgtcttcatagaacggagcccgccgcaagaatgtggatgagcgttccagaggctccacacccagcaccaaccgccggggtcaggacgcaaaaggccgcctcatcggtttctgcaccctgggcctccaaccctactttgctcgcaccgaatgtggacgaatgtgagaaccatttagcttgtcctggccaggaatgtgtgaacagcccaggctccttccaatgtcggacttgtccaagtgggcaccacttacaccggggcagatgcacagatgtggacgaatgttcctctggtgcacctccatgtgggccccacggccactgcacaaatacagagggctcctttaggtgttcttgcgctcctgggtacagagcaccctccgggaggcccggcccttgcgccgacgtgaatgagtgtctggagggagacttttgtttcccacacggtgaatgtctcaacacagacggatcatttgcatgcacctgcgccccaggctaccggcccggaccacgaggggcttcctgcctggggtcttacccgggatag

SEQ ID NO: 121981 - DNA, 669 bp, Artificial Sequence
  Description of Artificial Sequence: Synthetic coding sequence
atggagattcctccgaccaattatccggcctccagagcagctttagtagcacaaaactacattaattaccaacagggcactccccacagagttttcgaagtgcagaaagttaagcaagcttctatggaggacatccccgggagagggcataagtatcacttgaagtttgctgttgaggagattatccagaaacaggtcaaagtgaactgtactgctgaagttctgtatccctccaccggtcaggaaacggctccagaggtgaatttcacattcgagggcgagaccgggaaaaatcctgatgaggaagataatacattctatcagcgactgaagtcgatgaaggagcccttggaggctcaaaatatccccgataatttcggcaacgtatcccccgaaatgacgctggtgctgcacctggcctgggtcgcatgtggctacatcatctggcaaaatagtacagaagatacatggtataaaatggttaaaatccagaccgtcaagcaagtgcagcgaaatgatgatttcatcgagctggactacactattctactgcacaatatcgccagtcaagagatcataccctggcaaatgcaggtgctttggcacccacagtacggtaccaaggtgaagcataatagtcggcttccgaaagaagtgcaacttgagtag

SEQ ID NO: 121982 - DNA, 888 bp, Artificial Sequence
  Description of Artificial Sequence: Synthetic coding sequence
atggggctcccagtttcctgggccccacctgccctctgggtgctgggatgttgtgcacttctgctatcattatgggcactctgtactgcatgtcgcagaccagaggacgctgtggcacccaggaagcgtgcccgtaggcagagggcacgactgcagggtagtgctactgccgctgaggcctccttgcttcggagaacccacttgtgttcattgagtaaaagtgatacgcggctgcacgaactgcacagaggtccacgatcgagccgtgctctgaggcctgcatccatggacttgctcaggcctcattggctcgaggtgtctcgggatataactgggccgcaggcagccccgagcgccttcccacatcaggagctgcctagggctctgcctgcagccgcggcaaccgcagggtgtgccggcttagaggcaacctattcaaatgtgggcttggctgcactgccaggagtctccttagctgcaagccccgtggtcgcagagtacgccagggtgcagaagagaaagggcacccacagatctccacaggaaccccagcaggggaagaccgaagttactcccgctgcacaggtggacgtgctgtacagcagagtctgcaaacccaagcgacgtgatcctggtccaacgaccgacccactggatcccaagggtcaaggagctattctggctctggccggagatctggcttatcagacacttccactgagagctttggacgtcgactctggccccttggaaaacgtgtacgaatcaatacgggaactaggggatcccgcaggccgttctagtacttgtggcgcaggaactccccctgccagttcatgtccatctcttggtaggggctggcgcccacttcccgcctcactcccttag

SEQ ID NO: 121983 - DNA, 324 bp, Artificial Sequence
  Description of Artificial Sequence: Synthetic coding sequence
atgggattacccgtgagttgggctcccccggccttgtgggtcctgggatgttgcgccttgcttctgtcactgtgggctttgtgtactgcctgcagacggcccgaagacgctgtggctccccggaagcgggcccgtcggcaaagggcccgtctacagggtagcgcaacagctgcagaagcgagcttgctgcggaggactcatctctgctcattgagcaagtcagacactagacttcacgagcttcatagaggacctcggagctccagagccctgaggccagcttcaatggacctacttcgtccccactggttagaggtcagctag

SEQ ID NO: 121984 - DNA, 2094 bp, Artificial Sequence
  Description of Artificial Sequence: Synthetic coding sequence
atgggcgagcgggccggatcccctggcacggatcaggaacgaaaggccggaaaacatcactactcatacctcagtgactttgagacgccccagtcttcaggacgtagcagtcttgtctcttcttctcctgccagtgtgcggagaaaaaaccccaagcggcagactagcgacggacaggtccatcatcaggcccctcgcaaaccgagtcctaagggactgcctaaccgcaaaggggtgagagtggggtttagatcccagtccttgaaccgggagcctcttcggaaggacacagacctggtcactaagcggatcctgtccgccaggcttctaaaaatcaacgaactgcaaaatgaagtaagtgaactgcaggtgaaacttgctgagctgcttaaggaaaacaagtccctcaaacgtctgcaataccgccaggagaaggctctaaataagttcgaggatgcagagaacgagatttcacagctgatttttagacataacaacgagatcacggctctgaaagaaaggctcagaaagtcgcaagagaaggaacgggcaaccgagaaaagggtcaaggataccgaatccgagctgttcagaactaaattttcactgcagaagcttaaggaaatttcggaggcaaggcatctgccagagcgcgacgatttggcaaagaagctggtaagtgctgagctgaagcttgatgatactgaacggcgtattaaagagctctccaaaaatttggagctgtcaaccaattcatttcaaaggcaactcctggcagagcgcaagagggcatacgaagcgcacgatgaaaataaagtgctgcagaaggaggttcagcgcctctatcacaaacttaaagagaaggagagggagctggatatcaagaacatttactccaataggttgcctaaatccagcccaaataaagaaaaggagctcgcattacgaaaaaatgctgcctgccaaagtgacttcgctgacctgtgtacgaagggtgtccagactatggaggacttcaagccggaggaatacccccttacccccgagaccatcatgtgttacgagaacaaatgggaggagcccggtcacctgaccctggatctgcaatcccaaaaacaggaccgacatggggaggctggtatccttaatcctatcatggaaagggaggagaagttcgttaccgacgaagagctgcatgttgtaaagcaggaggttgaaaagctcgaggatgaatgggagagagaagagctggacaagaagcagaaggagaaggccagccttctggagagagaggagaagccagagtgggaaacaggcagataccaacttgggatgtaccccattcagaatatggacaaactgcagggggaagaggaggagaggttaaagcgagagatgctactggcaaaactcaatgaaattgaccgcgaactccaggactcacgcaacctgaaataccctgttctgccccttcttcccgactttgagtccaaattgcactcccccgagagaagcccaaagacgtatcgcttcagcgaaagcagtgaacgcctgttcaacggccaccatctccaggacatttcattttcaacccctaaaggcgagggccagaattccggaaacgtgcggtcccccgcgagtccgaacgaatttgcttttgggtcatacgtaccaagctttgcaaaaacctctgagcggtccaaccccttttcccagaagagcagcttcctggacttccaacgaaattcgatggaaaagcttagcaaggacggggtcgacctcattacaagaaaagagaagaaggccaaccttatggagcagctgtttggcgcatccggatcctctaccatcagcagcaaatcaagcgatcccaactcggtggccagcagcaaaggggacatagatcctctaaacttcttgcccggcaacaaaggatccagagatcaagagcatgacgaagacgaggggttttttctgagcgaaggacgcagtttcaacccgaataggcaccggttaaagcatgccgatgataagccagctgtgaaggcagcagacagtgtcgaggatgaaattgaggaagttgcactcaggtag

SEQ ID NO: 121985 - DNA, 2094 bp, Artificial Sequence
  Description of Artificial Sequence: Synthetic coding sequence
atgggggagagggcgggatcccccggtaccgaccaagagcggaaggccggcaaacatcattattcgtatctgtccgattttgaaaccccccagtcgtcaggccgctcgtctttagtcagtagctcacctgcgagcgtcaggagaaaaaatcctaagcgccagacatctgatgggcaggtgcaccaccaagcgcctcggaaaccatctcccaagggtctgcccaataggaaaggcgtgcgggtgggattcaggtctcaaagtctaaacagggaaccactgcggaaggataccgatcttgtgactaagaggatattgtctgcgcgcctgctgaaaattaacgagcttcagaacgaagtgagcgaactccaagtgaagctggcagagctgctgaaggaaaacaaaagtctcaaacgattgcagtataggcaggaaaaggccttgaataagttcgaggatgccgaaaatgagatctcgcaactgattttccggcacaataacgagatcactgcactaaaggagaggctacgcaagagccaggagaaggagcgcgccacagagaaaagagtaaaagacactgagagcgagctgtttagaacaaagttttcattacagaaactaaaagagatctccgaagcgagacatctgccagaacgggatgatctggctaaaaagctggtgtctgctgaactcaagctggacgatacggaaaggcgcattaaagagctcagcaagaatttggaattgagcacgaacagttttcagaggcagctcctggccgagcgcaaaagagcatacgaggcccatgacgagaataaggtcctgcaaaaggaagtgcagcgcctatatcacaaacttaaagagaaggagcgggagcttgacataaaaaatatctacagtaaccgcctgcccaaaagttccccaaacaaagagaaagagcttgcgctccgcaagaacgctgcttgtcagtccgactttgccgacttgtgcacaaaaggggttcagactatggaggatttcaagcctgaggaatatcccctcacccccgaaaccatcatgtgctatgagaataagtgggaagaacctggacatttgaccttggacctccagtcacagaaacaggaccggcatggggaggcagggattctgaaccccatcatggaaagagaggagaaatttgtgaccgacgaggagctgcatgttgtaaaacaggaggttgaaaaactggaagatgagtgggagcgcgaagagctggacaagaaacaaaaagaaaaggcatcgctgctcgagagggaggagaagcccgaatgggaaaccggtaggtatcagctcggcatgtacccaattcagaatatggacaagctgcagggggaggaggaggagcgcttaaagagggagatgcttttggccaagctcaacgagatcgatagggagctacaggattctcgcaatctgaagtatccggtcctccccctgctgcctgatttcgaatccaaattgcacagcccagagcgctcaccaaagacctataggttttctgaatcctctgagaggctgtttaacggacaccacttacaggatatctctttttctaccccgaagggggagggccagaatagcggcaatgtccgctcccctgccagccctaacgagttcgccttcgggtcgtacgtgccatcattcgctaaaacaagcgagcgttctaaccctttctcccagaagtcaagctttctggattttcagcgaaatagtatggaaaaactctccaaggacggcgttgatctgattaccaggaaagaaaaaaaggctaacctgatggaacagctgttcggcgcttctggctcatcaacgatatcgtcaaaatcctcggatccgaattctgtcgcctcctcgaaaggcgacatcgaccccctgaattttctgccgggaaacaagggctcccgcgaccaggagcacgatgaggacgaaggtttcttcctttcagaaggacgctcttttaatcccaatcgccatcgcctgaagcatgccgatgacaagccggctgtaaaagctgccgactcggtcgaagacgaaattgaggaagtcgccctccggtag

SEQ ID NO: 121986 - DNA, 693 bp, Artificial Sequence
  Description of Artificial Sequence: Synthetic coding sequence
atgaaaaacccgatgttggaagtggtctcactactcttggagaagctgctactgatttctaactttacactgttttccagcggcgccgctggcgaggacaagggccggaactccttttacgagacttcttcttttcaccgcggtgacgtgcttgaagtcccgcgcacacatctcacccactatggtatttatttgggtgataatcgggttgcccatatgatgcccgacatcctgttggcactcaccgacgatatgggtcgcactcagaaggtggtgtctaataagcgcctcatactgggtgtaattgtaaaggtcgcaagtatccgggtggatacagttgaggacttcgcctacggcgccaacattctcgttaaccaccttgacgaatctctgcagaaaaaggcactcttaaacgaagaggtagcaagacgagcagagaaactcctcggctttactccgtattccttgctgtggaataactgcgagcatttcgttacttattgcagatacgggactcccattagcccccaatctgacaagttttgtgaaacagtcaagataatcatcagggatcagagatctgtgttagcctctgcggtgttgggactggcctccatagtctgcaccggccttgtgtcttataccaccctgcccgctatatttattccattctttttgtggatggctggctag

SEQ ID NO: 121987 - DNA, 210 bp, Artificial Sequence
  Description of Artificial Sequence: Synthetic coding sequence
atgaaaaatccgatgctggaagtggtcagcctgctgctggaaaagctgcttctgattagcaattttactttgttttctagcggcgctgctggtgaagataaggggagaaattctttctacgaaaccagcagcttccatcggggtgacgtgcttgaggtccctaggacccatctgacccactatggcatctacctgggtgataaccggtag

SEQ ID NO: 121988 - DNA, 693 bp, Artificial Sequence
  Description of Artificial Sequence: Synthetic coding sequence
atgaagaaccccatgctcgaagttgtctctctcctcctggagaaactgctcctgatctccaactttactttattctcaagcggagctgcaggagaagacaagggaagaaatagcttctacgaaacaagctcctttcatcgcggagacgttctagaggtgccaagaacacacctgacccattacggaatctacctgggtgacaaccgtgtagcccatatgatgcccgatatcttgctagcactgaccgatgacatgggccggacccagaaagtggttagtaataaacggcttatccttggcgttatcgtgaaggtggcttcaatccgagtggacactgtcgaggacttcgcttacggagcaaacattcttgtgaatcacttggacgaaagtctgcaaaaaaaggcacttttgaacgaagaagtcgcaagaagagccgagaagttgctgggatttaccccatacagtttgctctggaacaattgcgagcacttcgtgacatattgtagatacggaaccccaatctcaccacagagcgacaaattctgtgagacagttaaaattatcataagggatcagcggtccgtgctggcatcagccgttctcggactggcctcaatagtctgcacgggcctggtcagttatacgacactcccagctatctttattcccttcttcttgtggatggccggctag

SEQ ID NO: 121989 - DNA, 1110 bp, Artificial Sequence
  Description of Artificial Sequence: Synthetic coding sequence
atggtatgggccccacttgggcctccacggaccgactgtctgaccctccttcatacacccagcaaggattcaccaaagatgtccctggaatggttagttgcatggagctggagcctggacggcttacgcgattgcatagctacaggcatccagtccgtaagagactgcgatacgacagccgttatcactgtcgcttgcctgttagtgctgtttgtctggtattgctatcacgtaggtcgagaacaaccccggccatacgtgtcagttaactcactgatgcaggcagcggacgccaatggacttcaaaatggttatgtctactgccagtcacccgaatgtgtccgttgtacccataatgagggcctgaatcagaaactctaccacaatttacaggagtacgcaaaacgctatagctggagcgggatgggcaggattcataaggggattagagagcagggtagatacctaaacagcagaccttctatacagaaacccgaggtgtttttcttgcctgaccttccaactaccccttacttcagtagggacgctcagaagcatgacgtagaggtgctggagcgaaattttcagaccattctctgcgaattcgaaaccctctacaaggctttcagcaattgcagcctcccacagggctggaaaatgaacagcacaccctctggagagtggtttaccttctacctggtcaatcagggagtttgcgtgccacgtaactgcagaaaatgccctcgcacatacaggctgttagggtccctgaggacatgcattgggaataacgtcttcggtaacgcttgcatttctgtgcttagcccggggaccgtaattacggaacactacggacccacgaacatcaggatccggtgccacctgggactaaagacacccaacgggtgcgagctcgtggtggggggagagccgcagtgctgggcagagggccggtgcctgctgttcgatgactcctttctgcacgccgctttccatgaggggtcagctgaagacggcccccgtgttgtattcatggtcgacctatggcacccaaatgtagcggctgcagaacggcaggccttagatttcattttcgctccaggccgctag

SEQ ID NO: 121990 - DNA, 984 bp, Artificial Sequence
  Description of Artificial Sequence: Synthetic coding sequence
atgtcccagcctagtggaggcagagcccctggaactcggatctatagctggagttgtccgacagtgatgagtcccggcgaaaaactcgaccccataccagatagcttcattctgcagcccccagtctttcacccagttgtaccctatgtgacaacgatcttcgggggtctgcacgccggcaagatggttatgctccagggggtggttcccctggatgcacatcggttccaggtcgacttccagtgcgggtgcagcctttgtcctagacccgatatcgccttccactttaatccaaggttccacaccactaaaccacacgtgatatgtaatacactgcatggcggcagatggcagcgtgaggccagatggcctcatctggcactccgcaggggcagctctttccttattctgttcctgtttggcaacgaagaagttaaggtgtccgttaatggccagcacttcttacactttaggtatcgtctccccctatctcacgtggacacattggggatcttcggcgacattctggtggaggcagtcggatttctcaatattaacccctttgtcgaaggaagcagagaatacccagctggacacgaagtgccctgctcacacgccttgcctcagggcctttctcctggccaggtcattatagtgcgcgggcttgtgctgcaggaaccaaaacacttcaccgtttcactgcgcgaccaggccgcccacgcgccagtgactttgcgcgcctcgttcgccgacagaactctggcatggatcagtcgttggggacagaagaaattaattagcgctccattcctgttctacccacagagatttttcgaggtgctgctgctatttcaggagggcgggttaaagttggccttaaacggacagggtctgggagctacaagcatgaatcagcaggctcttgagcagttacgggaattgagaatatctgggtccgttcagctttactgcgtgcactcctag

SEQ ID NO: 121991 - DNA, 1014 bp, Artificial Sequence
  Description of Artificial Sequence: Synthetic coding sequence
atgtctcaaccgagtggcgggagggcccccggcacacgcatttactcctggtcttgtccaactgtgatgagccctggggagaagctggaccctatcccagattccttcatactccagccgccagtgttccatcctgtggtaccatacgtcactacaatctttggaggcctgcacgctggcaaaatggtgatgctacagggcgtggtgccgttggatgcccatagcaggtttcaagtggattttcaatgtggctgcagcctgtgtccacgcccagatattgcgttccatttcaacccgaggtttcacactacaaagccccacgtgatctgtaatactctgcacggtgggcgatggcagcgcgaggcaaggtggccacatttggcattgaggcggggctcttcttttttgattctttttctcttcggtaatgaagaggttaaggtgagcgtgaacgggcagcattttctccactttcgataccgtctccctctgtcacacgtagataccctgggtatcttcggagacatcttggtcgaagctgtcggcttcctcaacattaatccgtttgtagaagggtctcgggagtaccccgccggtcacccctttcttcttatgtcccccaggctggaggtgccatgttctcatgccctgccccagggactcagcccagggcaagtgatcatcgttcgagggctggttcttcaagaaccgaagcactttacagtatcattacgcgatcaggcagcacatgcgcctgtgacattgagggcctcctttgctgatagaacattggcctggatatccagatggggacagaagaagttaatatctgcccctttccttttttacccacagaggttctttgaggtcctcttgctgtttcaggaagggggcctaaagcttgcacttaatggtcaagggctgggcgccacctctatgaatcaacaggcgctggagcagctccgggaactgaggattagcgggagtgtgcagttgtattgtgtgcactcttag

SEQ ID NO: 121992 - DNA, 1011 bp, Artificial Sequence
  Description of Artificial Sequence: Synthetic coding sequence
atgagccaaccctctggtggccgcgctcccggcacacggatttattcttggtcctgtcccaccgtgatgtcaccaggcgaaaagctcgatccaataccagacagttttattctccaacccccagttttccaccccgtggttccctatgtcacgacgatcttcgggggccttcacgcaggaaagatggttatgctccagggtgtagttcccctggatgcgcatcggtttcaggtcgactttcaatgtgggtgtagcctgtgcccaaggcctgatatcgcgttccacttcaatccccggtttcacactacaaaaccccacgtcatttgcaatactctgcacggaggtcgctggcaacgggaagctaggtggccacatctggccttgaggcggggaagctctttccttattctgttcctgtttggaaatgaagaagtcaaggtttctgtgaatggccaacactttctgcactttaggtatcggcttcctctcagccacgtggacacgttgggtatctttggcgatatcctagtcgaggctgtcggattcctgaacattaacccattcgtcgaagggtccagagagtatcctgctggtcacccttttcttctgatgtcccctcggcttgaggtcccctgctcgcacgcactgcctcagggactgtccccaggtcaggtgattattgtgcggggtctggtgctccaagaacccaaacactttaccgtgagccttagggaccaggcagcacacgcaccagttactctaagggcatcattcgcggatcgaactctggcttggatcagcagatgggggcagaagaagctgatcagcgctccttttttgttctatccacagcgcttttttgaggtgttgttgctgttccaggagggtggactcaagctggctcttaatgggcaaggtttgggagcaacaagcatgaatcagcaagcgttagaacaactgagggagctgcggatctccggaagcgtacagctgtactgcgttcacagctag

SEQ ID NO: 121993 - DNA, 828 bp, Artificial Sequence
  Description of Artificial Sequence: Synthetic coding sequence
atggtaatgcttcagggagttgtacctctggacgcgcaccgctttcaggttgattttcaatgcggttgctccctttgtcccaggcctgacattgctttccactttaaccctaggttccacacaactaaaccccatgtgatttgtaataccttgcacggcggtaggtggcagagggaggcacgctggccacacctggcgctgcgaaggggcagctccttcctcattctatttctcttcgggaatgaagaggttaaagtgtctgtaaatggccagcacttcttacactttcgctaccggttgcccctgtctcatgtggatactctaggcattttcggcgatatcttggtcgaggcagttggattcctcaacatcaaccctttcgtggagggctccagggagtaccctgccggccatccattcctactcatgtcccccaggctggaagtgccctgcagtcacgctctgccacaaggcctttcaccagggcaggttataattgtgcggggactcgtccttcaggagccaaaacatttcacggtgtcccttcgtgaccaggccgcccacgctccggtgaccctccgagctagctttgctgaccgcaccctggcatggatcagccgatggggccaaaagaaactgatttccgctcccttcttattctaccctcagcggtttttcgaagtgcttcttctgttccaagaagggggactgaagttggctctcaacggccaggggttgggagctacctctatgaatcaacaggccttagaacagttgcgagagttgcgcatctccggctctgtgcaattgtactgtgtacacagttag

SEQ ID NO: 121994 - DNA, 801 bp, Artificial Sequence
  Description of Artificial Sequence: Synthetic coding sequence
atggtgatgctgcagggcgtcgtgcccctggatgcacatcgctttcaggtcgatttccagtgcgggtgctctttgtgtccccgacctgatattgccttccatttcaaccctagattccacaccacgaaaccccatgtgatctgcaataccctgcacgggggccgctggcagcgcgaagcccgatggccccacttggccctcagaaggggcagctcatttctcatcctgttcctgtttggaaacgaagaggtcaaagtgagcgtgaatggacaacactttctacatttccggtatcggctcccactctctcatgtggatactctgggcatcttcggtgacattttagtggaagcggttggcttcttaaacatcaatccctttgtcgaaggcagccgggaatatcccgccggccacgaggtcccatgtagccacgcgctccctcaaggattgtcccccggccaggtgataattgtccgcggtctcgtgcttcaggagcccaaacacttcacagtctctttgcgggatcaggccgcacatgcccctgttactttgagagcgtcattcgctgaccgaaccttggcgtggatttctcggtgggggcagaaaaaactaatttccgcccccttccttttctatccccagcgctttttcgaggtgcttcttttatttcaggagggaggcctcaagctggcacttaatggtcaggggctgggagccaccagcatgaaccagcaagcacttgagcagttgcgcgagctgaggatcagcggaagcgttcagctgtattgcgtgcactcgtag

SEQ ID NO: 121995 - DNA, 378 bp, Artificial Sequence
  Description of Artificial Sequence: Synthetic coding sequence
atggccgacgaggagttagaggccctccgccgtcagcgcctggctgagttgcaggcaaaacacggtgatcctggcgatgccgcccaacaggaggccaagcaccgggaggcagaaatgcgcaatagcattctcgcgcaggtactggaccagagtgccagggcccgacttagcaacctagctttagtcaaaccagagaaaaccaaggcggtcgagaactacctgattcaaatggcccgatatggccagctgtccgagaaggtgtctgagcagggactgatagaaatcctcaagaaggtctctcagcagaccgagaagacgaccaccgtgaagttcaaccgcagaaaagtgatggactctgacgaggatgacgattactag

SEQ ID NO: 121996 - DNA, 1530 bp, Artificial Sequence
  Description of Artificial Sequence: Synthetic coding sequence
atgggcgtacaggccggactcttcgggatgttaggcttccttggcgttgccttgggcggatcacctgccctcagatggtataggacaagctgtcatctgacgaaggcagttccaggcaatccactcggctatctgagcttcctggctaaagatgcacaggggctcgcactcatccacgcacggtgggacgcccaccgtagactgcagagctgtagttgggaggacgagcctgaactgacagccgcttacggcgccctgtgcgcccacgaaaccgcctggggcagcttcatccacacacccggcccagagctgcagagggccctggctacgctgcagtcccagtgggaggcgtgcagagctttggaagagagccctgccggtgctcgcaagaagcgggccgcgggtcaatcaggagtccctggcggtggccatcagcgagaaaagagagggtggaccatgcccgggacattgtggtgtggggtgggcgacagcgcagggaattcttcagagctgggagtgttccaagggcccgacctctgctgccgcgagcatgaccggtgcccacagaatatttcccccttgcaatataactacggtataaggaactaccgttttcatacaatctctcactgtgactgcgatacgcgcttccagcagtgcttacagaatcagcatgactccatctctgacatcgtgggagtggctttttttaacgttctggagatcccctgctttgttctggaggagcaagaggcctgcgttgcttggtattggtggggggggtgtcggatgtacggaacagtaccgctcgcacgcctacagccccggacgttttacaacgcgtcctggagctcacgtgccaccagtcccactccaagctctcggtcccccgctccacccaaaccaaggcagaaacagcacctccgtaagggaccaccccatcagaaaggatccaaacgtccctcaaaggctaatacgaccgcactgcaggacccaatggtgtcaccccggctggacgtcgcgcccacagggttgcagggaccacagggtggattgaaaccccagggcgcaagatgggtgtgccgatctttcagacggcatctggatcagtgtgaacaccaaatcggaccgcgggagatcgagttccagctcctcaacagcgcacaggagcccctcttccactgcaattgtactagaagactggcgcgcttcctgcgccttcattccccacccgaggtgacgaatatgctttgggagctgttaggcaccacctgctttaagttggccccccctctcgattgcgttgaaggcaagaactgtagccgcgacccacgggccatccgagtgtccgcgcgacatttacgaaggctgcaacaacgccgccatcagctccaggataaagggactgacgagagacagccgtggccttccgaaccattgcggggcccaatgagtttctataatcagtgtcttcagttgactcaagcagctcggaggcccgatcgacagcagaagagttggtcacaatag

SEQ ID NO: 121997 - DNA, 93 bp, Artificial Sequence
  Description of Artificial Sequence: Synthetic coding sequence
atgactggagagctggaggtgaagaacatggatatgaagcccggatccactcttaaaataaccggttcaatcgcggatgggactgatggctag

SEQ ID NO: 121998 - DNA, 1758 bp, Artificial Sequence
  Description of Artificial Sequence: Synthetic coding sequence
atgacacctccccgcctgttttgggtgtggctgctcgtagccggaacccaaggggtgaatgacggtgacatgcggcttgccgacggaggcgcaacaaaccaggggcgcgtcgaaatcttctaccgcggccaatggggtacagtatgcgacaacttgtgggatctcaccgacgcctccgtcgtttgtcgcgcgcttggcttcgagaacgctacgcaagcactcgggcgcgcggcatttgggcagggcagcggcccgattatgttggatgaggtccagtgcacaggtactgaggcatctctggctgattgtaagtccctaggctggctgaaaagtaattgtcggcatgaacgggacgcaggtgtagtgtgcacaaatgaaactagaagcactcatacgttagacttatccagagaattatctgaagcccttggccagatcttcgatagtcagcgcgggtgtgatctctctataagcgtgaacgttcagggggaagatgccctgggattttgcggacacaccgttatcctaaccgcaaacctggaggctcaagcgctgtggaaggaacccggatctaacgttaccatgagcgtcgatgccgagtgcgtgcctatggtgcgcgatctactgcgctacttctattctcggcggatcgacatcacgctttctagcgttaagtgcttccacaaactcgcctcagcgtatggggcaagacagctgcagggctattgtgcatccctgtttgccattctgctgccgcaggacccttcctttcagatgccgctcgacctgtacgcatatgccgtggcaaccggagatgccctgctggagaagctttgccttcagtttctggcttggaatttcgaggcactgacacaagccgaagcctggcccagcgtgcctacagatctgctccagcttctgcttccacggtctgatttagccgtgccttcggaattagccctgctgaaggctgttgacacatggtcctggggcgagagagctagtcacgaggaggtggaaggtttggtggagaagattcgcttccccatgatgttgcccgaagaactgttcgagttgcagtttaatctcagcctatactggagccatgaggctttgttccaaaagaagactctacaggccctggagttccacactgtgccgttccagctgctggccaggtataagggcctcaacctcactgaggatacctataagcctagaatatacacaagccctacctggtctgcttttgtgacagacagcagctggagcgcacggaagtcccagctggtatatcagagccgacggggtccactggtgaagtattcttcagactacttccaggcacctagcgactatagatactacccgtatcaaagctttcagacgccgcagcaccccagctttctgttccaggataaaagggtgtcatggtcactggtgtatctgcccactattcaatcgtgctggaactacgggttcagctgtagctcagacgaactcccggtgctggggctcactaagtccggaggctccgacagaactatcgcctatgagaacaaagccctgatgctatgcgagggcctgttcgtggcagatgtgaccgactttgaggggtggaaggctgcaatcccaagcgctcttgacaccaatagcagtaaaagtacatcgtcctttccttgcccagccggtcacttcaacggttttagaactgtgataaggccattttatttaacgaacagttcaggagtggactag

SEQ ID NO: 121999 - DNA, 1722 bp, Artificial Sequence
  Description of Artificial Sequence: Synthetic coding sequence
atgacgccacccaggcttttctgggtttggctgctggtggcagggacacagggcgtgaacgacggggacatgcgactggctgatggaggggccacaaatcagggcagggtagagatattctacagagggcagtggggaacggtatgtgataacctgtgggacctcaccgacgccagtgtggtgtgtcgagcactgggcttcgaaaacgccactcaggccctggggcgggcggccttcggtcaaggcagtggtcccattatgctagccgactgcaaatcactgggttggctgaagagcaattgtaggcatgagagggatgcaggcgtggtgtgtaccaacgaaacccgctctacccacactctggacctctctcgagagctcagcgaggctctaggacagatatttgactcacagagaggctgcgatctgtctatctccgtgaatgtccaaggcgaagacgcattaggcttctgtggccacacagtgatcttaacagcgaacctggaggcccaagctctgtggaaggagcctggcagcaacgtcactatgtctgtggacgccgagtgtgtgcctatggttcgcgatctgctgcgttatttctacagccgcagaatcgatattaccctctctagcgtcaagtgttttcataaacttgcatcggcttacggcgcgagacagctgcagggctactgcgcatccctgtttgctattctgctgccacaggaccccagctttcagatgcctctggacctgtacgcttatgcggtagcaaccggcgacgcccttctggaaaaactgtgcctgcagtttctggcatggaattttgaagctctgacgcaggccgaggcttggcccagcgtgcccacagacctcttgcaactgttgttaccccgcagtgatttagccgttccctctgaattagcgttgctgaaagcagtggatacttggtcctggggcgagcgggcgtctcacgaagaggtggagggcctcgttgaaaagatacgatttcctatgatgctgcctgaggagctgtttgagttacagttcaatctgtcactgtactggtctcacgaggctttatttcagaaaaagacactccaagccctggagtttcatacggtgcctttccaattactggcaagatataaaggactaaacttgactgaagatacgtacaagccccggatttacacaagccctacctggagcgcttttgtcactgattcctcatggagcgctcggaaatcccagctagtttaccagtcacgtcgtggaccactcgtgaagtactcttccgattactttcaggcaccctctgattatcgctattacccatatcaaagcttccaaactccccagcacccttcttttttattccaagacaagcgagtgtcatggagcctggtttacctccctacgatccagagctgctggaattacgggttctcttgttcctctgacgagctgccggtgctgggtttgactaagtcaggtggatctgacagaaccatcgcctacgagaataaggctctcatgctttgtgaaggcttgtttgtcgcagacgtcactgattttgaagggtggaaggcagccatccccagcgctctcgatactaattcatctaaatccactagctcgttcccctgccctgcaggacacttcaatggcttccgcaccgtgatcaggcccttttatcttacaaatagctccggagtggattag

SEQ ID NO: 122000 - DNA, 411 bp, Artificial Sequence
  Description of Artificial Sequence: Synthetic coding sequence
atgtctaatgtgcctcacaaaagctccctgcccgaaggaatccgtccagggaccgtactcaggatccggggcctggtccctcccaacgcgagtcggtttcatgttaatttgctctgtggagaggagcagggctctgatgcagccctacattttaatccccggcttgacacaagcgaagtggttttcaatagcaaagagcagggaagctgggggcgggaggaaagaggccccggcgtgccctttcagagaggccaacccttcgaggtgcttatcatcgcttctgatgacgggttcaaagccgttgtgggcgacgctcaataccatcacttcaggcacagactgccacttgcccgggtgaggctggtcgaagtgggaggggatgttcagctggacagcgtcaggattttctag

SEQ ID NO: 122001 - DNA, 954 bp, Artificial Sequence
  Description of Artificial Sequence: Synthetic coding sequence
atgatgctttccctgaataacctgcaaaatatcatttacaatcccgtgatccctttcgttggaaccattcctgatcagcttgatcccggcactctgatcgtcattagaggtcacgtccctagcgatgcggacagatttcaggtcgatctccaaaatggcagttccatgaagccgcgggccgatgttgcattccacttcaacccccgattcaagagggcaggttgcattgtttgtaatacacttatcaacgagaaatgggggcgggaagagattacttacgacaccccattcaaaagggaaaagtcgtttgagattgtcataatggtccttaaagacaagtttcaggttgcagtgaacggaaaacacacactgttgtatggacaccggattgggccagagaagatagacacactgggcatctacggaaaagtgaacattcacagcatcggcttctcttttagctctgatttgcagagtacgcaagccagctctctggaactgacagagatttctcgcgaaaatgtgcccaagtccggcacccctcagctgagactcccttttgctgctcgtctaaatacacctatgggcccagggagaacagttgtcgtcaaaggagaggtgaacgcgaatgcaaaaagcttcaatgtcgacctgctggctggcaagtctaaggatatcgctctgcatctgaatccccgactgaacatcaaggcctttgtgagaaacagcttcttacaggaaagctggggcgaggaggagcgcaacattacatcttttcctttctctcccgggatgtactttgagatgattatttactgtgatgttagagaattcaaggtggctgtaaacggcgtccattcacttgagtacaagcatagattcaaggagctgtcaagcatcgatacgttggagatcaatggcgatatccacttgctcgaggttagatcatggtag

SEQ ID NO: 122002 - DNA, 1080 bp, Artificial Sequence
  Description of Artificial Sequence: Synthetic coding sequence
atgatgttgagtttaaacaacttgcagaacatcatttataatcctgttatcccatttgtcggcaccatcccggatcaattggatccaggaactctaatcgtgatccggggacacgtcccaagtgacgccgatcgattccaagtggatctgcagaacgggtcttctatgaagcctcgtgcagatgtcgcgtttcatttcaaccctcggtttaaaagggccggctgtatcgtgtgcaatacgttaatcaacgaaaagtggggaagagaggagataacttatgacactccatttaagcgggaaaagagttttgaaatcgtgatcatggtgttgaaggataaatttcaggtggctgtcaatgggaaacacacactgctctatggacataggatcggccctgagaagatagatacattaggtatctacggcaaagtgaacatccactccataggcttcagtttttcctccgatctgcagtccacgcaggccagtagtctagaattgactgaaatttcccgggagaatgtgcccaagtctggcacaccccagctgccttccaacaggggtggcgatatcagtaagattgcccctaggacagtttatacaaagtccaaggacagcacagtcaatcacacgttgacttgtaccaagatccctcctatgaattacgtgtctaagagacttcctttcgctgctcgcctcaacactcccatgggtcccgggaggactgtggtggtcaaaggcgaggtcaacgccaacgcaaaaagcttcaacgtggatctacttgcagggaaatccaaggatattgccctccacctgaaccccagactaaacatcaaggccttcgtccgcaatagctttctgcaggaaagttggggcgaagaggaacggaacattactagttttccattctctcctggcatgtacttcgagatgatcatctactgcgacgtcagggagttcaaagtggccgttaacggtgtgcacagcttggagtataaacaccgatttaaagagctatcatcaattgacaccctggagattaacggtgatatacatttgctggaagtgcggagttggtag

SEQ ID NO: 122003 - DNA, 1077 bp, Artificial Sequence
  Description of Artificial Sequence: Synthetic coding sequence
atgatgctcagccttaataatctgcagaatataatctacaatccggttattccgttcgtggggacgatacccgatcagctggaccccggaactctgatagtcattcggggccacgtcccctccgacgccgaccgtttccaggtggatctacagaatggctcatccatgaaaccgcgcgctgacgtcgccttccacttcaatccaagatttaaaagggcagggtgtatcgtttgcaataccttgataaatgaaaagtggggccgcgaggagattacttatgataccccctttaagcgcgagaagagcttcgagatcgtgattatggttctgaaggacaagtttcaagtggccgtgaacggcaagcacacattactgtacggccaccgcatcggtccagaaaagatcgacacgctagggatttatgggaaagtcaatattcacagtatcggattttcattctctagcgacctgcagtctactcaagctagtagcctcgaattgaccgaaatctcgcgggagaacgtgcctaagtctggcacaccccagctccgactctctttgccctcttgggaccttcaggggcatgggtccgagaccttcaggtctgtcctgtggacacgcgtcttcgagatagccttctgccggcctctggggacggtcgcgtccttccagcgtctgccattcgcagcccgccttaacacacccatgggacctggtagaactgtggtggtgaagggagaggtgaacgccaacgcaaagagcttcaacgtggacttactcgcagggaagtctaaggacatcgccctccacctgaatcctcgtctgaatatcaaggcatttgtgagaaactcctttcttcaagaatcttggggcgaggaagaacggaatattacctccttcccattttctccaggcatgtatttcgagatgataatctactgtgatgtcagagagttcaaagtcgcagttaacggagtgcactctttagagtacaagcaccggtttaaagagttgtcctcaatcgatacactggagatcaatggtgatatccatttattggaggttaggtcatggtag

SEQ ID NO: 122004 - DNA, 954 bp, Artificial Sequence
  Description of Artificial Sequence: Synthetic coding sequence
atgatgctgtccctgaacaatctgcaaaacatcatttacaaccctgttattccatttgtagggaccattcccgaccaactcgatccaggaactcttatcgtcataagggggcacgtgcctagcgatgctgacagatttcaagttgacctgcagaacggctcaagtatgaaacccagggcggacgtggcgttccacttcaatcctcgatttaagcgcgctgggtgtattgtgtgcaacacccttatcaacgagaagtggggcagggaagaaattacatatgacacgcccttcaagagagaaaagtcattcgagatagtcatcatggtgctgaaggataaattccaagtggccgtgaacggaaagcacaccctgctgtacggtcacagaatagggcccgagaaaatcgacacactgggcatttacggaaaagtgaatattcacagcatcgggttcagcttctccagtgacctgcagagcacccaggctagctccctggaactcacagagattagtagggagaatgtacccaagagtgggacacctcagcttaggctgccctttgcggccaggctgaacacacccatgggcccaggcagaacagtggttgtgaaaggggaggtcaatgccaacgcgaaaagctttaacgtcgatctgttggctggcaagtcaaaggatatagcgcttcatctgaacccaagactcaatattaaagcatttgtccgtaatagctttttacaggaaagttggggtgaggaagagcgaaatatcacctcgtttcccttctctcctggcatgtattttgagatgattatttactgcgatgtccgagagtttaaagtggcggtgaatggcgttcacagtctcgagtataaacatagatttaaggaattgtccagtatagacacactagagattaatggagacatccacctgcttgaagtaaggagttggtag

SEQ ID NO: 122005 - DNA, 627 bp, Artificial Sequence
  Description of Artificial Sequence: Synthetic coding sequence
atgatgttgtcgttaaacaatctgcagaatattatctataaccccgtgataccattcgtcggaactatcccggaccagctagatccgggaacactgatagtgattagaggacatgtaccgtctgacgcggaccgatttcaagtagacttgcagaacggaagcagcatgaagccgcgggccgacgtggcgtttcactttaatccacggtttaaaagggcggggtgcattgtttgcaacacactcattaacgaaaagtggggaagggaagagattacttacgacacaccctttaagcgcgaaaaaagctttgaaatcgtgataatggtacttaaagataaatttcaggtggctgtcaatggaaagcatacactactgtacggacaccgaatcggacctgaaaaaatcgatactctagggatatatggtaaggtcaatattcatagcatcggctttagtttttcaagtgatctgcagtcgacgcaggcaagctctttagagcttacagagattagcagagagaacgttcctaagagcgggaccccgcagctacccagcaaccgcggaggtgacatttctaaaatcgccccaaggacagtgtataccaaaagtaaagactcaacggtctag

SEQ ID NO: 122006 - DNA, 903 bp, Artificial Sequence
  Description of Artificial Sequence: Synthetic coding sequence
atgatgctttcactgaataatctgcagaatattatatataacccggtaataccgtttgtgggcaccatcccggaccagcttgatcctgggactttgatcgttatcagaggccacgtcccatcagatgccgaccgctttcaggtggacctccagaatggttccagtatgaagccccgggctgacgtggcttttcactttaatccccggtttaaaagggctggctgtatcgtctgcaatacactcattaatgaaaagtgggggcgggaggagatcacctacgatactcctttcaaacgcgaaaaatcgtttgagatcgtcatcatggtgttaaaggacaagttccaggtcccgaaatcagggactcctcagcttccctccaaccggggcggcgacataagtaagattgcacccaggaccgtgtacaccaaaagtaaggatagcaccgttaaccacactttgacctgcaccaagatacctccaatgaactacgtgtccaagcgccttccctttgctgctagactgaataccccaatgggccccgggagaacagtggtggtaaagggtgaggtgaacgctaatgctaagagttttaatgtggatctccttgctggaaagagcaaggacattgcattacacctcaaccctcgcctgaacattaaggcctttgtgcggaacagctttctgcaagaaagttggggggaggaggagagaaatatcacctcctttcccttctccccaggcatgtactttgagatgatcatctattgcgatgtcagagagttcaaagttgctgtgaatggcgtacattcattagaatacaaacaccgcttcaaagagctctcgtcgattgacactcttgagatcaacggggacattcatctcctggaagtccggtcctggtag

SEQ ID NO: 122007 - DNA, 1080 bp, Artificial Sequence
  Description of Artificial Sequence: Synthetic coding sequence
atgatgctgtccctgaacaacctccagaacattatatacaatccagtcatccccttcgttgggacaataccagatcagctcgatcccggaactttgatagttatccgcggtcacgtgccttccgatgccgaccgatttcaagttgacctccagaacggctctagcatgaagccgcgcgccgacgtcgccttccactttaatccaagatttaagcgagcgggctgcattgtgtgcaacacccttattaacgaaaagtggggccgggaggaaattacatacgacactccatttaagcgtgaaaagtcattcgagatagttataatggtgctcaaggacaaattccaggtagctgtcaatggaaagcacactctgttgtatggccaccggattgggccggagaagatcgacacgttaggcatttacgggaaggtgaacattcactcgattggattctcctttagctctgacctccagtctacgcaagccagtagtttggagctcaccgagatttcaagagaaaacgttcctaagtccgggaccccccagctgcccagcaatcgcggcggtgacatatcaaagattgcaccaaggacagtttacaccaagtcaaaggattctaccgtgaaccacaccttgacctgtactaaaattccacccatgaactatgtttccaaacggctcccttttgcagcacggctaaatactcctatggggccgggcaggacagttgttgtgaagggcgaagtgaatgcaaatgccaagagctttaacgtggatctcctcgcaggcaaaagcaaggatatagcactgcacctgaaccctaggctgaacatcaaggccttcgtccgcaactcctttttacaggaatcatggggagaagaagagcgtaatattacctccttccccttttcccctgggatgtacttcgaaatgatcatttactgcgacgtgagagagtttaaagttgcagtcaacggagttcactccttggagtataaacatagattcaaagagctcagtagtatcgataccttagagattaacggtgacatccacttgcttgaagtgaggtcctggtag

SEQ ID NO: 122008 - DNA, 507 bp, Artificial Sequence
  Description of Artificial Sequence: Synthetic coding sequence
atgatgctgtcccttaataacctccagaacattatctataatcccgtcataccattcgtaggtacaattccagaccagctggaccctggaaccttaatcgtcatcagggggcacgtgcccagtgacgctgataggtttcaggtagacctccagaatggcagctcaatgaagccccgtgcagatgtcgcctttcacttcaatccgagatttaagcgggcaggctgcatcgtctgcaacactctgataaatgagaaatggggccgggaggagatcacctacgataccccttttaagcgcgaaaaatccttcgaaatcgtaatcatggtgctgaaggacaagttccaagtggccgttaatggaaaacatacattactgtacggacacaggataggcccagaaaaaatcgatacactcggaatctacgggaaggtaaatattcattccataggcttcagcttcagtagcgacctgcagtccactcaggctagttctctggagcttacctag

SEQ ID NO: 122009 - DNA, 321 bp, Artificial Sequence
  Description of Artificial Sequence: Synthetic coding sequence
atgatgctgagccttaataacctgcaaaacattatctacaaccctgtcatcccatttgtcggcacaatcccagaccagctagacccaggtaccctgattgtcatccgtggacatgtgccctctgacgcggatcgcttccaggtcgatctgcagaatggctccagtatgaagcctagggctgatgtggcgtttcattttaatccacgcttcaagagagccggctgcatcgtgtgcaatacattgatcaatgagaagtggggaagagaggaaataacctacgataccccatttaagcgggagaagagcttcgaaattgtctag

SEQ ID NO: 122010 - DNA, 1080 bp, Artificial Sequence
  Description of Artificial Sequence: Synthetic coding sequence
atgatgctgtcgcttaacaatctgcagaacataatttataatcctgtcattccattcgtggggactataccagatcaactcgatcccggtaccctgattgtcatcagaggccacgtaccatctgatgctgaccggtttcaggtcgacttacagaacgggagtagtatgaaaccacgggcggatgttgcttttcatttcaatccacgctttaaaagagcaggatgtattgtttgtaacacactgatcaacgaaaaatgggggcgggaggagatcacatacgatactccgttcaaacgtgaaaagtcctttgaaattgtgatcatggtgctcaaggataaattccaggtggctgtgaatggcaagcacaccctactctacggacatcggatcggcccggagaagattgacacactgggaatttacggcaaggtcaacatccactctatcgggttttcattttcatccgatctccaatctactcaggctagctcgcttgaactgacagaaatctcacgggaaaatgtccccaaatcaggaactccacagctcccctcaaacagggggggtgatataagcaagattgccccacgtaccgtctataccaagtcaaaagatagcaccgtgaaccacactctgacatgcaccaagatccctcctatgaattacgtgtccaaacgtttgcccttcgccgcacgcctcaatacacccatgggacctgggagaaccgttgttgtgaaaggagaggtcaacgcaaatgccaaatctttcaatgtcgacttactcgccggaaaatctaaggacatcgcactccacctgaatccccgcctcaacataaaggcgttcgtgcgcaattctttcctgcaagagtcttggggggaggaggagagaaatatcacgagctttccattcagccccggcatgtacttcgaaatgattatctactgcgatgtacgggaatttaaagtagcagtgaatggtgtacacagtctcgaatataaacacagattcaaggagctgtcgagtatcgacacacttgagatcaatggcgatattcacctgcttgaggtcaggagttggtag

SEQ ID NO: 122011 - DNA, 954 bp, Artificial Sequence
  Description of Artificial Sequence: Synthetic coding sequence
atgatgcttagcctgaacaaccttcagaacataatttacaatcctgtgattccattcgtggggaccatcccagaccagttagatcctggtactctcattgtaattaggggacacgtaccgtctgacgccgaccgatttcaggtggatctacaaaacggctcatctatgaaacctcgtgcagacgtagcattccatttcaaccctcgcttcaagcgcgcagggtgcattgtgtgcaacaccctaatcaatgagaaatggggccgcgaggaaattacctacgacactcctttcaagcgggagaaatcattcgaaatcgtaattatggtgcttaaggataagttccaggtcgccgtcaatggcaaacacactctgctgtacggtcacaggattggcccggagaagattgacaccctcggaatctacggaaaggtgaacattcattctataggattttcattctcgtctgacctgcagagtactcaggcgagttctctggaactgaccgaaatctctcgcgagaatgtgcctaaatcaggtacaccccagctgcgcctacccttcgctgctcgcctgaatacacctatgggcccaggccgaacggtcgttgtcaaaggggaagtgaacgctaacgccaagagctttaacgtggaccttctagctggaaagtccaaagacatagccctgcacctgaacccacgtcttaatattaaggccttcgtgcgaaacagcttcctgcaagagtcctggggagaagaagagcggaacatcacttctttccctttcagtccgggaatgtacttcgaaatgattatttattgcgacgtccgggagtttaaggtagctgtaaatggagtgcattcacttgagtataagcaccggtttaaggagctaagctccatcgataccctcgaaatcaacggagacatacatctgctcgaggtgcgtagttggtag

SEQ ID NO: 122012 - DNA, 1080 bp, Artificial Sequence
  Description of Artificial Sequence: Synthetic coding sequence
atgatgctttccctcaataatctccaaaacattatctataatcccgtcattccattcgtagggactatcccagatcagctcgacccaggtacacttatcgtgattcgaggacacgtaccgagcgacgccgatagatttcaagttgatctgcagaacgggtctagtatgaaaccaagggctgacgttgcctttcactttaaccctcggttcaaaagagccggatgtatcgtgtgcaacactttaatcaacgaaaagtggggcagagaagagattacatacgataccccctttaagcgcgaaaagtccttcgagatcgtcatcatggtgttgaaagataagttccaggtagccgtgaacggaaaacacaccctcttatatggacatagaatcgggcctgagaagatcgacaccttagggatttatggcaaggtgaacattcactccatcggtttttcattctcgtctgatctgcagtctacacaggcctccagcctggagctgacggaaatctctcgcgagaacgtgccgaagagtggaaccccccagttaccttctaatagagggggcgatatctctaagatcgctcccaggaccgtatacacaaagtccaaagattcaaccgtgaaccacactctgacatgtactaaaattccaccaatgaactacgtcagcaaaagactaccttttgctgccaggcttaacacacccatgggcccaggacggaccgtggtggttaagggcgaggtgaatgctaatgccaaatcatttaacgttgatctgctggctggaaaatccaaagacatagcactgcatctcaacccccgactgaacattaaggcatttgtccgtaacagctttctccaggagtcctggggagaggaggagagaaacataacatcgttccccttttcaccgggcatgtattttgaaatgatcatttactgcgatgtgagagaattcaaagtcgccgttaacggagtacacagtctggagtacaagcataggtttaaagaactatcctcaatcgataccttagaaatcaacggagatatccacttactggaggttcggtcctggtag

SEQ ID NO: 122013 - DNA, 132 bp, Artificial Sequence
  Description of Artificial Sequence: Synthetic coding sequence
atgatgctcagccttaacaacctgcagaacatcatctacaaccctgtgataccttttgtggggaccatcccagatcagctcgaccctggaacgttgattgtaatcaggggccacgtccctagcgatgcctag

SEQ ID NO: 122014 - DNA, 972 bp, Artificial Sequence
  Description of Artificial Sequence: Synthetic coding sequence
atggcattctcaggatcacaagcaccatacctgtcccctgctgttcccttctctggaactatccagggcggcttacaagatggactgcagattaccgttaacggcacagtgctctcctcttctggtacccggttcgctgtcaacttccagacagggttctctggcaatgacatagcctttcacttcaaccccagatttgaagacggcggctatgtagtgtgcaacactcgccagaatggaagttggggccccgaggagcgtaaaacacatatgccgttccagaagggaatgccatttgacttgtgttttctggtccagagcagcgatttcaaggtgatggtgaacgggatcctgttcgttcagtatttccaccgggtgccgtttcatcgcgtagacacaatcagcgtaaacggctcggtgcagctatcctatatttccttccaaccacccggcgtttggcccgctaacccggctccaattacccagacagtcatccacaccgtccaatcggcacccggccaaatgttctctacgccagctatccctccaatgatgtacccacatcctgcctatcccatgccgtttataactactattctgggaggcttatatccttccaaatctatcttactctccggaacagtgctgccctctgctcagcggtttcatatcaacttatgctctggcaatcatatcgccttccacttaaacccccgatttgacgaaaatgccgtcgtaaggaatacccaaatcgacaacagctggggttccgaggagcgttcactgcccaggaagatgccgttcgtgcgggggcagagcttcagtgtgtggattctgtgcgaagcccactgtctgaaagtggccgtcgatggccagcacctctttgagtactatcacagactcaggaacttgcctaccattaacaggctagaggtggggggagacattcagctgacccacgtacagacctag

SEQ ID NO: 122015 - DNA, 936 bp, Artificial Sequence
  Description of Artificial Sequence: Synthetic coding sequence
atggctttttcagggtcacaagcaccttacctttctcctgcggtgcccttttcgggaacaatccagggaggattacaggatgggttgcaaatcaccgtgaacggaacagttttaagcagcagcggcactagattcgccgtgaactttcagaccggcttttccggcaacgacatcgcctttcacttcaatccccggtttgaggatgggggctacgtggtatgcaatacacggcagaatggctcctggggaccggaagaacggaagactcacatgccttttcaaaaaggaatgcctttcgacctgtgcttcctcgtccagtccagcgatttcaaggtcatggtgaacggcattctctttgtacagtacttccatcgcgtgccctttcatcgagtggacacgatatccgtaaacggcagtgtccagctgtcttacatcagcttccagacccagaccgtgattcacaccgtccaaagcgctcctggacagatgttcagtacgcctgccatcccacctatgatgtacccccatccggcttatccaatgccattcatcacaacaatactgggaggtttgtaccctagtaagtccatcctgttgtcaggaactgtcctgccgtccgcgcagcgattccatatcaacctttgcagtggtaatcatattgctttccacctaaatccgcgctttgatgaaaatgcagtggttcgcaatactcagatcgacaatagttggggcagcgaggaaagaagcttgcctcgcaagatgcccttcgtcagaggccaaagtttttcggtatggatcctgtgtgaagcgcattgccttaaagtggccgtcgatggtcagcacctgttcgaatactaccaccgactgcgtaacttgccgaccattaataggctggaggtcggtggggatatccagctgacacacgtgcagacctag

SEQ ID NO: 122016 - DNA, 741 bp, Artificial Sequence
  Description of Artificial Sequence: Synthetic coding sequence
atggccttctccggcagccaggccccttacctcagtcccgccgttcccttttccggtacgattcagggcggtctgcaggacgggctgcagatcactgtcaatggaaccgtcctcagttcatccggaaccagatttgctgtgaatttccaaacaggattctcgggcaacgacatagcattccacttcaatcctcgttttgaagatggtggatacgtagtgtgtaacacccgccagaacggatcatggggacccgaggagaggaagacccacatgcccttccaaaagggcatgccattcgatctgtgcttccttgtgcagagtagcgattttaaagtgatggtcaacggcatcctgttcgtccaatattttcatagagtcccctttcacagggtggacacaatttctgttaacgggtccgtgcagctgtcgtacattagcttccagccccccggcgtctggcctgcaaatcctgcccccattacccagaccgtgattcacacagtgcagtctgctcctggacagatgttcagcactcctgcaatcccgcccatgatgtacccacacccggcctaccccatgccatttatcaccacaattcttggtggattgtatccctcaaagagtattctcctgtctgggaccgtcctgccgagtgcccaacgatgcggcagctgcgttaaactgacagcaagccgatggccctggatggtctcaacatgccttaataccacgatcgcctag

SEQ ID NO: 122017 - DNA, 1068 bp, Artificial Sequence
  Description of Artificial Sequence: Synthetic coding sequence
atggctttcagcggctcacaagctccttacctgtcccccgcggttccattcagcgggactatacagggaggccttcaggatggtctgcaaatcacagtgaacggcactgtgctgtcctcctctggtactcggttcgctgtgaatttccagacaggtttttctggaaatgacatcgcttttcactttaatcctcgtttcgaggatggaggctacgttgtctgcaacacaaggcaaaacggcagctgggggcccgaagagagaaagactcatatgcctttccagaaggggatgccattcgatctttgcttcctggtgcagagctctgattttaaggtgatggtgaatggcatcctatttgtgcagtatttccaccgtgtaccgttccatcgggtggacacaatttcagtaaatggatctgtacagctctcttatatatcatttcagaatccaagaaccgtgcccgtgcaaccagctttctccaccgtgccattcagccagcccgtctgcttccccccgaggccccggggccggagacagaaacctccaggtgtgtggccggcaaacccagccccaatcactcagacagtgatacacaccgttcagagtgctccaggccagatgttttctacccccgctataccacctatgatgtatccccatcctgcctacccgatgcccttcataacgaccattcttgggggcctatatccttctaagtccatccttctctccggtacagtgttaccctctgcgcagcgtttccacatcaacctatgctctggtaatcatatcgcttttcacctcaaccctagatttgatgaaaatgccgtagttcgcaacacacaaatcgataatagctggggctccgaggagagaagtctcccgagaaaaatgcctttcgtacgtgggcagtcttttagcgtctggattctatgcgaagcccattgtttgaaggttgccgtggacggccaacatctctttgagtactatcatcgactgagaaatcttccaaccattaaccgacttgaggtggggggagacatacagctaacccacgtgcagacgtag

SEQ ID NO: 122018 - DNA, 666 bp, Artificial Sequence
  Description of Artificial Sequence: Synthetic coding sequence
atggggccattttctgccccggtagagcctgatggcggatatgtggtctgtaatacccgccagaacgggtcatggggccccgaggaaagaaaaactcacatgccattccagaagggcatgccctttgatctgtgtttcttggtgcagagttctgacttcaaagttatggtgaatggaatcctgtttgtccagtactttcatcgggttcccttccacagggtcgatactatttcagtcaatgggtctgtacaattgagttatatttcattccaaaaccctagaactgtgccggttcagcccgcatttagcacagttccattttcccagccagtgtgttttccaccccgtcccagaggccgcagacagaagccacccggggtgtggcccgctaatccagctcccatcactcagaccgttattcataccgtacagtcggcccccgggcagatgtttagcacaccggcgattccccctatgatgtatcctcatcccgcttaccctatgccatttattaccacaattcttggcggactgtacccctctaaaagcatcctgttgtcaggtacggtgctgccctccgcccagcgctgtggcagctgtgtgaaactaactgctagccggtggccgtggatggtgagcacatgtctgaatacaactattgcctag

SEQ ID NO: 122019 - DNA, 360 bp, Artificial Sequence
  Description of Artificial Sequence: Synthetic coding sequence
atggccttcagtgggtcgcaagcaccctacctttcaccggccgtccccttctctggtactatacaaggtggcctccaagacggcctgcagattacggttaatgggaccgttttgagcagttcagggactagattcgctgtcaacttccagaccgggtttagcggtaatgacatcgccttccatttcaatccccgttttgaggacgggggctacgtggtttgtaatacaaggcagaacggaagttggggacccgaagagcgcaaaactcatatgccattccagaaaggaatgccctttgacttatgcttcttggtccaatcttcagacttcaaagtccaccttctgcttctcctgctctag

SEQ ID NO: 122020 - DNA, 1533 bp, Artificial Sequence
  Description of Artificial Sequence: Synthetic coding sequence
atggcaggcagccgccaacgtggtcttcgcgctagggtgagaccattattttgtgcccttctcctgagcttgggtcggttcgtgcggggggatggagtcggaggcgatccagctgtggctttacctcatcgtcggttcgagtataaatactctttcaaaggcccacacctcgtccaatccgacggtacagtcccattttgggctcacgccggcaacgccattccctcctccgaccagattcgggtcgctccttcactgaagtcccagcggggctccgtgtggaccaagacaaaggccgcttttgagaattgggaggttgaggtgacgttccgcgtcacagggcgcggcaggatcggggctgacgggctggcgatctggtacgcagaaaaccagggcttggaaggtccggtgttcggaagcgcagatctgtggaacggtgtgggtatattttttgacagtttcgacaacgatgggaaaaagaacaatccagccattgttatcatcggcaataacggccagatacactacgatcatcaaaacgatggggcatcccaggccctggctagctgccagcgtgactttcgtaacaaaccctatccggtgagagcaaagattacttattatcagaacacgctcaccgtgatgatcaataacggctttacgcctgataagaacgattatgaattctgtgcaaaagtagagaacatgattatccccgcccaggggcacttcggtatctccgccgccacaggcggcctggccgatgatcacgacgtcctgtcattcttaacgttccagcttactgaaccaggtaaagagccacctactcccgacaaggaaatcagtgagaaagaaaaagagaagtaccaggaggaattcgagcacttccaacaagagttggacaagaagaaggaggagttccaaaagggccaccccgacttgcaggggcagccagcagaggaaattttcgaatctgtaggcgatagggagttgagacaggtgtttgaaggacaaaatcggatacacctggagatcaaacagttaaataggcaactggacatgatccttgatgagcagcgtaggtatgtctcttctctgactgaagaaatcagtaagcggggagcggggatgccggggcagcatggacagattacacaacaggaactggatacggtcgtgaagactcagcacgagattctgagacaggtaaatgagatgaagaactcaatgagcgaaacagtgagacttgtgtcagggatgcagcacccaggttcagccggaggagtttatgagaccactcagcacttcatagatattaaggaacatctacatattgtgaaacgcgatattgacaatctggtacagcggaatatgcctagcaacgaaaaaccaaagtgtcctgagcttcctccgttcccctcatgtctctcaactgttcactttattattttcgttgtggtgcagactgtgctcttcattggatacatcatgtaccggagccagcaagaggcagctgccaaaaaattcttttag

SEQ ID NO: 122021 - DNA, 1101 bp, Artificial Sequence
  Description of Artificial Sequence: Synthetic coding sequence
atgcagcctttatggctgtgctgggctttgtgggttcttccgcttgctagccccggcgcagctctgactggggaacagctgcttggcagcctcctccggcagttgcaacttaaggaggtgccaactctcgatagggctgatatggaagaactggtgatccctacacacgttcgcgcccagtatgtggcactcttgcagcgctctcacggcgatagatcccggggtaagagattctctcaatcgttccgagaagtggctggtagattcctggctttagaagcatctacccaccttcttgtgtttggaatggagcaaaggctgccccctaacagcgaactggtgcaagcagtgttaaggctcttccaggagcctgtgccaaaagcggccctgcacaggcatggcaggctgagcccccgaagtgccagagccagggtcactgtcgaatggcttcgggtgcgtgacgacggctctaataggacctctctaatcgactcgcggctcgtcagcgtgcacgaatctggttggaaggcctttgacgtgaccgaggcggttaatttctggcagcagctctcacggcccaggcagcccttgctgctccaagtaagcgtgcagagagagcatctaggtcctttggcttcaggcgcccacaaactcgtgcggtttgctagtcagggggctcccgccggcctcggtgaaccacaattagagttgcatactctagacctgggtgactatggcgcacaaggagactgtgatccggaagcccccatgaccgagggcaccagatgctgtcggcaagaaatgtacattgacttgcagggtatgaagtgggccgaaaattgggtgcttgagcctcccggattcctcgcctacgagtgcgtgggaacatgtagacagccacctgaggctctcgccttcaaatggccatttctcggcccacgtcagtgtattgcttctgaaaccgatagcttaccaatgattgtgtctattaaggaaggaggcagaacgcgtccccaggtcgtgtctctgcctaatatgcgggtccagaagtgctcttgcgctagcgacggggccctggttccgagacggttgcagccttag

SEQ ID NO: 122022 - DNA, 1101 bp, Artificial Sequence
  Description of Artificial Sequence: Synthetic coding sequence
atgtggccactgtggctttgttgggccctgtgggtgctacctctggcgggaccaggggccgccctgacagaggaacaactgctcggcagtttgctgcgccagctgcaattatcagaggtcccggttctagaccgggccgacatggagaagctcgtaattcccgcacacgtgcgtgcgcagtatgtagttttactgaggcgcagccacggcgataggagtaggggaaagcgctttagtcagtccttccgcgaggttgccggaaggtttctcgcgtcagaggcttccacacacttgctggtgttcggcatggagcagagacttccgcctaactctgaactagtgcaggcggtactccggctttttcaggagcccgtaccaaaagcagctctgcacaggcacggccggctgagccctagatctgcccaggctcgggtgaccgtggaatggctccgagtgcgtgacgatggatccaaccgaacttccctgatcgacagccgccttgtgtccgttcacgaatcaggatggaaggctttcgacgtaacagaagccgtcaacttttggcagcaactctcccgtcctcgtcagccgttgttgcttcaggtgagcgtgcagcgagagcatctcggaccactggcttccggagctcataagctagtacggttcgctagtcagggcgcccctgcggggcttggcgagccccagctagaacttcacacactggaccttcgcgattacggggcccagggcgactgtgatcccgaagcgccaatgaccgagggcactcgatgttgcagacaggaaatgtacattgacctgcagggtatgaagtgggcgaagaattgggtcttggaacctcctgggtttctagcttatgaatgtgtcgggacctgccagcaacctccagaagcattagcattcaattggccctttctcggtcctaggcaatgtatcgctagtgaaacagcctccctcccgatgatcgtctccattaaggaggggggaagaactcgaccccaggtcgtctcgctaccaaacatgcgggtgcagaagtgcagttgcgccagcgatggcgcgctcgtgcctaggagacttcagccatag

SEQ ID NO: 122023 - DNA, 999 bp, Artificial Sequence
  Description of Artificial Sequence: Synthetic coding sequence
atgtggccattatggctatgttgggccttatgggtgttgcccctcgccggtcctggtgctgccttaaccgaagagcagttgttgggctcattactacgacagctgcagctgtccgaagttcctgtgctggatcgtgcagatatggaaaaactggtaatccctgcccacgttcgcgcccaatatgttgtgcttctccggaggtcccatggcgatcggtcaaggggaaagaggttctcgcagtcatttcgcgaggtcgcaggccgctttctggctagcgaggctgcgttgcaccggcatggacggctcagtcctcggtccgctcaagctcgtgtcacggtcgagtggctccgcgttcgcgatgacggaagtaaccgcacaagtctaattgactcaaggcttgtgtcagtccacgagtccggctggaaggctttcgacgtgaccgaagctgtgaacttttggcagcagctgagcagacctagacaaccactgctgttgcaggtcagcgtgcagcgggaacatttggggcccctggcctcaggcgctcacaagctggtgaggttcgctagccagggtgcccccgcagggctgggggaacctcagctcgaactccacaccctggacctccgggattatggggctcagggagactgcgaccccgaggcacccatgactgaaggcacccggtgctgccgccaagagatgtatattgatctgcaagggatgaaatgggcaaaaaactgggttctggaacctccagggttcttagcatatgaatgcgtagggacctgccagcagccccccgaggccctggcttttaactggccatttctgggaccccgccagtgtattgcgtctgaaactgcaagtctacccatgatcgtgtccatcaaagaggggggaaggacgaggccccaagtggtcagcctgcctaatatgagggtgcagaaatgctcatgcgctagtgatggagccctcgtcccccggcggttacagccttag

SEQ ID NO: 122024 - DNA, 1131 bp, Artificial Sequence
  Description of Artificial Sequence: Synthetic coding sequence
atggtgtggaaggtggccgtgtttctgtcggtggctctgggcatcggagcagtccctattgacgatccagaggatggcggaaagcattgggtagttatagtggccggcagtaatgggtggtacaattatcggcaccaggcggacgcctgccacgcctaccaaatcatccataggaatgggatcccagacgaacaaattgtggtcatgatgtacgatgatattgcctactcagaagataatcctactcctggcatcgtcatcaatcgcccgaacggcactgacgtctatcagggagtcccgaaggattacactggagaggacgtgactccgcagaatttcctcgctgtgctgcggggcgacgcagaagccgtgaaagggatcggatctggaaaagtcttgaaaagcgggccacaagatcacgtgtttatctacttcacagaccatgggtcaaccggaattctggtgtttcctaatgaagatcttcacgtcaaggatctcaatgagactatccattacatgtacaagcataagatgtacaggaaaatggtattttatatcgaagcgtgtgagtctgggtccatgatgaatcacctgccggacaatattaatgtttacgccacaacagccgctaacccacgcgaaagctcctatgcctgctactatgacgagaagagatcaacctatctcggagactggtactctgtcaactggatggaggactcagatgttgaagacctgactaaagagacattacataagcagtatcacctcgtaaaatcgcacacaaacacaagccacgtgatgcagtatggcaataaaaccattagtaccatgaaagtgatgcagttccagggcatgaaacggaaggcctcatcaccagttcctctccccccagtgactcatctggatttgacccctagccctgacgtgccattgactataatgaagcggaaactcatgaacactaacgacctagaggagagtaggcaattaactgaagaaatccagagacacctggattacgagtacgccctgagacatctctacgtgctggtgaacctgtgtgaaaagccctacccactccacaggatcaaactgagtatggaccacgtttgtctcggacactattag

SEQ ID NO: 122025 - DNA, 1119 bp, Artificial Sequence
  Description of Artificial Sequence: Synthetic coding sequence
atggtgtggaaagtggcagtctttctgtctgtagcactagggatcggtgccgtgccaatcgacgatcccgaggacggaggcaagcactgggtggtcatcgtggctgggtccaatgggtggtacaattacaggcatcaggccgacgcttgccatgcctaccagattattcacagaaatggcatccccgatgagcagattgttgtgatgatgtatgatgatattgcctacagcgaggataacccaacgccagggattgtcattaatagaccaaatggaacagacgtgtaccagggggtgcctaaggattacacaggcgaggacgtgactcctcagaactttctggccgtgctgagaggcgacgccgaagcagtgaaagggattggcagtggtaaggtgctcaaatctggccctcaggaccacgtgttcatatattttaccgaccacggatccaccggtattcttgttttccctaatgaagacctgcacgtcaaagacctgaatgaaactatacattatatgtacaaacacaaaatgtatagaaagatggtattctacattgaagcctgcgagagcggaagtatgatgaaccatcttcctgacaatatcaatgtctacgccaccacggccgccaatccacgcgagtcctcctacgcctgttactatgacgagaaacggagcacgtacctgggagactggtactctgttaattggatggaggattccgatgtggaggatctcacaaaagagaccctgcacaagcaatatcatctggtcaaatcccacactaatacaagccacgttatgcagtatggcaacaagacgatttcaacaatgaaggtgatgcagttccagggtatgaaaagaaaagcttccagccccgtcccactgcctcctgtcacacaccttgatcttaccccctccccagatgttccactcacaatcatgaagcgcaaactaatgaataccaatgatttggaagagtcccggcagctgaccgaggaaattcagaggcatctggatgacaagatcgtccacggaccgcgggtcccgtggtctctcctgaagtcatgcctgctggaggccttcccctcagtctccgcccctccaaccgtatgctag

SEQ ID NO: 122026 - DNA, 1302 bp, Artificial Sequence
  Description of Artificial Sequence: Synthetic coding sequence
atggtgtggaaagtagcagtgtttttgtcggtagccctaggcatcggagccgttcccattgatgaccccgaggacggcggaaaacactgggtggtgatagtagctggttctaacggctggtacaactaccgtcaccaggccgacgcctgccacgcttaccagatcatccatcggaacggcattccggacgaacaaatcgtcgtaatgatgtatgatgacatcgcttactcggaagataacccaacaccaggtatcgtaattaatcgccccaacgggacggatgtatatcaaggagtgccaaaggattacactggcgaggacgttacaccgcagaatttcctggccgtgttgagaggcgacgcggaggcagtcaagggcataggctctggaaaggtattgaagtctgggcctcaggatcatgtgtttatctacttcacagatcacgggagcaccggaattctggtcttccctaatgaggacctgcatgtcaaggatttgaatgaaacaattcactacatgtataagcacaagatgtacagaaagatggttttttacattgaagcctgcgaatctgggtctatgatgaaccacttgccagataacattaatgtgtacgcaacgaccgctgctaaccccagggaaagtagctatgcttgttattacgacgaaaagaggtccacctacctcggggattggtatagcgtgaactggatggaggactcagatgtagaggacctcaccaaagaaaccctgcacaaacagtaccacctggtcaagtctcacacaaatacttcacatgtcatgcagtatggcaacaagaccatctccactatgaaggtgatgcagtttcaggggatgaagcggaaggcgagcagccccgtacccctgccacctgtgacacacctggatttgaccccctcacccgacgttcccctcacgattatgaagcgtaaactgatgaatactaatgacctcgaagagtcaagacagttgacagaggaaattcagagacaccttgacgcccggcacctgatagagaagagtgttcgcaaaatcgtttccctgctcgcagcaagcgaagctgaggtggaacaactcctgagtgagagagcccctctgacgggccacagctgttaccctgaggcattgctccattttcggacacactgcttcaactggcacagtccaacgtacgagtacgctctgcgacatttgtatgtgttggtgaatctctgcgagaaaccatatcccctccacaggatcaagttgagtatggatcacgtctgtctcggtcactactag

SEQ ID NO: 122027 - DNA, 1302 bp, Artificial Sequence
  Description of Artificial Sequence: Synthetic coding sequence
atggtctggaaagtggccgtgttcctgtctgttgcgttggggattggcgctgtgcctattgacgatcctgaggacggcggcaagcactgggtggtgatcgtggctggctctaatggctggtacaattatcgtcaccaagcagacgcctgccacgcataccagataattcaccggaatggtattccagatgagcagatcgtggtcatgatgtacgatgatattgcatactcggaagataatcccactccgggaattgtaataaacagaccgaacggcaccgatgtgtaccagggggttccgaaggattacactggtgaagacgtgaccccgcagaatttcctggccgtgttgaggggagatgcagaggcagtgaaaggcattggctccgggaaagtgcttaagtcaggccctcaggatcatgtctttatctactttaccgaccatggcagcacgggaatcctggtgttcccaaacgaggacctccacgtgaaagatctgaatgagacaatccattatatgtacaaacataagatgtatcgcaaaatggtgttctacattgaagcttgtgagagcgggtccatgatgaaccatctgccagacaatatcaatgtgtacgcaaccacggccgcaaaccccagagagagttcttacgcgtgttattacgatgaaaagaggagtacgtatctcggcgattggtattccgtgaattggatggaagattccgacgtggaggacctgacaaaggagactctgcataaacagtaccacctcgtgaaaagccatactaacacctcccacgttatgcaatacgggaataaaacaatcagcaccatgaaggtaatgcaatttcaagggatgaagaggaaagcatctagtccagtgccactccctcccgttacccatctggatctgaccccaagtcccgatgtgccacttactatcatgaaaagaaagcttatgaacacaaacgaccttgaggagtcacgtcaacttacagaagaaatccagcgccatcttgatgctcgccacctcatcgaaaaatctgtacgaaaaatcgtttcactattagcagcatctgaggcggaggtggagcaactcctttcagagagggctccactaaccgggcacagctgctatcctgaagcactgctccactttcgcacacattgctttaattggcattcccccacgtatgagtacgccctccgtcatttgtatgtactggtgaacctatgtgagaaaccctatcccctgcaccgaatcaaattaagtatggatcacgtttgtctgggccactactag

SEQ ID NO: 122028 - DNA, 1197 bp, Artificial Sequence
  Description of Artificial Sequence: Synthetic coding sequence
atggtgtggaaggtcgcggtgttcctcagcgtcgcactcggtatcggcgccgtgccaatcgatgaccccgaagacggaggcaaacactgggtcgtgattgtggcaggtagcaacggctggtataactataggcatcaagcggacgcctgtcacgcctatcagatcatacatagaaatggtataccagatgaacaaatcgtggttatgatgtatgacgtcacaccccagaactttctggccgtgctcaggggcgatgctgaggcggtgaaaggcataggttctggcaaagtactgaaatccggaccccaagatcacgtgttcatttactttaccgaccacgggtccaccggcatcctggtcttccctaatgaagatctccatgtgaaggatctgaatgaaacaattcactatatgtataaacacaagatgtacaggaagatggttttttacattgaggcctgtgagagtggatctatgatgaaccatctccccgacaatattaatgtgtatgcgacaacggccgctaacccgcgggaatccagctacgcctgttattacgacgagaagcggtctacctatttgggggactggtactctgtgaattggatggaggacagcgacgtggaggacctgactaaagaaacgctgcataaacagtaccatttagtgaagagccataccaacaccagccatgtcatgcagtatggcaataagacaatctcaacaatgaaggtgatgcagttccaggggatgaaacgtaaagcttcctcacccgttccacttcctcctgtgacgcatctcgatttgacaccatcaccagatgtgcctctgacaatcatgaagaggaagctgatgaacaccaacgatctggaggaaagtagacagctgaccgaggagattcaacgacatcttgacgcccgccatctcatcgaaaaaagcgtgaggaagatagtttccctcttggcagccagcgaggcagaggtggagcaactcctgtccgaaagggcgcccctgacaggtcacagctgctatcccgaagccctgctgcactttagaactcactgttttaattggcactcccctacctatgagtacgcgctacgccatctttatgtccttgtgaacctgtgtgaaaaaccataccctctacacaggatcaagctaagcatggaccacgtctgtttgggacattactag

SEQ ID NO: 122029 - DNA, 1233 bp, Artificial Sequence
  Description of Artificial Sequence: Synthetic coding sequence
atggtctggaaggttgctgtcttcctcagcgtcgctggcagcaacggctggtataattacagacaccaggccgacgcctgccatgcctaccagatcatccaccggaatggcatccccgatgaacaaatcgtggtcatgatgtatgacgatatcgcatatagtgaggacaatcctacccccggtatagtcattaatagacctaatggcacagacgtttaccaaggtgtcccaaaggattacactggcgaggacgtgacgccacaaaattttcttgcggtgttgaggggggacgccgaggccgtcaagggtatcggatccggaaaagttctgaagtctgggcctcaggatcatgtcttcatttattttaccgatcatggcagtactggaatcctggtgttcccaaatgaagacctgcacgttaaggatcttaacgaaacaattcattacatgtacaagcataagatgtataggaaaatggtcttctatatcgaggcatgcgagtctggatccatgatgaatcatctgcctgataatatcaacgtttatgccactaccgcggcaaacccccgtgagagcagctacgcctgctactatgatgagaaacggtccacttatttaggtgactggtacagcgtaaactggatggaggacagcgacgtcgaggatttaaccaaggagacactgcacaaacagtatcatcttgtgaagtcccacacaaatacctctcatgtgatgcagtatgggaacaagaccatcagtacaatgaaagtcatgcagttccagggcatgaaaagaaaagcgagctctcccgtacccttacctccggtcacccaccttgatttaaccccgtctcctgacgtgcctctgactatcatgaagaggaagctcatgaataccaatgacctcgaggaaagccgtcagctgaccgaggagattcagcgacacctggacgcacgtcatctgatcgagaagtccgtcaggaagattgtctcgcttctcgcagcctcagaggcagaggtggagcaactactgtccgagcgcgcacctttgacagggcacagttgttacccagaagccctgctgcattttcggacacattgtttcaactggcactcaccgacctatgagtatgccttacgtcacttatacgttttggtcaatttatgtgagaagccttacccgcttcacaggattaagttgtcaatggatcatgtttgtctgggccattactag

SEQ ID NO: 122030 - DNA, 174 bp, Artificial Sequence
  Description of Artificial Sequence: Synthetic coding sequence
atggtgtggaaggtcgccgtgtttctgtcagttgctctgggaattggggctgtgccaatcgacgaccctgaagacggcgggaagcactgggtggttatagtggccggctctaacggttggtataactacagacaccaagccgacgcatgtcacgcctatcagataatacattag

SEQ ID NO: 122031 - DNA, 60 bp, Artificial Sequence
  Description of Artificial Sequence: Synthetic coding sequence
atggtgtggaaggtggccgtctttctaagtgtggcactcggtatcggggctgtgccttag

SEQ ID NO: 122032 - DNA, 177 bp, Artificial Sequence
  Description of Artificial Sequence: Synthetic coding sequence
atggtttggaaggtcgcggtcttcctgtccgtggccctcgggatcggcgccgtcccgatcgatgaccccgaggatggtggcaaacactgggtcgtgattgttgcgggcagcaacggatggtataactatcggcatcaggcagacgcatgtcacgcttaccagataattcacaggtag

SEQ ID NO: 122033 - DNA, 237 bp, Artificial Sequence
  Description of Artificial Sequence: Synthetic coding sequence
atggtgtggaaggtggctgtcttcctaagtgtcgccctgggaataggcgcagtgccaatcgatgatcccgaggacgggggaaagcactgggttgtcatagtggctgggagcaatggatggtataattaccgacaccaagcagacgcttgccatgcgtaccagatcatacacaggaacggcattcctgatgaacagatagttgtgatgatgtacgatgatattgcttattcggaatag

SEQ ID NO: 122034 - DNA, 237 bp, Artificial Sequence
  Description of Artificial Sequence: Synthetic coding sequence
atggtgtggaaggtggcagttttcctctctgtcgcgcttggtatcggagccgtaccaattgacgatcccgaggatggcggtaaacattgggtggttatagtcgctggcagcaacggttggtacaactatcgtcatcaggccgacgcgtgccacgcataccagataatccaccgcaacggtatccctgatgagcaaattgtggtgatgatgtacgacgatattgcttattctgaatag

SEQ ID NO: 122035 - DNA, 2736 bp, Artificial Sequence
  Description of Artificial Sequence: Synthetic coding sequence
atggctgcagcggccgccagcgcaccccagcagcttagcgatgaggagctgtttagccaattgcggagatatggcctgtctccggggcctgtaaccgaaagcactcggcccgtgtacctcaaaaagctgaaaaaactcagggaggaggaacagcagcagcatcggtcgggcggccgcgggaataaaactaggaacagcaataacaacaataccgctgccgcgacagtcgccgctgccgggccggcagccgccgccgccgcaggcatgggtgtcagacccgtgtctggtgacttgtcatatctgcgcacccctggggggctatgccggataagcgctagtggcccggagtctctgctgggtggcccaggcggtgcgtctgccgctccagccgccggttctaaagtgttgctcggcttttcgagcgacgaatccgatgtggaggcttccccccgagatcaagcaggcggcgggggccgaaaggatagagccagtctgcagtacagagggctcaaagctccaccggccccactggccgcttcagaggtcacgaactccaactccgccgagagaaggaagccacactcgtggtggggagctaggaggcccgccgggccggaactacagacccctccgggcaaggatggagctgtggaagatgaggagggggaaggagaggacggcgaggaacgcgacccggagactgaggagcctttgtgggcatctcgcacagttaacggctctagactcgtaccttacagctgtagagagaactattctgacagcgaagaagaggatgacgatgacgtcgccagttcccggcaggtcctgaaagatgacagtctttctcggcatagaccaagacgaactcattctaagcctctccctccactgaccgccaaatccgccgggggacgccttgaaacctcagtgcagggtggcggcggactggccatgaatgacagggctgctgcagctggatccctcgacagatcccggaatcttgaggaggccgccgccgctgagcaaggaggcggctgcgaccaagtggacagctcaccggtgccccggtaccgcgtcaatgcaaagaagctcactccactgctcccgccccctttgacagacatggactcaaccctcgattccagcaccggctccctgttaaaaaccaacaaccatatcggaggaggcgccttcagcgttgattctcctagaatttactcaaacagtctccccccaagcgccgcagttgccgccagctccagtctccgcatcaatcacgccaatcacacgggctcaaaccatacctacttgaaaaacacctataacaaacctaagctgagtgagcccgaggaagaactgctgcaacagtttaagagagaggaagtctccccgaccggcagcttttcagctcactacttatctatgttcctattgacagccgcatgcttgttctttcttatactcggccttacctatttgggcatgaggggaacaggggtatcggaagatggcgaactcagtatagagaatccttttggcgaaacattcggcaagattcaggagtccgaaaaaacacttatgatgaataccctgtacaaactgcacgatagacttgcacagctggccggtgaccacgagtgcgggagcagtagccagagaaccctcagcgtccaggaagccgcagcctatctgaaagacctgggtcccgagtacgagggcatatttaacacgagcctgcagtggatcctggaaaacgggaaggatgtgggcattaggtgcgtgggctttggccctgaggaagagctcacgaacatcacagacgtccagttcctgcagtccactcgtcctttaatgagcttctggtgccgctttagacgcgcattcgtcacagttactcaccgtcttctgctgctgtgcctgggagtagtgatggtgtgtgtggtgctgcgctacatgaagtatagatggacgaaggaagaggaggaaacacgccaaatgtacgacatggttgtgaagattatcgatgtcttgcggagtcacaatgaggcctgccaggaaaataaagaccttcagccctacatgcctattccacatgtgcgagacagcttaatccaaccacatgaccgaaagaagatgaaaaaggtctgggatagagctgtggacttcctggcggccaacgagtctcgggttagaaccgaaactcggcgcattggcggtgctgattttctggtatggaggtggattcagccttctgcatcatgcgacaagatcctcgtcattcccagcaaggtgtggcagggccaggcgtttcacctcgacagaaggaattctccacctaattcactgacgccctgccttaaaattcgcaatatgttcgacccagtcatggagattggagatcagtggcatttagcaatacaggaagccattcttgagaaatgcagcgacaacgatggtatcgtgcacattgccgtggacaagaactccagggaagggtgcgtatacgtaaagtgcctgtctcccgagtacgccgggaaagctttcaaggcattacatgggagctggttcgacggaaagttggtcacagtaaagtacctacgactcgatcggtatcaccacaggtttcctcaggcgctgacttccaacacaccgctcaagcctagcaacaagcacatgaattctatgtctcatctgaggttgcgtaccggcttaaccaatagccagggatcatcttag

SEQ ID NO: 122036 - DNA, 4512 bp, Artificial Sequence
  Description of Artificial Sequence: Synthetic coding sequence
atgccaggcccgccagctctgaggaggcgattgctgcttttgctacttgttctcctaattgccggcagcgccggagcagcaccgctaccgcagacaggagccggggaagctccccctgccgctgaagtgtcgagcagcttcgtcatcctctgcgtctgctctttgatcattctcattgttcttattgccaattgtgttagctgctgtaaggacccagagatcgatttcaaggagtttgaagacaattttgacgatgaaatcgactttacccctccagcggaggacactccatctgtgcagagccctgcagaggtttttacactaagcgtgccaaacatatctctcccagccccgagccagttccagccctccgtggaagggctgaaaagtcaggtagcacgacatagcctcaactatattcaggaaatcggaaatggttggtttggtaaagtgctccttggcgagatatacacaggaacttctgtggcccgtgtcatcgtgaaagaattaaaggccagcgcgaatccaaaggagcaagacactttccttaaaaatggcgaaccttactacattctgcagcatccaaacattcttcagtgtgttgggcaatgcgtggaagccataccttacctgctcgtgttcgagttctgtgacctaggagacctgaaggcttacctgcgtagtgaacaggagcatatgaggggcgacagtcagacaatgctcctgcagaggatggcatgcgaggtagccgcaggcctggctgcaatgcataagctgcatttcttgcactccgatctggcgctgcgaaattgctttcttacgtcagacctgaatgtgaaagtcggagactacggtatcggtttctcccgttacaaagaagattacatcgagaccgacgataagaaagttttcccacttcgctggacagccccagaactggtgactagcttccaagaccggctgctgacagcagaccaaacaaagtattccaatatctggagcctcggagtgaccctttgggaattattcgataatgcagcgcagccatactcaaaccttagtaaccttgatgtgctcaaccaagttattcgcgaaagagatactaaactgcccaaaccccagttggagcagccctattctgatagatggtacgaggtgctgcagttttgttggctttcgcctgaaaaaagaccggcagctgaggatgtacatcgactgctgacatatctgaggcttcagtctcagcgagatagcgaagtggacttcgagcagcagtggaacgccctgaaacccaacacaaatagccgggactcaagcaataacgctgcgttccctatccttgaccatttcgctagagatcgactggggagagagatggaggaagtgcttacggtgaccgaaacatctcagggtctttcttttgagtatgtctgggaggcagctaaacacgaccactttgatgagcggtcccgagggcacctggacgagggcctttcttacaccagcatcttttaccctgtggaggtcttcgaaagcagcctaagtgatcccggcccaggtaaacaggacgattccgggcaggatgtacccctgcgagtgcctggcgtggtacctgtgttcgatgcccacaacttgagtgtgggaagtgattattacattcagctggaggagaaatccggttctaacttagaacttgattatccacccgccctcctgacgactgacatggataacccagaacgaactggtcctgagcttagtcagctcaccgccttaagatctgtggagctggaagagtcctccactgatgaagacttctttcaatcttctacggaccccaaggactcctcccttcccggggacttacatgttaccagcggacccgaatccccgtttaacaacatctttaatgacgtggataaaagcgaggatcttccttcccaccagaaaattttcgatctcatggaacttaacggagtgcaagccgacttcaagccagcaacgttgtcaagtagcctagataatccaaaggaatctgttatcactggccactttgagaaagaaaagcctcggaaaatctttgactccgaacctctatgcctctcagataatctgatgcatcaggataacttcgacccgcttaatgtccaggagctcagcgagaattttctctttctgcaggaaaagaacctcctcaagggtagcctgtcctctaaggaacacatcaacgacctgcagaccgagctcaaaaatgccggctttaccgaagccatgttggagaccagctgtcgtaactcactagacactgagcttcagttcgctgaaaacaagccaggattgagcctgctccaggaaaatgtaagtaccaagggagacgacaccgatgttatgctgacgggagataccctgtccacatcgctgcagtcgtccccagaggtccaggtgcccccaacaagctttgagaccgaggagacaccacggcgggtgcccccggactccctgcctactcagggagagacccaaccaacttgtctcgacgttatagtacctgaggactgcctacaccaagacataagtcctgatgccgtaaccgttcccgtcgaaatcctctcgaccgatgccagaactcattcgctggacaaccggtcccaggattctcccggcgagtcagaggagactctgcggctgacagaatcagacagcgtcttggccgacgacattctggccagtcgcgtgagcgtgggaagctcgctccctgaactgggccaggagctgcacaacaaaccattcagcgaagaccaccactctcaccgtcggttagagaagaatctcgaggctgtcgaaacattgaaccaacttaattctaaggacgccgcgaaagaagctggtctcgttagcgcgctgtcctcagatagtaccagccaggattcgcttctagaggacagcctgtccgccccgttcccagcctcagagcccagccttgagacccctgattctctagagagcgttgacgtgcacgaggccctgctcgactcgctgggaagccacacacctcagaagcttgtgcctccagacaagccggctgactcaggctacgagacagaaaacctcgagtctccagagtggacgcttcatcccgcccccgagggtaccgccgactccgaaccagcaaccactggtgacggtggacactctgggctccccccgaatcccgtgattgtgatttccgatgccggcgacggtcacaggggcaccgaggtgaccccagagacctttacagctggctcacaggggtcctaccgagacagtgcctacttttctgataacgatagtgagcctgaaaagaggagcgaggaggtgcctggcacatcaccttctgccctggtccttgtgcaagagcaaccactgcccgagccggtgctgcccgagcagtcgcctgctgctcaggatagctgcctggaggcccggaaatctcagccagacgagtcctgcctgagcgcactgcacaacagtagtgacctggaactgagggctacgccagagccggcccaaacaggcgtccctcaacaggtacacccaactgaagatgaggcatcatccccctggtccgtactcaacgctgagttgtcatcaggggatgattttgagacacaagacgaccggccctgcactttagcgtccaccggaacgaataccaacgagctgctggcttacaccaactcagccttggacaagagtctctccagccattctgaaggtccaaaactgaaagaacccgatatcgagggaaaatatcttggaaaactcggggtctctggcatgttagacttaagcgaagatgggatggatgccgacgaggaggacgaaaattccgatgactctgatgaggacctgagagccttcaatttgcactctctgtccagtgaatcagaagatgagactgaacaccctgtgcccattatcctgtctaatgaggatggccgacacttgcggtcactgctcaagcctaccgctgcgaacgcccctgatccattgcctgaggactggaaaaaagagaaaaaggcagttacctttttcgacgacgtgactgtttacctttttgaccaggaaacacccacaaaggaattgggcccatgtggcggcgaggcctgtgggccagacttgtccggtcccgcgccagcatctggctctccatatttgtccagatgtatcaacagcgaatcatcgactgatgaggagggaggaggttttgagtgggacgatgacttctctcctgacccctttatgagcaaaaccacctccaaccttctgtcaagcaagccaagcttacagaccagtaagtacttttctccgcccccgcctgctcgatccaccgaacaaagttggccacacagcgctccctattccagattcagcatctcccctgccaacatcgcctcgttctcacttactcacctgacggattctgacattgaacagggcggcagttctgaagacggcgagaaggattag

SEQ ID NO: 122037 - DNA, 186 bp, Artificial Sequence
  Description of Artificial Sequence: Synthetic coding sequence
atgcagccaaggacacagccactcgcacagacattgcccttctttctaggcggtgcccctcgggatacgggcctgcgcgtgccagtgatcaaaatgggtactggctgggaaggatttcagcggacgctcaaagaggttgcgtatatccttttgtgctgctggtgcatcaaggagctgctggactag

SEQ ID NO: 122038 - DNA, 186 bp, Artificial Sequence
  Description of Artificial Sequence: Synthetic coding sequence
atgcaacccagaactcagcctttggctcagaccctgcccttctttctgggaggggcccctcgtgatacaggactaagagtaccagttattaagatggggacaggctgggagggatttcagaggactcttaaagaggtggcctacatcctcctgtgctgttggtgtataaaggaactgctcgattag

SEQ ID NO: 122039 - DNA, 522 bp, Artificial Sequence
  Description of Artificial Sequence: Synthetic coding sequence
atgtactcctttatgggcggcgggctgttctgcgcctgggtaggaacaatactcttggtggtcgccatggcaacggaccattggatgcagtatagactctctggctcctttgctcaccaaggtctgtggcgctactgcctcggcaataagtgctacctgcaaacagactccatcgcttactggaacgccaccagggctttcatgatactcagcgctctgtgcgcaatttcggggatcattatgggcataatggcattcgcccatcagcccactttctcccggatcagcagacctttctccgccggaatcatgttcttctcttctaccctgtttgttgtgctcgctctggccatttacactggggtgaccgtctcttttcttggcaggagatttggagattggagattcagctggtcatatatccttgggtgggtggccgtattaatgacgttttttgcgggcatattttatatgtgtgcttatcgagtgcacgagtgccggcgactgtcaacccctagatag

SEQ ID NO: 122040 - DNA, 681 bp, Artificial Sequence
  Description of Artificial Sequence: Synthetic coding sequence
atgcccggaggcccgggcgtgctccaggcactcccggcgactatcttcttactgtttttgctctccgcggtgtaccttggacccgggtgccaggctctgtggatgcacaaggtaccggcttcactgatggtttctcttggggaagacgctcatttccaatgtcctcacaactctagcaataacgccaatgttacctggtggagggttctacacgggaattatacctggcccccggaatttctgggaccgggggaggaccccaatggtactctcattattcagaacgtgaataagtctcatgggggtatttacgtctgcagggtgcaggagggaaatgagtcttaccagcaatcatgcggcacatatctacgcgtgcgccagcctccaccccgcccatttttagacatgggggagggaactaagaaccgaatcataactgccgagggcatcatcttgctcttctgcgcagtggtgcctgggacgttgctcctctttcgaaaaaggtggcaaaatgaaaaactgggcctggacgcaggtgacgaatacgaggatgagaacctgtacgagggtctgaacctcgatgattgttcaatgtacgaagatataagcaggggcctgcagggaacataccaggacgtcgggagtttaaacatcggcgatgtgcaactggaaaaaccttag

SEQ ID NO: 122041 - DNA, 2001 bp, Artificial Sequence
  Description of Artificial Sequence: Synthetic coding sequence
atggctgacatggaagacctgtttgggagtgatgctgacagcgaggctgaaagaaaggatagcgacagcggtagcgatagcgactccgaccaagagaatgccgcaagtgggtccaacgcaagcggaagtgaatccgatcaggacgagaggggggacagtgggcagccaagcaataaggaactgtttggagacgactcggaggacgagggagcatcacatcactccggctccgataaccactcagagcgtagtgacaatcggagcgaggctagtgaacgcagcgaccatgaagacaacgacccctccgacgtcgatcagcactctggatccgaagcacctaatgatgacgaggatgaggggcacaggtccgatggcggttcgcaccattcagaggctgagggatccgaaaaggcgcattccgatgacgagaaatggggacgtgaagacaagtccgatcagtccgacgacgagaagatccagaattccgacgacgaggagcgggcacaagggagtgacgaggacaagttgcagaattcagacgacgatgaaaagatgcagaacacagatgatgaggagagaccccagctttctgatgacgagaggcagcaattgagtgaggaggaaaaggccaattccgacgacgagcgccctgtagctagcgacaacgacgacgaaaagcagaattctgacgacgaggagcaaccacagttgtctgacgaggaaaagatgcagaatagtgatgatgaacgcccccaggcgtccgatgaggagcatagacattctgacgatgaggaagagcaagaccacaagtcagaatctgcaagaggctcagattccgaggatgaggtgctgcggatgaagagaaaaaacgccattgcttccgactctgaagccgattccgacaccgaggtccccaaagacaatagcggcacaatggatctcttcggtggggcagacgacatctccagcggctccgacggcgaagacaagcccccgactccaggtcaacccgtggacgaaaatggacttcctcaggaccagcaagaggaagagcccattcctgaaactcggatcgaggtcgagatacctaaggtgaacacagatctggggaacgatttgtactttgttaagctgccgaacttcctaagcgttgagccccgcccatttgatccacagtattacgaggatgagttcgaagacgaggagatgctagacgaagagggacggacacgactaaagctgaaggtggaaaatacaatcagatggcgcattaggcgcgacgaggaggggaacgagatcaaggagagtaacgcacgaattgtaaagtggtctgatgggagcatgagcttgcatctggggaacgaagtgtttgacgtgtacaaggcgcccctgcagggagaccacaaccacctctttatcagacagggaacaggcctccagggacaggcggttttcaagaccaaattgacgttccgccctcattcgaccgattctgcgacacatcggaaaatgacactctctcttgcggataggtgcagcaagacccagaagattagaattttgccaatggctgggcgggaccccgagtgtcagagaacagaaatgattaagaaggaggaggagcgcctccgggctagcatacggagagaaagccaacagaggcgcatgagagaaaaacagcatcaacgaggactcagcgcctcttatcttgaacccgaccgctacgacgaggaggaggaaggggaagagagcatttctctggctgccatcaagaacagatataagggaggtattcgtgaggagagagctaggatatattcaagtgattccgatgaggggtccgaggaggataaggcccagaggctcctcaaggccaaaaagttaacaagtgacgaagaaggggagccgagtgggaaacgcaaggccgaagacgatgacaaggccaataagaagcacaagaaatacgtaatctctgatgaggaggaagaagacgacgactag

SEQ ID NO: 122042 - DNA, 1821 bp, Artificial Sequence
  Description of Artificial Sequence: Synthetic coding sequence
atggctgacatggaggatctgttcggatctgacgccgactccgaggcagagaggaaagatagtgactccgggtccgactccgattcagatcaggagaacgcggcctcaggctcaaatgcatcagggagcgagtctgaccaggatgagcgaggcgacagcgggcagccttctaataaagagctatttggagacgatagcgaggacgagggagcaagccaccacagcggttctgataatcatagcgaacgctcagataacagatccgaggcctccgagaggtccgaccacgaagataacgatccgagcgatgtcgaccagcattctggcagcgaggcacctaacgacgatgaggatgagggtcatcgaagcgatggcggctcccaccatagcgaagccgaggggtcagaaaaggcgcacagcgatgatgagaaatggggacgcgaggacaagtccgatcagtcagatgacgagaaaattcagaactccgacgatgaggagcgggctcagggatctgatgaagacaagttgcaaaactccgacgatgacgaaaagatgcagaacaccgatgacgaagaaaggccccaactctcagacgatgaaagacaacagctgtccgaggaagaaaaggcaaacagcgatgacgaacggcccgtggcttccgacaacgacgacgagaagcagaattcagacgatgaggagcagccacaactgtctgacgaagagaagatgcagaactctgacgacgaacgaccccaggcatccgatgaggagcatcgacactccgatgacgaagaggaacaggaccacaagtccgagtcagcccgggggagtgatagtgaggatgaggtgctgcgaatgaaaagaaagaacgccattgcttctgatagcgaggcagatagcgataccgaggtgcccaaggacaactctgggactatggacctttttggaggagccgacgacattagtagtggttccgatggggaggacaaaccgcctacccccgggcaacccgtggacgagaatggtctgccacaggaccagcaggaagaggaaccaatcccagagactaggatcgaggtcgaaatccccaaggtgaacacagatctgggaaatgacctttattttgtgaaactgcccaatttcctgagcgtagaaccatccatgtccctgcaccttgggaacgaagtcttcgacgtctacaaagctcctttgcagggcgaccataaccacctatttattcgacagggaaccggcctccagggccaggctgtgttcaagactaagctcacctttcgccctcactctacagatagcgctacgcacagaaagatgactcttagcctggctgaccgctgttcaaaaacacagaaaatccgaattctcccgatggcgggccgggacccagagtgccagcgaaccgagatgatcaagaaagaggaagaaaggctcagagcctccattcggagggaaagtcagcaacgtagaatgagggagaagcagcaccagcgtggcctgagtgcctcatacctggaacccgaccgctacgatgaagaggaggagggcgaggagagcattagcctggccgctatcaagaaccgttacaagggaggcatcagggaggagcgagcccggatttattcttctgactcggatgagggaagcgaggaggacaaagcacagcggctgttgaaggcaaaaaaacttactagcgacgaagaaggcgagccctcaggtaaacgtaaggctgaggacgacgataaggctaataaaaagcacaagaagtacgtcatatctgacgaggaggaggaggacgatgactag

SEQ ID NO: 122043 - DNA, 1935 bp, Artificial Sequence
  Description of Artificial Sequence: Synthetic coding sequence
atggcggacatggaggacctctttgggagtgatgcggactctgaggcggaaaggaaagactccgattcgggcagcgacagcgatagcgaccaagagaacgcagcctccggcagtaatgcctctgggtccgaatccgatcaggatgagcgcggcgactcagggcaaccctccaacaaggagctctttggagatgacagtgaagacgagggtgcctcccatcacagtggatctgataaccacagcgagcggtccgataatagatctgaagccagcgaaagatccgaccacgaggacaatgatcccagcgacgtggatcagcactcgggctcagaagcccctaatgacgacgaagacgaaggacaccggtctgacggcggctcgcaccatagcgaagcagagggatcggaaaaagcgcactccgacgatgagaagtggggaagagaagacaagagtgatcagagcgacgacgaaaagattcaaaattctgacgacgaggaacgcgcacaagggtctgatgaggataagctgcagaacagtgacgacgacgagaagatgcagaacacggacgacgaggaaagacctcaactctcagatgacgagcgacagcaactttccgaggaggagaaagcaaacagcgacgatgaaagaccagtcgccagcgacaatgacgatgacgatgagcgcccgcaggcatccgacgaggaacataggcactccgatgatgaggaagaacaagaccataaatcagaaagtgccaggggaagtgactccgaagacgaggtactgagaatgaaaagaaaaaacgcaatagcgagtgattccgaagccgattcggacaccgaagtccccaaggataactctgggacaatggatcttttcggtggagctgacgatatatcctctggatccgatggggaagataaacccccgactcctgggcaaccagttgacgagaacgggcttccacaggatcagcaagaggaagagcccattccagagaccaggattgaagtggaaatacccaaggtgaatacagacctggggaacgatctgtatttcgtgaaacttcctaacttcctgtccgttgaaccacggccatttgatccacagtactatgaagacgaattcgaggacgaggagatgctggatgaggaagggagaaccaggctaaagctcaaagttgagaacaccataaggtggcgtatcaggagagatgaggagggaaatgagatcaaagagtctaacgctagaatcgtgaagtggagtgacgggagcatgtcgttacacctcggaaatgaggtatttgacgtttacaaagcccccctacagggcgaccacaaccatctatttatcagacagggcactggactgcagggccaggcagtgtttaagacgaagctgacattcagaccccattccaccgacagtgccacacacaggaaaatgacactgtccctggccgatcggtgttccaaaacccagaagataagaatcctgccaatggctggaagagatcccgagtgtcaacgaaccgaaatgatcaagaaagaagaggagcgcctgcgcgcttcgatccgcagagaatctcagcagaggagaatgagagagaaacagcatcagcgaggactgtcggccagttatttggaaccagacaggtatgacgaggaggaggaaggagaagagagcatttctttggcggctatcaagaaccgctataagggaggaattagggaagagagagcacgcatctattcttctgacagtgacgaaggtagcgaggaggataaggctcagaggctgctgaaagccaagaaattaacatctgacgaagaaggtgagccatcaggtaaacggaaggctgaggatgatgacaaggctaacaaaaagcataaaaagtatgtcatttctgatgaggaggaagaagatgacgactag

SEQ ID NO: 122044 - DNA, 2127 bp, Artificial Sequence
  Description of Artificial Sequence: Synthetic coding sequence
atgcgtgagcgcatctgggcgccgccgctgttactgctcctgcctttactgttaccccccccactgtggggcggccccccggattcccctcgccgggagctagaacttgagcctggacctttgcagcccttcgatctgctgtacgcatccggcgctgcggcatactactctggggactacgaaagagctgtgagagatctggaagccgctctgagaagtcatcgccgattgagggagatcagaactcggtgtgctcgccattgtgctgctcggcacccactgccccccccaccaccaggcgagggaccaggtgccgagctccctctgtttaggtctctactaggtcgtgctaggtgctatcgaagttgcgagacccagcgcttaggcggtcccgcaagtaggcaccgcgtgagcgaagacgttagatccgacttccaacgccgggtgccgtacaactatctccagagggcatatattaagctgaaccagctggagaaagcggtcgaagctgctcatactttctttgtcgctaatccggagcatatggagatgcaacaaaacatagagaactaccgggctaccgctggtgtggaagctctgcagctggtggatagagaggcgaaaccccacatggaaagctataacgctggagtcaaacactatgaagcagacgattttgaaatggctattcgccacttcgaacaagccctccgggaatacttcgtggaagatacagagtgccgcaccttgtgcgagggcccccagcggtttgaggagtacgagtatttgggttataaggcaggattatacgaagcgatcgctgaccactacatgcaggtgttggtttgtcagcatgaatgtgtccgagagttggcaacccgccctggccgactgagtccaatcgagaacttcttgcctttgcactacgactatctccaatttgcgtactatcgggtgggagagtatgtgaaagccctggaatgcgctaaagcatacctgctgtgtcaccctgacgacgaggatgtcctagacaatgtcgactactacgagtccctgcttgacgacagcatcgatcccgcctccatcgaagctcgggaggatcttaccatgtttgttaaacggcacaaattggaaagcgaattgatcaaaagcgcagcagaagggctaggcttcagctacaccgagcccaactactggatcagatatggggggcgccaagatgaaaatagggtgccaagcggcgttaatgtcgagggggccgaggtgcacgggttttcaatgggaaagaaactatcccctaagatagaccgagacttaagggaaggaggccccctcttatatgagaatattacattcgtgtacaacagcgaacaattgaatggtactcagagagttctgttagacaacgtgctgtctgaggagcagtgccgggaactccattccgttgctagtggcattatgctggttggggacgggtacagggggaaaacatcacctcataccccaaatgagaagtttgagggcgcaacggtgctcaaagccctgaaatccggttacgaaggcagggtaccgctcaagtccgccaggcttttttacgacatcagcgaaaaggccaggagaattgtcgaatcctatttcatgctgaattcaactctctacttttcatacacccacatggtgtgcagaaccgcgctcagcggccagcaggatcgaaggaacgacctctcacatccgattcatgctgataactgcctgctggatccagaggccaacgaatgttggaaagagccacctgcctacacctttagagactactcggcacttctttacatgaacgacgattttgaaggtggagagttcatcttcacggagatggatgcgaagacggtcaccgctagcatcaaacccaaatgcgggcggatgataagcttttcctctgggggcgagaatcctcacggagtaaaggccgtcacaaaaggcaagcgctgcgctgtcgcactttggttcaccctagatccgctgtacagagaactggagcgtattcaggcagacgaggtgatcgccattcttgaccaggaacaacagggcaagcacgagctcaatatcaacccaaaagatgaactgtag

SEQ ID NO: 122045 - DNA, 1584 bp, Artificial Sequence
  Description of Artificial Sequence: Synthetic coding sequence
atggagatgcagcagaacattgaaaactacagggccacagcaggagtagaggctctgcagctggtggaccgcgaagcgaagccccacatggagtcttacaacgcgggagtcaaacattacgaagccgatgacttcgagatggctattaggcactttgagcaggcgcttagagagtacttcgtggaggatacagaatgccgtacactgtgtgaggggccccagcggttcgaggagtacgaatatttgggatataaggccggcctgtacgaagctatcgctgatcattacatgcaggttctggtgtgtcagcacgaatgcgtgagggaactggcaacccgcccgggccggctcagtccaatagagaattttctccccctgcactatgattatctgcagtttgcgtactatcgggtgggcgaatatgtgaaggccctggaatgcgctaaagcctatctgctgtgccacccagatgatgaagacgtgctggataacgttgactactatgaaagtctgctggacgacagcattgaccccgccagcatcgaagcacgagaggatctcactatgttcgtgaagaggcataaacttgaatcagaactaataaagtcagccgctgagggattggggttctcctataccgaacccaattactggatccgctatggaggtcgccaggacgagaatagggtgcccagcggagtgaacgtggaaggggccgaagttcacggctttagtatgggcaaaaagctaagtcccaagatcgatagggatctgagagaagggggcccactgttatatgagaatattacctttgtttataacagtgagcagctcaacggcactcagcgggtgttgctggacaacgtgctgtcagaggagcagtgtagagagttacactctgttgcttctggcattatgctcgtgggtgatggctaccgtggtaagaccagcccccacacgccaaacgaaaaattcgagggggccactgtgctcaaggccctgaaatccggatatgaagggagagtgccacttaaatctgcaagactgttttacgatatctctgagaaggcccgccgcatcgtggagtcttactttatgcttaactccaccctctatttttcctatacccacatggtgtgccgcaccgccttgtctggccaacaggaccgcagaaacgacctgtctcacccaatacacgcagataactgtttactggacccggaagccaacgagtgttggaaagagcctccagcttacacttttcgagattattctgccctgttatacatgaacgacgactttgagggaggggagttcatctttactgaaatggacgcaaaaacagtgactgcttctataaagcctaagtgtggccgaatgattagcttctcaagcggaggcgaaaaccctcatggagtcaaagcggtgaccaaggggaagagatgtgccgtagccttatggttcaccctcgaccccctatatagggaactagaaagaatccaggccgatgaagtgatcgcaatccttgaccaggaacagcagggcaaacacgagttaaacatcaatcccaaagatgaattgtag

SEQ ID NO: 122046 - DNA, 2721 bp, Artificial Sequence
  Description of Artificial Sequence: Synthetic coding sequence
atgatatgccagaaattctgcgtagttcttctgcactgggaattcatctacgtgattacggcttttaatctctcctatcccatcacaccctggcgcttcaaattgagttgtatgccaccaaactccacatacgattatttcctgttgccagcaggcctgtccaagaacaccagcaattcaaacggccactacgagacagcagtcgaacccaagtttaatagtagcggtacacactttagtaatctatccaagactacatttcattgctgcttccgctctgaacaggaccgtaactgttcgctttgcgctgacaatattgaagggaagacgtttgtctccactgtaaatagccttgtcttccagcagatagacgcaaactggaatatccaatgttggctgaagggtgatctgaagcttttcatctgttatgtagaaagtctgtttaaaaacctcttccggaattataactacaaggtgcatttgttgtacgtactgccagaggtccttgaagactccccactcgttccccaaaagggatcctttcagatggttcactgtaactgttcagtccatgagtgctgtgagtgtttagtgccagtcccgacagcaaaactgaatgatactcttttgatgtgcctcaaaattacttctggcggggtcattttccagtccccgttaatgtcggtgcaacctatcaacatggtgaagcctgacccacctctgggcctgcacatggagatcactgatgatggcaacttaaaaatctcttggagctctccacccctagtcccctttccactgcagtaccaggtgaagtattcagagaactccacaaccgtcattcgcgaggccgacaaaatcgtctccgccaccagcctgctcgtagacagtatcctgccagggagcagttatgaagttcaggttcgcggtaaacgccttgacggacctggaatatggtccgattggagcactccccgagtctttacaacccaggacgtgatctactttcctcccaagatcctcacctccgtcggctctaacgtatcgttccattgcatatacaaaaaggagaacaagattgtaccatccaaagagatagtttggtggatgaatctcgctgagaaaatccctcagtctcagtacgacgtagtgtcggaccacgtcagcaaggtgacattctttaacctaaacgagaccaaacccaggggcaaatttacgtacgatgcggtctactgctgcaatgagcacgagtgccaccaccgatacgcggaactgtacgtcatcgacgttaacattaacattagttgtgagaccgacggatacttgacgaagatgacttgcagatggagtacctccaccatccagtccttagcagagagcacactgcagctgcgctatcacagaagcagcctctactgttcggatatccctagcattcaccccataagcgagcccaaagactgctatcttcagagcgacggtttttatgaatgcatttttcagccaatcttcctgctttccggttatacaatgtggatacgtatcaaccattccctgggcagcttggattcacccccaacttgtgtccttcccgactctgttgttaagccactaccccccagcagcgtaaaagccgaaatcactattaacattggcttactgaagatcagttgggaaaaaccagtctttccagaaaacaacctacaattccagatccggtatggtttgtctggaaaagaagtccagtggaagatgtacgaggtgtatgacgctaagtctaaatccgtcagcctgcctgttccagacctttgcgccgtctacgccgtccaggtcagatgcaaaagactggacgggttaggatactggagcaattggagcaaccccgcatacacagttgtgatggacattaaggtcccaatgcggggacctgagttttggagaatcatcaacggcgacaccatgaaaaaagagaaaaatgtgactttactgtggaagccgctcatgaaaaatgatagcctgtgcagcgttcaacgctacgtgattaatcatcatacctcttgtaatggcacctggagtgaggacgtgggtaatcataccaagtttaccttcctctggactgagcaagcccatacagtgaccgtgctggcaatcaacagcatcggagcaagtgtcgccaactttaatctgaccttctcgtggcctatgtcaaaagtgaacatagtccagagcctgagcgcttatccactgaattcgtcttgcgtgattgtgtcttggatacttagcccctctgactacaaactcatgtatttcattatagagtggaaaaacttaaatgaggacggcgagataaagtggcttcgcatcagctcatccgttaagaagtattacattcacgatcactttattcccatcgaaaagtatcagttctccttgtaccctatttttatggagggagtgggaaagcccaagatcattaattcattcactcaggatgatattgagaaacatcagagtgacgctgggctgtatgtgatcgtaccagtgattatatcctcatcaatccttctattaggcactttgctgatcagtcatcagaggatgaagaaactgttctgggaagacgttcctaatcccaagaactgcagctgggcgcagggcctaaactttcagaagaagatgccgggcactaaagaactcctgggtggtggctggctgacctag

SEQ ID NO: 122047 - DNA, 3498 bp, Artificial Sequence
  Description of Artificial Sequence: Synthetic coding sequence
atgatctgtcagaagttctgcgtcgtccttctgcattgggagtttatttacgtgatcaccgcatttaacctttcttacccgattacaccatggcgttttaagctgagctgtatgccccctaactctacatatgattacttcctgcttccggctgggcttagtaagaatacatcaaacagcaatggccattacgagacagctgtggaacccaagtttaattcttccggtacccacttcagtaatctgagcaagaccaccttccactgttgcttccgctctgagcaggacaggaattgttctctgtgtgccgacaatatcgaaggaaagacctttgtctccacagtgaatagtctggtgttccagcagattgatgcaaattggaacatccagtgctggctgaagggcgacctgaaattgttcatctgttatgtcgagagcttatttaagaatctttttcgcaactacaactacaaggtccacctgttgtacgtgctgccagaggttctggaggactccccactggtgccacagaaggggtcattccaaatggtacactgcaattgcagcgtccacgagtgttgcgagtgtctcgttccagtccccacagctaaactgaatgatacattgctgatgtgtctgaagatcacttcgggtggggtgatttttcagtcccctttaatgtctgtacagcctataaatatggttaagcccgatcctcctctgggactccacatggaaattacagacgacggcaatctgaaaatcagctggtcaagtccccctttggtaccatttcccctgcagtaccaagtgaagtattcagaaaacagcactactgtgatcagagaagccgataaaatagtgagcgccacatcactgctcgtcgattcaattctccctggttcttcctacgaagtccaagtccgcgggaagcgcctcgacggaccaggtatttggtccgactggagcacacctcgcgtgtttactacccaagacgtaatatatttccccccaaagatcctcacctcggtcggcagcaatgtttcatttcattgcatatacaaaaaagaaaacaagattgtcccctccaaggagattgtgtggtggatgaacctggcagaaaagattccccagtcacagtacgatgtcgtttcagatcatgtgtcaaaagtaaccttctttaacctgaacgagaccaagcctcggggtaagttcacctatgacgctgtgtattgttgtaacgagcatgaatgtcaccacagatacgctgagctctacgttatcgatgtgaacatcaatatctcttgcgaaacagacggctatctcaccaagatgacctgcaggtggtcaacgtccaccattcaatctctggccgaaagcaccttgcagctcagatatcaccgatcctcattgtactgttctgacattcctagtatccatcctatttccgagcctaaagattgctacctgcaatccgacggtttctatgagtgcatttttcaaccaatcttcctgctctctgggtacaccatgtggatccggattaaccatagtctaggaagcctggacagtcctccaacttgcgtgctgcctgattcggtcgttaaaccacttccaccgagttcggtcaaggcggaaatcaccatcaatatcggccttctgaagatctcgtgggaaaaacctgtatttcccgagaataatctgcaatttcagattcgatacgggttgagtggaaaagaggtacagtggaaaatgtatgaggtgtacgacgcaaaatctaaaagcgtcagcctgccggtgcccgacctttgcgccgtgtatgcagtccaggtgaggtgcaaaaggcttgacggacttggctactggtctaactggtccaaccctgcgtatactgtggtaatggatatcaaggtacctatgcgtggccctgagttctggaggatcatcaatggagatacaatgaagaaggagaagaacgttacactgctatggaagcctcttatgaaaaacgatagcctgtgctctgttcagagatacgtcattaatcatcacaccagttgtaatggaacctggagcgaggacgttgggaatcacacaaagttcacgttcctctggaccgagcaggcgcataccgtgaccgtgcttgctatcaactcaatcggcgcttcagtggccaatttcaatctgacattttcctggcccatgtctaaggtcaatatagtgcagtctttatccgcttacccactgaactcttcttgcgtgatcgtctcgtggatactgagcccctccgattataagctcatgtactttattatcgaatggaagaatctcaacgaggatggagaaattaaatggctcagaatctcttcatccgtcaagaagtattacatccatgatcatttcataccaattgaaaaataccagttcagtctctacccaattttcatggagggtgtcgggaagcccaagattatcaattcttttacccaggatgacatcgaaaagcatcaatcagatgcaggactctacgttattgtgcctgtcatcatttcttctagcattctgctgctgggtacactgctaatctctcatcaacggatgaagaaactgttctgggaagacgtaccgaatccgaaaaactgttcgtgggcacagggattaaacttccaaaagcccgagacttttgagcatctgttcatcaaacatactgcatctgttacctgtggccccctgttgttggagccagaaaccatatcagaggatatctctgtcgataccagttggaaaaacaaagatgagatgatgcccacgaccgtggtgtcactcctctccacaaccgacctggaaaagggatccgtgtgcataagtgatcagtttaattcagtcaatttctctgaagccgaggggaccgaggtgacttacgaggacgagtcgcagcggcaacccttcgtgaaatatgctacgctgatatctaactctaagccctcagagaccggggaagaacagggcctgataaacagctcagttacgaagtgcttctctagcaagaacagtcccctgaaagattcttttagcaactcttcttgggagatcgaagctcaagccttcttcatcctttctgatcaacaccccaacatcataagtccccatttaacctttagtgaaggcttggatgagctgcttaaactcgaggggaattttcccgaggaaaataacgataagaagagcatttactatctaggcgtcacctctattaaaaagcgggaatccggtgtcttgctcactgataagagtagagtatcatgtcccttccctgccccatgtctattcactgacatcagagtgctacaggatagctgcagtcatttcgtggagaataacattaatcttggaacatcgtccaagaaaacttttgcctcctatatgcctcaatttcagacttgcagcactcagacgcacaagatcatggaaaacaagatgtgcgacttaacggtgtag

SEQ ID NO: 122048 - DNA, 2721 bp, Artificial Sequence
  Description of Artificial Sequence: Synthetic coding sequence
atgatctgccaaaagttttgtgtcgtgctgctccattgggagtttatctacgtcatcacggcgtttaacttgtcatacccaatcaccccatggcgtttcaaactaagctgtatgccgccaaattccacttacgattactttctactgcctgccgggctcagcaagaatacttccaattcgaacggtcattatgagacggccgtggaacccaagttcaactcttccggtacccactttagtaacctgtccaaaactacattccactgttgtttcagatctgaacaggatcggaattgctcgttgtgtgccgataacatcgaagggaagacctttgtttccactgtcaattcgctggtttttcagcagatcgacgctaactggaatattcagtgttggctcaaaggcgatctgaaactgttcatctgttatgtggagtccttgtttaaaaacctgttccggaactataattacaaggtccacttactctatgtcttacccgaggttttggaagactcacccctggtgcctcaaaagggcagctttcagatggtccactgcaattgctcagtccacgagtgctgtgagtgcctggttccagtccctacagccaagctgaacgatacactcctcatgtgtctgaaaattacctctggtggggtgatttttcaatctcctctgatgtccgtccaacccatcaacatggtcaagcccgacccacccctggggctgcacatggagattaccgacgatggcaacctgaaaatctcctggagttcccctcctctcgtaccttttccattacagtaccaggttaagtattctgagaatagtacgactgtgatccgcgaggccgacaagatcgtgtcggccacaagcctgctggtcgattctatactgccaggcagcagctatgaagttcaggtcaggggaaaaagactggacggcccaggtatttggagcgactggtcaacccctagggtgttcacaacacaggacgttatatatttcccacccaagatcttgacttctgtcggcagtaatgtttccttccattgcatctacaagaaggagaataagatcgtcccttccaaggagatcgtctggtggatgaacctggccgagaaaatcccacaatctcagtatgacgtggtctcagatcacgtgtccaaggttaccttctttaacctcaatgaaaccaagcctcgcggaaagttcacttatgacgccgtttactgctgtaacgaacacgaatgccaccatagatacgcagaactgtatgtcattgacgtaaatatcaacatctcctgcgagaccgacgggtatctgacaaagatgacatgcaggtggagtactagtactatccagagtttagcggaatctaccctgcaactgcggtaccacagatcctctctttactgcagtgacattcccagcattcatccaatttcagaacctaaggattgttatctccagtctgacgggttctatgaatgtatctttcaacctattttcctgctgtcaggatataccatgtggattagaattaatcatagcttgggaagcctggattccccccccacatgcgtgctgcctgacagtgtcgtcaagccattgccgccaagttcagtaaaggctgaaattacaatcaatataggtctcctcaagatcagctgggagaaacctgtttttccagagaataacctccaatttcagatcaggtacgggttgtcgggcaaagaagtgcagtggaaaatgtatgaggtctacgatgcgaagagtaagtccgtgtccctgcccgtgcccgatctgtgcgccgtctacgcagtgcaagtcagatgcaagaggttggacggactgggttactggagcaattggtctaatccggcatatacagtagtgatggacattaaggtccctatgaggggcccggaattctggcgcattataaatggcgacacaatgaaaaaggagaagaatgtaactctcttgtggaagcctctgatgaaaaacgattccctctgctcagtgcagcggtacgtgatcaaccaccacacctcatgtaacggaacctggtcagaggacgtgggcaatcatactaaattcacatttttgtggacggagcaggcacataccgtcacagtactagccataaactccataggcgccagcgtggctaactttaacctgactttttcttggcccatgtccaaggtcaatatcgtacagagccttagcgcgtacccacttaattcctcttgcgtgatcgtatcctggatcctgagcccaagcgactataagctgatgtactttataatcgaatggaaaaatctcaacgaggatggagagataaaatggctccgtatttcatcaagtgtcaaaaagtactacatccacgaccactttataccaatcgagaagtaccagttctccctgtaccctatcttcatggagggagtcggcaagcctaagatcatcaacagcttcacacaggatgacattgagaaacaccaatccgatgcggggctttacgtgatcgtgcccgtcatcataagttcaagtatcttacttctcggcactctacttatctcacatcagcgcatgaaaaaattgttttgggaggatgtcccgaatcctaagaattgttcttgggctcagggccttaactttcagaaaaagatgcctggcacgaaggagttattaggtggtggatggctgacctag

SEQ ID NO: 122049 - DNA, 2877 bp, Artificial Sequence
  Description of Artificial Sequence: Synthetic coding sequence
atgatctgccaaaagttctgtgttgtccttctccactgggaatttatctatgtgataacagcattcaatctctcctacccaattacaccgtggcgtttcaagctgagctgtatgccacctaactcaacgtacgattatttcctactgccagctggcttaagtaaaaatacatccaattcgaatgggcactatgaaaccgcggttgagcctaagttcaacagcagcggcactcacttctccaaccttagcaagaccacgtttcactgttgtttccgttccgaacaggaccgaaactgcagcctgtgcgcagataatatcgagggcaagacttttgtatctaccgtcaattcgctggtgtttcagcagattgacgcaaactggaacatacagtgctggctgaagggcgacctgaagctttttatttgttacgttgagagcttgttcaagaatctgttccggaactacaattacaaggtccacctgctgtatgtgcttccagaagtgctcgaagacagcccactcgtaccccaaaaagggtcctttcagatggtccactgcaattgtagtgtgcatgagtgttgtgaatgcctggtgccagtacctacagctaagctgaatgatactctgctcatgtgtttgaagattacgagtggaggggtcatatttcagtcaccattaatgtccgtccaaccaataaatatggttaaaccggatccgccactggggctgcacatggagattacagacgacgggaatctcaagatctcatggagctccccacccctcgtcccctttccactgcaatatcaagtcaagtattctgagaacagcactacagtcatcagagaggcggacaagatcgtgtccgctacatccctactggtagactctattctgcctggttcttcttatgaggttcaagttcgcggaaagagacttgatggaccaggtatctggagcgactggagtaccccaagagtctttactactcaggatgtgatctactttccaccaaagattctcacaagtgtcggctctaacgtgtcttttcactgcatctacaagaaggagaataagatagtaccgtccaaggagatagtttggtggatgaatctggctgaaaaaatcccccagtcccagtacgacgtggtcagcgaccatgtgtccaaagtgacattctttaatctcaacgagaccaagccacgaggcaagtttacttacgacgcagtgtactgctgtaacgagcacgagtgccatcatcgctatgctgaactgtacgttatcgatgtgaatatcaacattagctgcgagaccgatggctacctgacaaaaatgacttgtcgttggtcaaccagcaccattcagagcttggcagaatcaacgttgcagttgcggtatcataggtcctccttatactgtagcgacattccgtcaatccacccgatctcagagccaaaagactgctatcttcagtcagacggcttttacgaatgtatcttccagccgattttccttctgtctggatacactatgtggatcaggataaatcactcattgggttccctggactccccgcccacatgtgtcctacctgacagtgtggtaaagccccttccgccatcaagcgtgaaggcagaaatcactataaatataggcctgcttaagatctcttgggaaaagccggttttcccagagaataatctgcagttccagatccgatatggtctttcagggaaggaagtccaatggaaaatgtacgaggtttacgacgcaaagtcaaagtctgtcagcttacctgtgcctgacctctgcgccgtgtacgccgtccaggtgcggtgtaagcggctggatggactaggctattggtccaactggtctaatccagcatacactgtcgtaatggacattaaagtccccatgcggggacctgagttttggcggataatcaatggtgacaccatgaagaaagagaagaatgttacactactttggaaacctctgatgaagaacgatagcttatgttcagtccagcgctatgtaattaaccaccacacttcatgcaacggcacctggagtgaggatgttggaaatcatactaagttcacgttcctgtggacagagcaggcccacaccgtcaccgttctggctattaattctatcggtgcctcagtggcaaactttaatttgacattctcctggcctatgagcaaggtgaacatagtgcagagcctatccgcatatcctctaaattctagctgcgttatcgtgagttggatcctgagcccctcagattacaaactgatgtacttcatcattgagtggaaaaacctcaatgaagatggcgagataaaatggttgaggatttcatcttcggtgaagaaatactacattcatgaccacttcattcctatcgaaaaataccagttctcactatacccaatctttatggaaggagtgggaaagcccaagatcatcaattcattcacgcaagacgacattgagaaacatcagagcgacgccgggctatacgtaatagtgccagtgattattagcagctctatccttcttctggggacactgttgataagtcaccaacggatgaaaaagctgttttgggaagatgtgccgaatccaaaaaattgcagctgggctcagggcctgaatttccagaaaatgcttgaaggctcaatgtttgtgaaaagtcaccaccatagccttatttcttctacccagggacataaacactgtggccgccctcaaggcccccttcacaggaagacacgcgatctgtgtagcctcgtctatttactgacactaccccctttactctcatacgaccccgcaaagtcacccagcgtcagaaacactcaggaatag

SEQ ID NO: 122050 - DNA, 2691 bp, Artificial Sequence
  Description of Artificial Sequence: Synthetic coding sequence
atgatctgccagaaattctgcgttgttctgctacactgggagtttatctacgtcatcactgccttcaatctgagctaccctataacaccttggaggttcaagttgagttgtatgcccccaaacagtacatatgattacttcctgctgcccgccggtctctcaaaaaacacgtcaaattcgaacgggcattacgagaccgcagtcgaacccaagttcaatagtagtgggacccatttctccaatttgtcaaagacgactttccattgctgctttcggagcgagcaagacaggaactgctccctctgtgccgacaatatcgaaggcaaaactttcgtgtcaactgtcaattcactcgtgtttcagcaaatcgatgctaattggaacatccagtgttggttgaagggtgacctgaaattattcatctgttatgtggaatccttatttaaaaatctattccggaactataactacaaggtccatcttctctacgtgctccccgaggtactggaggactcaccccttgtgcctcaaaagggttcgttccagatggtacattgcaattgcagtgtccacgagtgttgcgagtgtctcgtcccagtacccaccgccaagctgaacgacacccttctgatgtgtctgaagattacatccggcggtgtcatcttccagagccccctgatgagcgtgcagcctataaacatggtgaagcccgatccccccctagggcttcacatggagattacagatgacgggaatctaaagatcagctggtcatctccgcctctcgtgccgtttccgctccaatatcaggtgaagtatagcgaaaatagtaccacagtgatacgcgaagctgacaaaatagtgtccgctacttccttactagtcgattcaatcttaccaggctcttcatacgaggttcaggtgcggggtaagcgcttggacggccctggtatttggtccgactggagcacgcccagagtgttcacaacccaggacgtgatctatttcccaccaaaaatactgacgtcagtgggctcaaatgtgtcttttcactgcatttataagaaggaaaacaagatcgtgccttcaaaagagattgtatggtggatgaatttggcagaaaaaatcccacagtcacagtacgacgtcgtgtcagatcacgtgtccaaagtgacattctttaacctgaacgagaccaagcctcgcggaaagttcacctatgatgccgtctactgctgcaatgagcatgaatgtcaccacagatatgcggagttgtacgttatagacgtgaatattaatatatcttgtgagaccgacggatacctaaccaagatgacgtgccggtggagcaccagcacaatccagagcttggcagagagtacattgcagctcagataccaccgtagtagcctgtactgttccgatatccctagcatccatcccatcagtgagcccaaagactgctatctccagagcgatgggttttacgaatgcatcttccaaccaatatttctgctctccgggtacaccatgtggattcgcatcaaccacagcctggggagcctggacagccctccaacttgcgtgctgcccgactctgtggtgaagcctctgcctccatcatccgtgaaagctgaaatcaccatcaatattggtctgctgaaaatcagttgggagaaaccagtattccctgagaacaacttgcagtttcagataaggtatggcctgagtggaaaagaggtgcaatggaaaatgtacgaagtgtatgacgcaaagagtaagtcagtcagcctccctgtgccagatctgtgtgccgtttacgccgtccaggtccgatgcaagcgactggacgggttagggtattggtcaaattggtcaaatcctgcatacaccgtagtcatggatatcaaggttccgatgcggggacccgaattttggcggatcatcaatggtgatacaatgaagaaggaaaagaacgtgacactcctgtggaaacccctgatgaagaacgactccctttgctctgtgcagaggtatgtgattaaccaccatacctcctgtaacggcacctggtccgaggatgttggcaatcacacaaagtttactttcttatggacggaacaggcacacaccgttaccgtgcttgccattaacagtattggtgccagtgtggctaattttaatcttacatttagctggccaatgtcaaaagtaaacatagttcagagcctgagcgcttaccccttgaatagctcctgcgtgatagtgagctggatcctaagtccttctgactacaaacttatgtacttcatcatcgagtggaaaaatctcaatgaagatggtgagattaagtggttacggatatcttcttctgtgaagaagtactatattcatgatcacttcatccctattgagaagtatcagttctctctctatccaatcttcatggaaggagttggcaaacctaagatcataaatagttttacccaagatgacatcgagaagcaccagagcgacgccggactgtatgtgattgtgccggtgatcatcagctcaagtatattgttgttgggcaccctgctgatctcacaccagaggatgaagaagctgttctgggaagacgttccgaaccctaaaaactgtagttgggcccagggactaaacttccagaaacggactgatattctgtag

SEQ ID NO: 122051 - DNA, 699 bp, Artificial Sequence
  Description of Artificial Sequence: Synthetic coding sequence
atgatgcctacaacagtggtttcgctgctgagcacaactgacctggagaaaggcagcgtttgtatctctgaccagttcaacagcgttaatttttcggaggctgaaggcaccgaagtgacgtacgaggacgaaagtcagcgccagccctttgtcaagtacgccactctgatatctaattccaagccatccgaaacaggcgaggaacagggattgatcaatagttccgtaacaaaatgtttcagcagtaagaatagccccctgaaggacagctttagcaacagttcttgggagatagaggctcaggcattttttattttgtccgatcaacaccccaatatcatcagccctcatcttacattctctgagggattggacgaactgctgaagctcgaggggaactttccagaagagaacaatgataaaaaaagtatatattatttgggagtgacctctatcaagaagagagaaagcggagttcttctcacagataagtcccgggtgtcttgtcctttccctgctccatgccttttcaccgatattagggtattacaagacagctgctctcactttgtggagaataatataaatttgggtacttcttcaaagaagacgttcgcctcttatatgccccagtttcagacctgttctactcagacacacaagatcatggagaataagatgtgtgacctgaccgtgtag

SEQ ID NO: 122052 - DNA, 396 bp, Artificial Sequence
  Description of Artificial Sequence: Synthetic coding sequence
atggccggagtgaaagctctcgtggctctgagcttcagcggcgcgatcggccttacttttctgatgcttggatgtgcgctggaggattatggagtttattggccactattcgtgctcatcttccacgccatcagccctattcctcattttatcgcaaaaagagtcacatacgactcagatgctacttcatcagcgtgccgcgaactggcatacttcttcacaaccgggatcgttgtgtccgccttcggcttccctgtaatcctcgcgcgggttgcagtgatcaagtggggagcttgcggcctggtgcttgctggaaatgcagtcattttcttaactattcaaggcttttttctaattttcgggcgcggtgatgatttctcctgggagcagtggtag

SEQ ID NO: 122053 - DNA, 396 bp, Artificial Sequence
  Description of Artificial Sequence: Synthetic coding sequence
atggccggaatcaaggcactcataagcctgtcgttcggcggcgccatcggcctgatgtttttgatgctgggctgcgcactgcctatatacaacaagtattggccactctttgtgctcttcttttatatcctttcccccataccatattgcatagcccggagacttgtcgacgatacagacgccatgtccaacgcctgcaaggaacttgcaatttttctaactacgggcatcgtggtcagcgccttcggcttgccgatagtgtttgcacgagcacaccttatcgagtggggcgcatgtgctctggttctcactggaaatacggtcatctttgcaactattctcggttttttcctggtctttggaagtaatgacgattttagttggcaacagtggtag

SEQ ID NO: 122054 - DNA, 510 bp, Artificial Sequence
  Description of Artificial Sequence: Synthetic coding sequence
atggccggaatcaaagcgctgattagtctgtccttcggcggtgccatcggccttatgtttctcatgctcggttgtgctttgcctatttataacaaatactggccgctgttcgtcctgttcttttatatactctcccccataccctattgtattgccagacggctcgtggacgacaccgacgcgatgtccaacgcgtgcaaagaactcgctatttttttgacaaccggcatcgtggtcagcgcgtttgggctgccaattgttttcgcccgagcccacctcatgggcagactgccgttcttcagtaagatgggtacggccgagagtgaaggtcgcgagaccctgacacagcagctcccccttccggctgcagctatgcgtcggctccttcctgcgtctagagtatcgacccagcctgtcctgcggctcgccgactctgcggagagcctgctcggtcggcctgccctgtgggcattggggtttctcctctgtccacccagccaagcccagtag

SEQ ID NO: 122055 - DNA, 3195 bp, Artificial Sequence
  Description of Artificial Sequence: Synthetic coding sequence
atgatgaaatttaggttccgaaggcagggtgcagatccccagagggaaaaactgaaacaggaactgttcgcctttaataaaacagtcgaacatggctttccaaatcagccatccgctctggcatttgatcccgagctacgaatcatggcaatcggcacccgaagtggagctgtgaaaatttatggcgcgcccggagtggagttcaccggcctgcatagagacgcagctactgtgacgcagatgcattttcttacgggtcaggggcggctgctgtccttactggacgatagctcactgcatctgtgggagattgttcaccacaacggctgtgcccacctcgaagaagctcttagcttccagctaccaagccgcccaggttttgatggtgcgagtgctcccctgtctctcacccgcgtgaccgtggttctcttggtcgctgcatccgacatcgctgctttaggcaccgaggggagttccgtgtttttccttgacgtgacgacattgacgctcctggagggccagactctggcacctggggaagtcctccgcagcgtgccggatgactaccgctgcggtaaggcactcgggcctgtggagtctctgcagggtcatctccgcgacccaactaagatcctcattggctatagcaggggtctgctagtcatttggaatcaggcatcccaatgtgtagaccacatatttctgggcaaccaacagttagaaagcttgtgttggggccgcgactcatctacggtagtttccagccactctgacggaagctacgcagtctggtctgtcgacgctgggtcatttccaacactccagccgaccgttgccacaactccgtacggaccgtttccctgcaaggcaatcaataagatcctctggagaaactgcgaatcagggggccattttatcattttcagtggtgggatgcctagagcctcatacggcgacaggcattgtgtcagcgtgctgagggcagagaccttagttacgctggacttcacatctagaatcattgatttctttacagtgcattcaactcggcctgaggatgagttcgacgatccacaggctctcgctgttctccttgaggaagagttggttgtgttagatctacagactcctggatggccagccgtccccgcgccgtatctggcccctctgcattcaagcgcaatcacctgttccgcccatgtggccagtgttccagccaaactgtgggccagaatcgtctccgcgggagagcagcagtccccacagccagtatcgtcggccctgtcctggcctattaccggcggacgaaacctggcacaagagccttcccagcgtggactgcttttgaccgggcatgaggacggaacggtgcggttttgggatgcttcaggagtggcacttcgacccctttacaaattgtcaacggctggactcttccagaccgactgtgagcacgcggactcactggctcaggccgcggaagatgactggcctccgtttcgcaaggtgggatgttttgacccgtacagtgacgatccgcgactgggcgtccaaaaagtggccctgtgcaagtatactgctcagatggtggtagccggtaccgccgggcaggtgctcgtgttagagctcagcgatgtgcccgttgaacaggccgtgtccgtcgcgatcatagatttactgcaggatagagaggggttcacttggaagggccatgagcgactatcaccaaggaccggccctctgccctggcccgccggcttccagccacgcgttttggtccagtgtcttccacctgctgcagtgacagctgtgacacttcacaccgagtggagtctggtggcctttgggacttcccacggattcggcctgttcgattaccagaggaaatcgccagtgctggctcgctgcactctccacccaaacgacagtctggccatggagggacctctgagccgcgtgaagtccctgaagaaaagtctgagacaatcctttaggcgcattcgaaaaagccgggtctccggcaaaaagagagcggcaaacgcaagctcaaagctgcaggaggcgaatgcacaactggccgaacaggcttgcccccacgacgttgagatgacgccagtccagcgcagaatagaacctaggtctgccgacgattcactgtctggcgtggtgcggtgtctgtactttgcagatacatttctgcgagatggggcacaccatggtcctaccatgtgggccggaacgaacagcggatcagtgttcgcctacgcccttgaggtgcccgcagccgcagttgggggagagaaacgcccggagcaggccgtggaagctgtgctggggaaggaggtccagttaatgcaccgggccccagtggttgcaattgccgtcctcgacggtaggggtagaccccttcctgaaccatacgaggcctcacgcgacctggcgcaggcacccgatatgcagggcggacatgcagtactgattgcctccgaagagcagtttaaggtgtttacactaccgaaagtcagcgccaagacaaaatttaagttgactgcccacgagggctgtcgcgttagaaaggtcgcgcttgcgacatttgcgagcgtcgcttgcgaggattacgctgaaacttgtttggcctgcctcaccaatcttggtgatgtgcatgtattcagtgttcctggcttgcgcccacaggtccattactcttgcatccggaaggaagatatcagtgggatcgccagctgcgttttcacgcgccatggccagggattctacctgatttctccctccgaatttgaacgcttctcgctgagtgcaagaaacataacagagcctctttgctcactcgatattaactggccccgagacgcaacccaggcatcctatagaattagggagagcccaaaactgtctcaggccaatggaaccccatccatcctcctagctccccagtcattggatggctcccctgatcccgcacatagtatggggccagatacccccgaacctcctgaggctgcactcagccctatgtccatcgattccgctactagcgcggacacaacgcttgatacaacgggagacgtcaccgtggaagacgtgaaagattttctcgggtcgtctgaggagtctgaaaaaaatttacgtaatctggctgaggacgaagcacacgcctgtgccattttgatcaagtag

SEQ ID NO: 122056 - DNA, 1056 bp, Artificial Sequence
  Description of Artificial Sequence: Synthetic coding sequence
gaactgccttcagctgccccagactctaccctgttactgactgcacagcattgggtcgccaaccttttcatcttggccactctgatcggctggacagtgcggagttttttcttgggccggatggagacgtgttgcagtcaccttggcttgcggtctggtagaagatttgccgtcagcatcggatactggcacgacccctatattcaacactttgtgagactgagtaaggagcgcaaggctcctgaaatcaatagaggctatttcgcacgagtgcatggggtctcccagctcattaaagcattcctgcgcaagacagagtgtcactgtcagatcgtgaacctgggcgctggtatggacaccactttttggaggctgaaggacgaggacttgttgccttctaaatacttcgaagtcgacttccccatgatagtaactcggaaattgcattccatcaaatgcaagccacccctcagtagccccatcctggaattgcacagcgaagatacactccagatggacgggcacattctggatagtaagcggtacgctgttattggcgccgacctgcgggacctctccgagctcgaagaaaaactgaagaagtgcaacatgaatacccagctgccgaccctattaatcgctgagtgtgtcctggtgtatatgaccccagagcagtctgcaaatctcttgaagtgggcagccaattcctttgaacgggccatgtttataaattacgagcaggtcaacatgggcgataggttcgggcaaattatgattgagaacctgcgaagaaggcaatgtgatctggctggggtcgaaacctgcaagtcactggagtcgcagaaggagaggctcttgtccaacggctgggagacagccagcgccgtagatatgatggagctgtataaccgcctccctcgggccgaagtgagccggattgaaagcttagaatttctggatgaaatggagctgcttgagcagctgatgcgacactattgtctgtgttgggctactaaaggagggaatgagcttggtcttaaggagattacgtattag

SEQ ID NO: 122057 - DNA, 840 bp, Artificial Sequence
  Description of Artificial Sequence: Synthetic coding sequence
atggccactcgacagcgcgaaagtagtatcacttcttgctgctccacgagtagctgtgatgctgacgatgaaggcgtacgcggcacatgtgaggatgcgtcgctgtgcaaaaggtttgctgttagcattgggtactggcatgatccatacatccagcattttgtccgcctgagtaaagagcgcaaggctcccgaaattaatagaggctatttcgctagagtccacggggtaagccagctgatcaaggcattcttacggaagactgaatgccactgtcagatagtgaatctgggggccggcatggacactacgttctggcgccttaaggatgaggacctgctgccgagcaaatacttcgaggtggacttcccaatgatcgtgacccggaagctgcattcaatcaaactgcccacccttcttatcgctgaatgtgtcctggtgtacatgactcctgaacagtctgctaacctgcttaaatgggctgccaactctttcgaacgggctatgttcatcaactatgaacaggtgaacatgggcgacagattcggccagattatgattgaaaacttacgacggaggcagtgcgacttagccggcgtggaaacttgcaagagcctcgagtcccagaaggaaaggctattgtccaatgggtgggagactgccagcgcagttgacatgatggaactgtataatcggctccccagagccgaggtgtcaaggattgagtcgctcgaatttctggacgaaatggagctgctggagcagcttatgcggcactattgtctctgttgggcaactaaaggcggaaatgagctgggacttaaagaaatcacctattag

SEQ ID NO: 122058 - DNA, 1005 bp, Artificial Sequence
  Description of Artificial Sequence: Synthetic coding sequence
atggctacccgacagagggagagcagcatcactagctgctgctctaccagctcgtgcgatgctgatgacgaaggtgttaggggcacctgcgaagatgctagcttgtgcaaacgatttgccgtctccatcggttactggcacgacccttacatccagcacttcgtccggctgagcaaagaacggaaggcccctgaaatcaacagaggatactttgctcgagttcacggtgtgtctcagctgatcaaagcttttttgcgtaagactgagtgccactgccagatagtgaacctgggcgccggaatggacactacgttttggagactaaaggacgaggacctgcttccaagcaagtattttgaagttgatttccctatgatcgtgaccaggaagctacatagtatcaagtgcaagcccccactctcatctcccattctggaattgcacagcgaggacactttgcagatggatggtcatatactggatagcaaaagatacgcagtgataggggcagacttgcgggacctgagcgaactggaagagaagttaaaaaagtgcaacatgaacacacagttacctaccctgctgatagctgagtgtgtactggtctacatgacaccggaacaatctgcgaatctcttaaagtgggccgccaactcttttgaaagagcaatgttcataaattacgagcaggttaacatgggagaccgtttcgggcaaatcatgattgaaaacctaaggaggagacaatgcgacctggccggcgtggagacctgtaagtcactcgagagccagaaagaaagactgctcagcaacggctgggagaccgcctcagcggtggacatgatggagctgtataaccgtctcccccgggctgaggtatccaggattgaatctctggagttcctggacgagatggaactgttggagcagctgatgcgccattactgcttgtgttgggctactaaaggagggaatgagctcggtctgaaagagatcacctactag

SEQ ID NO: 122059 - DNA, 2415 bp, Artificial Sequence
  Description of Artificial Sequence: Synthetic coding sequence
atggctgtcagggcactgaaactgctcacaaccctgttggccgtggtggctgccgcttcccaagccgaggtggagtcagaagctggctggggaatggtgacgcctgatctgctcttcgctgaaggaaccgcagcttacgcaagaggtgattggcccggcgttgtgttatcgatggagcgcgctttgcgttcccgcgccgctcttcgggctctcaggttgcgttgcagaactcagtgtgccgctgacttcccttgggaactagaccccgactggagcccgtcacctgcacaagcctctggagcggctgccctcagggacttgagcttcttcgggggactgcttcggcgcgcggcctgtcttcgaagatgtttggggcctcctgctgcccacagtctgagcgaggagatggaactggagttccgcaagcggtccccctacaactacctgcaggtcgcctactttaaaatcaataaactcgagaaagccgtggccgcagcgcacaccttcttcgttggcaacccggagcacatggaaatgcagcagaatctcgactattaccaaaccatgagcggagtgaaggaggctgactttaaggacctggaaacccagcctcatatgcaagaatttaggttgggcgttaggctgtactccgaggagcagccccaggaggctgtgccgcatctggaagcagccctccaggaatatttcgtggcgtacgaagaatgtagggctctgtgcgaggggccatatgactacgatgggtacaattaccttgagtataacgcggacttgtttcaagcaattacagatcattatatccaggtccttaattgcaaacaaaattgtgttacagagctggcatctcacccctcccgcgagaaaccctttgaggacttcttaccttcgcactacaattatctgcagtttgcctactataatattggcaactacacacaggccgtcgagtgtgcaaaaacatatttattgttttttccgaatgatgaggtgatgaatcaaaacctcgcttactacgccgccatgctaggggaagagcatacacgttccattgggccacgtgagagcgctaaggaatatcgccagagatccttactagaaaaagagcttctgttctttgcctatgatgtgttcggtatcccgtttgtggatcctgattcttggactcccgaggaagttatccctaagagactgcaagaaaagcagaagtctgagcgggaaacagccgtgcggatttctcaggagatcgggaaccttatgaaggaaatcgagacgttggtggaagagaagacaaaagaatccttagatgtttcaaggctgacgagggagggcggtccactgctttacgaaggaatttcgcttacgatgaactccaagttactgaacggttcacagcgagttgtgatggatggggtgatctctgatcatgaatgccaggagctgcagcggctcaccaatgtggctgctaccagcggagatggataccggggccaaacgtcgcctcatacgcctaacgaaaagttctacggtgtcactgtcttcaaagcgctgaagctcgggcaggaaggcaaggtgcccctgcagagcgcccacctttactacaatgtcaccgagaaagtgcgtaggatcatggaatcttactttcggctggacactccattgtacttcagttatagccacctggtgtgccggactgcaatcgaagaagtgcaagctgagagaaaagacgattctcatcctgtccacgtagataactgcatcttgaatgcagaaacattggtgtgcgttaaagaaccacctgcttataccttcagagactattcagcaatactgtacctgaacggtgactttgatgggggaaacttttatttcactgagctggatgctaagaccgtgaccgcagaagtgcaacctcaatgcgggcgcgccgtagggttctcttctggcacggagaacccacacggcgtgaaagcagtgactagaggccaacgctgcgctatcgcattgtggtttaccctcgacccaagacattccgaacgagtcagggccgcacgcgctggagagtcttcctggtgctgtggagatccctttcctgagaggccgtggtttgccttcctgttccccaagtcacattgtcaatggctccggcacgagaggagtacgtgggacacctccagcaatgcgctgtctctgtggagtcattgcctggtcttgccgggccccgctgtcaacggcattcaggtcggtaaggaggtgaagaccggtagcgacgccgaattcctcgtcccttctctcggtcccacatctgctgtcttgtttcaacgtgtcgggcctgccggaaaagaaatgtccctcgggccactgagaaacttgccttgtccactgggcagcagtagttag

SEQ ID NO: 122060 - DNA, 2211 bp, Artificial Sequence
  Description of Artificial Sequence: Synthetic coding sequence
atggcagttagagccctgaagctgctgacaacgctgctcgcagtggtggccgctgcctcccaggccgaagtggaaagcgaggcagggtggggaatggtgactcccgacctgctgttcgcagaaggtacagccgcatatgcacgtggcgattggcccggggtagtgctctcaatggagcgggccttgagaagccgggcagcactgcgggccctgagactgaggtgtaggacccagtgcgctgctgatttcccctgggagctcgatcctgattggagtccatctcctgcccaggccagcggtgccgcagccctccgggacctgtcattcttcggggggcttctgagaagagcggcatgcctgcgtaggtgcttgggcccgcccgccgcccactcgctcagcgaggaaatggagctggaattcagaaagaggtctccctataactacttacaagtagcctacttcaagatcaacaaattggagaaagcagtggcagctgcacatacattcttcgtcggcaatcccgagcatatggagatgcagcaaaacctagattattaccagaccatgtccggtgtcaaggaagccgattttaaggacctcgagactcagcctcacatgcaggagtttaggctgggagtgcggctatacagtgaagagcaaccacaagaggcggtgcctcatctggaagccgcactacaggaatattttgtagcttacgaggagtgccgcgccctttgcgaaggcccgtacgattatgacggctacaattatctagaatataacgcagatctttttcaggcaatcaccgaccattacatacaggttctgaactgcaagcagaactgcgtcacagaactggccagccacccttcgagggagaaaccatttgaagacttccttccttctcactataattatctccagttcgcctactataatatcgggaattatactcaggctgtggagtgtgccaagacctacctactgttttttcctaatgacgaagtaatgaatcagaacttagcttactacgccgctatgctcggggaagagcatacgaggagtattggccctagagagtctgcaaaggaatatagacaaaggtcgcttctagagaaggaactgctctttttcgcgtatgatgtatttggaattccatttgtcgatcccgattcttggactcctgaggaagtaatacctaagcgcctacaggagaaacagaaatccgagagagagactgccgttcggatctcccaggaaatcggtaatctgatgaaagaaatcgagaccctcgtcgaggagaaaactaaggagtctcttgatgtgagccggctgactcgggaggggggcccgctcctctacgaggggatttccctgacaatgaactccaagctgctgaacggatctcagcgtgtggtcatggatggcgtgatttcagaccatgaatgccaggagctgcagagacttaccaatgttgccgcgacttccggagacggttataggggacaaacgtctccacacaccccaaatgaaaagttctacggcgtgacggtcttcaaggccttaaaactgggccaggagggcaaagtccctctgcagagtgctcacctttactacaacgttacagagaaggtgcggcgtattatggaatcgtatttcagactggacacccccttatactttagctattctcacctcgtgtgtcgcacagccatagaggaggttcaggccgaaagaaaggacgacagccacccagtgcatgtggacaactgcatcctgaacgctgagaccctggtgtgtgtcaaggagccgccagcctatacgttccgggactacagcgcaattctatatctcaacggagacttcgatggcggtaatttttacttcactgaactggacgctaagacagtgaccgctgaggtccagcctcaatgtggacgggccgtgggtttcagctctggaacagaaaatccacacggggtgaaggcggtcacaaggggtcaaaggtgcgctattgctctgtggttcactttggatccaaggcactctgagagggatcgggtgcaagcagatgacctagtgaagatgctcttttccccagaagaaatggacctgtcacaggagcagcctctggatgcgcagcagggcccaccagagcccgcccaggagagcctgagcggctcagaaagtaagcctaaggacgagctgtag

SEQ ID NO: 122061 - DNA, 2094 bp, Artificial Sequence
  Description of Artificial Sequence: Synthetic coding sequence
atggccgttcgcgcacttaagcttttgacgacactattagcagtggtggctgccgcctcccaggctgaagtggaatctgaagcaggttggggaatggtgaccccggatctgctgttcgcggaaggcaccgccgcctacgctaggggggattggcccggcgtggtactgagtatggagcgcgccctgcgcagtagagctgccctaagggcgctgagacttcggtgtagaacccagtgcgccgcagactttccctgggaactagacccggactggtctccaagcccagcacaggcctctggcgccgctgcattgagggatctgagcttcttcggagggcttctgagaagagcagcttgtctcagaaggtgtctgggccctccagccgctcactccttgagcgaagagatggagctcgagtttaggaagaggagcccctacaattacttgcaagtggcctatttcaagattaacaagctggaaaaagcggtggcagccgctcatacttttttcgtgggcaaccccgagcacatggagatgcaacagaatctggactactaccaaaccatgtccggtgtcaaggaagcagactttaaggaccttgaaacccagcctcacatgcaggaattcagactaggtgtgaggctctattctgaagagcagccccaggaggccgtcccacatctcgaggcggccctgcaggagtacttcgttgcctatgaagaatgccgagcactgtgcgagggcccctatgattatgatggttacaattacctggagtataatgccgatttatttcaggctattaccgatcactacattcaagtgttaaactgcaagcagaactgcgtgaccgagcttgcatcccatccaagccgagagaagccatttgaggacttcttgcctagtcactataattacctgcagttcgcctactacaacatcggcaactacacccaagctgtagagtgtgctaaaacctatctcttgtttttccctaacgacgaagtcatgaaccagaatctagcatactatgcagcgatgctgggagaggaacacacacgaagcattggcccgagagaatccgctaaagaatatagacagcgtagcctccttgaaaaggagctgctgtttttcgcttatgacgtgttcggaatccccttcgttgacccagattcttggacccccgaagaagtgatacctaaacgcctccaggaaaagcagaaaagtgaaagagaaactgcggtcaggatctcccaggagattgggaatttgatgaaggaaatcgaaactctggttgaggaaaaaacgaaagaatctctggatgtcagccgcttaactcgggaaggcgggccactcctttatgaaggaatctcactgaccatgaactctaaacttctcaatggatctcagagggtcgtcatggacggggttataagtgaccacgagtgtcaggaactgcagaggcttacaaatgtcgccgctaccagcggtgatggttacagggggcagacgtctcctcatacccctaatgaaaagttctatggggtgaccgtatttaaggcccttaaattagggcaggagggcaaagtgccgctgcagagcgcacacctctactataatgtgaccgaaaaggtgcggcgtattatggaatcttactttcgccttgacacgcctctgtatttctcatacagccacctggtatgcaggactgccattgaggaagtgcaggctgaacggaaggatgactcacatcctgttcacgtggataactgcatccttaatgcagagaccctggtgtgcgtcaaggagcctcctgcttacacctttcgagactactcagctatcctgtatctgaacggggatttcgacgggggaaatttctatttcaccgagctcgacgcaaaaacagtgacagcggaagtgcagcctcaatgtgggcgcgctgtggggtttagctctgggactgagaatccccacggtgtcaaagccgtgaccagaggacagaggtgcgccatcgccctatggtttaccctggaccctaggcatagcgagagggtcagagctgcccgggcaggacaaggagcaggacggtag

SEQ ID NO: 122062 - DNA, 459 bp, Artificial Sequence
  Description of Artificial Sequence: Synthetic coding sequence
tgagagagggaaactgccgtccggattagtcaggagatcgggaatctaatgaaagagatcgagacactggtggaagaaaaaactaaggagtctttggatgtttctcggctcaccagagagggcgggcccctgttgtatgaaggaatatcattgactatgaacagcaagctgcttaacggctcccaaagggtcgtgatggacggcgtgatcagcgaccacgaatgccaggaactgcagagacttacaaacgtggcagcaacatcgggagatggctaccgcggacagacaagtccccacactccaaatgagaaattctatggagttacggtgttcaaggccctgaagcgtggagtcgtgctggtgcggtttcacaccgccgacaaggatgtgccggaaactggccagttcaccaaggagcgtggcctgcttggccttactgtcccctgtggatggggatag

SEQ ID NO: 122063 - DNA, 1806 bp, Artificial Sequence
  Description of Artificial Sequence: Synthetic coding sequence
atggagttggagttccggaaacgcagcccatataactacttgcaggttgcttacttcaagatcaataaattagaaaaggccgtggccgcagcacacacatttttcgtgggaaaccccgagcacatggaaatgcaacaaaatctggactactatcagactatgtctggtgtcaaagaggcggacttcaaagacctcgagacccagccccatatgcaggagtttcgactgggggtgagattatacagcgaagaacaaccgcaggaagcagtccctcacctcgaagccgccctgcaggagtatttcgtggcttacgaagaatgccgagccctctgcgagggaccttatgactacgatggatacaattacctcgaatacaacgccgacctttttcaggccatcacagatcactacatccaggttctgaattgtaagcagaattgtgtcaccgagctggcatcccacccatcaagggagaaaccctttgaagatttcttgccctcccactataattaccttcagttcgcttactacaatatcggcaattacacccaggcagttgaatgcgcaaaaacttatctcctgttctttcccaacgatgaggtgatgaaccagaatctggcctactatgctgcgatgctgggtgaggagcacacacggtccattggccctagagaaagtgctaaagagtatcggcaaagatctctcttggaaaaagagctcttgttcttcgcttacgacgtgttcgggattccgtttgtagatcctgattcctggacaccggaggaggtcattcctaagcgcctgcaggagaagcaaaaatccgagcgagaaacagctgtgcgaatatctcaagagatagggaatcttatgaaggaaatcgaaaccctggtggaagagaaaacaaaggagagcctcgacgttagtcgcctgacaagggagggaggccccctcttatacgagggtatctcgctcactatgaacagcaaactgttaaatgggtcacaaagggtagttatggacggtgtaatcagtgatcatgaatgccaggagttacagcggctcaccaacgtcgccgccacttctggcgacggctaccggggacaaacatctcctcatacaccgaacgaaaagttttatggcgtcacagtcttcaaagcactcaagctcggccaggaagggaaagtcccactacagtcagctcatctgtattataatgttaccgagaaggtccgccgtatcatggagtcttacttccgcctggatacccctttgtatttttcatattctcacctggtctgtcggaccgccatcgaagaggtccaggctgagcgcaaggacgactctcatcccgtacacgtggacaactgtattctgaacgccgagacattagtgtgtgtgaaggagccaccagcgtataccttcagagactacagcgctattctgtatcttaatggcgacttcgatggcggcaatttttatttcaccgagctcgacgccaagacagtgacagcggaagtacagccccaatgtggacgcgctgtggggttctcatctggcactgaaaacccccacggcgtgaaggctgtgaccagagggcagcggtgtgctatagccttatggttcacattagatcctcgacactccgaaagagaccgtgtgcaggccgacgacctggtgaagatgctcttttcccctgaagagatggacctgtcccaagaacagccattggacgcccagcaagggcccccggagccggcccaggaaagcttatccggttcagaatctaagccaaaggacgagctgtag

SEQ ID NO: 122064 - DNA, 2355 bp, Artificial Sequence
  Description of Artificial Sequence: Synthetic coding sequence
atgacatcgccagctgctgcccagtctcgggagatagactgtctttcaccagaagcccagaaactggccgaagccaggctggctgccaaaagggctgcgcgggccgaggcacgcgagataagaatgaaggaactcgaaagacagcagaaggaggaggactccgagcgctattcccgtagaagtcgacgtaacacgtccgcctcggacgaggatgaacgtatgtccgtgggctcaagaggatctctgagggtggaggagcgacccgaaaaagactttaccgagaagggatccagaaacatgccgggactgagcgctgccacgttggcatcccttgggggaacctcttcccggagaggatccggtgacacctctatttcgatcgacactgaagcttcaatcagagaaataaaggatagcctggccgaggtcgaggagaaatataaaaaagccatggtatcaaatgctcagctcgacaacgaaaaaacaaactttatgtaccaggtggacacactgaaagatatgctgctagaactggaggagcagctcgcagaatcgcgccgccagtatgaagaaaaaaacaaggagttcgagcgcgagaaacacgcccattccatcttacaattccagttcgcagaggttaaagaggcgctgaaacagagagaagagatgttggagaaacacggaattatccttaattcagagatagccacaaacggggaaacgagtgacacattgaataatgtcggttatcagggacccactaagatgacgaaggaagagttgaatgcgctgaaatctactggcgatggtacgctggggcgcgcctcagaagttgaagtcaaaaacgagatcgtcgccaatgtaggcaaacgggaaattttgcacaatacagagaaggagcagcatactgaagatacagtcaaagactgcgtcgacatcgaggttttccccgccggcgaaaacacagaggatcagaagagtagtgaggacacggccccattcctcggcactcttgctggggccacatacgaggaacaggtgcagtctcagattctcgaaagtagcagcctccccgagaacacggtgcaggtggaaagcaatgaagtgatgggggcacctgacgacagaactcgtacccccttagagccttccaactgctggagtgacctagatggtgggaatcatacagaaaacgtgggcgaggccgcagttacacaggttgaggaacaggccggcactgtggcctcctgtccattaggacatagtgacgacacagtttatcatgatgacaaatgtatggttgaggtaccccaggagcttgaaacctcaacagggcacagtcttgaaaaggagttcactaaccaggaggcggcagaaccaaaggaagtccccgcccattcaaccgaagtgggacgggatcacaatgaagaagaaggagaagagacgggcctgagggatgagaaacctattaaaacagaagttcctggatcccccgcaggaaccgaaggcaactgtcaggaggccactggcccaagtacagtcgatacccagaacgagccgctggacatgaaagagccagacgaggagaaaagcgatcaacaaggcgaggcgctcgattcctcccagaagaagactaaaaataagaagaagaagaacaagaaaaaaaagtcccctgtgccagtagaaacgctcaaggatgtgaaaaaggaactgacatatcaaaacactgacctgtcagagattaaggaagaagagcaggtcaagagtactgatcggaaaagcgcggtagaggcgcagaacgaagtgaccgaaaacccaaagcagaagatcgctgctgagtccagtgagaatgtggattgtcctgagaaccctaagatcaagcttgatggaaagctcgatcaggagggagatgacgtacaaactgccgccgaagaggttttagctgacggcgatactcttgattttgaggatgacaccgtccagagcagtggccctagagcgggcggagaggagctagacgaaggcgtagctaaggacaatgctaaaatagatggagcgactcagtcctctcccgcagagccaaagtccgaagacgctgatcgttgtactctcccagagcacgagagtcccagtcaggacatttcggacgcctgcgaggcggagagcacagagcgttgcgagatgtccgagcacccaagccagactgtccgcaaagcgctggactctaactccctggaaaatgacgacttgtcagccccgggacgggagcccggtcactttaatcctgagtctagggaagatacacgaggagggaacgaaaagggtaagtcaaaggaggattgcacaatgtcctag

SEQ ID NO: 122065 - DNA, 2259 bp, Artificial Sequence
  Description of Artificial Sequence: Synthetic coding sequence
atgacctctccggccgctgcacagtcacgggagatcgattgtctgagccccgaagcccaaaagttagccgaggcgagattagccgcaaagcgagcagcgagggcagaagcccgggagattcggatgaaggaacttgaacgccagcagaaagaggtagaagaaaggcctgagaaggactttacagaaaagggctctaggaacatgcccggcctgtcagctgcgaccttggcttcactaggcggcacttccagccgtagaggttctggtgacacttctatatctatcgatactgaagcaagcatccgggaaatcaaggacagcctcgcagaggtagaagaaaaatacaaaaaagccatggtgtctaacgcccaattggacaatgaaaaaaccaactttatgtatcaggtagacaccctcaaggacatgcttttggagctcgaagagcaactcgccgaaagtcggaggcaatatgaggagaagaacaaagagttcgagcgtgagaagcatgctcacagtattctacagtttcaattcgcagaggtcaaagaggcactcaaacagagggaagaaatgctcgaaaagcacggcatcatcctgaattctgagattgcgacgaacggagaaacatccgatacactgaataatgtgggatatcagggcccgacaaagatgaccaaggaagagctgaacgccctgaagtctaccggtgatgggacgttagggcgcgcatctgaggtggaggtgaagaatgagatagtggctaatgtcgggaagcgcgagatcctgcacaacacagaaaaggaacagcatactgaggacactgtcaaggactgtgtcgatatcgaggtctttcccgcaggtgaaaataccgaagatcagaagtcctccgaagataccgccccttttctcggcaccctagcaggagccacctacgaggagcaggtgcagtctcagattctagaaagtagctctctgcccgaaaacaccgtgcaggtggagagcaacgaggtcatgggcgctcccgacgaccgaacacgcacccccctggagcccagtaactgttggagcgacctcgacggcggtaatcatacagagaatgtaggcgaagccgccgttacccaagtggaagagcaggccggtactgtggcgtcctgcccactgggccattccgacgacaccgtgtatcacgatgacaagtgcatggtggaggttccccaggagcttgaaacaagcaccgggcattctttggagaaagaattcaccaatcaagaggccgctgaacctaaagaagtgccagctcattctacagaagtgggaagggaccataatgaggaagaaggggaggagactggcctgagggacgaaaaacctattaaaacggaggtaccagggtcacccgcaggcactgagggaaattgtcaagaagcgactggaccgtccactgtggacacccaaaatgagccactggacatgaaagagccagacgaggaaaagagcgatcaacaaggcgaggcactggacagcagtcaaaaaaagaccaagaacaagaagaaaaagaacaagaagaagaagagcccagtccctgtggagacacttaaagacgtcaagaaagagttaacttaccagaacaccgacctatcagagattaaagaagaggagcaggtcaaaagtactgatagaaagagcgcagtggaggcccagaatgaggtgactgagaatcctaaacagaaaatagcagccgagagttccgagaacgtggattgtcctgagaatccaaaaataaagcttgacggcaagttggatcaagagggagacgatgtgcagaccgcagccgaggaagtattggcagatggagatactttggacttcgaagatgataccgtccagtcttcagggccgagggcgggtggcgaggagctcgatgaaggggttgcgaaggacaacgccaagatagatggcgcaacgcagagttcaccagctgaaccaaagtccgaagatgctgaccggtgcaccttgcccgaacacgaaagtcctagccaggacatcagcgacgcttgcgaggctgagagtaccgaacgctgtgaaatgagcgagcaccccagtcagacagttcgaaaagcgctggacagcaactctcttgaaaacgacgacctctctgcacccggccgggaacccggccattttaaccccgaaagccgcgaagacactcgggggggcaacgagaaggggaaatccaaggaagattgtaccatgagttag

SEQ ID NO: 122066 - DNA, 1893 bp, Artificial Sequence
  Description of Artificial Sequence: Synthetic coding sequence
atgactagtcccgccgctgcccagtctcgggaaattgattgcctgtcacccgaggctcagaaactcgccgaggctcggcttgctgccaagcgagcagctagagccgaagcgagggagatacgcatgaaggagctcgagaggcagcaaaaggaagtgactagtgcccaagagaagtattatggactagacactaaatggggcgatatcgagcaatggatggaggactctgaaagatactcaagaaggtcacgccgtaacacatcagcgtctgatgaagacgagcgcatgagcgtcggatcacggggatctctgcgttcccaacccgacctggagtacggcggcccgtatgcttggacgaatggatacgacggagagctctacggctcgcaaagcctgaacaggaggtcgggcaggcctagctgtctatacagcgctgcgcggccgtcggggtcttatcgcgcctctgtccttgatgaagggtcttttggtgggaccaggcggggctccaccagtgggagtcgagctccatccgagtatagtggtcatctgaattctagctcacgcgcctcctctcgtgctagttcggcccgcgcatcccctgttgtagaagagagacctgagaaggactttactgaaaaaggatcaagaaatatgcctgggctcagcgctgcaaccctcgcgtccttgggaggcacaagctcccgcaggggctctggcgatacctccatcagcatcgacacagaagcaagcatccgggaaatcaaggaactcaacgagctcaaagatcaaatccaggatgtggaaggaaaatacatgcagggacttaaggagatgaaagatagtttggcggaagtggaggagaaatataaaaaggcaatggttagtaacgcgcagttagataatgagaagacgaacttcatgtaccaagtggataccctcaaagacatgcttttggagctagaggagcagctcgccgagtccaggcgccagtacgaggagaagaataaagagttcgagcgcgagaaacatgcacactctattctgcaatttcagtttgctgaagtaaaagaagctttgaagcaacgtgaagagatgttggaggaaataaggcagcttcagcaaaaacaggcatcaagcattcgggagatttctgatcttcaagagacgattgaatggaaggataaaaagataggcgcacttgaacggcaaaaagaatttttcgacagtgttaggtctgagcgtgacgacttgcgcgaggaggtcgtcatgcttaaagaggagctgaaaaaacacggcattatcctgaatagcgagatagccacaaatggagagacttctgataccctcaacaacgtgggctaccagggtccgaccaaaatgacaaaggaagaacttaatgccctgaaatctaccggggatggaacactggatatcaggctgaaaaagctggttgacgaaagagagtgtctgttggagcaaatcaaaaagcttaaaggacagcttgaggaaagacagaagattggaaagctggataatctacgcagcgaggatgacgttttagagaatggcaccgatatgcacgtgatggaccttcagcgggacgccaatcgccagattagcgacctgaagttcaagcttgcgaaaagcgaacaggagattaccgctttggaacagaacgtcataaggctggagtctcaagtgtcccgatacaagtctgctgccgaaaatgccgagaagatcgaagatgaactgaaagccgagaaacggaagctccaaagggagctacggagtgcactggataagaccgaagagctcgaagtgtccaacggccacttggttaagcgcctcgagaagatgaaggcgaatagatctgcactgttaagccagcagtag

SEQ ID NO: 122067 - DNA, 2427 bp, Artificial Sequence
  Description of Artificial Sequence: Synthetic coding sequence
atgacaagtcccgctgcggcgcagtctcgggagatcgattgcctctctccggaggcccagaagttggccgaggcgcggttggccgcaaaaagggctgcacgcgccgaagctcgcgagattagaatgaaagaactggagaggcagcagaaggaagaggactccgagcgatacagccggaggtcccggcgcaataccagcgccagcgacgaggacgagcgcatgagcgtggggtccagagggtctctgcgcgtagaagagcgaccagagaaggacttcacggaaaaaggaagtaggaacatgccgggtctcagcgctgcaactctcgcctccctcgggggaacgagcagcagacggggatccggggatacaagtatttcaattgacacagaagcttctatcagggagataaaggaactgaacgaactcaaagatcagattcaagatgtcgaaggcaagtacatgcaggggctgaaggagatgaaggatagtctggccgaggtagaggagaaatataaaaaggccatggtatcaaacgctcagcttgataatgaaaaaaccaattttatgtaccaggtcgacaccttgaaggatatgttgttggagcttgaagaacagctggcagagtctcggcgacaatacgaggaaaagaataaggaattcgagagagagaagcatgcccacagtattctgcagttccagtttgccgaagtaaaggaagcactgaagcagagagaggagatgctcgagaagcacggaatcatcttaaatagcgaaatcgccacaaatggcgaaacctccgatacactgaataatgtcggctatcagggccctactaaaatgaccaaggaggagctgaacgctctgaaaagcacaggcgacggcaccctcggtagggccagcgaggttgaggtcaagaatgagattgtggctaatgtcggcaagcgcgaaatactgcacaacaccgaaaaggagcagcatactgaggacacggttaaagactgcgtcgatatcgaagtgttccctgcaggggagaatacagaggatcagaaaagttccgaagataccgccccgtttctagggaccctagctggggccacatatgaggaacaagtgcaaagtcagatactggagtcctcctcgttaccagagaatacggtacaggtggagtcaaatgaagtcatgggggcgccagatgacaggactcgcacacccctagagcctagcaattgctggtccgatctggacggtgggaatcacacagagaatgtaggagaagccgcagttacccaagttgaggagcaggcagggacagtggcctcatgcccactggggcattcagacgacacggtgtatcacgatgacaaatgtatggtggaggttccacaggagcttgagacaagtacagggcactctttagagaaagagttcaccaatcaggaagctgccgaacccaaagaggtccccgcccactccactgaggtaggccgagaccacaacgaggaagaaggggaggagacagggttgcgtgacgagaaacctatcaagacagaggtgccaggaagtcccgccggaactgagggcaactgtcaggaagccaccggacccagcactgtggacacacaaaatgagcccctggatatgaaagaacctgacgaagagaagtctgatcagcagggcgaagctttggactccagccagaagaagaccaagaacaaaaaaaagaagaataaaaagaagaaaagcccagtaccagttgaaacacttaaggatgtgaaaaaagaacttacttaccagaacacagacctgtctgaaatcaaagaggaggagcaagtaaagtcaaccgatagaaaaagcgcagttgaggctcagaatgaagtgacagaaaaccccaaacagaagattgccgccgagtcgagtgaaaatgtggattgcccagaaaatccgaagatcaagctggatggtaagctggatcaggaaggggatgacgtacagactgctgccgaagaggtgctggctgatggggacactctcgatttcgaagatgataccgtccagtcatcagggccccgagctggcggcgaagaactcgatgagggcgtggctaaagataatgccaagatagacggggctactcaaagcagccccgccgaacccaagtcagaggatgccgacagatgtactctgccggaacatgaatcgcctagccaagatattagtgatgcgtgcgaggcggaatcaacagagcggtgtgagatgtccgagcacccgagccagaccgttagaaaggcactggactccaattccctggaaaacgacgacctcagcgctccagggagggagccggggcacttcaatcctgagagccgggaggacaccagaggtgggaacgaaaagggtaaatccaaggaggattgtacaatgtcctag

SEQ ID NO: 122068 - DNA, 1923 bp, Artificial Sequence
  Description of Artificial Sequence: Synthetic coding sequence
atggatatgggaactcagggttctgggcgtaaaagactccccaaccgggagaggttgacagctgaagatgacgctctgaatcaaatcgcaagagaggccgaggcacggctcgcagccaaaagagcggcacgtgccgaggctcgagagattcggatgaaggaactcgagaggcagcaaaaggagatttatcaggtccaaaagaagtactatggactcgatacaaaatggggggatatcgagcagtggatggaggactctgaacgatactctagaagaagcagaaggaacacctcagccagtgacgaggacgaacgcatgtccgttggcagccgtgggtccttgaggtctcagcccgatctcgagtatgggggcccctatgcctggaccaacgggtacgacggagagttgtacgggtcccagtctttgaatagaaggagcggaaggccttcgtgcctttattccgcagcaaggccttccggctcctatagggctagcgttctggatgaaggatccttcgggggcaccaggcggggcagtacatctgggagtcgagcaccatccgagtactccggacatttgaacagcagcagcagagctagttccagggccagctcagcacgcgcttccccagtagtcgaggagaggcctgagaaagattttacagagaagggctcccgaaatatgcccggattgtcagcagccaccttagccagccttggcgggacctccagtcggaggggatccggagatacttccattagtatagatacggaggcgtctatacgggagatcaaggaactgaacgagctgaaggaccagatccaagatgtcgaggggaagtacatgcaagggctcaaagaaatgaaggatagcctggctgaagtggaggagaaatataagaaggccatggttagtaatgcccaactcgacaatgaaaagaccaacttcatgtaccaggtggacacccttaaagacatgctccttgagctcgaggaacagttggcggaaagtcgtcgtcagtacgaagaaaagaacaaggagttcgagcgcgagaagcacgcccactccattttgcagtttcagtttgcagaggtcaaagaagctcttaagcagagagaggagatgctcgaagaaatccgacagcttcagcagaaacaagccagtagtatcagggaaattagcgatctccaggaaactattgaatggaaggataaaaagatcggagctttagagcgacagaaagagttttttgattctgtgcggtctgaacgtgacgatctgagagaggaggttgttatgctcaaagaagaattgaagaaacatggcattatcctcaactccgagatcgcaaccaacggggaaacatctgataccctcaataacgtcgggtatcagggcccaactaaaatgacgaaggaagagctaaacgctctgaagtctactggagacggaaccctggacattcgcttgaagaagttagttgatgaaagggagtgcctcctggagcagatcaagaagcttaagggccagttggaagagcggcagaaaatcgggaaactggacaacctgaggagcgaggacgacgtgttagagaatggtacagatatgcacgttatggatctgcagcgggatgcaaacaggcagatctccgatctgaaattcaagcttgctaagagtgaacaggaaattacagccctggaacagaacgttattcggctggaaagccaggtgtcaagatacaaatcagcagcagagaacgccgagaagatcgaggacgaattgaaagcagagaaaaggaagctgcagagggaactgcgaagcgcgctcgacaagaccgaggagttggaagttagtaacggccatctggtgaagcgcttagaaaaaatgaaagccaacagaagcgctcttctgtcacaacagtag

SEQ ID NO: 122069 - DNA, 2166 bp, Artificial Sequence
  Description of Artificial Sequence: Synthetic coding sequence
atgggaactccagcttcaggaaggaagcgcacccctgtgaaggataggttcagcgccgaggatgaagcactttccaatatcgctagagaggccgaggctcggctggcagccaaacgagctgcccgtgcggaagcacgcgatatccgcatgcgtgagcttgaacgccaacagaaagagtactcactgcacagcttcgatagaaaatggggtcagatccagaaatggctggaagatagtgagcgtgcacgctacagccatagatcttctcatcatcgaccgtacctcggcgttgaagacgccctcagcatccgctctgtgggctcgcatcgttatgacatgttcaaagaccgatcatctcgattgagctccctgaatcacagctatagccactcacacgggatgaaaaagcgcagtagtgattcccacaaggaccttctaagcggtctttatttcgaccagagaaactactcctctctgagacattctaaacctacatccgcctactacacacggcagtcgagcagcctgtattcagacccgctggcaacttataaatccgaccgggcttcccctacagccaatagcggcctgctgcggtcagcatccctcgcttcgctctacaatggtggcctatacaatccatatggacccaggaccccctccgaatgttcctactactccagccggattagttctgcccgcagtagcccgggattcaccaatgatgatactgccagcatcgtttcctccgaccgagcatcaagagggagacgagagtccgttgtaagcgctgctgactattttagcagatcaaacagacggggatccgttgtgtccgaggtagacgatatcagcataccagacctttccagcctagacgagaaatccgataaacaatacgccgagaattatactagaccaagttccaggaactctgcttccgctaccaccccactctctggcaactctagcaggagggggtcgggagacacatctagcctgatcgaccccgacacgtcactatctgagctgcgggatatctacgatctgaaagatcaaatccaggatgtagaggggagatacatgcaaggcctgaaagaattaaaagaatccctcagtgaagtggaggaaaagtataagaaggccatggtgtccaacgcacagctggacaacgaaaagaacaacctcatctaccaggttgatacgcttaaggacgtgatcgaggagcaagaggaacagatggccgagttctaccgtgagaacgaggaaaaatccaaagagcttgaaaggcagaagcacatgtgctccgtgcttcagcataagatggaagaactcaaagaaggtttgcgacaacgcgacgagttgattgaggagaaacagaggatgcaacagaaaattgataccatgacaaaagaggtatttgatctacaggaaaccctcctgtggaaagataagaaaataggcgcactggagaaacaaaaggagtatattgcgtgcttacgtaatgagagagacatgttgcgggaggaattagccgatctacaggaaaccgtgaaaaccggggagaagcacggcttggtcattattccagacggaacaccaaacggagacgtgtcacacgaacctgttgcaggtgctattacagttgtctcacaggaggcggcccaggtgctggaaagcgcaggtgaaggacctctggacgtccgacttcggaaattagccggagagaaggaggagctgttgagccaaatcagaaagttaaagttgcaactggaggaagagaggcagaaatgcagcaggaatgatgggaccgtgggagacctggccggcctacagaacgggtctgatctgcagttcatcgagatgcaaagagatgccaatcgacagattagcgagtacaaattcaagttaagcaaggccgagcaggacattactaccctggaacagtcaatatcaagattggaagggcaggtgctccgctacaaaaccgcagccgagaacgcggaaaaagtggaggacgaactcaaagccgaaaagaggaagctccagagagagttacgtacggcattggataaaattgaagagatggaaatgacaaactctcacctggccaagaggctagagaagatgaaggccaataggaccgctctgctcgcccaacagtag

SEQ ID NO: 122070 - DNA, 1203 bp, Artificial Sequence
  Description of Artificial Sequence: Synthetic coding sequence
atggggactcccgcgagcggccggaaacggaccccagtgaaggatcgcttttccgcggaagatgaagcactaagtaacatcgcccgcgaggccgaagcacggcttgccgccaagagggccgcccgggctgaagcaagggatatcaggatgagggaactggaaaggcagcagaaagagctggacgaaaagtcggataagcagtatgccgagaattacactcgccccagcagtcggaattccgcttctgcaacaacaccccttagtgggaacagtagcaggagaggctcaggcgacacgtctagccttatcgatccggatacgagtttgagtgaattgagagagtcactttctgaggtggaggagaagtataaaaaagccatggtgagcaatgctcagttggacaacgagaagaacaacttgatttatcaagtcgacaccttaaaagatgtgatcgaagagcaagaggagcagatggcagaattctatcgcgagaatgaagagaaatctaaggaacttgaacgacaaaagcatatgtgctcggtcctccagcacaagatggaggaactgaaagaagggcttcgacagcgggacgaactcatcgaaaaacacgggctggtaatcatccctgacggcacacctaacggtgatgtgtcccacgagccagtggctggagcaatcacagttgtgtcccaagaggcagcccaagttctcgaaagtgccggagagggtcccttagacgttcgactgcgaaagttggctggcgagaaggaggaacttctgtctcagattagaaaactgaagttgcagcttgaagaggagaggcagaagtgtagtagaaacgacgggacagtaggtgacctagcggggctccagaacggtagtgacctgcaatttattgagatgcagcgtgatgccaaccgccagatatcggagtataagtttaaactcagcaaagctgagcaggacattaccactctggagcagagtatctctagattagagggccaagtgctacgttacaaaactgctgccgaaaacgcggaaaaggtcgaagatgaactgaaagcagagaagaggaagctgcagagggaactccgaaccgccctggataagattgaggagatggaaatgaccaacagccacctggccaaaagactagagaagatgaaagccaacagaacggctctgttggctcagcagtag

SEQ ID NO: 122071 - DNA, 2166 bp, Artificial Sequence
  Description of Artificial Sequence: Synthetic coding sequence
atgggaacaccagcctccgggcgtaagaggactcccgttaaagatcgattcagtgcagaggacgaggctctatctaatattgcccgggaagctgaggcccgtctggccgcaaagcgtgccgccagggcggaggctcgcgacatacgtatgagggagctggaaaggcaacaaaaagaatactctctccattcatttgatcgtaagtggggacagattcaaaagtggcttgaagattctgagcgcgcgaggtacagtcaccgctcgagccaccatcggccttacctgggggtcgaggatgcactgtcaattagaagtgttgggagccatcgttatgacatgtttaaagaccggtcctcgaggctgtcatccctcaaccactcttactctcacagccacggtatgaagaaacggtcctcggactctcacaaggatctgctgagcgggctttattttgaccaacgcaattatagttcccttcgccactcgaaacccacgagcgcctactatacaagacagtctagctcactgtattccgatcccctcgctacctataaatccgatcgtgctagccctaccgcaaattctgggctgctgagaagcgcttcactggcttcactttataacggtgggctctacaacccatacggacccaggaccccaagtgaatgcagctattactcttcaaggatctcttccgcccgtagcagcccgggctttactaatgacgacaccgcatcaatagtctcctctgacagggcttcaagggggcgcagggagtctgttgtctctgccgctgactacttcagtaggagtaatagacggggaagtgtcgtgtcggaagtggacgatatatcaatcccagacttgtcatcactggatgagaaatccgataaacagtatgccgagaattacactcggccctctagtagaaatagtgcatctgctacaacgccgctgtccggaaactccagccgaagaggatcaggggacacctcaagtttaattgatcctgacacatccctgagtgagctgcgggacatctacgatcttaaggatcagattcaggatgtggagggccgctacatgcaaggtctcaaggagcttaaggaaagcctgtccgaggttgaagagaaatacaaaaaagctatggtatctaacgcccagcttgacaatgagaagaataatctcatctatcaggtcgatactcttaaggacgtgatcgaggagcaggaggaacagatggcagagttctatagggagaacgaggagaagtctaaagagcttgagcgtcaaaaacacatgtgctcagtcttgcagcacaaaatggaggagctgaaagaaggattgcgccaacgggacgaattgatagaagaaaaacaacgaatgcaacagaaaatagacaccatgactaaggaagtgtttgatcttcaggagaccctgctatggaaggataagaaaatcggcgccctagagaagcagaaagagtacatagcctgtctgaggaatgagagggatatgctgcgcgaagaactggccgatcttcaggagactgtgaagacgggcgagaaacatggtcttgttatcattcccgatgggactcctaacggggacgtgtctcacgaacctgtggccggagcaattaccgtcgtgtctcaggaggccgcacaggtcttagaatctgctggcgaaggtcctttagatgtgcgcttgagaaagctcgctggggaaaaggaggaactcttatcccagattagaaaattgaaactgcagcttgaagaagaacgacaaaagtgcagccggaacgacggcaccgtgggtgacctggcaggattacagaacggttccgatttgcaattcattgaaatgcagcgcgacgcgaaccgccagatatccgagtataaatttaagctgagtaaggccgagcaggacatcaccactttggaacagtcaatatctcgtcttgaggggcaggtcctgcgttataagaccgctgccgaaaacgctgagaaggttgaggacgagctaaaggctgagaagaggaagttgcagagagagttacggacagcgttagacaagatcgaagagatggaaatgaccaatagccatctggctaagagactggaaaaaatgaaagcaaaccggactgcactgctcgcccagcagtag

SEQ ID NO: 122072 - DNA, 180 bp, Artificial Sequence
  Description of Artificial Sequence: Synthetic coding sequence
atgggcactcccgctagtggccggaaaaggacgcccgtgaaagatcgtttttctgccgaggacgaagcgctctctaatatcgcaagggaggcagaagctcggctggccgccaagagggcagccagagctgaagccagagacatcaggatgagagagctggaacgtcagcagaaagagtag

SEQ ID NO: 122073 - DNA, 180 bp, Artificial Sequence
  Description of Artificial Sequence: Synthetic coding sequence
atgggtactcctgcgtcgggtcgaaagcgcactcctgtgaaggaccgcttctcagctgaagatgaagccctgtccaacattgcaagagaggctgaagcgcgtctggctgccaagagagccgccagggccgaagcccgcgacattcgaatgcgcgaactggaacgacagcagaaagaatag

SEQ ID NO: 122074 - DNA, 180 bp, Artificial Sequence
  Description of Artificial Sequence: Synthetic coding sequence
atgggaactccggcatctggacggaagcgaacaccagtgaaggataggttttccgcagaggacgaagcactatccaatatcgccagagaggccgaggcccgactggctgctaaaagggctgcaagggcagaagcccgggacatcaggatgagagaacttgaaagacagcagaaggagtag

SEQ ID NO: 122075 - DNA, 1275 bp, Artificial Sequence
  Description of Artificial Sequence: Synthetic coding sequence
atgggaactccggcctctggaaggaaaaggacccccgtcaaagacaggttttctgcagaagacgaggcattgtccaacattgcacgggaggcagaggccagactcgcggccaaacgcgcagccagggctgaggctcgggacatccgtatgcgtgagctggaaagacaacagaaggagctggatgagaagagtgacaagcaatatgcagaaaactataccagaccttcaagccgtaacagcgcatctgccactaccccgctcagcggcaattccagcaggcgagggtccggggatacctcttccctcatcgacccagataccagcctatcggagctccgagacatctatgatctaaaagaccagattcaggatgtggagggaaggtacatgcagggattgaaggagttgaaagagagcttgtcagaggtcgaggagaaatacaagaaagccatggtatctaatgcgcagctggacaacgagaagaacaatttgatctaccaggttgacacgctgaaggatgtcatcgaagagcaggaggagcagatggcagagttctacagagagaacgaggaaaaatctaaggagctcgaaaggcagaagcatatgtgcagcgtgttgcagcataaaatggaagagcttaaagagggtctgaggcaaagggacgaacttatagaaaagcacggacttgtgataattcctgacggaacccccaatggtgacgtatctcacgaacccgtcgccggtgccattaccgtggtctcccaggaggctgcccaggtgctagagagcgcaggcgaggggcctctggacgtcagactgcgtaagctagccggggagaaagaggagctactctctcagattcgcaagctcaaactacaactggaagaagagcgtcagaaatgttctcggaacgatggtacggtaggagatctagccggcctccagaacgggtcggacttgcagttcatagaaatgcagcgtgatgctaaccgacagatttcagagtataaattcaagctgtctaaagccgaacaggacatcacaaccctggagcagagtataagtcgccttgaaggccaggttcttcgctacaagacggctgccgagaatgctgagaaggtggaggacgaattgaaggccgaaaaaaggaaactgcagcgcgaattaaggaccgccctcgacaagattgaggagatggagatgactaactcccaccttgccaagcgcttggagaagatgaaagccaatagaactgcgctcttagcacagcagtag

SEQ ID NO: 122076 - DNA, 2316 bp, Artificial Sequence
  Description of Artificial Sequence: Synthetic coding sequence
atggcgccgggaccgttctctagcgcccttctgagtccaccccccgccgccctaccgtttctgcttctgctatgggccggggcaagccgcggccagccttgcccggggagatgcatctgtcaaaacgtggcccctactctcactatgctctgcgcaaagaccggacttctgttcgtacctccagcaatagataggcgcgtggtagaattgaggctgacagataatttcatcgctgctgtacggcgcagggactttgcaaacatgacctctctggtacatctgaccctgagccgcaacaccataggacaagtagccgcgggagccttcgccgacctgcgtgctctgagagcgctgcatctagactccaatcgactggctgaagttcggggtgatcaactgcgcgggctcggtaacctgcggcatttaatcctcggaaataaccagattaggagggtggaatctgcggctttcgacgcgttcctgtccaccgtggaggacctcgatcttagttataacaatctagaggctttgccctgggaagcggtgggccagatggtgaacctgaacacactgactctagaccataacctaattgaccatatcgcagagggcaccttcgtgcagctacataagctggttcggctcgatatgacgtccaaccgactgcacaaactacctccagatggcctgtttcttagaagtcaggggaccggccctaagccccctacccccttaaccgtgagctttgggggaaaccctctacattgtaattgtgaactcctgtggctgagacgcctgactcgcgaggacgacctggagacctgtgccactccagaacacctcaccgatcggtatttttggagtattcctgaggaggagttcctgtgcgagcccccactcatcactagacaagccggagggagagcactcgtcgtcgagggacaggccgtgtccttgcgctgcagagcggtgggcgaccctgaaccagtagtgcactgggtggcccctgacggacggttactgggcaattcctcacgcacgcgagtgcgcggcgatggtacccttgatgtgacaatcacaaccctgcgcgactctggaaccttcacttgcatagctagcaatgccgcgggcgaggctaccgccccagttgaggtatgcgtcgtgcccctgcctctgatggctccacccccagccgcaccgcctccactgactgaacctggtagctccgatatcgccacgcctggtcgccccggcgcaaacgacagcgctgccgaaaggcggttagtggccgcagagcttaccagtaactccgtgctcattcgctggcccgctcagcggcccgtgccgggcataagaatgtaccaggtgcagtacaactcttcagtggacgacagcctggtctaccggatgatcccgtccaccagccaaacgttcctggtgaacgacttagcagctgggcgcgcatacgatctgtgcgtactggctgtctacgacgatggtgcaaccgccctgcctgctactagggttgtcggctgcgtccagttcacaacggccggtgatcctgccccctgtcggcctttaagagctcactttctcgggggcaccatgatcatcgccattggcggcgtgatcgtggcctctgttctggtgtttatcgttttattaatgatcaggtacaaggtgtacggcgacggagacagtcgtcgtgtcaagggttcacgatctctgccacgagtttcgcacgtttgtagtcagactaatggtgcggggactggtgctgcgcaggctccagcgctgccggctcaagatcactacgaggcgttgagagaggtagagagtcaggccgcccccgcggtcgctgttgaagcgaaggccatggaggccgagactgcaagcgccgaacctgaggttgtgctcgggagatctcttggaggttcagccacgtccctatgcttgctgcccagcgaggaaacatccggcgaagaaagtagggcagccgtgggcccacgacgatcgaggagcggggcgctagagcccccaacctcggcccctccaacgctagccctggtcccgggcggggcagcagcccgacctcggccgcagcagcgatattcctttgatggcgactacggcgcactttttcagtcacactcctaccctcgccgtgcgcggagaaccaaacggcatcggagcaccccacacctggatggagccggaggaggggctgcaggcgaggacggtgacctgggtctcggctcggcccgggcatgcctggccttcacctcaacagagtggatgctcgagtctactgtctag

SEQ ID NO: 122077 - DNA, 2370 bp, Artificial Sequence
  Description of Artificial Sequence: Synthetic coding sequence
atggagacactgctgggcggcttgctcgcctttggtatggcttttgccgttgtggatgcctgcccaaagtactgcgtttgccagaacctctccgagtctcttggcaccctgtgcccatctaaagggctgttgtttgtccctccagacatagaccgtaggaccgtcgagctgaggctgggaggaaacttcatcatccacatttcacggcaggatttcgcaaatatgactggcctggttgacttgacactgagtcggaatacaatcagccacatccagccattctctttcctggacctagagagccttcggtccctgcatttagactccaatagactgccgagtctcggagaagacacactgcgggggctggtgaaccttcaacacctgattgtcaataataaccaattagggggcatcgccgatgaggcctttgaagacttcttacttacattagaagacctggacctgagttataataatcttcacggtctcccctgggacagcgtccgcaggatggtgaacctccaccagctgtctcttgaccacaacttgctggatcacattgctgaaggcacgttcgccgatcttcagaaactggcaaggttagacctgacctctaatcggctgcaaaaactccctccagatccaatctttgcaagaagtcaggcatccgcgctgacagcgacgcctttcgccccccccctgtcattttcttttggaggcaatcccctgcattgcaattgcgaactcctgtggcttaggaggctcgaacgagacgacgatcttgagacatgtggttcacccggcgggttgaaaggacgctacttttggcacgtgagggaggaggaatttgtgtgcgaaccacccctgatcactcagcacacacacaaactgctggtgctggagggtcaggctgccacactgaaatgcaaggcaatcggtgacccatccccgttaattcactgggtcgctcccgatgaccgcctggttggaaatagcagtcgaacagccgtgtatgacaatggcaccttggacatatttattaccacttcccaggactctggcgcgttcacatgtattgccgcgaatgccgcaggggaggctacagccatggtcgaggtttctattgtccagttaccgcatctctccaatagcacatcgaggactgctcctcccaagtcacgccttagcgacataacaggatcctccaagaccagcaggggaggtggggggagcggcgggggggagccgcctaagagtccacctgagcgggcagtccttgtatccgaggtgactactacttcagctttagtcaaatggagcgtgagcaagtctgctcccagagtaaaaatgtaccaactgcaatacaactgttccgacgacgaggtgctgatttataggatgatcccggccagcaataaggcatttgtggtaaacaaccttgttagtggaacaggatacgacctttgcgtcctcgccatgtgggacgacacggctaccactctgactgctactaatattgtaggttgcgcccagttttttaccaaggccgattatccccagtgccagagcatgcatagccagattctgggggggacaatgatactggttattggcggcattatcgtggccacattactggtattcatagttatacttatggtgcgctacaaggtctgcaaccatgaggctccctccaagatggctgcggcagtgtcaaacgtctactcccaaactaacggcgcccagcctcctccaccgtccagtgcccccgccggtgctcccccacagggcccgccaaaggtggtggtgcggaatgagctccttgacttcactgcatctctggctagagcttcagactcctcgtccagttcgtctttgggatctggtgaggctgctggcctggggagggccccgtggcgtatccctccatctgcccctaggccaaagccgtccctcgaccgactcatgggggctttcgcctccctcgaccttaagtcccagcggaaagaggagctgctggatagtaggacacctgctggcaggggagccgggacctccgcccgcggccatcattcagatagggagccgctgctggggccgcccgccgctcgggcccggagcttgctgccactacccttagaaggcaaggctaagcggtcccatagctttgacatgggggattttgccgcggccgcagcgggtggcgtagttcctggcgggtacagtcctccacgaaaggtctccaacatctggaccaagaggtccctcagcgtgaatggtatgctgctgccatttgaagagtcagacctagtgggggcaagaggcaccttcggaagcagtgagtgggtcatggaatcaactgtgtag

SEQ ID NO: 122078 - DNA, 1887 bp, Artificial Sequence
  Description of Artificial Sequence: Synthetic coding sequence
atggctattctgccgctgctgctgtgcctgctgccgcttgcccccgcctcttcaccccctcagagtgctactccaagtccgtgtcctaggcggtgccgttgtcaaactcagtcccttcccctgtccgtgctttgtccaggagcaggtctgttgtttgtgcccccaagtctagaccgaagagcggctgaactgagactggctgataactttattgcttcagttcgtcgccgcgatctggcaaatatgacaggcctcctgcacctgtcactttctcggaacactattcgtcacgtggccgcaggtgcttttgcagatctccgggcgcttcgtgcactccatttagatggtaatcggctcacctccctgggagagggtcaactgaggggtctggtgaatctccgccacctgatactgtccaacaatcaattggcagccttggcggctggtgctctcgacgattgtgccgaaaccctcgaggacttagacctgtcctacaataacctcgagcagctcccttgggaggcactcggtcggctggggaacgttaatactctaggactagaccacaatcttcttgccagcgtccctgcgggcgctttctcacggttgcataagttggcaaggctggacatgacaagcaacaggttaactaccattccccccgatccattgttttcccggctgccactgttagcccgtcctcgcgggtccccagcctctgcccttgtgctggcgttcgggggtaacccattgcactgtaattgtgaactcgtgtggctacgcagattggctagagaggacgatctagaagcctgcgctagtcccccggcactgggcggccggtacttttgggccgtgggcgaggaggaattcgtttgtgaacctccggtcgttacccacaggagcccccccttagctgtgccagccggccggccggccgccttaagatgtagagcagtaggagaccccgaacctagagtcagatgggtgagcccacagggcaggctgttggggaatagttcacgagcacgagctttccctaacgggacattggaactattggttacagagccaggcgacggaggtatttttacctgcatcgccgcaaacgcagcaggtgaagctactgcggcagtagagctgaccgtggggcctcccccaccgcctcagctcgccaactccacctcttgtgacccacccagggacggtgacccagacgcgctgacaccacccagtgcagcaagcgctagtgctaaggtcgctgataccggacctccaacagatcgcggtgtacaggtcaccgaacatggagcaacagccgccctggtgcagtggcctgaccaaagaccgattccgggaatacgaatgtatcagattcagtacaactcgtccgctgatgatattttggtgtaccgtatgattcctgcggaatctaggtctttcctcctcacggatctagccagcgggaggacatacgacttgtgtgtcctggctgtctatgaagatagcgctacgggactgaccgcgacccggcctgtaggatgtgcaaggttctcaaccgaacccgctctgcgtccatgtggggctcctcatgccccattcctcgggggaacaatgatcatcgcactcggcggcgtcatcgttgccagtgtgctcgtgttcatcttcgtcctgctaatgcgctataaggtccatggcggccagccacccgggaaggctaagatccctgccccagtgtcaagcgtctgcagccagaccaatggggcactgggtcctacgcctactccagctccccctgcgcctgaacctgctgccctccgcgcacacacagtggtgcagttggactgtgaaccgtggggtccgggtcacgaaccggtgggcccttag

SEQ ID NO: 122079 - DNA, 1887 bp, Artificial Sequence
  Description of Artificial Sequence: Synthetic coding sequence
atggcaattcttcccctgttgttatgtctgcttcccctcgctccggcatcgtcacccccccaatccgcaacaccatcgccttgcccacggagatgcaggtgccaaacgcagtcattaccattgtccgttctttgtcctggcgctggccttctgttcgtgccgccatcactggaccgacgcgcggcagagcttaggctcgccgacaacttcatcgcctcagtcaggaggcgcgacttggccaacatgactggcttactccacctctctctttcgcgaaacaccattcgacacgtggcagccggagcctttgccgacctgcgcgcgctgcgcgctttgcatcttgatggcaatcgtttaacttctttgggagaaggccagctacgggggctggtgaacctgcgccacctgattctgtccaacaatcaactcgctgccttggcagcaggtgccctcgacgactgtgcagagacactcgaggatttagatctatcgtacaataacctggagcagctgccttgggaagccttgggtagacttgggaatgtgaatacactggggctcgatcataacctgctagcttccgtgcctgcaggtgcattctctagactacataagctggctaggctggatatgaccagcaatcgactgacaacaatccctcccgacccactcttcagtcggctgccactgctcgcccggcctagagggagtcctgcatctgcactcgttctcgctttcggcggcaacccgttacattgtaactgcgaactggtgtggcttcgaagacttgcacgagaagatgatctggaggcctgtgcctctccccccgcacttggtggaagatatttctgggcggtgggggaggaagagtttgtgtgcgaaccgccagtggtgacccacaggtcccctccactggcagtgcctgcaggcaggccagccgctctgagatgtagagcagtgggagaccccgaaccccgtgtgagatgggtgagcccacaaggccggctgctggggaatagcagtagggctcgcgcattcccgaatgggacactggaactcctggtaacagagccgggcgacgggggtatcttcacctgcattgccgctaacgcagccggtgaggccaccgcagccgtggagctgactgttggcccacccccacctcctcagctggcgaattcaacgtcttgtgatccccccagagatggcgaccccgatgctctgaccccaccatctgccgcttctgccagcgcaaaggttgctgatactggccccccaacagataggggggtgcaggtaacagagcatggcgccactgccgctctggtgcaatggccagatcaacgcccaattcccggaatacgaatgtaccagatacagtacaatagcagtgcagatgacattctcgtgtacagaatgataccggcagaatctaggtcattcttgctgaccgacctggcctcgggtcgtacgtatgacctgtgcgttttagcagtgtacgaggattccgcaaccggtctcacagctaccaggccagtgggctgcgcacggttctcaacagaaccagctctgcgtccttgcggagctccccatgctccattcttagggggcactatgatcatcgcattggggggcgtgatcgtcgcttccgtgttggttttcatcttcgttcttctcatgagatacaaggtgcacggcggccagccgcctgggaaagcaaagattcccgcaccagtcagttcggtgtgcagtcagactaacggcgccttaggacccacacctacgcctgcacccccagctccagagccggccgctcttcgtgcgcacacagtcgtgcagctggattgcgagccatggggaccaggccacgagcccgtggggccttag

SEQ ID NO: 122080 - DNA, 1908 bp, Artificial Sequence
  Description of Artificial Sequence: Synthetic coding sequence
atggcgcctccactgctgctgctccttctcgcctccggcgctgctgcctgcccactgccttgtgtgtgccagaatttgtccgagagcttaagcaccttgtgtgcccaccgtggtttgttgttcgtgcctcctaacgtagacaggcgcacagtggagctccgcttggccgataacttcatccaggcactggggccaccagattttagaaatatgaccggattagtcgacctgaccctgagtcgaaacgctatcacccggatcggagccagggctttcggggacttggaatctctgcggtctctgcacctcgacgggaatcggctggtggagctgggaactggcagtctcaggggcccagtaaatctgcagcatttaatcttgtccgggaaccagcttggcagaatcgcccctggcgccttcgacgactttttggagtctttggaggacttggacctctcgtataacaacttaagacaggttccctgggctggaatcggggcaatgccagccctgcataccctcaacctggatcacaacctgattgatgcactgcccccaggcgctttcgcacagttgggccaattaagcaggctcgatttgacatctaacaggcttgccactcttgccccagacccactctttagccggggcagagacgccgaagccagcccagctccattagtgctgtcttttagtggaaatcccctacattgtaattgcgaacttttatggttgaggagactggccagaccagatgacttggagacatgtgcttctccacccggactggccggccgatacttctgggctgtgccggagggagaattttcttgcgaaccacccctgattgctcgccatactcaaaggctgtgggtccttgaagggcagagagcaacactgagatgccgagccctgggcgatcctgcccccaccatgcactgggtgggccctgacgataggctcgtcggcaactcctcgcgcgcccgagccttccccaatggtacattggagattggcgtcaccggcgcaggtgacgccggcggatatacctgcatagccaccaaccctgcaggggaggccaccgcccgcgtggaactccgagtcctggctctgccacacggggggaactcttcagccgaaggggggaggcctggcccatctgatatcgccgcaagcgcacggacagctgcagagggcgaagggacgttggaaagtgaacctgcggtgcaggtgacggaagtaaccgcaacatctggtcttgtttcatggggccctggaaggcccgccgacccggtttggatgtttcagatacagtataattcctctgaggatgagaccctgatttaccgcatcgttccggcttcatcccatcacttcttgctcaagcatctcgtgcccggagccgattatgatctctgcctcctcgctctatctccagccgccgggccttcagatcttacggcgactcgccttctgggctgtgctcatttctccacacttcccgcatcacctctatgtcacgccctgcaagcacatgtcctaggtggcaccctgactgttgcagtggggggagtgctcgtggctgcacttttggtcttcaccgtggctttacttgtacggggtcgcggcgccggaaacgggaggctccctctgaagctgagtcatgtgcaaagccagaccaacggggggccgtctccaactcctaaggctcacccccccaggtcacctccccctaggccgcaaaggagttgttcactcgatctcggcgatgcaggatgttacggatatgcaagaagacttgggggggcttgggctcgtcgctcgcactcagtgcacggtgggcttcttggtgccggctgccgaggcgttggcggaagtgctgagcggctagaagagagtgtggtgtag

SEQ ID NO: 122081 - DNA, 2160 bp, Artificial Sequence
  Description of Artificial Sequence: Synthetic coding sequence
atggaaaaaattttgttctatctgtttctgattggaatcgcagttaaagctcagatttgtcccaagagatgcgtctgccagatcctctctcctaacctcgcaaccctatgcgcaaagaagggtctcctatttgtgccccctaatatagatcggcgcacagtcgaactgcgcctggctgacaacttcgtgaccaatatcaaaaggaaagattttgcaaatatgacctcccttgtcgacctgaccttgtcgcgcaatactatttcgttcataactcctcacgctttcgccgatcttcgcaacctgcgtgccttgcatttgaacagcaaccgtttgacaaagattacgaacgatatgtttagcggattatcgaatcttcaccacctcattcttaacaacaaccagctcacactcatttctagcactgcattcgacgatgtgtttgccctggaggaattggatttatcatacaataacctcgagactattccctgggatgcggtcgagaagatggtgtcactccacacactttctcttgatcataacatgatcgataatattccgaaggggacattctctcacttacataagatgactcggctggacgtgacttccaacaagttacagaagctgccccctgatcccctctttcagcgagcacaagtgttggctacaagtggtatcatcagccctagtacatttgccctgagctttgggggaaatccgctgcattgcaattgtgagctcctctggctccgcagactttctagggaagacgatctggaaacatgtgcgagccctcccctattgactgggaggtacttttggagcattcccgaggaagaattcttatgcgagcccccgctgattaccagacacacgcacgagatgcgagtcctagaaggccagagggccacccttcgctgtaaggcgcgcggagatccggagccagcgatacactggatttcgcctgaagggaagcttattagcaatgctaccaggtcactcgtctatgataatggcactcttgacattctgattacgaccgtgaaagacacaggagcattcacttgtatcgcaagcaaccctgctggggaagcaacccagatagtcgacctacacatcattaaactcccacacctactgaactctactaatcatattcacgagcctgatcctggcagctctgacatttctacttctaccaagagcggtagtaacacatcttctagcaacggagacactaagctgagtcaagataaaattgtggtggccgaggccactagctctacggctcttcttaaatttaacttccagcgcaacattcctggcatcaggatgttccagattcaatacaatggaacatacgatgatacgctggtgtacaggatgattcctcctacatcgaaaaccttcttggtaaataacttggcagcaggcaccatgtacgatctgtgcgtcctggcgatttatgacgatgggatcacctccctaaccgccactcgcgtcgttggctgcatccagttcactaccgaacaggattatgtgcgttgccactttatgcagtcgcagtttttggggggtaccatgatcatcataattgggggtatcattgtcgccagtgtcctggtgttcatcatcatactaatgattcggtataaagtgtgtaataacaacggacaacataaggttactaaagtgtcaaatgtgtactcccagaccaatggcgcccagatccaggggtgctcagtgacacttccacagagcgtttctaagcaggctgtgggacacgaggaaaacgctcagtgttgcaaggccactagtgataatgtgattcagagttcggaaacctgcagcagccaggactcttcgacaactacttccgccctcccaccttcctggacaagctctacaagcgtatctcagaagcagaaacggaagacaggaacgaagccatccaccgagccacagaacgaggcagtgaccaatgtcgagagccagaataccaatagaaacaatagcactgcactgcagctggcgtcccgacccccagattccgtaaccgaaggcccaacaagcaagcgagcccatattaagcctaatgcactcctcactaatgtagaccagatcgtgcaggaaactcagcggctcgagctaatctag

SEQ ID NO: 122082 - DNA, 1863 bp, Artificial Sequence
  Description of Artificial Sequence: Synthetic coding sequence
atgcaggtgagcaaaagaatgctcgccgggggggtgcggagcatgccctcacctctgttggcttgctggcagcccatcctgttactagttctcggaagcgttcttagcggcagtgccactgggtgccccccccgctgcgagtgttccgcacaggacagggccgtcttatgtcacagaaaaaggtttgtggctgtgccagagggcatccctaccgagactaggctcctcgacttaggtaagaacaggatcaagacgctgaaccaagacgagtttgcttccttccctcatttagaagagctcgaactgaatgagaacatcgtgtcagccgtcgaacctggggcattcaacaacctctttaacctgaggaccttgggactccggtccaaccgtctgaagctgatacccctaggggtgtttacagggctaagcaatttaactaaactggacatctccgaaaacaagatcgtcatcttactagactacatgttccaagatttatacaacttgaaatctctggaggtgggagataatgacctggtatacattagccaccgcgccttttcaggcctgaattccctcgagcagctgaccttagagaaatgcaatctgacgtccatccctaccgaggctctcagccacttgcacggattaatcgtgttgagactccgccatcttaacatcaacgcaatcagggactactcatttaaaaggctgtataggctgaaggtcctagagattagtcactggccatatctcgacaccatgacccccaactgcctttatgggctgaatctaactagtctgagcattacccattgcaatctgacagccgtcccttaccttgccgttagacatctagtgtatttgagattcttaaatctatcctacaatccaatatccaccatcgagggaagtatgttacatgagttgcttcggcttcaggaaattcagctggtaggcggacagcttgcggttgttgagccttatgcttttaggggcttaaattatcttcgggttttgaatgtcagtgggaaccagctcacaaccctagaggaatccgtcttccacagtgtgggcaaccttgagaccttaatcctggactcaaacccattagcgtgtgactgccgtctgttgtgggtgttcaggaggagatggagattgaacttcaaccgtcagcagcccacatgtgccactccagagttcgtgcaaggcaaggaatttaaagatttccctgacgtgcttctgccaaactacttcacctgccgccgcgcacggattcgggatcgcaaggcccagcaggtgttcgtcgatgaagggcatacagtgcagttcgtctgcagggctgacggagatccccccccggctattctttggttgagccctcgaaaacacctggtcagtgctaaatccaatgggcgacttactgtgttccctgacggcacactagaagttcgctacgcccaggtgcaagataacggcacctatctgtgcatcgcagccaatgctgggggtaacgatagtatgcccgcccatctccacgttaggtcctactctcccgactggccacatcagccaaataagacattcgcctttattagcaaccagccaggtgaaggtgaggcaaatagcacccgcgccacggtgcccttcccattcgatattaaaactttgatcatcgcaaccacaatggggttcatcagttttctcggcgtggttcttttctgcttagttctgttattcctgtggtcacggggaaaggggaatacaaagcataatatcgagatcgagtatgtgcctcgtaagtccgacgccggcatcagctccgcagacgcaccacggaaattcaacatgaaaatgatatag

SEQ ID NO: 122083 - DNA, 168 bp, Artificial Sequence
  Description of Artificial Sequence: Synthetic coding sequence
atgcttgccggaggagtccggtcgatgccttctcccttgctggcgtgttggcagccaatcctgctgctcgtcctgggctctgttctatccgggtccgccaccggctgccccccaagatgtgagtgtagtgcacaggatcgagcggtcctttgtcaccgcaaacgctag

SEQ ID NO: 122084 - DNA, 1845 bp, Artificial Sequence
  Description of Artificial Sequence: Synthetic coding sequence
atgttagctggaggtgtcagatccatgccctccccacttctggcatgttggcagccaattctcctccttgtgctaggcagcgtcctctctggctccgctacgggttgtccgccccgatgtgaatgttcagcccaggatagagcggtcctttgccaccgcaaaagattcgtcgccgtgccagaggggatcccaactgagacgagactcctcgaccttgggaagaatcggatcaagaccctaaaccaagacgaatttgccagcttcccacatctggaggagcttgagctcaatgagaatatcgtgtcagccgtggaaccaggcgcattcaataacctctttaacctacggacactgggccttaggagcaaccggctcaaactcattccattaggcgtcttcactgggctgagtaacctgaccaagctggatatttctgaaaataagatcgtgatcttgctcgattatatgttccaggacctgtataatctcaagagcctggaggtgggagacaacgatctagtgtacatcagccatagggcattttccggtctgaactcgttagagcagctgacccttgaaaaatgtaacctgacttccatcccgactgaagccttgagccatctgcacggcctgatagtcctcagattaagacatctgaacatcaacgctatccgtgactactcattcaagcgactgtaccgcctgaaggttcttgaaatctcccactggccgtacttggatacaatgacccctaactgcttgtatgggcttaacttgacttccctgtctatcacacactgcaacctcaccgctgttccttatcttgcggtcaggcacctggtatatctgagattcctgaatctgtcttataacccaatcagcacaatcgagggttcgatgctacacgagctgctgagactgcaggagatccagttggtaggaggccaactcgccgtagttgagccctatgcttttcgagggcttaattacctccgcgtgttaaacgtgagtggcaaccaactcacgactcttgaggagagcgtgtttcactccgtcgggaacctcgaaacccttatcctcgactccaaccccctggcctgcgattgccgactgctgtgggtgttccggcggcgatggagactaaatttcaatcgtcagcagccaacatgcgccacccctgagtttgttcagggaaaggagttcaaggactttcctgacgtactgttaccgaactattttacgtgcagacgcgcacggattcgcgacaggaaagcgcagcaggtctttgtggacgaaggtcatacagtgcagttcgtatgcagagcggatggagatccaccgcctgccattctctggctgagcccccgcaaacacctagtgtctgcgaaatccaacggtaggttgaccgttttcccagatggaactctggaggtaagatatgcccaggtacaagacaacgggacctacctatgtatcgcagccaacgctgggggcaacgactccatgcctgcccacctccatgtccggtcttacagtccggattggccacaccagcccaataaaacgtttgcctttatctcaaatcaacctggcgagggggaagccaattccacccgcgcaacagtcccctttcctttcgatattaagaccctgataatcgccacaaccatgggctttatctcattcttaggcgtcgttctcttttgcctcgttttgctattcctttggtcgagagggaaaggcaacaccaagcacaatatcgaaattgagtacgtgcctcgaaagtcagacgccggaatttcctcggccgatgcgcctcggaaatttaatatgaaaatgatttag

SEQ ID NO: 122085 - DNA, 1821 bp, Artificial Sequence
  Description of Artificial Sequence: Synthetic coding sequence
atgcttcataccgccatctcatgctggcaacccttcctggggttggcagtcgtgctgatctttatgggatctacaatcggatgccccgcaagatgcgagtgttccgcccagaacaaaagcgtctcatgccatcggcggcgacttattgcgattcctgaaggcatcccaatcgaaactaaaattctggacttgagcaagaaccggctcaaaagcgtgaatccggaagaatttattagttatcctcttctggaggaaatcgacctttccgataatatcatcgccaatgtggaacctggcgccttcaacaatctatttaatttgcgctccctccgactaaagggcaatcgattaaaattggtcccattaggggtgttcaccggcttgagcaacctcacgaagcttgacatttccgaaaataaaattgtgatcctactggactacatgttccaggatctgcacaatctgaaaagtttagaggttggagacaacgacctcgtgtacatctctcatagggcattttcaggcctgcttagtttagagcagctgaccctcgaaaagtgcaacttaactgcagtaccgaccgaagcgctgtcacaccttcggtcacttatctcactccaccttaaacatctgaacatcaacaacatgccagtttatgctttcaaacgtctctttcacctcaagcatttggaaatcgactattggcccttgcttgacatgatgccggcaaattcactgtacggtctgaaccttacatctctgtccgtcacaaatactaacttgtccaccgtgccttttctcgcgtttaagcatctggtttaccttacccatcttaacctctcctataacccaatcagtacaatcgaagccgggatgttttccgatctgatcaggctgcaagagctccacatcgtaggagctcagctccggactatagaaccacattctttccagggtctccgatttcttagagtcctgaatgtgtcacagaatcttctggagactttagaggagaatgtgtttagttcccctcgggccctggaggtgctgtctattaacaataacccgctggcctgtgactgtcggttactctggattctgcaaagacagccaacacttcagttcggaggccagcaacccatgtgtgccggaccagatactatcagagagaggagcttcaaagacttccattccactgcactgtccttctattttacgtgcaagaaacccaaaatacgggagaagaagctgcagcatctgctggttgatgaaggtcaaaccgttcagctcgaatgtagcgcagatggcgatcctcagccggtgataagttgggtgaccccccgtagacgcttcattaccaccaagtcaaatggcagagctactgtgctgggggacggcactctggagatccgattcgctcaggaccaggattccgggatgtatgtctgtatcgcctccaatgcggccggtaatgataccttcaccgcttccctcaccgtgaagggcttcgctagtgaccgctttctgtatgccaatcgcacacccatgtatatgacagactctaacgataccatctccaacggcaccaacgccaatactttcagcttggatctcaagacgatcctcgtatcaaccgccatgggctgctttactttcctgggagtagtactcttctgttttctgctgctcttcgtgtggtcccggggcaaggggaagcacaagaactccattgaccttgagtatgtacccagaaagaataacggcgcagttgtggaaggagaagtcgccgggcctcgacgctttaatatgaaaatgatctag

SEQ ID NO: 122086 - DNA, 1821 bp, Artificial Sequence
  Description of Artificial Sequence: Synthetic coding sequence
atgttacacaccgcaatctcttgttggcaacctttcctcggtctcgcggtggtattgatttttatgggctcaaccatcggttgtccagcgcggtgtgaatgctctgctcagaataaaagtgttagctgccaccggcggcgactcatcgctatccctgaaggcatcccaatcgaaactaagatcctcgatctctctaagaaccgcctgaagtccgtcaatccagaagagtttatatcctacccacttctggaggaaatcgacctgtcggataacataatcgcaaacgtggagcctggagcgtttaataatctgttcaacttgaggtcactgagattgaaagggaacagattgaaactggtcccgttaggggtgttcactgggctctctaacttgactaagctggatatttcggagaacaaaattgtcattctgctggactatatgtttcaagatctgcataacctcaaatcactcgaagtcggagacaatgatctggtttatattagccatagagcattcagcggacttctctctctggagcagttgaccctggagaagtgcaacctcaccgctgtacccaccgaagcattatcccacctccgctctctaatatcactccatctcaagcatctcaacattaataatatgcctgtttacgcatttaaacggctatttcatctgaagcaccttgagatcgactattggccactgctagatatgatgcctgcgaactcgttgtatggactcaatctgacttcattgtctgtgacgaacactaacctgtccactgtgcctttccttgcgttcaagcacttggtgtaccttacccatttaaatctgtcatataaccccattagcaccatcgaagccggaatgttctctgaccttattcgcctacaggaactccatattgtgggcgcccagctacgcaccatcgaacctcacagcttccagggtctgagatttctgagagttctgaacgtcagccagaacttactggaaaccctcgaagaaaacgtatttagcagccccagagcactcgaagtgctgtcaatcaataacaatccccttgcatgtgattgtagactgctatggattctccagcgccagccgaccttacagttcggaggtcaacagccaatgtgcgccgggccagacacaatccgggagcgttcgtttaaagactttcactctacggctctgtccttttattttacctgcaaaaagccaaagataagggagaagaaattacagcatctcctcgtagatgaaggccagactgtgcaattggagtgtagtgcggacggagatcctcaacccgtgatttcttgggtgactcccaggagaagatttattactaccaaaagcaatgggagggccaccgttctgggggatggcactctcgagatccgtttcgcgcaggatcaagacagcggcatgtatgtttgcatagcaagcaacgccgcaggcaatgacacatttactgcttcccttacagtaaaaggcttcgcttcagatcgctttctgtatgccaatcgcaccccgatgtatatgactgactcaaatgacacaattagcaacggcacgaatgcaaacaccttctccctggacttgaaaacgattcttgtaagcactgccatggggtgtttcacctttttgggcgtggttctgttctgtttccttctcctgttcgtctggtcgcgcgggaagggcaagcacaaaaattctattgatctagagtacgtcccacgcaaaaacaacggagcagtagtcgagggcgaggtggccggtccacgaagatttaacatgaaaatgatctag

SEQ ID NO: 122087 - DNA, 1779 bp, Artificial Sequence
  Description of Artificial Sequence: Synthetic coding sequence
atgacctgctggctgtgcgtgttatcactccctctgctgttgctgcccgcagctccccctccagccggcggatgccctgcccggtgcgaatgtaccgtccagacccgggctgtcgcctgcacccgccgccgtctgacagctgtgccggatgggatacccgccgaaactagactgctcgagctcagtcgcaaccgcattaggtgcttgaatcccggggaccttgcagcactccctgccctcgaggaattagacttatcggagaacgcgatagcgcacgtggagcctggtgctttcgctaatcttccacggctgcgtgtcttgcgcctccggggtaaccaactcaagctcatcccccctggggtctttactaggctggacaacctaactcttcttgatctgtcggagaacaagcttgtgattctcctggattatactttccaggaccttcactccctccgcagacttgaagttggcgacaacgatctcgtgtttgtttcccgaagggctttcgcaggccttctggcactggaagaactgactttagaacgttgtaacctgactgcgctttctggagagtccctgggtcacctccgcagtctcggtgccctgcggcttagacatctggctatcgctagcctcgaagatcagaactttaggagactgcccgggctgttgcacctggagatcgataattggccacttttagaggaggttgcagcaggaagtttgagaggccttaatctgacatccttatcagtaacacacacaaacatcactgctgttccagcggccgctttgcgtcaccaggcccacctcacttgcctgaacttatcacacaaccccatcagtactgttccccggggatccttcagagatctggtgcgcctgcgggaattacacttggccggagccctgctggcggtcgttgagccacaggcgtttctcgggctgaggcagattcgacttctcaacctcagcaacaacctattatctaccctagaagaaagcacctttcactcagtaaatacgctggagaccctacgcgtggacggaaatcctctcgcctgcgactgtaggttgttatggattgtacagcgccggaagaccctcaactttgacggacgcttgccagcatgtgctacacccgctgaagtcaggggtgacgcacttaggaatcttcctgactccgtcttgtttgaatatttcgtgtgtagaaagccgaaaatacgtgagaggcgcctgcagcgtgtgacagctaccgctggagaagacgtccggtttctgtgcagggccgaaggggagccagctcctaccgttgcctgggttacaccccagcatagaccagtcactgccacatctgccggcagggcacgggtgttacctggaggaacattggagatccaggacgctaggccgcaggattctggcacatatacatgtgtggcatccaatgctggggggaatgacacctattttgcgactctgaccgttcgaccagagcctgccgcaaaccgaacccctggtgaagcacataatgagacactggccgcactgcgcgcgcctctcgatttaacaacaatcttggtgtccacagccatgggatgtattactttcttgggagtggtacttttttgctttgtgctcctgttcgtctggtcccggggaagaggacagcataagaacaacttttcagttgagtatagtttccggaaagtggatgggccggcggccgctgccggacaaggaggcgctaggaagttcaatatgaagatgatatag

SEQ ID NO: 122088 - DNA, 2172 bp, Artificial Sequence
  Description of Artificial Sequence: Synthetic coding sequence
atgcctcttttttttcgcaaaagaaagccctctgaagaggcccgcaagcgcctagagtaccagatgtgtctggctaaggaagccggtgcagatgacatcctcgacatctctaaatgtgaactgtccgagataccgtttggtgcctttgccacatgcaaagttttgcaaaaaaaagtactgattgtccataccaatcacctcacgtcactgctcccaaagagttgcagcttactctctctggctaccatcaaagtcctggaccttcacgacaatcaactaacggccctgcccgatgacctggggcagctgaccgcccttcaggttctgaatgtggaacgaaaccagctgatgcagctgcctagaagtatcgggaatctgacacaactgcagacgttaaacgtcaaggacaataagttgaaggagctgcctgatacagtcggagagcttcgatccctaagaacgctgaacattagcggtaatgaaatccagcgtctgccacagatgctggctcacgttagaacccttgagatgctctcccttgatgcttccgcgatggtgtatccgcctagggaggtatgtggggctggaactgccgctattctgcagttcctttgtaaggaatcagggctcgaatactatccaccctctcagtatctgctgccaatcttggagcaggatggcatcgagaattccagagattccccggatggacccactgacagattctctcgcgaggagctggagtggcagaatcggtttagcgactacgaaaaacggaaggaacaaaaaatgctggagaaactggagtttgagagacggcttgagctaggccagcgagaacacacccagctgctgcagcaatcaagcagtcaaaaagacgagattcttcaaaccgtgaaagaagagcagagccggttggaacagggtctaagcgagcaccagaggcatctcaacgccgagcggcagagactgcaggagcagctgaagcagactgagcagaacattagcagtcggatccagaagctcctgcaggataatcaaagacagaagaagagctccgagattctcaaatctctagaaaatgaaaggataagaatggaacagctcatgagcatcacacaggaggaaaccgagtcccttaggagacgggacgtggcctccgcaatgcagcagatgctgactgagagttgtaaaaatcgcctgatccagatggcttatgaaagccagagacagaatcttgtgcaacaggcgtgctcatcgatggccgagatggatgagcgatttcagcagattctcagctggcaacaaatggatcagaataaggctataagccagattttacaggagagcgccatgcagaaggcagcattcgaggctctacaagtgaagaaggatcttatgcatagacagattaggtctcagattaaactaatagaaaccgaacttcttcagcttactcagctcgaactgaagaggaagtcattggacactgaaagcttacaggaaatgatcagtgagcagagatgggccctgtccagtcttctgcaacagttgctgaaggagaagcagcagagagaagaggagttacgcgaaattcttactgagctggaggccaagtcagaaacacgacaggaaaattattggctgattcaatatcaaaggctgctcaaccagaaacctctgagtctgaagctccaagaggagggcatggagcgtcagctcgtggccctactcgaggagctatccgctgaacactacctgcctatcttcgcgcaccacagactgagtcttgacctcctttcacagatgtcaccaggagacttagcaaaagtgggggtatccgaagccgggctgcagcacgagatcctaagacgagtccaagaattacttgacgccgcccgcatccagccagagcttaaaccccccatgggggaagttgtaacgcccactgcgccccaggagccccccgaaagtgtgcgaccttccgccccgccggccgagctggaggtccaggcgagtgaatgtgtagtttgcctcgaacgggaagctcagatgatctttttgaactgtggccatgtctgttgttgtcagcaatgttgtcaacctctgcgtacgtgtccactttgccgccaggacattgcccagcgactgagaatctaccacagttcttag

SEQ ID NO: 122089 - DNA, 2172 bp, Artificial Sequence
  Description of Artificial Sequence: Synthetic coding sequence
atgcccctgtttttccgaaagagaaaaccatctgaagaggcccgaaagagactggagtaccagatgtgcctggcaaaggaggccggcgccgacgatattttagatatatctaagtgtgagttgtccgagatcccgttcggtgccttcgccacctgtaaggtgcttcagaagaaagtcctgattgtgcacacgaaccacctgactagcctgctgcccaagagctgttccctgctgagtctagcgacgatcaaggttctggacctccatgataaccagctgacagctctgcccgatgatttaggacagctcactgccctgcaggtgttgaatgtggagcgcaatcaactgatgcagctgcctagatccatcgggaacctgactcaactgcagaccttgaatgtgaaagacaacaagctcaaagagttgcccgatactgtcggtgaattacgctctttacggactctgaacatttctggaaacgaaatccagaggctgcctcagatgctggctcatgttcgcaccctagaaatgctaagtctcgacgcgagtgcaatggtgtatccaccacgtgaagtctgcggagctggtaccgctgccatattgcagttcctatgcaaggaatcaggcctcgaatactacccccccagccaatatctgctccctatccttgaacaggacgggattgagaactccagagattctcccgacggcccaactgaccgcttttctcgggaggagctagagtggcagaataggttctctgactacgaaaaaagaaaggaacaaaagatgttggagaaactagagttcgaaaggcgcctcgaactgggacagcgggaacacacacagctgctgcagcagtcaagttctcaaaaggacgaaattctccaaactgttaaagaggaacagtcgaggttagaacaggggctgtctgagcatcaacggcatcttaatgccgagcgccagcggcttcaagaacaactgaagcaaaccgagcagaatatatccagtcggatccagaagttgctgcaggataatcagagacagaagaaatccagcgagattctgaaatcccttgagaatgagcggattcgcatggagcaattaatgagcatcacccaggaggagacagaaagccttcgtagacgcgacgtggcctctgccatgcagcaaatgctgacagagtcttgtaagaatcgcctcatccagatggcctatgaatctcagcggcagaatctcgtacagcaagcgtgctcctcgatggcagaaatggatgagcgctttcagcagatcttgtcatggcaacagatggaccagaataaagccatctcccagatcctccaggaaagcgccatgcaaaaagccgcattcgaagcactgcaggtgaagaaggatcttatgcacagacagatccgctcccagatcaaactgatagagaccgaactcctgcaactgacacaacttgagttgaagcggaaatcccttgataccgaatccctccaggagatgatttccgaacagagatgggccctctcttcgcttctacagcaactcttaaaagagaagcaacagcgcgaagaggagcttagagagattttaacagagctggaggccaaatcagaaactcgccaagagaactactggctgattcaataccagagattgctaaatcaaaagccactctcactaaaactccaagaagaaggtatggagcggcaattagtggctttgctagaagagctttccgctgagcactacctgcctatatttgcccaccacagactaagccttgacttgctatcacagatgagccctggggacctggctaaagtcggagttagcgaagccggcctccagcatgagatccttcgcagagtccaggagctgttggacgccgccaggatccaaccggagttgaagccaccaatgggcgaagtcgtaacaccgacggcaccacaggagcctccagagtctgtaagacccagtgcgccccctgcagaactggaggtgcaagcctctgagtgtgtcgtctgcctcgaaagggaagctcaaatgatttttctgaactgtgggcatgtttgttgttgtcagcagtgttgccagccgctccgcacttgtccactgtgccgccaggacatcgcacagagattgcgtatatatcacagtagttag

SEQ ID NO: 122090 - DNA, 2172 bp, Artificial Sequence
  Description of Artificial Sequence: Synthetic coding sequence
atgcccttgttcttccggaagagaaaacctagcgaggaggcccgcaagcggttggagtatcagatgtgtctcgcaaaggaggccggtgctgacgatatcttggacataagtaagtgcgagttatcagaaattccttttggagctttcgctacctgtaaggttctgcaaaaaaaggtcctcatcgtccacaccaatcatttgacaagtctgttgcccaagtcctgctcactgctttccctggccaccatcaaagttctggatctgcacgacaaccagttaacagcccttccagatgaccttggacagcttacagcactacaggtgttaaatgtagagcgtaatcagttgatgcagctgccacggtccattgggaacctgactcaactgcagacacttaatgtcaaggataacaaactaaaagaattgcctgataccgtcggggaactgaggagtcttcgtacattgaatatcagcggaaacgagattcaacgactcccacaaatgctcgcccatgtgaggacgctggagatgctgtctctggatgcatccgctatggtctacccacctcgagaggtgtgcggggcgggcaccgccgccattcttcagtttctttgcaaagagtccggactcgagtactaccctccttctcagtatttgctaccaatactagaacaagatggtatcgaaaacagcagagactcccccgacggacctacagatcgtttctcccgggaagagctggaatggcagaaccggttctcggactatgaaaagcgcaaagagcagaagatgttagaaaaactggaatttgaacggagactggagcttggacagcgggagcatactcaactgctgcagcagtcatctagtcagaaagacgaaattttgcagacagtgaaagaagagcagtctcgcctagaacaaggcttatctgagcaccagagacaccttaacgccgaacggcagcgtctgcaggagcaattaaagcagaccgagcaaaatatttcctctcgcatccaaaaacttctgcaggataaccaacgtcagaaaaaatccagtgaaattctgaagtcccttgaaaacgaaaggatccgcatggaacagctgatgagtatcacgcaggaggagaccgagtcactcagaagacgggacgtggccagcgcaatgcagcaaatgctgacagagtcctgcaaaaatcgcctgatccaaatggcctatgaatcacagagacagaacttagtccagcaggcctgttcctccatggcagaaatggacgaacgattccagcagatcttgagctggcaacaaatggatcagaataaagccatctcccagatcctgcaggagtctgccatgcagaaagccgcctttgaggctctgcaagtaaagaaggacctaatgcaccgacagatacgctcccaaatcaaactgatagagacagagctgttgcagctgacccagctggagctgaagcgcaagagcctggataccgaaagcctgcaggagatgatcagcgagcagcgttgggccctgagctcgttgctccaacagctcctcaaggagaagcagcagcgcgaagaggaactacgcgagatcctgaccgaactggaagccaagagcgaaaccaggcaggagaactattggctaatacagtatcagaggctgcttaatcagaaaccactgtcgctcaagctccaggaagaagggatggagcggcaactcgttgctctgctcgaggaactgagcgccgagcactacctgccaattttcgctcatcaccgactgagtcttgacctgttgagccagatgagtccaggggatctcgcaaaagtgggcgtctccgaagctggattgcagcatgaaatcctgcgccgtgtccaggaactgctggacgccgctcgaattcagccagaactcaaacccccgatgggagaagtggtcacgcctacagcaccgcaggaaccccccgaaagcgtacgcccatcggcacctcctgccgaactggaggtccaggcaagcgaatgtgtggtttgcctggaaagagaggctcaaatgatattcctgaactgtggtcacgtgtgttgctgccaacaatgttgccagcctctccgcacatgccccctttgtagacaggatatagcccagcggcttagaatttatcacagtagctag

SEQ ID NO: 122091 - DNA, 2091 bp, Artificial Sequence
  Description of Artificial Sequence: Synthetic coding sequence
atgcctctgttctttagaaagcggaaacctagtgaagaagccaggaagcggctcgagtaccagatgtgcctcgctaaggaggccggcgctgatgatatactggatatcagcaagtgcgagctgtcagagatccccttcggagctttcgcaacttgtaaagtgttacagaaaaaggtgcttattgttcacacaaaccacctaacgtcacttttgccaaagtcatgttcccttctttctctcgcgactataaaggtcctggacctgcacgacaaccagctaacagccctccctgatgatctggggcaactcactgcccttcaagtgctcaatgttgaacggaatcagttgatgcagctcccgcgaagcataggtaacctcacccaactccagacccttaatgtaaaggataacaaattgaaggaactgcccgacacggtcggtgaactgaggtctcttcgcaccttgaatatcagcgggaacgagatacagcgactcccacaaatgctcgcccatgtgagaaccttggaaatgctgagtttggatgctagcgccatggtttaccctcctagggaggtgtgcggtgccggaacagctgcaattctacagtttctgtgcaaggaatctggccttgagtactaccctcctagccagtacctccttccaattctggagcaggatggaatcgaaaatagccgcgacagccccgatgggccaacagaccgattttccagagaggagctggaatggcagaatagattctcagactatgagaaaaggaaagaacaaaagatgttggagaaactggagtttgaaagaaggctggaactgggccaaagagagcacacacagctgttgcaacagtctagcagccaaaaagacgaaattctccagacagttaaagaagaacagagtcggctagagcaaggtctttcagaacatcagcgccacctcaatgctgaacggcaacgacttcaggagcagttgaagcaaacggaacaaaacattagctcaaggatacagaagcttctgcaggataatcagagacagaaaaagtccagcgaaatcctcaagtcattggagaacgaacggattcggatggagcagttgatgagtatcacgcaagaagagacagaatcccttaggagaagggacgtggcctcagcaatgcagcaaatgctgacagagtcatgcaagaatcgccttatacagatggcgtacgaatcacaacgccagaatctggtgcaacaggcctgttcctctatggcagagatggacgagagatttcagcagattctgtcttggcagcagatggatcagaacaaggccatttctcagatccttcaggaaagcgccatgcaaaaagctgcttttgaggccctccaagtaaagaaagacctaatgcacaggcaaattaggtctcaggagatgatatcggagcaaaggtgggccctgtcttctctgctgcaacagcttctgaaggagaaacagcagagagaggaggagctgcgcgagattctgactgagctggaagcgaaaagcgagactagacaagagaattattggctaatccagtaccaacgcttgctgaatcaaaagccactcagcctgaaacttcaggaggaggggatggagcgtcagctggttgccctcctagaggagctctctgctgagcattatctgccgatatttgcccaccaccggctgtctctggacctgctgtcacagatgtcacccggggacctggctaaagtaggggtgtcagaggctgggttacaacacgaaatcctcagacgcgtgcaggagcttctcgacgcggcccgaatccaacccgagttaaaacccccgatgggtgaggtagttacgccgaccgcccctcaagagcctcctgagtctgtgcggccaagcgccccacccgcagaactggaggtacaggcatctgagtgtgtggtctgtttagaaagggaggctcaaatgatttttctgaactgcggccacgtttgttgttgtcagcagtgctgccagcctctgagaacctgcccattgtgcagacaggacattgcccagcggttgcggatctaccacagcagctag

SEQ ID NO: 122092 - DNA, 465 bp, Artificial Sequence
  Description of Artificial Sequence: Synthetic coding sequence
atgttccattgtattccactgtggaggtgcaatagacacgtggaatcaattgataagcgccactgctccctggtttatgttcctgaggagatttacaggtatgcacgctctctcgaggagctgctgcttgatgcaaatcagctgagggaattgcctgaacagtttttccagctggtgaaactgagaaagctgggattaagcgacaatgagattcagaggctcccacccgagattgccaattttatgcagttggtggaactggacgttagccgcaacgaaatacccgaaatccccgagagtatttcattctgcaaagctttacaagtggcagatttctccggaaaccctctcactcgactgcctgagagttttccagaacttcagaatttgacgtgtctgagtgtgaacgacatcagcctacaatccttacccgaaaatattggcaaacagaagaccacttcttag

SEQ ID NO: 122093 - DNA, 1575 bp, Artificial Sequence
  Description of Artificial Sequence: Synthetic coding sequence
atgttccactgcatccccctttggaggtgtaacagacacgtggagtccatcgacaagaggcattgctccctagtttatgtgcccgaggagatctacaggtacgcccggtcgcttgaggagctcctcctggacgccaaccagctcagagagcttccagaacagttttttcagctagtgaaactgcgaaagcttggcctctccgataatgagattcagcggctgccgcccgagatcgctaattttatgcaattggtcgaactagatgtctcacggaacgaaatccctgaaatccctgaaagcatatctttttgcaaggccctgcaggtagcggatttctcaggtaaccctctgactcgattaccagaatcgtttccagagcttcagaatcttacttgtctctcagtgaatgatatttctctgcagagcctgccagaaaatatcggcaatctttataatctggcgtccctggagctgagagagaacctgctaacctatctaccagatagtctgacacagcttaggaggctcgaggagttggatctgggcaataatgaaatctacaatttacccgagagcatcggagctctactgcacctaaaggatttgtggctggatggaaatcagctttccgagttaccccaggaaattggtaatctgaagaatctgctgtgtctggacgtgtcagaaaatcggctggagaggttgccagaagagatttcaggcctgacatcgctgactgatctggtcatctcccaaaacctcttagaaacaataccggatgggattggtaagctcaaaaagctgtcaatactaaaggtcgatcaaaacaggttaacccagctgcccgaggcagtcggcgaatgcgaatccctcactgaactcgttttgacagagaaccagctattgactctgccgaaatcaatcggaaagcttaaaaaactgtccaacctaaatgcagaccggaataaactagtctcattaccaaaagagattgggggttgctgttcactgaccgtgttttgtgtccgtgacaacaggctgacgcggatcccagccgaagtgtcccaagctaccgaactccatgtcctggacgtggcgggcaaccgattgttgcacctgcccctgtccctgaccgcccttaaactcaaagcactatggctttctgacaatcagagtcagcccctgctgacctttcagacagacacggattacacaaccggggagaagattttaacatgcgttctccttccacaattgcccagtgaaccaacgtgccaggagaatctgccgagatgcggagcattggagaatctagtcaacgatgtgtctgacgaggcctggaatgaacgcgccgttaatcgcgtaagcgccatccgtttcgtggaggacgagaaggacgaggaggataacgagacaagaacactgctaaggagagcaaccccccatcctggcgagctgaaacatatgaagaagacggttgagaaccttagaaatgacatgaatgcagctaagggcctggatagcaataagaacgaagtgaaccacgccatcgaccgcgtgacaaccagtgtgtag

SEQ ID NO: 122094 - DNA, 834 bp, Artificial Sequence
  Description of Artificial Sequence: Synthetic coding sequence
atgggtaacaccattcgagccttggtcgcattcataccagccgaccgatgccaaaattacgtggtgagagatctcagggagatgccccttgacaagatggtcgacctcagcggctctcaactgcggagattccctctgcatgtgtgctcgtttagagagctggtcaaactgtacctgtcagacaatcacctgaacagtctgccccccgaactgggacaattgcaaaatctgcagatcttggctctggactttaataactttaaggccctcccccaggtggtctgcaccttaaagcagctctgtattctgtatctgggaaataataaactctgcgacctaccatctgagctgagtctactgcagaatctacggaccttgtggattgaggccaattgcttgactcagctccccgatgtcgtttgtgagttatccctgctgaagactcttcacgcaggaagcaatgctctgcgactgttgccaggacagctccgaagactccaggagctgagaacaatctggctgagtggaaacagattgaccgacttcccaacagttctattgcacatgccttttttagaagtaatcgacgtcgattggaatagtatccggtacttccccagcctggcccacttaagctctctcaaactggtcatctacgaccacaacccttgtcgaaacgctccgaaagtggcaaagggcgtgcggcgcgtaggcagatgggcggaggagacccccgagccagatccacgcaaagccaggcggtacgctctcgttagagaagagtcacaggagctccaggcccctgttcctctgctgcccccgactaactcttag

SEQ ID NO: 122095 - DNA, 4116 bp, Artificial Sequence
  Description of Artificial Sequence: Synthetic coding sequence
atgaccgaggagagtagtgacgtgccccgggaactcatcgaatcaatcaaggatgtgattgggcgcaaaataaagatctcagttaagaagaaggttaaactggaggtgaagggagataaggtcgagaataaggtcctggtcctgacttcctgtcgcgcctttctagtgactgccaggatcccaacgaagctcgagttgacttttagttatttggaaatccacggagtggtctgtagtaagtccgcacagatgatcgtcgagaccgaaaagtgttctatatctatgaaaatggctagccctgaggatgtgtccgaagttttggcacacatcggaacctgcctcagaaagattttccccggtctatctcccgtgaggattatgaaaaaagtgtctatggaacccagcgagaggctagcctccctgcaggccctgtgggacagccaaacagtagccgagcaggggccatgtggtgggtttagccagatgtacgcctgtgtttgcgattggctcggttttagctaccgggaagaggttcagtgggatgtggacaccatctacctcacacaagacacccgagagctcaacttgcaagatttctcccatttggatcaccgcgatctgatccccatcattgctgcactggagtacaaccagtggtttaccaagctgtcaagcaaagatctgaaactgagcaccgatgtttgtgagcaaatactgcgcgtggttagcagaagtaatcggctcgaagagctagtcctcgagaatgccggcttgcgaactgatttcgcccaaaagctcgcgtcagcattagcgcacaatcccaacagcgggctccatacaataaacctggccggaaacccattagaggatcggggcgtgtcatcactgtccatacaatttgccaaactcccaaagggcctgaagcatcttaatctgagcaagacatctctctccccaaagggcgtgaatagtctgtctcaatctctctcggcaaatccactgactgctagcacccttgttcatctggacctgtcgggcaatgtcttgagaggagatgatctttcacacatgtataacttcttggcacagcctaatgcaattgttcatctcgacctatccaatacagagtgctccctcgacatggtgtgcggagcactcctcagaggctgtctgcagtacctggctgtgctcaacttgagcaggaccgtcttttctcaccgcaaaggcaaggaggtccccccatcctttaagcagtttttcagctcctcactggcacttatgcacattaacctgagtggcacaaaacttagtccagagccacttaaggcgctactgctgggactcgcctgcaaccacaacttgaaaggtgtgtcactggatctctcaaactgcgaactacgttctgggggtgcccaggtcttagagggatgcattgcagagatccacaatataaccagccttgatatcagtgacaatgggctggagagcgatctttcaacactgatcgtctggctgagtaagaatcggtcgatccagcatctggctctcggaaaaaatttcaacaatatgaaaagtaagaacctgacccctgttctggacaacctggtacaaatgattcaggacgaggagtcccctctgcagtctctttctttggctgatagtaaattaaagacagaagtgaccatcatcatcaacgccctgggctccaacacttccctgactaaggttgatatctctggcaacggaatgggggatatgggcgccaaaatgctggcaaaggctctccagatcaatactaagcttaggactgtgatttgggataagaacaacatcacagcccaggggttccaggatatcgctgtcgcaatggagaaaaattacaccctgaggtttatgccaattcccatgtatgatgcaagccaagccttgaagaccaatcccgaaaagactgaggatgctctgcagaagatcgagaattatctgttgcgaaaccatgagactcgcaaatacctgcaggagcaggcctacaggcttcagcagggcattgtgacttccacaactcagcagatgatcgacagaatctgtgttaaagtgcaagatcacctcaatagtcttcggaattgcggcggcgatgcaatccaggaggatctaaagtcagcagagcggctgatgcgggatgctaaaaactctaagactctcctgcccaacctctaccacgtcggtggggcctcttgggccggcgccagtggtctgctgtccagcccaatccaggagaccttggaatctatggcgggtgaggtaacaagagtcgttgacgaacaactcaaggctctgttggagtctatggttgacgcagctgaaaatctttgccctaacgtgatgaagaaggctcacattcggcaggacctgatacatgcaagtaccgagaaaatctccattcctcgtaccttcgtcaaaaatgttcttctggagcagtccggcatcgacattcttaacaagatatctgaagtcaaacttactgttgcgtcttttctgtccgaccggatcgtggacgagatcctcgatgctctctctcattgccatcataaactggctgaccacttctcccggcgcggaaaaacactcccacagcaagagagtctggagatagagctggctgaggaaaagcccgtgaagaggtctattatcacagtagaggaactgaccgagatcgaacgtctggaagatctggacacatgcatgatgacgccgaaatccaagcgcaagagcatccatagcaggatgctgaggcctgtgtcaagagccttcgagatggaattcgatttagacaaagccctagaagaagtacctatccatattgaagacccaccctttccctctttgcggcaggaaaagagatccagcggtttcatctctgagctccccagcgaggaaggtaaaaagttggagcacttcacaaagttgagaccgaagcggaacaagaagcaacagcccacccaggcagcggtgtgtgctgcgaacatcgtctcacaagacggcgagcagaacgggcttatgggccgggttgacgaaggagttgatgagttctttactaagaaggtcactaaaatggattctaagaaatggagcacaaggggttccgaatcccatgagcttaatgaaggtggagatgagaaaaagaagcgggattcaaggaaatcaagcggatttctgaacctcatcaagagcagaagcaagtcggagaggccgccaactattcttatgactgaagagccatcttcacccaagggcgcagtaaggtcgcctcctgtcgattgtccaaggaaagatactaaggcagccgagcacaatgggaactcagagcggatcgaggagattaaaacaccggattctttcgaagagtctcagggggaagaaatcggcaaagtcgagcgcagtgacagtaagagctctcctcaggcgggccgccgatacggggtccaagtgatgggcagcggtcttttagcggaaatgaaggccaagcaggaaaaacgcgccgcgtgtgcacagaaaaaactcggcaacgacgcagtgagccaggatagttccagtcccgcattatctggagtcgaacgaagcgacgggggtggcgcagtgccaaaactgcacccagggctgccagagaatagatttggtctcggaacaccagagaagaacaccaaagcggagccaaaggcagaagctggatcacggtcaaggagtagctccagcaccccaaccagtcctaagccactattgcaaagccccaaaccctcgttggctgcccgaccagtaatccctcaaaagccacggactgcgagcagacccgatgatatcccagactctccgtcatcgcccaaagtcgccctgctgcctcccgtgctgaagaaagtgccatctgacaaggaaagagatgggcaatccagcccccagccttcccccagaaccttcagccaggaagtgagccggcgcagctgggggcagcaggctcaggaataccaagaacaaaaacaacgtagctcatccaaagacggacaccagggcagcaagtccaacgattctggggaggaggcagaaaaagagttcatttttgtatag

SEQ ID NO: 122096 - DNA, 531 bp, Artificial Sequence
  Description of Artificial Sequence: Synthetic coding sequence
atgtatgcatgcgtgtgtgattggcttggtttctcctacagggaagaggtccagtgggacgttgataccatttatctcacacaggataccagggagctgaacctgcaggatttcagtcacctggaccaccgagatttgatacctattatcgctgccttagaatataaccaatggttcacaaaattatcgtctaaagacctcaagctgtccacagatgtgtgtgagcagattctcagggtggtttcacgatctaatcggttagaagaattagttctggagaacgctggcctcagaaccgattttgctcagaaactggcctccgcccttgctcataacccaaattcaggattacacacaatcaatctggctggcaaccccctggaagaccgtgaaacaactacaaagataaaacggcaaaacgtgcctaccgtcttgcagacttatttggttgtctgtccctccgattaccaaccctgcccactccctctcggcaaggacaattactatagcgacttctctcatgatggctag

SEQ ID NO: 122097 - DNA, 3981 bp, Artificial Sequence
  Description of Artificial Sequence: Synthetic coding sequence
atgaccgaagagagttctgatgtgccaagggaactgatcgagtcgatcaaagatgttattgggcgcaagataaagatttccgtcaagaaaaaagtgaaattggaggtcaaaggtgataaggttgaaaataaggtcctcgtcctgacttcctgcagagccttccttgttactgcacgaatcccaacaaagttagaactcaccttttcctacctggaaattcatggggttgtctgctcaaagtctgctcaaatgatcgtggaaaccgaaaagtgcagcatttccatgaaaatggcctctcccgaggatgtaagcgaggtgctggcgcatatcggcacttgcctgagaaagatcttcccgggtctgtcaccagtacgcattatgaagaaagtgtcaatggaaccgagcgagcgtctcgcatctctacaggccctgtgggattcccaaacagtggcagaacagggaccttgtggcggttttagccagatgtacgcttgtgtatgtgactggttgggcttcagctaccgagaggaggtccagtgggatgttgacaccatctatttgacccaggacaccagagaattgaacctgcaggatttttcgcaccttgatcaccgggacttgattcctattatcgccgcattagagtataaccaatggttcaccaagctgtctagcaaggacctgaaattgagcactgatgtctgcgaacagatactccgtgtggtgtctagatcaaatcggctcgaggagctggttctcgagaacgcgggcctgcggaccgatttcgcgcagaaattggcgagtgccctcgcgcacaatcctaattccggccttcatacaataaatcttgctggcaatcctcttgaggatcggggagtgtcttctttgtccattcagttcgctaagcttcctaaagggttaaaacacctcaatctcagcaaaacttcactgagccccaaaggggtgaacagtctctcacaatccttgagcgctaatcctctgaccgctagcaccttggtgcatctcgacctcagtggaaatgtcctgaggggcgacgacctgagccacatgtacaactttttggcacagccgaatgctatcgtgcacttggatttatcaaacactgagtgtagcctggacatggtgtgtggagctttactcaggggctgtctgcaatacttagccgtcctcaatctgtctcgaacggttttttcacataggaaggggaaggaggtgcccccttccttcaagcagttcttttcatcatccctcgctttaatgcatatcaatctctctggcaccaaactgtcacctgaaccattaaaagctctgcttctcgggttggcttgtaaccacaatctcaaaggggtgtccctggacctgtccaactgcgagttgcggtcaggaggtgcccaggtattggaagggtgtattgctgagatccataatataacgtccctcgatatcagcgataatggactggaatccgatctgagcacacttattgtatggctgtccaaaaaccgttcaattcagcatcttgcgcttgggaaaaattttaacaatatgaaatcgaaaaatcttacacccgtgctggataacttggttcaaatgatacaagacgaggaatctcctctacagagccttagtctggccgactcgaagctgaagaccgaagtgaccataatcatcaatgcattgggctccaacactagtctgactaaggtggacattagtgggaatggcatgggcgatatgggagccaagatgctagctaaagcactgcagataaacaccaagctcagaaccgtaatttgggataagaacaacattaccgcacagggcttccaggacatcgctgtggcaatggagaaaaattacactctgcgcttcatgcctattccgatgtatgacgcttcgcaggcgctcaaaacaaatcccgaaaagaccgaagatgctttgcagaagatcgagaactatctgctccgtaaccacgagaccaggaaatatttgcaggagcaggcatatcgcttacagcaggggattgtgacttccacaacccaacagatgattgatcggatttgcgtgaaagtgcaggaccatctgaattccctgcgcaactgtgggggtgatgcaattcaagaagatctgaagtccgctgaacgactcatgcgggacgccaagaattctaagaccttacttccaaatctctatcatgtcggcggggcaagctgggccggggcatctggactcctgagttccccaatccaggaaaccctggaatccatggccggggaagtgacgcgcgttgtcgacgaacaattaaaagccctgctggaaagcatggtcgacgccgccgagaatctttgcccgaacgtgatgaaaaaggcacacattcgacaggatctcatccatgcctccacagagaagatctctatccctaggacgttcgtgaaaaacgtacttctggagcagagcggaatagatatactcaacaagattagcgaagtgaaactgaccgtagcatctttcctgtcagaccgaatcgtggatgagatcctggacgccttgtcacactgtcaccataagctggccgaccatttttctagacgcggcaaaaccttgcctcagcaggaaagcctggagatcgaattagctgaagagaaacccgtcaagagaagtattataacagttgaggagttgacagagatagaaagactagaggatctcgacacctgtatgatgactccaaagtctaaaagaaaaagtatacacagcaggatgttgcgtccagtctcaagggcctttgagatggagtttgacctagacaaggctctcgaagaggtcccgatccacattgaagatcctccgttcccgagcttgaggcaggaaaagagatcatccgggtttatttctgaactccctagtgaagagggaaagaaacttgaacatttcaccaagcttcgaccaaaacgaaataagaagcaacagccaacgcaggcagctgtttgcgcggcgaatatcgtcagccaggacggagaacagaatggattaatgggacgggttgacgaaggcgtggatgagttcttcactaagaaggttactaagatggatagtaagaagtggagcacaagggggtccgagagccatgaacttaacgaaggaggggatgaaaagaagaaacgagatagccgtaagtcctccggttttctcaatctgattaaatccaggtcaaaatctgagcggccacccacaatcctgatgacagaggaaccatccagtcctaagggcgcagttaggtccccccctgtggattgtcctcgtaaggatactaaagccgctgagcataatggaaacagcgaacgaatagaggaaatcaagacacccgacagttttgaagagtcccagggcgaggagataggaaaagtagaaagaagtgactctaagtccagcccccaggccggccggcgttacggtgtccaggttatgggttccggcctgctagcggagatgaaggcgaaacaagagaaccgatttggacttggaactccagaaaagaatacaaaggccgagccaaaggcggaggccgggagccgctcacgatcaagttcaagtactcccactagccccaagccgctcctgcaaagccctaaaccaagcctggccgctcggccggtgatcccacaaaagcctcgtaccgcctctcgcccggacgatatacccgattccccctcatctccaaaggttgcactcctgccgccagtgctaaaaaaggtgccatcggataaagagcgcgacgggcagtctagcccacagccttctcccagaacgttctcccaagaagtctcccgaaggtcatggggccagcaggcccaggaatatcaggaacagaaacagagatcctcctccaaagatgggcatcaggggtccaagagcaacgattcgggtgaagaggcagagaaggaatttatattcgtctag

SEQ ID NO: 122098 - DNA, 1116 bp, Artificial Sequence
  Description of Artificial Sequence: Synthetic coding sequence
atgggccacaaagttgtggtctttgacatttcagtgatacgtgccctgtgggaaacacgcgtaaagaagcataaggcttggcagaagaaggaggttgagcgtttggaaaaaagcgccctcgaaaagatcaaggaagaatggaatttcgtggctgaatgtagacgaaagggaattccccaggccgtgtattgcaaaaacggcttcattgacaccagtgtgcggctgctcgataagattgaacggaatactttgactagacagtcttcactgccaaaagatcgcggtaagcgatccagcgcatttgtgttcgaactgtccggggaacattggaccgaactaccggactctttgaaggaacagacccacttgcgagagtggtacatatctaatactctcatccaaataatccctacatatatacagctgtttcaggctatgcggatattggacctgccaaaaaaccagatctcccatctgcctgcggagataggatgcctgaagaacctcaaggagttgaacgtggggtttaactatctcaaaagcatcccccccgagctcggtgattgtgaaaacctggagcgcctggattgcagcggtaacctcgagctcatggagcttcccttcgagctctccaatttgaagcaggtcacgtttgtcgatataagtgcaaacaaattctcctccgtgcctatctgtgtcctcagaatgtctaacctgcagtggctggacatttcctccaataatctgaccgacctgccacaggatatagacaggctggaggaattacagtcattcctcctgtataagaacaagctcacctatctgccctactctatgctgaatctaaagaagctcaccctgttagtcgtgagcggggaccatctggttgaactcccgaccgctttgtgcgattcatctactccactgaaattcgtgtccctgatggacaatcccattgacaacgcacagtgtgaagatggcaatgaaattatggaatcggagcgcgacagacaacattttgataaggaggttatgaaagcctatatcgaggacctgaaggagcgcgagtctgtcccctcttacactacaaaggtctcgttctctttgcagctgtag

SEQ ID NO: 122099 - DNA, 1116 bp, Artificial Sequence
  Description of Artificial Sequence: Synthetic coding sequence
atgggtcataaagtggtcgtattcgatatctccgtgataagagctctgtgggaaacaagggtgaagaaacacaaagcctggcagaagaaggaagtggaacggttagagaagtcagctctggaaaaaatcaaagaagaatggaactttgtcgcagaatgccgtcgcaaaggcattccccaggcagtgtactgtaaaaatggcttcatagatacatccgtacgattacttgacaagatcgagcggaatacgctcactagacagtcttccctccctaaggaccggggcaaaagatcctctgcgttcgtgtttgagttgagcggcgagcattggacagagctccccgactcactgaaggaacagactcacctgcgtgagtggtacatctcaaacactctcatccaaatcatcccaacttatatacagctgtttcaggcaatgaggatcctggacctgccaaaaaaccagattagtcatctgccagcggagattggatgcctaaaaaatctgaaagagctcaatgtgggattcaattacctgaagagcatccctccagaactgggggactgcgagaatttggagcggcttgactgctctggcaatctggaattaatggagctgcctttcgagctatcgaacttaaagcaagtgacttttgtcgatatctcggccaacaagttttccagcgtgccaatatgtgtgctccggatgtctaatctccagtggctcgacatctcaagcaacaatctgaccgatctaccacaagatatcgaccgcttagaggaactgcagtccttcctgctctacaaaaacaaactcacctacctgccttactcaatgctgaaccttaaaaagttaaccctactcgtggtttctggtgaccaccttgtggagctgcctacagcattgtgtgactcctccactccccttaagtttgtgagcctgatggacaacccaattgacaatgctcagtgcgaggacggcaacgagatcatggagtctgaacgtgatcgacaacactttgataaagaggttatgaaagcgtatatagaggacctcaaggaaagagaaagcgtgccttcctatactaccaaggtgagcttctccctgcagctctag

SEQ ID NO: 122100 - DNA, 918 bp, Artificial Sequence
  Description of Artificial Sequence: Synthetic coding sequence
atgggtggaacgctcgcatggaccctgcttctgccactgttgctcagggaaagcgactctctggagccaagttgtaccgtgtcttctgctgacgttgattggaacgctgagttttcggccacctgccttaattttagtgggctatctctgagcctccctcacaatcagtctcttagggcatcgaatgtgattctgctggatctaagcggcaatggattaagagaactgcctgtgacattctttgctcaccttcagaagctggaagtcttaaatgtgctgcggaatcctctgagccgcgtggatggtgccctggctgctcggtgcgatctcgacctgcaggccgactgcaattgcgcattagagtcatggcacgatattagaagagacaattgcagcggacagaagcccctcctgtgttgggacacaacttcctcccagcacaacctgagcgccttccttgaggtgtcctgtgcgccaggtctagcgagcgccaccatcggcgccgtcgtggtgagtggctgtctgctgctgggactggcaatcgctggccctgttctggcttggcgtctctggagatgtagagtcgcccgctcacgcgaactgaacaaaccttgggccgcccaagacggccccaaacccgggctgggtctgcagcccagatacgggtccagaagtgctccaaaaccccaggttgccgtgcctagttgtcctagtacaccggactatgagaacatgttcgtggggcagcccgcggctgaacaccagtgggacgagcaaggagctcatccatctgaagataatgatttttacatcaattacaaagatattgacctcgcctctcagccagtgtactgcaatctgcaatctctgggccaagcaccaatggatgaggaagagtacgttattccaggccactag

SEQ ID NO: 122101 - DNA, 1005 bp, Artificial Sequence
  Description of Artificial Sequence: Synthetic coding sequence
atgagaggacctagctggagcagaccacgccctcttctgctcttacttcttctcctgtcaccttggcccgtatgggctcaggtctctgcgactgcatcaccttccggttccctgggcgcccccgactgtcccgaggtgtgtacgtgtgtgccgggcggtcttgcctcctgctcagcactgtcgctgcctgccgtgccccccggcctctctcttcgtttgcgagccctgctgctggaccacaacagagtcagggccttaccaccgggcgcctttgcaggtgctggggccctccagcgactggacttgagagaaaatgggctgcatagtgtgcatgttcgcgcattttgggggctcggcgctttacagctcctggatctctcggctaaccagctagaagccctagcccccggaaccttcgcacctcttcgggccttaagaaacctgtcacttgcaggaaacaggttagctcggctagagcctgcagcacttggggcacttcctttactccgttcactaagcctgcaggataatgaattagcggccctggcgcctggactacttgggcggctgcctgccttggacgctctgcatctgagagggaacccatggggctgtggctgcgccttgcgtcccctttgtgcttggttaaggcgacatccgttacctgccagcgaagcggagacagttctgtgcgtctggcctgggaggcttactctctctcccctgaccgctttctctgacgccgccttcagtcattgtgcccaacctctggcgctgcgagatctggccgttgtgtacacactggggccagcctcattcctggtctcactcgcatcctgtctcgcccttggaagcgggctaaccgcctgtcgggcacgcagaaggcgcctgcggacagcagccttgaggccaccaagaccgccagatcctaatccagaccctgatccccatggatgtgcgtcccctgccgacccaggttctcctgcagcagcagcacaagcttag

SEQ ID NO: 122102 - DNA, 1923 bp, Artificial Sequence
  Description of Artificial Sequence: Synthetic coding sequence
atgctgaacaagatgacacttcaccctcagcaaattatgattggaccacggttcaatagagctctcttcgatccccttttagtggttctgctggcgctgcagttgctagtcgtggcgggcttggttcgggcacagacctgtcctagtgtctgttcttgcagcaatcagttctctaaggtgatctgtgtgcgaaagaaccttagggaagtcccagacggaatttccactaatacacgtcttctgaatttgcacgagaatcaaatccagataatcaaagtgaactcttttaagcacctcaggcacctggagatactccagctcagcagaaatcacatcagaaccatagagataggcgcttttaacgggctggccaatctcaacaccctcgagttgtttgacaaccgcctcacaaccattcctaacggggcattcgtttacctctccaagctgaaagagctatggttgcggaacaatccaatcgaatctataccatcctatgcgttcaaccgcattccatctctccggcgactcgaccttggcgagctaaaacgactatcctacatttctgaaggcgccttcgaggggctgtcgaacttgcggtacttgaatcttgcaatgtgcaatctcagagaaatccccaacttgactcccctcatcaagctggatgaactggatttgtctggcaaccacctgtccgcgatcaggccaggatcattccagggattaatgcacttgcaaaagctctggatgatccagtcacagatccaggtgattgaacgcaacgcttttgataacctgcaatctctcgtcgagattaatttggcacataataatctgacccttttgcctcacgacctgtttactcccttgcaccacctggagcgcatccatctccaccataatccgtggaattgcaactgcgacattctgtggctttcgtggtggattaaagacatggcaccaagtaatactgcttgttgcgcaaggtgcaatacaccacccaatctaaaaggccggtatatcggggagctggaccagaattatttcacttgctacgctcccgtgatcgtcgagcccccagctgatctgaacgtgacggaagggatggctgccgagcttaagtgccgggccagcactagtctgacaagcgtgtcctggatcaccccaaatggcactgttatgacccatggcgcctacaaagttcggatcgcagttctgagtgatggaacactgaacttcacaaacgtaacagtccaggataccggtatgtacacttgtatggtttctaactccgtggggaacacaaccgcatcggccactcttaatgttaccgcggcaactactactcctttctcgtattttagcacagtgacagtggagacaatggagccctcacaggacgaggccaggactacagataacaacgtcggtcctacacctgtggtcgactgggagacaaccaacgtgaccacaagcctcacacctcagtccaccaggtcaacagagaagacatttacaatcccagtgaccgatattaacagcggcatacccggaattgacgaggtgatgaaaaccactaaaataattatcgggtgttttgtggcgatcacactaatggccgccgtgatgcttgttatcttctacaagatgaggaaacagcaccaccgccaaaatcaccatgcccccactcgcacagtggagatcattaacgttgacgatgagataaccggggacacacccatggaaagccatctcccaatgccggcaatcgaacacgagcatctcaatcactataattcatacaaatccccatttaaccacaccaccactgttaacacgatcaacagcatccactcctctgttcacgaacccctactgattcgtatgaattccaaggataacgttcaggaaacccagatttag

SEQ ID NO: 122103 - DNA, 1923 bp, Artificial Sequence
  Description of Artificial Sequence: Synthetic coding sequence
atgttgaataagatgacgctgcacccccagcagattatgatagggccgcgctttaaccgagcacttttcgacccattactagtggtgttgttggcactgcagttgctggttgttgccggcctagtgagagcacaaacctgtccttcggtgtgcagctgcagcaatcaattttctaaggtcatctgcgtacgcaaaaacctgcgtgaagtccccgatggtatcagtaccaacactcggctcctcaacttgcatgaaaaccagatccaaatcatcaaggtgaactccttcaagcatctccgtcatctcgagattctccagctgtcgcggaaccacattagaactatcgagataggggcattcaatggacttgcgaatctgaacactctggagctttttgacaaccgactgacaactatacctaatggagccttcgtctatctttcaaaactcaaagagctttggttgcggaacaaccctatcgagtccatacctagctatgcctttaaccgcatcccaagccttcggaggctggatctcggcgaactgaaacgcttgtcctacataagcgagggagcatttgagggtttaagcaacctgcgctatctgaatctagccatgtgcaacctgcgggaaatccccaacctgacaccgctcatcaaactcgatgagctcgatctttctggcaaccacctatctgccatcagacctggtagctttcagggactgatgcatttacagaaactttggatgattcagagtcagattcaggtgatcgagcgcaatgcctttgacaacctccagagcctggtagagatcaatctcgctcacaataacctgacactgttgccccacgacctatttactccactgcaccacctggagagaattcacctgcatcataacccttggaattgcaactgcgatatcctatggctgtcctggtggattaaggatatggcaccatccaatactgcgtgttgtgcccgctgtaacaccccacccaatctcaagggtagatacatcggtgagttagaccaaaattatttcacatgttatgctccggttatcgttgagccacctgcggatctgaacgttacagaggggatggccgcagagctgaaatgtcgcgcttcaacatctttaaccagcgtcagctggatcacgcctaatggtaccgtgatgacccacggtgcgtataaggtacgcatagcagtgctgtcggatggcaccctgaattttacaaacgtgaccgtgcaggataccggtatgtatacttgtatggtctccaattctgtcgggaacacaactgcctctgccacactcaatgtcactgccgccacaactactcccttctcttatttttccacggtgaccgtggaaacgatggaaccctcacaagatgaagcaaggaccacggataataatgtggggccaacacctgtcgtggattgggagacgaccaatgtaaccactagtcttacaccacagagtacacgctcaactgaaaaaaccttcacaattcccgttaccgatatcaatagcgggattccagggatcgacgaggtaatgaagacgacaaagattatcatcggctgtttcgttgccatcactctgatggccgcagtcatgctggttattttctacaaaatgcggaaacagcaccataggcaaaaccatcacgcaccaacaaggaccgtggaaatcatcaacgtggacgacgaaattacaggggatacacctatggagtcacatctccccatgcccgccatcgagcatgaacacctgaatcactataactcatataagtctccatttaatcacactactaccgtgaatactattaattcaattcattcctctgtgcatgagccgctgctgataagaatgaactccaaggacaatgtgcaggaaacccaaatttag

SEQ ID NO: 122104 - DNA, 1923 bp, Artificial Sequence
  Description of Artificial Sequence: Synthetic coding sequence
atgctcaataagatgaccctgcatccccaacaaattatgatcgggccaaggttcaatagagccctcttcgacccacttctggttgttttactcgccctgcagctgctggtggttgccggactggtgcgggctcaaacatgcccgtctgtgtgttcctgctcaaatcaattttccaaagtcatttgtgtccgcaagaatctccgcgaggtcccggatggcattagcactaatactcgcctgcttaacctgcacgagaaccagatccagatcatcaaagtcaattcttttaagcacctgcgacacctggaaatcctgcagctctctcgcaatcatattagaactattgagatcggggcatttaatggcctggctaatttgaacacgttggaactgtttgacaatagattaacaacaatacccaacggcgcctttgtgtatttgagtaagctgaaagaattgtggctccggaacaatcccatcgaatctatcccatcatacgccttcaataggattccttctttgagacggctggatctcggagagctgaagagattgtcgtatatatcagagggcgccttcgaaggcttgtccaacctgcggtacctgaatctggcaatgtgtaacctgcgcgagatccctaacctaactcccctcatcaagctggatgaactggatctgagtgggaaccacctgtctgcaattaggcccggatcttttcagggtttgatgcatctgcaaaagctgtggatgatacagtcccagattcaggtcattgagcggaacgccttcgacaacctgcagtcactggtagagataaacctggcccataacaatttaactctgctgccccacgatctgttcacacccttgcatcacttggaaagaattcacctacaccacaatccatggaattgcaattgtgatatcttatggttgtcttggtggatcaaggatatggccccctccaacacagcttgttgcgcacggtgcaacacacctcctaatcttaagggtcggtatatcggggagctggaccagaattattttacttgctacgctcctgtaatcgtggaacctcctgccgacctaaatgtgaccgaggggatggcagctgagctgaaatgcagagcctctacatcgctgacatccgtaagttggattaccccgaatggtacggtgatgacccatggcgcttataaagtgaggattgcggtcctgagtgatggtacactgaactttacaaatgtgacagtccaggacacaggcatgtatacttgcatggtctccaatagcgtaggcaacacaacggcgagcgccacattgaatgttacagctgctacaacgacacccttttcttatttttccactgtaaccgtcgagactatggaaccatcacaggatgaagccagaacgaccgacaataacgtgggccccaccccggttgtggactgggagacgacaaatgttactacatcactcactccgcagtcaacccggagcacagaaaagacttttacaataccggtaactgacataaattccggcattccaggtatagatgaagtgatgaaaaccacgaaaatcattatcgggtgcttcgttgctattaccctcatggccgctgtgatgttagtcatcttttataagatgcggaagcagcatcacaggcagaatcatcacgccccgacaaggactgtggagataattaatgtcgatgatgagatcacaggagacacaccaatggagagtcacctgcccatgcccgctatcgaacatgagcacctgaatcactacaacagctacaagtctccttttaaccacactacaacagttaacactattaatagtattcattcatcagtgcacgagcctttattgatacggatgaattccaaggacaatgtccaggagactcagatctag

SEQ ID NO: 122105 - DNA, 1923 bp, Artificial Sequence
  Description of Artificial Sequence: Synthetic coding sequence
atgctcaacaaaatgacattgcatccacagcagattatgatcgggcctaggttcaaccgcgctctgttcgaccctctattagttgtgctgcttgcactgcagctgttagtggttgccggtctcgtaagggcacagacatgcccttcagtctgttcttgttccaatcagttttccaaggtcatttgcgtgcgcaaaaacctcagggaagtgccggatggcatttcgacaaacacccgccttctaaatctgcacgagaaccagatccagatcataaaagtaaatagttttaagcaccttaggcacttggaaattctacaactatcacgaaatcacatcaggactatcgagattggagcgtttaacggactagcaaatctaaacacgctggagctctttgacaaccggttaactacaattccaaatggtgcctttgtctacctaagcaagctgaaggaactatggctgcgcaataacccaatcgagtcaatcccttcctatgcctttaaccgtatcccttctctccgtaggttggaccttggcgagcttaagagactaagttatatttcagaaggagcatttgagggactgagcaacctgaggtatctcaatctggccatgtgcaacctgagagagattccaaacctgaccccgctgattaagctggacgaacttgatctgtccggcaatcacctctccgcgattcggccagggtcctttcaaggacttatgcatctccaaaaactatggatgatccagtcccagatccaggtgatcgagagaaatgcattcgacaatttgcagtccttagtcgaaatcaacctcgctcacaacaacctcactcttctgccacacgacttatttactccgcttcaccatctggagagaatccacctgcaccacaacccttggaattgcaactgcgacatcctgtggctgtcttggtggataaaagacatggcccccagcaacactgcatgttgtgcaagatgtaacacccctccgaaccttaagggacgctacattggagagttggatcagaattatttcacttgctatgccccagtgattgtggaaccacccgcggatttaaacgtaaccgaaggaatggctgccgaactgaagtgtcgcgcgagcacatctttaacttctgtgagctggatcacccccaacggcactgtcatgacacacggcgcctataaggtgaggatcgcggtcctgtcagacggaaccctcaacttcacaaatgtgacagtgcaggacacaggcatgtacacgtgcatggtttctaactccgttgggaacaccacagcttcagccacacttaacgttacagctgccacaaccacacctttctcttacttttcaacagtcaccgtggagaccatggagccttcacaggatgaagcccgaacaaccgacaacaacgtcggtcctacacctgtggtggattgggaaacaacaaatgtcacaacgagtctgacccctcagtccaccaggagtaccgagaagacattcacgataccggtgaccgatatcaactctggcatacccgggatagacgaggtgatgaagacaactaagataatcatcgggtgttttgtggccataactttaatggcagcagtgatgctggtgatcttttacaaaatgagaaagcagcatcatcgccaaaatcaccacgccccaaccagaacggttgaaatcatcaacgtggatgacgagatcacaggtgacacacccatggaatcccacctccctatgcccgcaatcgagcatgaacacttaaaccattataattcatataagtcgccgttcaaccatactactactgtcaacacaatcaacagtattcattcttcggtgcacgagcctctccttataaggatgaactccaaagataacgtgcaggaaacgcagatctag

SEQ ID NO: 122106 - DNA, 126 bp, Artificial Sequence
  Description of Artificial Sequence: Synthetic coding sequence
atgctgaacaagatgactctccacccgcaacagataatgatcggcccgaggttcaatagggcgctgtttgatcctctactggtggttttactggctctccagctcctcgttgtggcaggtttgtag

SEQ ID NO: 122107 - DNA, 4614 bp, Artificial Sequence
  Description of Artificial Sequence: Synthetic coding sequence
atgaccactaaaagaaaaattattggtcgtcttgtcccatgccgctgcttccgaggtgaggaagaaatcatctctgtgttagattactctcactgtagcctccaacaagtccctaaagaggtgtttaattttgaacggaccctggaagaactctatctcgacgcaaaccagattgaagagctcccaaaacagctgtttaattgtcaggcactccgcaaactctcaatccctgataacgacctgtcaaacctgcccacaacaatcgctagtttggtgaatctgaaggagctggacataagcaaaaatggagtgcaggagttccccgagaatatcaagtgctgcaagtgtttgacaattattgaggccagcgtcaaccctatatccaagctgcccgacgggtttacacaacttttgaatttgacacaactgtacctcaatgatgcgtttctggaattcttgccagctaacttcgggcgactggtcaagctcagaattttagagctcagagaaaatcatcttaagacgcttcccaagtccatgcacaagctggcgcagctcgagagacttgacttgggtaacaacgaattcggggagttacctgaggtgctggaccaaattcaaaacctgagggagttgtggatggacaacaatgctttacaggtgttaccgggctctattggcaagctgaagatgctagtgtatctcgatatgtctaagaaccgaatagaaacggtggatatggatattagcggctgcgaggcattggaggatctgttattaagctcaaacatgctgcagcagcttcccgatagtatcggactcctgaagaagctaaccacccttaaggtggacgataatcagctgaccatgctgcctaatactattgggaacctgtccttacttgaggaatttgattgcagctgcaatgagttagagtcactgccgagcacaatagggtatctgcacagtcttaggacactggctgtggatgagaatttcttgcccgaacttcctcgggagattgggtcctgcaagaatgttaccgttatgtctctaagatccaacaaacttgagttcctacccgaggagattggccagatgcagaaattgagggtactgaacctatccgataaccgtctgaaaaatctcccatttagctttaccaagctcaaagagctcgccgctttatggctgtccgataaccaatcaaaggcactgatacctctgcagaccgaggcacatccagagaccaaacaaagagttctgactaactatatgttcccacagcaaccacggggcgacgaagatttccaatcagattctgactccttcaatccaactttatgggaagaacaaagacagcagaggatgacagttgcgtttgaatttgaggacaagaaggaggacgacgaaaacgccgggaaagtgaaagatctttcctgtcaggccccttgggaacgcggacagaggggaattaccctgcagcctgcgagactgagcggggactgttgcaccccatgggctaggtgcgaccagcagattcaggacatgccggtacctcagaatgaccctcaactcgcctggggctgcattagtggcctccaacaggaacgtagcatgtgcacgcccctgccagtcgccgcgcagagcacaaccttgcccagtctgtctggaaggcaagtcgagatcaacctgaagcggtaccctactccctaccctgaagacttgaaaaatatggtgaaaagtgtgcagaatctggtcgggaagccatcccatggcgtgcgagtcgagaatagtaatcccaccgccaacacagagcagacggtgaaggaaaagtacgaacataagtggcctgttgcccccaaagagatcacagtcgaggatagctttgttcatccagcgaatgaaatgaggattggtgagcttcatccttcactggctgaaacccccctgtatcctcccaagctggttctgctggggaaggacaaaaaagagtctacagacgaaagcgaggtggataagactcattgtctgaacaactccgtgtcatctggcacttactcagactattcacccagccaggcaagctcgggaagcagcaatactagagtaaaggtgggatcactgcagacaaccgcaaaagacgcggtgcacaacagcttgtgggggaaccggatcgccccctcttttccccagcccctggacagcaagcccctcctcagtcagagagaagctgtgccaccaggcaatataccccaaagaccagaccgcttgccaatgtccgacacctttacagataactggacagatggctcacattacgacaacactggctttgtggcggaagagacgaccgccgagaatgccaactccaacccactgctgagttccaaatcacggtccacaagtagccacggccgacgtcccttgatacggcaggatcgcatcgtgggggtccccttagagttagaacagagtacccataggcatacaccagagacagaggtgccacctagcaacccatggcagaactggacacgcaccccctccccattcgaagacagaacggcctttcccagtaagctggaaacaactcccactacatctccgctcccagagcgaaaggaacacattaaggagagtacagagatccctagcccattcagcccaggcgtgccatgggaataccacgacagcaaccccaaccgttcacttagcaatgttttctctcagattcactgccgccctgagtcctctaagggggtgatctcgatctcgaaaagcactgaacgcttgagtcccttaatgaaggatatcaagagcaacaagttcaagaaaagccagagcatcgatgagattgatattgggacctacaaagtttataacattccgctcgagaattacgcctccggatccgaccacctcggatcccacgaaagacctgataagatgctgggcccagagcacgggatgagctctatgtcacgatcacagagcgttcctatgcttgacgacgaaatgctgacttacgggagtagcaaaggcccccagcagcagaaggcatctatgaccaagaaagtttaccagttcgaccagagctttaacccccagggatccgttgaggttaaggctgagaaacgcatccctccacccttccaacataatcccgaatacgttcagcaagcttcgaagaacattgccaaggacctgatatctccaagagcatatagaggatatccgccaatggaacagatgttctccttctcacaaccttccgtcaacgaagatgctgtcgttaatgcccagtttgcaagtcagggggccagggccggattcctgcggagagctgattcccttgtgtctgccaccgaaatggcaatgttccggcgcgtcaatgagcctcacgagttgccgccaaccgataggtatggtcgtcctccataccgcggtggattagaccgccagagttctgttacagtaacagagtcccagtttctcaagcgcaacggcaggtatgaggacgagcacccctcatatcaggaggtcaaagcacaggccggctctttcccggtgaagaatctgactcagaggcggcctctctcggctcggagttactctaccgagagctacggagcttcccaaacccgtcctgtatcagcccggcccacgatggctgcactgttggagaagattccctccgattacaacctagggaattacggggacaagccaagcgacaattctgatcttaaaaccaggcctactccggtgaagggtgaggagtcatgcggaaaaatgccagccgactggagacaacagttattgcgtcacatcgaagcaagaaggctcgatcggaacgctgcctacaaacacaataccgtgaatctcgggatgctgccttacggggggattagcgctatgcacgcaggtcggtctatgacgttgaatcttcagaccaagagcaagtttgaccaccaggaactcccgcttcagaaaacgccttcccaacagagcaatatactggacaatggacaagaggatgtgagtcctagcgggcagtggaacccctaccccttgggccgcagggacgttccgcctgacactatcactaaaaaggccggctcccacatccagacattgatgggctcgcaaagcctgcagcatcgcagtcgagagcagcagccttatgagggtaacatcaataaggtgacaatccagcaattccagtctcctctgcctatccaaattccgtcatcacaggccaccagaggcccccagcctggtaggtgcctgattcagactaaagggcagagaagcatggatggatatcccgagcaattttgtgttcgaatcgagaagaacccaggacttggcttcagcatttcaggtgggatctcaggccaaggaaatcctttcaagccatccgacaaggggattttcgttacgcgagtccaaccagacggacccgcttcaaacctcctgcaacctggcgataagatacttcaggcgaatgggcactcatttgttcacatggaacacgaaaaagctgttctgctcctaaaatcgtttcagaataccgttgacctggttattcaacgcgagttgaccgtgtag

SEQ ID NO: 122108 - DNA, 4488 bp, Artificial Sequence
  Description of Artificial Sequence: Synthetic coding sequence
atgcagtgcctggagatgactaccaaacgtaaaatcatcgggcgcttggttccttgcagatgtttccgtggggaggaggagatcatatccgtcctggactacagtcattgttcgctccagcaagtccccaaagaagtttttaacttcgaacggaccctcgaagagctgtacctggacgctaaccagatagaggagctgcccaagcagctgttcaactgtcaggcccttagaaagttgagcattccggataacgacctgagtaatctgccaaccacgattgcctccctagttaacttgaaggaattggacattagtaagaatggtgtacaggaatttcccgagaatatcaaatgctgtaaatgcctaaccatcatcgaggcctctgttaaccctatcagcaagctgccggacgggttcacgcaactgctgaatctgacccagctatacctgaatgatgcattccttgagttcctccccgctaatttcggtagacttgtaaagctgcgaatcctcgaactaagagaaaaccacctgaaaacactgccaaaaagcatgcataagttagctcagcttgagcgcctggacttgggaaacaatgagttcggagagctgccagaagtcttagaccagatccagaacctcagagagctgtggatggataacaacgccttgcaggtacttcccggtagcatcggaaagttgaagatgctggtgtacctggacatgagcaagaaccgcatagaaacagtggatatggatatctctggctgcgaagcactagaggacctgttgctcagcagcaacatgctccagcagttgcctgactctatcgggctgctcaaaaaacttacgaccctgaaggtggatgataaccaactgacaatgctacccaacacgataggtaatttgagtctgctggaggagttcgattgcagctgcaatgagctggagagtttgccttcaaccattgggtaccttcactctcttagaacattagcagtagacgaaaacttcctgccagaactgcctagggagataggaagttgcaagaacgtgactgtgatgtcgctccggagtaataagctagagttcttgcccgaagagattggacagatgcagaagctccgggtgctcaatttaagtgacaaccggctgaaaaaccttcctttcagctttacaaaactgaaggaactggctgccctatggctgagcgataaccagagtaaggccctgatccctttgcagacagaagcccacccagagacaaagcagagagtattgaccaattatatgttcccccaacagcccaggggagacgaagacttccagtccgattcagactcatttaatccaaccctatgggaggaacagcgccagcaaagaatgaccgtagccttcgagtttgaagacaaaaaagaggacgacgagaatgctggcaaggtcaaggacctgtcatgccaggctccctgggaacgcggccagaggggtatcacccttcaaccggcccgactatctggcgattgctgcacaccctgggcacgctgtgatcagcaaatccaggacatgcctgtcccgcaaaacgaccctcagctggcctggggctgcattagcgggctgcaacaagagaggtccatgtgcacacctcttccagtagctgctcagtcaactactctgccctcactttccggaagacaggtggagatcaatctcaagcgatacccaaccccttaccctgaagatttgaaaaatatggtgaagtccgttcagaatctagtggggaagccttctcacggcgttagggttgagaactccaatcctaccgctaatacggaacagaccgtgaaggaaaaatatgagcacaagtggcccgtagcccctaaggagattacagtcgaagattccttcgtgcatccggccaatgagatgagaataggcgaactccatcccagtctggccgaaacacccctatatcccccaaagctggtcctattgggcaaagacaagaaagaatctactgatgagagtgaggtagataagacgcattgtctgaacaactccgtcagttccggaacatatagtgactactcaccatcacaggcaagtagcggctcctcaaatacgagggtgaaagtgggctcccttcaaacaaccgcgaaggacgccgtccacaactctctgtgggggaacagaattgctccctcgttcccccaacctttggatagcaaacccctgctttctcagcgggaggccgttcctcccggcaatatcccacagcgcccagacaggctgcccatgagtgataccttcaccgataactggaccgatggcagccactatgacaacacaggctttgtggctgaagaaacaacggccgagaacgcaaatagcaatcccctgctgtcctcaaagtcacgatctacttcttcacatgggagacggcccttgattaggcaggacagaattgtgggagtgccactcgagttggaacagtctacgcaccgccatacacctgaaaccgaggttcctccaagtaatccctggcagaactggacgagaacaccttctccgtttgaggatcggacagccttcccttcaaagttagaaacgaccccgaccacctcaccgctccctgagcggaaggaacatataaaggagagcaccgaaattcccagccctttctctcccggggtcccctgggaatatcatgatagtaatccaaaccgaagcctgtctaacgtgttctcgcagatccactgtagaccagagtcctctaaaggggtcatcagcatctctaagtccactgagcggctcagccccctcatgaaggacatcaagagcaacaagtttaaaaagtcacagagtatcgacgagatagacatcggtacatacaaagtttataacataccgctagagaactacgctagcggaagtgatcacctagggagccacgaacgccccgataaaatgcttggcccggaacatggcatgagtagcatgtcccgctcccagtctgttcccatgctggacgatgagatgttgacctatgggtctagcaaaggtccacaacagcagaaagccagtatgacaaagaaagtttaccagtttgatcagagtttcaatccccaagggtccgtggaagttaaggccgaaaagaggatccctcctccgtttcagcacaatccagagtatgtgcagcaggcctctaagaatatagccaaggatttaatcagcccccgcgcgtatcgaggataccctcctatggaacagatgtttagcttttcccaaccatctgtgaatgaagatgccgttgtgaacgctcaattcgcttctcaaggagctagggcgggtttcctgagaagagccgatagtctggtcagcgctacggagatggcgatgttccgccgggtgaatgaacctcacgagctaccccctactgaccggtacggccggcctccatatagggggggtttagacaggcaaagctcagtgacagttacggagtcgcagttcttaaaaagaaacggaaggtacgaggacgagcacccgagttatcaggaggtcaaggcccaggccggctccttccctgtgaaaaacctgacccaaagaagacctctgtccgcaaggagctacagcacggaatcatatggcgccagccaaacccgtcccgtcagcgcaagaccaacaatggccgccttgctcgaaaaaataccctccgattataacctgggaaactacggcgacaagccatccgacaatagcgatcttaagaccaggcccaccccggttaagggtgaggagtcatgcggtaagatgcccgccgactggagacagcagctgctgcgacatattgaggcaaggagactcgatagaactccttctcagcagtctaatatattggacaacggacaagaagatgtgagtccgtccgggcaatggaacccttaccccctgggtaggagggatgtgcccccggacacgattacgaagaaggcaggttcccatatccagacacttatgggatctcagagtctacagcacaggtcccgtgagcagcagccttacgagggcaacatcaataaggttacgatccaacagttccaatcccctctgccaattcagataccgtccagccaagcaacccgtggtcctcagcctggccggtgcctcattcaaacaaagggccaacgaagcatggacggatatcctgagcagttctgtgtcaggatcgagaagaatcctggactgggtttcagcatctcggggggtattagtggccagggcaaccctttcaagccttcagacaaagggatttttgtgacgagggtacagccggatggccctgcctcaaacctgctccagcccggagacaaaatactccaggccaatgggcactcctttgtccacatggagcatgagaaggctgttctacttctcaaatctttccaaaatacagtcgacctggtgatccagagagagctgaccgtgtag

SEQ ID NO: 122109 - DNA, 540 bp, Artificial Sequence
  Description of Artificial Sequence: Synthetic coding sequence
atgactactaaaaggaagatcatcggtcgtttggttccatgcagatgttttcgcggcgaggaggaaatcatttcagttctggactattcccattgttccctgcagcaagtgcctaaggaggtttttaattttgagagaactctggaggaattgtatctggacgctaaccagatagaggagctacccaaacagttattcaattgccaggccctcaggaagctcagtatacctgataatgacctgtcaaatctccctactaccatcgcctccctggtgaaccttaaggagctggatatttcaaagaatggcgtgcaggaattcccagagaacatcaaatgttgtaagtgtctgacgataatcgaggctagcgtaaaccccatttccaaattgcccgatgggttcacccaactgctcaatctcacacagttgtacctgaacgatgcgttcctcgagtttctgcctgctaatttcggcaggttagttaagctgcgtatcctggaactgagggaaaatcatctcaagacccttcctaagatttag

SEQ ID NO: 122110 - DNA, 3942 bp, Artificial Sequence
  Description of Artificial Sequence: Synthetic coding sequence
cgctccatgcacaagctcgcccagttggaacgcctggatttaggaaataacgaattcggtgaactgcccgaagttctggatcagatccagaacctgcgtgaactgtggatggataataacgccctccaggtcctgcctggttccataggcaagctcaaaatgctggtatacttggacatgagcaaaaatcggatcgagactgtagatatggacatcagcgggtgcgaagccctcgaagatcttctgctaagctccaacatgctgcaacagcttcccgattcaattggcctcctaaagaaactgaccacgctgaaggtggatgataatcagctcacaatgctgccaaacaccatcggaaacctgtccttactggaggagtttgactgtagctgcaatgagctggagtccctgccaagcaccattggatatctgcactcactcaggactttggccgtggatgagaatttcttacctgagttaccacgagagatagggtcatgcaaaaacgtaacagtgatgtccctgaggtccaataaactggaattcctcccggaggaaatcggacagatgcagaagctccgggtcctgaatctgagtgacaatagactgaaaaacctgcctttttcttttacaaagctcaaagaactcgcggcattatggctctcagacaaccagtccaaggcactgataccactccagaccgaggcccaccccgaaaccaagcagcgggtactcacgaactatatgtttccccaacagccacgaggggacgaggactttcagtctgactccgactccttcaatcctacgctgtgggaagagcaacgccaacaacggatgaccgttgcctttgagtttgaagacaaaaaagaggatgatgagaatgctggcaaagtgaaggatctatcatgtcaggcaccatgggagcgcgggcagaggggtatcacgcttcagcccgcgagattgtctggagactgttgcactccatgggcaaggtgcgatcagcagatccaggacatgcctgtgccacagaacgatccacagctggcttggggctgcattagtgggctgcagcaggaaagatccatgtgtactcccttacccgtggcggcacagtccaccacgttaccaagtctcagtgggagacaggtggaaatcaacctgaagagataccctacaccatatcccgaagacctgaaaaacatggtgaagtctgttcagaacttggttggtaagcctagtcatggggtccgggttgagaactccaatccaacagccaacaccgaacaaactgtgaaggaaaaatacgaacacaaatggccagttgctcccaaggagattactgtggaggactccttcgtgcatccagctaacgaaatgcggattggcgaattgcaccccagtctggccgaaacacctttgtacccgccaaaactggtccttctaggcaaagacaagaaagagtcaaccgacgagtctgaagtggacaaaactcactgtctcaacaattcagtttccagcggaacgtactccgactatagcccgtcccaggcttcctccggatctagtaatacccgcgttaaagtgggatccttgcagacaacagccaaggacgctgtgcacaattctttgtggggcaaccgaatagcgccatcatttccccagcccctggacagcaaacctctactgtcacagagggaggcagtcccccccggtaatatcccccagaggcccgatcgcctgcccatgtctgacactttcaccgacaattggacggatggtagtcattatgacaatactgggttcgtagcagaagagacaaccgctgaaaacgccaactctaaccctctcttgagctctaaatctagatccacgagctctcacgggaggcgacctttgattagacaggataggatagtcggagttccgctcgagctggaacaatctacccaccgtcatacaccggaaaccgaggttccgcccagtaatccctggcaaaactggacgagaacaccaagccctttcgaggatagaacggctttcccatccaagttggaaactacgccaaccacgagccccctacccgagagaaaggagcatattaaggaatcaacggaaatcccaagtccatttagtcccggagtaccttgggagtatcatgattcaaatccgaatagatctctgagcaacgtgttcagtcaaattcactgtagaccagagagcagtaagggtgtgatatctatctcaaagagtactgagcgcttatcacctttaatgaaggacatcaagtctaacaaattcaaaaaatcacagtctattgatgagatcgatataggaacatataaggtgtacaacattccactcgagaattacgccagcggctctgatcatcttggttctcatgagcgtcccgataagatgctaggccccgagcacgggatgtcatccatgagcagatcccagtctgttcctatgctggacgacgagatgttgacatatggcagcagcaagggccctcagcagcagaaggcctcgatgacaaaaaaagtataccagtttgaccagagctttaaccctcaagggtcagtggaggttaaggcagagaaacggattccacctccttttcagcacaatcccgagtatgtgcaacaggcaagtaaaaacatagctaaagacttgatttccccacgcgcgtacaggggctacccacccatggagcagatgttttctttttctcaaccttccgtcaatgaggatgccgtagtcaacgcccagttcgcctcccaaggagcccgggcgggctttctgaggcgcgctgactcactggtgtctgccaccgagatggcgatgttccgccgggtgaacgagccgcatgagctgccacctactgatcgctatggaaggccaccttatagaggggggctggatcgccagtcctccgtgaccgtgaccgagagccagttcctcaagcggaacgggcgctacgaagatgaacatccatcttaccaagaggtcaaggcccaggcaggttcttttcctgtaaagaacttgacacaaagacggccgttatcagcaagatcatactccactgagtcctacggcgctagccagactcgaccagtttccgcacggcccaccatggctgctctcttggagaagatcccgtccgattacaatcttggaaactatggagacaagccctcagacaattccgacctgaagacccgccccacacccgttaaaggggaggaaagctgcgggaaaatgccagcagattggagacagcagctactccgacatattgaggctcgacgactggaccgtaccccatcccagcagagtaacattctggataatgggcaggaagatgtcagccccagcggccagtggaacccataccctctgggcaggagagatgttccacctgacactatcactaagaaggccggcagccatattcagaccttaatgggaagccagagcctgcaacacaggagtcgtgaacagcaaccatacgaaggcaatatcaacaaagttaccatccagcagttccagtcccccctgcccattcaaataccttctagccaggccacacgcggaccgcagccaggcagatgcttgatacaaactaaaggacagaggtctatggatggctaccctgagcagttttgcgtgcggatcgaaaagaacccaggactaggtttttccattagcggtggtatcagtggccaggggaatccattcaagccatccgacaaaggcatctttgttactcgagtgcagcccgatggtcccgcgagtaacctccttcagccaggtgacaaaatcttgcaagccaatggacactcgtttgtgcatatggaacacgagaaggccgtactcctgctaaaatcatttcagaacacagtggaccttgtgatccagcgcgaactcacggtatag

SEQ ID NO: 122111 - DNA, 654 bp, Artificial Sequence
  Description of Artificial Sequence: Synthetic coding sequence
atgatggagaacctgatcagaggccgcaatcctccccagtaccagcggtctccctgtaaagaagtccgcgctgcactgaggaagagacctgaggaggagctccagtgcttggaaatgaccaccaagcgtaagattattggacgcctggttccttgtagatgctttagaggagaagaggagataatcagcgtgctggattactcccattgttcactccagcaagtgccaaaggaggtcttcaactttgagagaacactggaagaactgtatctagatgccaaccaaattgaggagttacctaagcaactctttaactgtcaggcactgaggaagttatccatcccagataatgatctatccaatcttcccaccaccattgcctcactagtcaacctgaaagagttggacatcagcaagaatggagtgcaggaattccccgagaacatcaagtgctgtaaatgcttgacaataattgaagccagcgtcaatccaataagtaaactgcccgacggcttcactcagctccttaaccttacccaactgtaccttaacgatgccttcctggaattcctccctgccaacttcggacgtttggtgaaacttcggattctcgagctccgagaaaatcacttaaagacgctgcctaatatctag

SEQ ID NO: 122112 - DNA, 2466 bp, Artificial Sequence
  Description of Artificial Sequence: Synthetic coding sequence
atgactaaaatgctcggcaagctccggattgccccaagctttccacaacccctagattccaagcctttactttcccagcgagaagcggtaccccctggcaatatccctcagagaccagaccgcctccctatgagtgatacctttacagacaactggactgatggaagtcactacgacaacaccggctttgtggccgaggaaacaaccgccgaaaacgcgaattcaaacccactgctctcttcaaagtcccgatcaacgagctctcacggacgtcgccccctgatccgacaagaccggatcgttggcgtccctttagaactggagcaatcgactcaccgccacacacccgagactgaggtgcccccctctaatccctggcagaactggacaaggactcctagcccattcgaagaccgtacggcttttccttcaaagctggaaacaaccccgaccacctcccctttaccggagcggaaggaacatatcaaggagtcaacagagatcccatcgccttttagccccggtgtgccctgggaataccatgatagcaaccccaatcgttctttgtcaaatgttttttcccagattcattgtcgccccgagagcagcaagggtgtcatatccatttctaagtccaccgagcgcttgagtccactgatgaaggatatcaaaagcaataaatttaaaaaatcgcagagtattgacgaaatcgacatcggaacctacaaggtctataacattcccctggagaactacgcgtccgggagcgaccacctaggatcccacgaaagacctgacaagatgttgggtccggagcacggaatgtcttccatgagccggtctcagagcgtgcctatgcttgacgacgaaatgctcacttatggcagtagcaagggcccccagcagcaaaaagctagtatgactaaaaaggtgtaccagttcgaccagtccttcaatcctcagggcagcgttgaagttaaagcagagaaacggattccccctccgtttcagcataacccagagtacgttcagcaggcttctaaaaacatcgccaaggatctcatcagcccaagagcctacagagggtaccctccaatggaacaaatgttttcattcagtcagccgtcggtaaacgaggatgccgtggtaaatgcacagtttgcctctcaaggagctagggctggcttccttcggcgcgcggattcactggtgtcagcaaccgaaatggccatgttccgccgggtcaatgagcctcatgagcttcctcccacggatcgatatggcaggcctccatacagggggggattggatagacagtccagcgtcactgtaaccgagtcgcagtttttaaagcggaacggaagatacgaggacgaacacccatcctaccaagaggttaaagcccaggcaggcagttttcctgtaaagaatctgacccagcggagaccactcagcgccaggagctattcaacagagagctacggcgctagccagacccggcccgtgagtgcccggcctactatggctgcattgcttgagaagattccaagcgactacaacctgggaaattatggcgataagccatcagacaattctgatttgaagacgaggcccactcctgtgaaaggtgaggagagttgtggtaagatgcctgcagattggcgccagcagttgctgaggcacattgaagccaggaggctggaccgcaacgccgcttataagcataacactgtgaaccttgggatgctcccctatggcggtataagcgcaatgcacgccggtcgatcaatgacactgaaccttcagactaagagtaagtttgatcaccaggagttacctttacagaagacgcctagccaacagtccaatatcctggataacggccaggaggacgtgtctcccagtggacagtggaacccctaccctctgggaaggagagatgtgcctcctgatacaatcacgaagaaagcaggtagtcacattcaaacacttatgggctcccagagcctccagcatcgttcgcgcgagcagcaaccctatgagggcaacataaacaaagtcactatccagcagtttcagtctcccctgcctattcagatcccctcctcccaagcaacacggggtcctcagcccggacgctgccttatccaaaccaagggacagagatcgatggacggataccccgaacaattttgtgtgaggattgagaagaacccaggcttgggcttctcgatcagcggcggtatctctggacagggcaacccgtttaagccatctgacaaggggatcttcgtaactagggtgcagcccgatggcccagcctccaatctgcttcagcccggagacaaaattctccaggccaacggacatagcttcgtacacatggaacatgagaaggcagtccttttactaaaatcttttcagaacaccgtggacctggtgatccagagggagttaaccgtgtag

SEQ ID NO: 122113 - DNA, 2433 bp, Artificial Sequence
  Description of Artificial Sequence: Synthetic coding sequence
atgatcccagtgacagaactacgatattttgcagatacacagcctgcctacaggatcctgaagccctggtgggatgtgttcacagattatatctctatcgtgatgcttatgattgccgtgttcggaggtactctccaagtgacccaggacaaaatgatttgccttccctgcaaatgggtgacaaaggatagctgcaatgatagctttcgcggatgggcagcacccggacctgagccaacgtaccccaacagcactatcttacctacccccgataccggtccaacaggaatcaagtatgacctggatcggcatcagtataactacgttgatgctgtatgctacgagaacagactccattggttcgccaaatacttcccatacttagtgctcctacacactctcatcttcttggcctgctccaatttttggttcaagttcccacggactagctcaaagctcgaacatttcgttagcatcctgctgaagtgcttcgactcgccttggactacaagggccctgagtgaaacagttgtggaagaatctgaccctaagcccgccttctctaaaatgaacgggtcaatggataagaagagcagcaccgtctccgaagatgtggaggccaccgttccaatgctgcagagaacaaaaagcaggatcgaacagggaatcgtggaccggagtgaaactggcgtgttggacaagaaagagggggaacaggcaaaggccctttttgagaaagtgaagaagtttcggactcacgtggaggaaggagatattgtttatcgcctgtacatgcggcagaccatcatcaaggtgatcaagttcatcttaataatctgttacaccgtctactacgtgcacaatattaaattcgatgtagactgcactgtggacatagagtctctcaccgggtataggacctaccgctgtgcccacccactggcaaccctcttcaaaatcctggcatcattctacatctccctggttatcttttacggcctgatttgtatgtatacgctgtggtggatgttgcgccgcagtctcaaaaagtactccttcgagtccatcagagaagagtcttcatacagcgacatcccagatgtgaagaatgacttcgcctttatgcttcacctaatcgatcagtacgatcctctctactcaaaacgttttgcagtatttctttcagaagtatcggaaaataagctgaggcaactaaacctgaataatgaatggactctggacaaactgagacagcggttaacaaagaatgcccaggacaaactagaactccacctgttcatgctgtcaggaataccagatacagtgtttgacctagtggagttggaagtactcaaactagaattgatccctgacgtgactatcccaccatctatcgctcagctgacaggcctcaaagagctgtggctctaccatactgctgcaaagatcgaggcaccggctctagcttttctgcgagagaatttgcgagccctacacatcaagtttacagacattaaagaaatccccctttggatctactcactaaagaccttagaagaactccacctgacgggtaacttgagtgccgaaaataaccgttacatcgtgatcgatgggctgagggagctcaagagactgaaggttttgcgcctgaaatccaatctttccaaactgcctcaggtggttaccgatgtaggcgttcaccttcagaaactcagcataaataatgaggggactaaactcatagtcttaaattccctaaagaagatggctaatcttacggaactggaactgatccgatgtgatctggaacgcatacctcattctattttttctctgcacaatttgcaagaaatcgatttgaaagacaataacctcaagaccatcgaggagattattagctttcagcacctgcacagattgacatgcctgaagctctggtacaatcacatcgcctacatcccaattcagataggcaacctgacaaacctcgagaggctctacctcaatcgcaacaaaattgaaaaaatacctacgcagcttttctattgccggaagctgcgttacctcgatctgtcccacaataatctcacctttcttccagcagacatcggtctgcttcagaatcttcagaatctcgccatcacagcaaacaggatcgagaccctgccacctgagctgttccagtgcaggaaactgcgggcgctacatcttggcaataacgtcctacagtcactgccaagccgcgttggggagctcacgaatctgacacaaatcgaattgaggggcaaccggctcgaatgtttgccagtggaactaggcgaatgcccgctgctcaagagatcaggtctcgttgtagaagaggatttgtttaataccctgcccccggaggtgaaggagcgattgtggagagccgataaggagcaagcttag

SEQ ID NO: 122114 - DNA, 2433 bp, Artificial Sequence
  Description of Artificial Sequence: Synthetic coding sequence
atgattcccgtgacagagctgcgctattttgcggacacgcaaccagcgtaccggatcctgaagccatggtgggacgttttcactgactacatttctatcgtcatgctaatgatcgccgtgttcggtggcaccttacaggtcacccaagacaaaatgatctgtctgccttgcaaatgggtgacgaaggatagttgtaatgactcattccgaggctgggcggctccaggccctgagcccacctaccccaactctactatcctaccaacacccgacacaggaccaaccggaataaaatacgatttggaccgccatcagtataattacgtcgatgcagtatgttacgaaaacaggctgcattggtttgccaaatacttcccctatttggtcttattacatactctcatttttctggcgtgctccaatttctggtttaagttccctagaacctcctctaaactggaacactttgtttctatactgctgaaatgcttcgacagcccttggaccactagggcacttagcgagacagtggtggaagaatctgaccctaaaccagctttttcaaaaatgaacggctctatggacaaaaaatcaagtacagtgagtgaggatgtcgaagcgacggtcccaatgctccagcggacaaaatctagaattgaacaaggaatcgtggataggagtgaaacaggggtgttggacaagaaggagggggagcaggcaaaagccctgttcgagaaagtcaaaaagttcaggactcacgtcgaggagggtgacatcgtctacagactgtacatgcggcagactatcataaaagtgataaaatttatcctgatcatttgctacacagtatactatgtccataatatcaaatttgatgtggattgcacagttgatatcgaaagcttgaccgggtacaggacttacagatgtgcacacccgctcgcaaccctgttcaagatcctcgccagcttttacatttctctcgtgattttttatggtctgatatgcatgtatactctgtggtggatgcttagacggagcttgaagaagtatagtttcgagagtatacgggaggaatcctcgtattcagacatccctgacgtcaaaaatgacttcgcatttatgcttcacttaattgaccagtacgaccccctgtatagcaaacggtttgcagtttttctgtcggaggtctccgagaacaagctgagacagttaaacttaaacaacgagtggactctcgacaagctgcggcagagattgactaagaacgcgcaggataaactcgagctgcacctctttatgttgagtggcattccagataccgttttcgatctggttgagcttgaagtgctcaagctcgagctgatccccgacgtcaccatcccccccagtatagcccagctgacggggttaaaggagctgtggctctatcatacagcggctaagatagaggcccctgcacttgccttcctccgcgagaatctgcgagccttacatattaaattcaccgatatcaaggagattccactctggatttacagccttaagacgctagaggaacttcacctcactggcaacctgtccgcagagaacaataggtatattgtcattgacggcctgagagagctgaagagactgaaagtgctacggcttaaatcgaatcttagcaaactgccgcaagtggtgacggatgtaggagttcacctgcagaaactctctatcaataatgagggtacaaaactgatcgtgttgaatagtttgaaaaagatggccaacctcacagaactcgagctaattaggtgtgacttggagcggattccccacagcatcttctcattacacaacttgcaggagatcgacctgaaggacaataacctcaaaacaatagaggagatcatctccttccagcatctgcacaggctcacttgcctaaagctttggtataaccacatcgcgtatatccccattcagattgggaacctcacaaacctcgagaggctctatctaaatagaaataagatcgaaaagatacctactcaacttttctattgccgcaagctgagatatctggatctttctcataataacctgacttttcttcccgccgatattggactgttacagaacctgcagaatttagcaatcactgccaatagaatcgagacactgccacctgagcttttccagtgcagaaaattgagggcgttacatctgggcaataatgtgcttcagagcctgccgtcccgcgtgggcgagctgactaatctgacccagatcgagctgaggggcaataggcttgaatgcttacctgtcgaactgggtgagtgccccctgttgaagagatccggtctggtggtggaagaggatttattcaatacactgccccccgaggtcaaagagcgcctctggcgggccgacaaagagcaggcttag

SEQ ID NO: 122115 - DNA, 2433 bp, Artificial Sequence
  Description of Artificial Sequence: Synthetic coding sequence
atgattccagtcacagaactgaggtattttgccgatacacaacccgcatatagaatacttaagccttggtgggatgtctttaccgattacatcagtattgtaatgttgatgatcgctgtatttggaggaaccttacaagtgacccaggacaaaatgatttgcttaccttgtaagtgggtcactaaggactcatgcaatgactcttttcgcggctgggcagcgcccgggcctgagcctacgtatcctaatagcaccatcttaccaacccccgataccggaccgacaggaatcaagtatgacctcgatagacaccagtacaattacgttgatgccgtatgctacgagaacaggctgcactggtttgctaagtattttccttatttagtcttgctgcatacactgatcttcctggcgtgtagcaatttttggtttaagtttcctcggacatcatctaagctggaacatttcgtttccatcctcctgaagtgctttgattccccctggacaacaagagccctctccgagacagtggtggaggagagtgatccaaagccagcattttctaagatgaatgggtcaatggataagaagtcctccacagtgtccgaggacgtggaggcaactgtgcctatgctgcagaggactaagagtcgcattgagcaggggattgttgacaggagcgaaaccggcgttctcgacaaaaaggaaggtgagcaggcaaaagccttgtttgagaaagtgaaaaagttccgtacgcacgtggaggaaggggatatagtttacaggctgtatatgagacagactatcattaaggtcatcaagtttatattgattatttgttataccgtctattatgttcacaacatcaaatttgacgtcgattgcacagtcgatatcgagtctctgactggctatagaacatatagatgtgcgcaccccttggctaccctttttaagattttagcctctttttacatctccctggtcattttttatggattgatttgcatgtatactctttggtggatgctccggcggtccctcaagaagtactcgtttgagtctatcagagaggaaagcagttacagcgatataccggatgtcaagaatgactttgcattcatgctccacctaattgaccagtacgacccgctgtactccaagcgcttcgcggtctttctcagcgaagtctccgagaacaagcttaggcagcttaatctgaataacgagtggactctggacaaactaaggcagcgcttgacaaagaacgcccaggataagctcgagctgcacctattcatgttgtctggaatacccgacaccgtgtttgatctggtcgaactcgaagtcctcaagcttgagttaattcccgacgtcacgatccccccgagcatcgcccagctcactggactgaaggaactttggctataccataccgccgccaaaatcgaggcccctgccctggcctttcttagagagaatctgagggccttacatattaagttcacggatatcaaggaaatccccctctggatttatagtctgaagacactcgaggaactgcacttaactggcaacctctctgcagagaataatagatacattgtaatcgacgggctcagggagctcaaaaggctgaaggtgctgagactcaaaagtaacttgtctaaactgcctcaggtggtgacggacgttggagtgcatctgcagaagctaagcatcaataacgagggcaccaagctgatcgtcctgaacagccttaagaagatggccaacctaaccgaacttgagctgatccgttgcgacctggagcggattccacacagcatattctccttacacaatctgcaggaaatcgacttaaaagacaataacttgaaaaccatcgaagaaattatcagctttcagcatttacacagactgacttgtctcaagctctggtacaaccacatcgcttacatccccatccagatcggaaatctgacaaatctagagcggctgtacctgaatcgcaacaagattgaaaaaattcccacccaactgttctactgccgcaaactccggtacctggacctcagtcacaataatttgacctttctgcctgctgacattgggctcctgcagaatctgcagaacctggccatcaccgctaaccggatcgagactctgccacccgaattgtttcagtgccgtaagttacgagcgctccacctggggaataacgtcctgcagtcgctgccgtctagagtgggcgagctcacaaatctgactcagatcgaactgagagggaatcgattagagtgcctgccggtcgaattgggtgaatgccctctactgaagcggtcaggcctggtggtcgaggaggacctattcaatacgctacctccagaagtaaaagagaggctgtggcgggcagataaggagcaggcctag

SEQ ID NO: 122116 - DNA, 2412 bp, Artificial Sequence
  Description of Artificial Sequence: Synthetic coding sequence
atgattaccctgaccgaactgaagtgtttagccgatgcacagagcagttaccacatactgaaaccttggtgggacgtgttttggtactacatcactctcattatgcttcttgtcgccgttcttgccggcgctctgcagctgacacaatcacgcgtgctatgctgtctcccttgtaaagtggaatttgataatcactgtgcggtgccttgggatatattaaaggcctctatgaatactagcagtaacccgggcactccactgccactccctctgcgaatacagaatgatctgcataggcagcagtactcttacatcgatgccgtctgctacgaaaaacagctccactggtttgccaagttcttcccatatttggtgcttctgcacacgctgatctttgcggcctgcagtaatttctggctgcattacccttctacctcctcccggctcgagcacttcgtagctatcctccacaagtgctttgatagtccatggaccacgagggccctgagtgagaccgtggcagagcagtcagtcagacctttgaaactctctaaaagtaagatcctgctgagctcgagcgggtgttcagctgacattgactccgggaagcagtcgctgccgtaccctcagcccggtctcgaatccgccggcatcgaatcacccacttcctcagtccttgataaaaaggaaggggagcaggcgaaggctatcttcgaaaaggtaaagagattcagaatgcacgtggaacagaaggacattatctatcgggtgtatttaaaacaaatcatagtgaaggtgattttgttcgttttaataatcacctatgtcccgtatttccttacccacattactcttgagattgactgctccgtggatgttcaggcatttaccggctacaagcgctatcagtgcgtgtattctcttgccgagattttcaaagtgctcgccagtttctacgtcattctggtgatcctgtatggactgacctccagctactctctatggtggatgctacgatctagccttaagcaatactcctttgaggcgctgcgggagaaatccaattattctgatatccccgatgtcaagaatgattttgccttcatcctgcacctggcagatcagtatgaccctctctactctaagcggttcagtatattcctgagcgaggtgagtgagaacaagctaaagcaaatcaacttaaataacgaatggaccgttgaaaagctaaaaagtaagctggtgaagaacgctcaagacaaaatagagttgcatctgtttatgctgaacggcctgccagacaacgtatttgagctgacagaaatggaagtgctgtcactagagcttattcctgaggtaaagttacccagcgctgttagtcagctcgtgaacctgaaagagttgagagtataccactcctccttagtggtggatcatcccgccctcgccttcctggaggaaaatctgaagatactgcggctcaaattcaccgaaatgggtaaaattcctagatgggttttccacctgaaaaatctgaaagagctctatctttcaggttgcgtgctgcccgaacagcttagtaccatgcagctcgagggcttccaagacctgaagaacctgagaacactgtatctgaagtcatccttgtcccgcataccccaggttgtgactgatttattgccaagtctccaaaaactcagcctggacaatgagggttctaaattagtggttctgaacaacctgaaaaaaatggttaacttgaaatcgctggaactgatcagctgcgatctcgagagaatccctcacagcatcttttctttgaacaatctgcacgaattggacctcagggagaacaaccttaaaacagtcgaggagatcatttcatttcagcacctacagaatctctcctgtcttaagctgtggcataacaacatcgcttacataccggcacaaattggcgcactcagtaacctggagcaacttagcctcgaccacaacaacatcgaaaacttgcctctgcagctgttcctgtgcactaaactccactatctcgacctgtcttataaccacttgacctttattcctgaggaaattcagtatctcagtaaccttcagtattttgcggtcactaacaataatatcgaaatgctccccgatggactgtttcagtgcaagaaactccagtgtctgctcctagggaaaaactctctgatgaacctgagtccccatgtgggcgagttgtctaatctcacacatctcgagcttatcggcaactacctcgaaacactcccccctgaactcgagggatgccagtccctcaagcggaactgcctcattgtggaggaaaatcttttgaacactctacctttacccgtcacagaacgtctgcagacatgcctcgacaaatgctag

SEQ ID NO: 122117 - DNA, 2412 bp, Artificial Sequence
  Description of Artificial Sequence: Synthetic coding sequence
atgataaccctcaccgaattgaagtgccttgcggatgcacagagcagttatcatattcttaagccttggtgggacgtcttttggtattacatcacgctgattatgctcttggtggcagtgttggccggcgccctgcagctcacgcagtcaagggtcctgtgctgtttaccatgtaaagtcgagtttgataatcactgtgccgtgccttgggatatattgaaggctagtatgaatacgtcgtctaatcccggtacccctttacctcttcctctcaggattcaaaatgacctccaccgacagcagtattcatacatcgacgccgtatgttatgaaaagcagcttcattggtttgccaagttctttccatacttggtgctgcttcatacactgattttcgccgcttgctcaaatttctggctccactacccgtccaccagctcaaggcttgagcatttcgtcgctatattgcacaaatgtttcgactccccctggacaacaagggcactgagcgaaacagtggctgagcagtctgtgagacctttgaagctttcgaagagcaagatcctgctgagttccagtgggtgcagcgcagacatagactccgggaagcaatcacttccctacccccagccagggctggagtccgccggcatcgagtctcctacttcctctgtcctggacaagaaagaaggagagcaagccaaagccattttcgaaaaagtgaagagatttaggatgcatgtggaacaaaaagatattatttatagggtgtatctgaaacagatcattgtgaaagtgatactgtttgtcctcattattacatacgtgccatatttcctgactcatattacacttgaaattgattgtagtgtggatgtgcaggccttcactggttacaaacgttatcagtgcgtctattctctggcagaaatatttaaggtacttgcaagtttctacgtgatactggtgattctgtacggcctaacgtcttcatatagtttgtggtggatgcttcgcagcagcctcaagcaatactctttcgaggccttgagggaaaaaagcaactactccgatattcctgatgtcaagaatgatttcgccttcattttacacttggctgaccagtatgaccctttgtattcaaaaaggttttctatctttctctccgaggtttccgagaacaaactgaaacagataaatcttaacaatgaatggactgtcgagaaactgaaatcaaaattggtcaagaacgcccaggacaagatagaactccacctgttcatgcttaacgggcttcccgataatgtctttgagctcactgaaatggaggtcctgagcctggagttaatcccagaagtgaagcttccttcagcggtaagccagctagttaacctgaaggagttgcgcgtgtaccacagtagcctggtagttgatcacccagctctagcatttctggaggagaacctgaagatcctgagactgaagtttactgagatggggaaaattcctagatgggtcttccatctgaagaacctaaaggagctatacttgagcggctgcgttctgccggaacagctttccaccatgcaactggagggcttccaggacctgaagaatctccgtacactgtacctgaagtcatccttgagcagaatcccacaagtggtcactgacctcctgccgtccctacagaaactgagtctggacaacgaaggctctaaactcgtggtgttgaacaacctgaagaaaatggtgaacttaaaatcactcgaactgatctcctgcgatctggaaagaattcctcacagtatattttctctgaacaatctccacgaactggacctcagggaaaacaacctgaagacggtggaggagatcataagcttccagcacttgcagaatctcagttgcctgaagctctggcataataatatcgcatacatcccggcacagatcggggcactgtcgaacctagaacagctgtccttggatcacaacaatattgagaacctaccactccaactttttctgtgtactaaattgcattacctagatctgagttataatcatcttactttcatcccggaggaaatacagtacctctcgaatctccagtatttcgccgtaacaaataacaatatcgagatgctgcccgacggcctattccagtgtaaaaaactccagtgcttacttctagggaagaacagtttgatgaacttgtccccccatgtgggtgagctgtccaacctgacccacctcgagcttatcggcaactatttggagaccctgcccccggaactcgagggttgccaaagcctaaaaaggaactgtctgattgtggaggaaaacttgctgaacactctgcctttaccagtgaccgagcgtcttcagacctgtctggataaatgctag

SEQ ID NO: 122118 - DNA, 2412 bp, Artificial Sequence
  Description of Artificial Sequence: Synthetic coding sequence
atgataacgctgactgagctaaagtgcttagcggatgcccagagctcgtatcatatattaaaaccatggtgggacgtgttttggtattacatcacattaataatgctgcttgtcgcagttctggccggtgcactgcagctcacccagagtcgcgtgctatgttgccttccctgcaaggtggagttcgataatcattgcgccgtaccctgggacatattgaaagctagcatgaatacaagctctaatccaggcacacccctacctttgcccctaaggattcaaaatgacctccaccgccaacagtatagttacattgacgctgtgtgttatgagaagcagctgcactggttcgctaaattctttccgtacttagtacttcttcatacactcatatttgccgcttgcagtaacttctggcttcactacccaagcacctcatccaggttggaacacttcgtggctatccttcacaaatgcttcgactcaccttggaccacacgggccctgtctgagaccgtggctgaacagagcgtgcggcctctcaagctgagtaagagtaagattctgctgtcatctagcggctgttcagccgacatagactccggtaagcagtccctgccatacccccaacccggactggaaagcgctggcatcgaatcgcccacctcatctgtgctcgacaagaaagagggggagcaggcgaaggcaatcttcgaaaaggtgaaacgcttcagaatgcatgtggagcaaaaagacattatttatcgtgtttacctgaagcagataattgttaaggtcatcctgttcgttcttataatcacctacgtgccgtatttcctgacacatatcacactcgagattgactgttctgtcgacgtccaagccttcacaggctataaaagatatcagtgcgtgtatagtctggccgagatcttcaaggtactggcttcattttacgtgatcctagtgattttgtatggcctgacctcctcttactccctgtggtggatgctgcgctccagcctcaaacagtactcttttgaagcgttgcgggagaagagcaattatagcgacatccctgatgtgaaaaacgacttcgcctttatcctgcacttagcggaccaatacgatcctctatactccaaacgcttcagtatctttctgtccgaagtgtctgaaaacaagctaaagcagattaatctgaataatgaatggaccgtggagaagctcaaatctaaactggttaagaacgcccaggacaagatcgagctccatctcttcatgctcaacggactgcctgacaacgtcttcgagctgaccgagatggaggtactctcactcgagctcataccagaggttaaattaccatcggccgttagccagttagtgaacttaaaggagctgagggtctaccatagctccttagtggtggaccaccctgctctagcatttctcgaggagaatctgaaaatcttgcgccttaagttcaccgaaatgggaaagattccgcgctgggtgttccacttgaagaatctgaaggagttgtacttaagtggttgtgtcctcccagaacagctgtcaactatgcagttggagggctttcaggatcttaagaatctgaggaccctctacctcaagtctagcttgagcagaatccctcaggtggtcaccgatctcttaccctcactccagaaattgtccctggacaatgaaggcagcaagttggtggtactgaacaacctaaaaaagatggtgaacctgaaaagtcttgagctgatcagttgcgatttggagaggatccctcattccatcttttcactcaataacctccacgagttagatctgcgggaaaacaatctgaaaactgtggaagaaataatatctttccagcacctccagaatctgtcgtgcctcaagctgtggcacaataatattgcttatatcccagcccagatcggagcgctgtccaacctcgagcagttgtccctggaccacaacaacatcgagaatctcccgctgcagctttttctgtgcaccaagctccattatctcgacctgtcctacaatcatctcactttcatccccgaggaaattcagtacctcagcaacttgcaatacttcgcagttaccaacaataacatagaaatgctgcctgacgggctatttcagtgcaagaagcttcagtgtctgttgctcggtaagaacagcctgatgaatcttagcccacatgtgggggagttaagtaacttaacacacttagagctgatcggcaactacctggagacacttccacccgagctcgaggggtgtcagagtctcaaacgcaattgtttaattgtggaggagaacttgctgaataccttacctctgcctgtgacagagcggctgcaaacttgcctcgacaagtgttag

SEQ ID NO: 122119 - DNA, 312 bp, Artificial Sequence
  Description of Artificial Sequence: Synthetic coding sequence
atgattacccttaccgaacttaagtgcttagcagacgcccagagctcttatcacatcttaaagccctggtgggacgtattctggtactacattaccttgattatgttgctggtagcagttttggcaggggcattgcagctgacgcagtcccgggtcctttgttgcctgccttgtaaagtcgaatttgataaccactgcgccgtcccctgggatatccttaaagcttccatgaataccagctctaaccccggaaccccgttgccattacctctcaggatccagaatgacctacatagacagcaatatagctag

SEQ ID NO: 122120 - DNA, 693 bp, Artificial Sequence
  Description of Artificial Sequence: Synthetic coding sequence
atgattaccctgaccgagctgaagtgtctggctgacgcccaatcctcctaccatattcttaagccatggtgggacgtcttctggtactacattacgttgattatgctgctagtcgccgtcctggcaggagctttgcaactgacccagtcgcgtgtcctgtgctgccttccctgcaaggttgagttcgataatcactgcgccgtgccttgggacattcttaaggcgtccatgaacactagctctaacccggggacccctttgccattgccattacgtatccagaatgatctccaccgccagcagtattcctatatcgacgccgtatgttacgaaaagcagctgcactggtttgccaaattcttcccgtatctggtgcttctccacacactgattttcgcggcctgctctaacttctggctgcattatcctagcactagctcccgactagaacactttgtggccatcctccacaagtgttttgactccccgtggaccactcgcgccctctccgaaaccgtcgcagagcagtccgtgcgcccgttgaaattgtccaaatccaaaatcctgctgtcctcctccggatgctctgccgatattgactctggcaaacagtctctcccttatccgcagcctggtctagaatcagcagggatcgagtctcctacgtcaagcgtcctgacagagggagggtag

SEQ ID NO: 122121 - DNA, 2412 bp, Artificial Sequence
  Description of Artificial Sequence: Synthetic coding sequence
atgatacctgtaacagagttccgccagttctctgaacaacagcctgcgttcagagtgctgaagccctggtgggacgtgttcaccgactacttatctgtagctatgctgatgatcggggtgtttggctgtactctgcaagtaatgcaggataagattatttgtctgccaaaaagagttcagcccgcccaaaaccatagcagtctctcaaatgtctcccaggccgtggccagcacaactcctttgccccctccaaaaccaagcccggccaacccaatcaccgttgaaatgaagggccttaaaaccgacctcgacctgcagcaatacagcttcataaatcagatgtgttatgagcgcgctcttcattggtatgcaaaatatttcccatacctggtcctgatccacactctggtgtttatgctttgttcaaacttctggtttaaatttcccggctcgagtagcaagatcgagcactttatttccatcctcggaaagtgctttgactccccttggactaccagagcgctgagcgaggtatctggcgaagatagtgaggagaaagataatcggaagaacaacatgaacagaagcaataccatccagtccggaccagaggactccctggtaaactcacaaagcctcaagagcatccctgaaaaatttgtggtggacaaatccacagctggggcactggacaagaaggagggcgagcaggccaaggccctgtttgaaaaagtgaaaaaatttaggttgcatgtcgaggaaggcgacattctctatgccatgtacgtacggcagaccgttctcaaggtgattaaattcctaattatcatcgcgtataactctgcacttgtgagtaaagttcagttcaccgtggattgcaatgtggacatccaggatatgactggttacaagaatttttcttgcaatcacacaatggcacacctcttcagtaagctgtccttctgctacctctgctttgtctcaatctacggattaacatgtctctataccctgtattggctgttttaccggtcccttagggaatactccttcgagtatgtgagacaggagaccggaatcgacgacataccggacgtaaagaacgatttcgcgtttatgctacatatgatagaccagtatgaccctctgtattccaaaaggttcgccgtgttcctatccgaggtaagcgagaataaactcaaacagttgaatctgaataacgaatggactccagataagctgaggcaaaagcttcaaaccaacgcccataaccggctcgagttacctctcataatgctatctgggctgcctgataccgtgttcgagataaccgaacttcaaagtctgaagctggaaattattaagaacgtaatgatccccgcgactatcgcccaacttgacaatctgcaggaattaagcctgcaccagtgtagtgtgaaaattcattccgccgccctctcttttctcaaagaaaatctcaaggtgctttcagtcaaattcgatgacatgcgagagctgcccccatggatgtacgggttacgcaacctggaagagctttacctggtgggatcattgtctcacgatatctcaaggaacgtcaccctggagtctttgagagacctgaaatcattaaagatcttatcaatcaagtcgaacgtcagcaagatccctcaggcggtggtagacgtctcctcccacttgcagaaaatgtgcatccacaacgacggtaccaagctggttatgctgaacaacctgaaaaaaatgacaaacctcacagagctcgagctagtccactgtgatctcgaacgcatccctcacgctgtgtttagcctcctgagcctgcaggaactggacctgaaggagaataatctgaagagcatcgaggaaatcgtgtccttccagcatcttcgaaagctcaccgtgctgaaattgtggcataactctattacctacatacctgaacatataaagaaattgacctcccttgagcgcttatctttctcccataacaagatcgaggttttaccctctcacttattcttatgcaataagataaggtacctggatctcagttacaatgacattaggttcattccccctgaaatcggcgtgctgcaatcattacagtatttttctatcacctgcaataaagtcgaaagtctgccagatgagctatacttttgcaagaagctgaaaacgcttaagattggcaagaactctctgagtgttctctccccaaaaattggcaatttactcttcctgagctatctagacgtgaaaggcaatcacttcgagatactacccccagaattaggcgactgtcgggcacttaagcgggccgggctggtggtggaggatgcactgttcgaaacactgccatcggacgttcgtgagcaaatgaagacagaatag

SEQ ID NO: 122122 - DNA, 2577 bp, Artificial Sequence
  Description of Artificial Sequence: Synthetic coding sequence
atgtttactttggcagaggttgcgagtctgaacgatatccagcccacatatcgcatcctcaagccatggtgggatgtttttatggattacttggccgtggtgatgcttatggtggccatattcgctgggaccatgcaactgacgaaggaccaagtggtctgtctgcctgtcctgccaagtccagtcaattctaaggcccatacccctcctggtaacgcagaagtgaccacaaatatcccgaagatggaggccgccacaaatcaagaccaggatggaagaactaccaacgatattagttttggaaccagcgcggtcactccggacattcccttaagggcaacatatccccgcaccgattttgcgcttccaaatcaagaagctaagaaggaaaagaaagacccaacaggacgtaagacgaatctcgattttcagcagtatgttttcatcaatcagatgtgctatcatttggctctaccctggtactccaagtattttccttacctggctcttatccacaccatcattctcatggtttccagtaatttctggttcaagtacccaaaaacttgctccaaggtggagcatttcgtaagcatccttggaaagtgtttcgaaagcccctggaccactaaagctttgagcgagacagcttgcgaagattcagaagaaaataagcaacggatcactggagctcaaactctgcctaaacacgtgtccacttcctccgacgagggctcaccttcagcctcgacgcctatgatcaacaagacaggattcaaattttccgccgagaaacctgtgattgaagtaccgtccatgaccatcctggataaaaaagacggagagcaggctaaagccttatttgagaaggtgagaaagtttcgagcccatgtggaagatagcgacttgatatataagctttacgtggtgcagaccgtcatcaagaccgcaaaattcattttcatcttatgctacaccgccaattttgtaaacgccatctcattcgagcacgtgtgtaaaccaaaggtcgaacacctgattggatacgaggtctttgaatgcactcataatatggcttatatgttaaaaaaattattgatctcttatatcagcatcatctgcgtgtacggcttcatatgcctgtacactctgttttggctgttccggattccacttaaagaatactccttcgaaaaggtacgcgaggaatcgtccttctcggacatccccgatgttaagaacgatttcgcgttcctgttgcatatggtggatcagtacgaccagctgtatagcaaacggttcggagtttttctgtctgaggtttccgagaataagctgcgagaaatatcccttaaccacgaatggacgtttgaaaaacttaggcagcatattagccggaacgcccaggacaaacaggagctgcacctttttatgcttagcggagttccagacgccgtgttcgacctaactgacctggacgtgttgaagctcgaactgatccctgaagccaagattccggcgaagataagtcaaatgacaaacctacaggagctgcatctgtgtcactgtcctgcaaaagtcgaacaaacagctttcagtttcctcagagaccatttgcggtgtctgcatgtaaaattcactgatgtagccgagattcccgcctgggtctatctactgaagaatttacgcgagctgtatttaattggcaacctcaattccgagaacaataagatgatagggctcgagtctctcagggagctgcggcatcttaaaatccttcacgtcaagagtaatcttaccaaggtgccaagtaatattacagatgtcgccccccacctaacaaaacttgtaattcataacgacggaacaaaacttcttgtgctgaactcactgaagaaaatgatgaatgtggcagagttagagctccagaactgtgagttggagcgaataccgcatgctattttctctttgagcaacctacaggaactggatctgaagagcaataatattcggaccattgaagagattattagcttccagcatcttaagagactgacttgcctgaagctgtggcacaacaagattgtaacaataccgccctcaatcacccacgtcaaaaacctggagtctctgtatttctccaacaacaaactggagtcacttccggtagcagtgttttctctccagaaactccgctgcctggatgtgagctacaataatattagcatgatccccatcgagattggactgctgcagaacctgcagcacttgcatattaccggtaacaaggttgatatactcccaaaacagctgtttaagtgcattaagctgagaaccctgaaccttggccaaaattgcatcacttcactgccagaaaaggttggccagctcagccagctcacccagctcgagctgaagggaaactgtctggaccggctgccagcccagctggggcagtgtagaatgctcaaaaaatccggcttggtggtggaagaccatctgtttgatacccttccactggaggtgaaggaagcactcaatcaggatataaatatcccatttgcaaacggtatctag

SEQ ID NO: 122123 - DNA, 2577 bp, Artificial Sequence
  Description of Artificial Sequence: Synthetic coding sequence
atgttcacactggccgaagtcgcaagtctgaatgatattcaacctacgtacagaattctgaagccctggtgggacgtgtttatggactacctagcagtcgttatgctgatggtagccatttttgcaggaacaatgcagctgacaaaggatcaggttgtgtgtctgcctgtactgcccagcccagtgaattcaaaagctcacacaccaccaggcaatgctgaagtgaccaccaatatccctaagatggaagcagcaaccaatcaagaccaggatggacgaactaccaatgatatttcctttggaacctctgccgtgacccccgatatcccactgcgggccacttacccccggaccgacttcgcgctgcccaatcaggaagccaaaaaagagaagaaggatccaacaggtcggaagactaacctggactttcagcagtacgtttttattaatcaaatgtgttatcaccttgcattaccttggtactccaagtacttcccctatttagctcttatccataccatcattctgatggtttcatctaatttttggtttaagtaccccaagacttgctccaaagtcgagcatttcgtgagcatcctcggcaaatgttttgagtccccctggactacaaaagctcttagtgaaactgcatgcgaggactccgaggagaacaaacaaagaattaccggggcacagacactccccaaacatgtcagcacttccagtgacgaaggctctccgagtgcttctactcccatgattaacaagactggttttaaattcagcgctgagaagcccgtgatcgaggtgccttctatgaccattttagataaaaaagacggagaacaggccaaggccttatttgagaaggtgcgaaagttccgtgcgcacgtagaggattccgacctaatatataagttgtacgtggtacagacagtgattaaaacggcaaaattcatctttattctgtgttataccgcaaattttgtgaatgccatctcctttgagcatgtctgtaagcccaaggttgagcatctcattggatacgaggtgttcgagtgcacccataacatggcgtatatgctgaagaaactgttgatctcctacatttctattatctgcgtgtacggctttatttgcttgtatacccttttctggcttttccgcatccccctcaaagagtattcctttgaaaaggttcgggaagaatctagtttctccgacattccagatgttaagaacgatttcgctttcctgctgcacatggtagaccagtatgaccagctgtacagtaagcgcttcggagtctttctcagcgaggtgagcgaaaataagctaagggagattagcctgaatcatgaatggacctttgagaaactaagacagcacatctcccgaaacgcccaggataagcaggagctacatcttttcatgctgtcgggagttcccgacgctgtgtttgacctcaccgatctggacgttctgaagctcgaacttatccctgaggcgaagataccagctaaaatctcacagatgactaatttgcaggagttgcacttatgccactgtccagccaaggtggaacagacagccttctcctttctgagggatcacctccggtgcctccatgtaaagtttacggacgtggcagaaatcccagcctgggtgtacctcttaaagaatttacgcgaactctacctaatcggaaacttgaactcagaaaataataaaatgatcgggctggagtccctgcgcgaacttcgacatcttaagatcctacacgtgaaatcgaatctgaccaaggtcccgtctaacatcaccgatgtagcccctcatctgaccaaactggtgatccataacgacggaacaaagttgctggtgctcaactcactgaagaagatgatgaatgtggcggaacttgaactacagaactgcgagctggaacgaattcctcacgctatcttttcgttgtctaatctgcaagagttggacctgaagtcaaataatattagaactatcgaggagatcatctccttccagcatctgaagcgccttacttgtctgaagctctggcacaataagattgtcacgatcccaccctctattacacatgtgaagaaccttgaaagcttatattttagcaacaataaactcgagtctctgcccgttgcagttttcagcttgcagaagctcagatgtcttgacgtgtcttacaacaacattagtatgatacctatagaaatcggtcttctccagaaccttcagcacttgcacatcactggaaataaggtggatatcttgcctaagcagctcttcaagtgcattaaactgcgcacactgaacctgggacagaattgtattaccagcttgcccgaaaaggtggggcagctgtcacagctcacccagctggagcttaagggaaactgcctggaccggctgcccgcgcagctcggacagtgccggatgttaaagaagagcggactggtcgtcgaagaccacctgttcgataccttaccgctggaagtcaaggaagccctaaaccaagatattaatatcccatttgctaatggcatctag

SEQ ID NO: 122124 - DNA, 354 bp, Artificial Sequence
  Description of Artificial Sequence: Synthetic coding sequence
atgttcacacttgcagaggttgcgtccctgaacgatattcagcccacctacaggatactgaaaccgtggtgggatgtgttcatggattacctcgctgtcgttatgttgatggtagccatctttgcgggcacaatgcaacttaccaaggaccaggtggtttgcttgcccgtgcttccttcacccgttaactctaaagcacatacacctccaggcaacgcagaggtaacgactaatattccaaaaatggaagccgccactaaccaggatcaggatgggagaacaaccaacgacatctccttcggtacgagtgctgtcacacctgacattccattgagagccacctaccctcgttag

SEQ ID NO: 122125 - DNA, 825 bp, Artificial Sequence
  Description of Artificial Sequence: Synthetic coding sequence
atgtttacactggccgaagtggcaagcttgaatgatatccagccaacttatagaattctgaagccctggtgggacgttttcatggactatttagcagtggttatgttgatggtggccatatttgctggtacaatgcagctcacaaaggatcaagtcgtttgcctgcctgtccttccctcccccgtgaactcaaaggctcacactccccctggaaacgctgaggttacaaccaacatcccaaaaatggaggccgctaccaatcaagaccaggatggcagaacaacaaatgacataagtttcggcacaagcgctgtcacgcctgacatccccctccgagccacgtatccacgaacagacttcgctctgccaaaccaggaggccaagaaggagaaaaaggaccccacgggacgaaagaccaacctcgacttccagcagtatgtgttcatcaatcagatgtgctatcatctggcattgccatggtattctaaatattttccatatctggccctaattcacacaataattctgatggtttctagcaacttttggtttaagtatccgaagacatgctctaaggtggaacacttcgtgtcaatccttggcaagtgctttgagtcaccatggacaacgaaagctctgtcagaaaccgcttgtgaggattctgaagagaataagcagagaattactggcgctcaaactctgccaaaacacgtgtccacttcctccgacgagggctctccttctgcctctacaccgatgattaacaaaacaggtttcaaattttcagccgagaagcctgtcatcgaagtgccttctatgacatag

SEQ ID NO: 122126 - DNA, 96 bp, Artificial Sequence
  Description of Artificial Sequence: Synthetic coding sequence
atgttcacactggccgaagtggcttcgctgaacgatatccagccaacttacagaatcctaaaaccttggtgggatgtgttcatggactacctgtag

SEQ ID NO: 122127 - DNA, 564 bp, Artificial Sequence
  Description of Artificial Sequence: Synthetic coding sequence
atgtttacgctggcagaggtcgccagtctgaatgatatccagcccacttatagaatcctgaaaccatggtgggacgtgtttatggactacctggcggtagtcatgctgatggtcgctattttcgccggcactatgcagttgacaaaggatcaggttgtgtgtctgcccgtccttcctagcccggtgaacagtaaagcccatacgccccctggaaacgctgaagtgacaaccaacatccccaagatggaagccgctaccaatcaggaccaggatggacggacaaccaatgacattagcttcggcacatcagccgtgactccagatattcccctgagagcaacgtaccccaggacagactttgccctccctaaccaggaagctaagaaagaaaaaaaggaccccaccgggcgcaagaccaacctggactttcagcagtatgtctttattaaccagatgtgctaccacctggccctgccctggtactcgaagtatttcccgtatctcgcactgattcacaccattatcttaatggttagcagtaacttctggttcaaatacccgtag

SEQ ID NO: 122128 - DNA, 369 bp, Artificial Sequence
  Description of Artificial Sequence: Synthetic coding sequence
atgttcaccctcgctgaggtagccagtttgaatgacatccaacctacctatcgtatactgaagccctggtgggacgtttttatggactacctggcggtcgtcatgctgatggtggctatttttgcaggaactatgcagctgacaaaggaccaggtggtatgtctgcccgttctcccctccccagtgaactctaaggcacacacccctccgggcaacgcggaggtgactaccaacattcccaaaatggaagcagcaaccaatcaggatcaggacggaagaactacgaatgatatcagtttcggcacctccgcagtgactcctgacataccactgagagcgacttatcctcggaccgacttcgccctgtag

SEQ ID NO: 122129 - DNA, 2391 bp, Artificial Sequence
  Description of Artificial Sequence: Synthetic coding sequence
atgattcctgtggccgaattcaaacagttcaccgagcaacagcctgcttttaaagtgctcaagccctggtgggatgttctcgccgagtatctgactgtcgctatgctgatgattggagtcttcggatgtacattgcaggtcacccaggataagatcatatgcttgcctaaccatgagctgcaagagaatctctctgaggccccctgtcagcagctactgccacgcggcataccagaacagatcggcgccctccaggaggtcaaaggattaaagaataacttggacctccagcagtactcctttatcaaccagctatgctatgagaccgcccttcactggtatgcaaaatacttcccctacttggtggtgatccacacactgatcttcatggtgtgcaccagcttctggtttaagttcccaggtacgtcaagcaaaatcgagcactttatttcaattctgggcaagtgtttcgactctccatggaccaccagggccctgagcgaggtctccggagaaaatcagaaggggcctgccgctacagagagagctgctgctaccattgtggctatggcaggaaccggacccgggaaggcgggagagggggaaaaggaaaaggtgctggctgaaccggagaaagtcgtgacggaaccacctgtggtgacactgctcgacaagaaagaaggcgagcaagcaaaggctctgtttgagaaggtgaagaagttccgcatgcatgtggaagagggcgacatactgtacacaatgtatatccgccagaccgtcctgaaggtatgtaagtttttagcaattctggtttacaaccttgtatacgtggaaaaaatcagttttcttgtggcctgtagagtagaaacttcagaggtcacaggctacgccagtttctgttgcaaccatacaaaagcccacttgttttctaagctggctttttgttacatctcttttgtttgcatttatggccttacttgtatctacacactgtactggctctttcaccgccccctcaaggagtacagttttagatcagtgcgcgaggagacaggcatgggggacatccccgacgtgaaaaacgacttcgcttttatgcttcatttgatcgatcagtatgattctctctactctaaaaggtttgctgtgttcttgagcgaagtcagtgaaagccggttgaaacaactaaacttgaatcatgagtggacaccagagaagctgaggcagaaattgcagcgaaacgctgccggacggctcgagctggctctgtgcatgctgcctggtctgcctgacactgtgttcgaactgtcagaagtggaatctctacggctagaagcgatttgcgacattacgttcccacccggattgtctcagctcgtacatctccaggagttgagcctcctacatagccctgctaggctgccctttagcttgcaggtgttcttaagagaccacctgaaggtgatgagggtcaaatgtgaagagttacgcgaggtgcccctttgggtattcggtcttcggggcctcgaagagcttcatctcgagggcctgtttccccaggagctggccagggccgccactctggaatctctccgcgagctgaagcagctgaaggtgttatcactgcgttcaaacgcaggtaaagtgcctgcatctgtgacagatgtggctggtcatttacagcgcctgagcctccacaacgatggcgcccggctggtggctctaaactcattgaagaaactggcagcactccgcgaacttgagttggtggcctgtggacttgagcgcatccctcatgccgtgttctctctcggggctctgcaggaactggatctgaaggacaaccacttgagaagtatcgaggaaattctgtcttttcaacactgtcggaaacttgtgactctgagactttggcacaaccagattgcttacgtgcctgaacacgttcgcaagctacgcagccttgagcagctgtacctctcatataataaactcgaaactctgccttcgcaattaggtctctgttcaggactgcgactgctcgacgtgtcacacaacgggctgcactcactgccaccggaagttggactcttacaaaacctccagcatctggctctgtcgtacaatgctctcgaggctctccctgaggaactgtttttctgcaggaaacttagaacactactgctgggcgacaatcaattatcccagctgagcccacatgttggcgctctgcgtgccttatcgcgtcttgaactcaagggaaataggctggaagctctgccagaggagttggggaattgcggcggcctaaaaaaggcgggtctcctcgtcgaagacaccctctaccagggtcttcccgccgaagttcgggacaagatggaagaggaatag

SEQ ID NO: 122130 - DNA, 1569 bp, Artificial Sequence
  Description of Artificial Sequence: Synthetic coding sequence
atggatttcctgttactgggtctatgcctctactggctcttgagacgaccgtccggggtcgtcctttgtctgctcggagcttgcttccaaatgttacctgccgcacctagtggctgcccccagctgtgtcggtgcgaaggccgccttctttactgtgaggccctcaacctcacagaagcccctcacaatctgagtgggcttctgggcctctcgctgagatataattcactgtcggagttgcgggctggtcagtttacagggttgatgcagttaacctggctataccttgaccataaccatatttgttcagtccagggcgatgcctttcaaaaactgcggcgagtcaaagagctcacgctttcctcaaatcagattacacagctgcccaacactacttttagacctatgcccaatctgcgtagtgtggacctttcatacaataaactccaggccctggcccccgatctattccatggtctgaggaagctgaccaccctccacatgcgcgccaatgccatccaatttgtgcccgttcggatcttccaggattgtaggtcactcaaatttctggatatagggtacaatcagctaaaatccttggcacgaaatagcttcgccggcttattcaagctgactgagcttcacctggagcataatgatctggttaaagtgaattttgcccattttccccgtctgatttccctacactcactgtgcttacggaggaacaaggtagcgatcgtggtctctagcctggattgggtgtggaacctggaaaaaatggacctcagcgggaacgagattgaatacatggaaccccacgtctttgagaccgtccctcacctgcagtcccttcagcttgatagcaaccgtctcacctatatagagccaaggatcctgaattcttggaaaagcctaaccagcattacccttgcaggcaatctttgggattgcggtcggaacgtttgcgccctggccagctggctgaataatttccagggtagatacgatggaaatttacagtgcgcatccccagagtatgcacagggagaggatgtcctggatgctgtctatgccttccacttgtgtgaagatggagctgaacccactagtggccacttgctctcggctgttaccaaccgaagtgatctgggcccccctgcttccagcgctacaaccctggctgacggcggcgagggccaacatgacggaacattcgaacccgccaccgttgctttgcccggtggtgaacatgccgagaatgcggtccagattcacaaggtggtcacaggcactatggcccttatattttcattcttgatcgtagtgctcgtgctttacgtgtcctggaaatgttttccggcatctttgcgccagctgaggcagtgctttgtgacccagcggcgcaagcagaaacaaaagcagacaatgcatcagatggcagcgatgtccgctcaggagtactacgtggactataaacctaaccacatagagggagcccttgtgatcattaacgagtatgggagctgtacctgtcaccaacagccagctcgcgagtgcgaagtgtag

SEQ ID NO: 122131 - DNA, 1569 bp, Artificial Sequence
  Description of Artificial Sequence: Synthetic coding sequence
atggattttctgctgctagggttgtgcctgtactggttgctaaggcgccctagcggcgtagtgctctgcctcttgggggcatgtttccaaatgttaccagccgctccatcagggtgccctcaactgtgtagatgcgagggaagattgttgtactgcgaagcactgaatctgacggaggccccccataatcttagcggccttctcgggctgagtctgcggtataacagtctcagcgagcttcgggccggtcaattcactggactaatgcagctgacatggctttatctagatcataaccacatctgcagcgtgcagggcgacgccttccagaaattaagacgcgtcaaagagctaacactctcttccaatcagattactcagctcccaaatactactttccggcctatgcctaacctcagaagcgtggatctttcttataataagctccaggcccttgctcctgatttgttccacggtctaagaaaacttaccaccttgcacatgagggctaatgccatccagtttgtgccagtgcgcatttttcaggactgtaggtctctcaagttcctcgatatcgggtacaaccaactgaagagtctggctaggaactcctttgctggtttatttaagttaacagagctgcatctggaacacaatgacctggtgaaggtcaacttcgcccactttcccagacttatctctctgcattctttgtgcctccggagaaacaaggtggcgatagtggtgtcctctctcgattgggtgtggaacctcgaaaaaatggatctatccgggaacgagattgagtacatggagccacacgtgttcgaaactgtcccccatctgcagagtttacaactcgattcaaacaggctgacttacatagaacccaggattctgaacagttggaagagcctgacaagtatcactctggcaggaaatctatgggactgcgggagaaacgtttgtgctctggcttcctggctgaataattttcagggacgttacgacggcaacctacagtgtgcatctccggaatacgcccagggagaagatgtgttggatgccgtgtacgccttccacttatgcgaggacggggcagagccaacctcgggccatcttctgtctgctgtcactaatcgatccgatcttggccccccagctagttccgctaccaccctggctgatggcggtgaagggcagcatgacggcacatttgagccagcaacagttgccttaccggggggtgaacatgctgaaaatgccgtgcagatccacaaagtagtgactggaactatggctcttatcttcagctttcttatcgttgttctcgtcctgtatgtcagctggaagtgctttcccgcaagcctccgccagcttaggcagtgctttgtgacacaacgcagaaaacagaagcaaaaacagacaatgcaccagatggcagctatgagtgcccaagaatattacgtcgactacaagccgaaccatatcgagggggctctggtcataatcaacgagtatggatcctgcacctgtcaccagcagccagcccgcgagtgcgaagtttag

SEQ ID NO: 122132 - DNA, 330 bp, Artificial Sequence
  Description of Artificial Sequence: Synthetic coding sequence
atggatttcctattgctcgggctgtgtctgtactggctgttacggcggccgtccggggttgtcctctgtctgctcggggcctgcttccagatgctcccagcagcaccctctgggtgcccacagctgtgccgctgcgaaggacgcctgctctactgtgaagccttgaacctcacagaagctcctcataatctcagtggactgctgggcctgtccttgcggtataacagtctctcagagctccgagcgggacagtttaccggcctgatgcagttgacctggctgtacttggatcacaatcatatctgctcagtccagggtgatgcattctag

SEQ ID NO: 122133 - DNA, 672 bp, Artificial Sequence
  Description of Artificial Sequence: Synthetic coding sequence
atggattttctgctgcttgggctctgcctctactggctcctgcgacgccccagcggagtggtgctctgcctgctgggagcatgtttccagatgctcccggccgcaccgtccggctgccctcagctttgccggtgcgaaggcaggctcctttactgcgaggctttgaacctgaccgaggctccccacaacctgtccggcctgctggggctctcccttcgttataactccctgagcgaacttcgtgctgggcaattcacgggcctgatgcagctgacatggttgtatctggaccacaaccatatttgctcggtgcagggggacgcgttccagaaactgcggagggtcaaggaactgaccctctccagtaatcaaattacccagctaccaaatacaactttcagaccaatgcctaacctcagatcggtcgaccttagctataacaaactgcaggccttggcccctgatttattccatggcctccggaagctgaccactttacatatgagagcaaatgcgattcagtttgtgccggtgcgaatatttcaggactgtagatccttgaagtttctggacattgggtacaaccagctaaaatcattagctcggaacagcttcgctgggttgtttaaactgacagagctgcacctggaacacaatgatctcgtgaaatag

SEQ ID NO: 122134 - DNA, 1569 bp, Artificial Sequence
  Description of Artificial Sequence: Synthetic coding sequence
atggacttccttctgctcgggctgtgcctctattggttactgaggagacccagtggcgtcgtcctgtgcctgctgggcgcatgcttccagatgctccctgctgccccctctgggtgtccccaactctgtcgatgcgaaggcaggttgttgtactgcgaggctctgaacctcacagaggctccccataacctctccggcttgctcgggctctctcttaggtataacagtttatcagaactgcgagcaggacaattcaccggcctcatgcagctgacctggctgtatctcgatcacaatcatatatgtagcgtgcaaggcgacgctttccagaaactgcgtagagtgaaggagctgacgcttagttctaaccaaataacccagctccctaatactaccttccggcctatgccgaatcttaggtcagtcgacttatcatacaataaacttcaagctcttgctccagacctgttccacggactaaggaaactcaccactctgcatatgcgcgccaacgccatccagtttgtgccagtccgtattttccaggactgccggagcctgaagttcctggacatcggttacaaccagctgaaatccttagccagaaactcgttcgccggtttattcaaactgacggagctccatcttgagcacaacgatctggttaaagtcaacttcgctcattttccacgtctcatctccttacattcactctgcttgaggcggaataaagtcgctatcgtggttagttcccttgactgggtgtggaacctcgaaaagatggacctgtcaggaaacgagatcgagtacatggagccgcacgtgttcgagaccgtcccccacctccagagcctgcagttagacagtaatcgattaacctacattgagccacgcattcttaattcttggaagtctctcacaagcatcaccctggcaggcaatctgtgggactgtggccgcaacgtttgcgccctagcctcttggctcaacaactttcagggccgttatgatggaaatctccagtgcgcgagcccagaatacgctcagggagaggacgtcctagatgctgtgtatgcattccacttatgtgaggacggcgcagagcctacgtcggggcacttgctaagtgccgtgaccaaccgatccgatctggggcctcctgccagcagcgccaccacacttgccgatggtggagaaggtcagcacgacggcaccttcgaacctgctacagttgccttgcctggtggggagcacgcggaaaacgccgttcagattcacaaagtcgtcaccggcaccatggcattgatattttcattcctgattgtagtgctcgtgttgtatgtgagctggaagtgctttcccgcatctctacggcagttacgccaatgcttcgtgacccagagacgaaaacaaaagcagaagcaaaccatgcatcaaatggcggctatgtctgcccaggaatattatgtggattacaaaccaaaccacattgagggggccctggtcattattaatgaatatggttcctgtacctgccaccagcagcctgctcgtgagtgtgaagtgtag

SEQ ID NO: 122135 - DNA, 1569 bp, Artificial Sequence
  Description of Artificial Sequence: Synthetic coding sequence
atggacttcctgcttctgggcttgtgcctatactggctgctaaggagacccagcggagtcgtcctttgtttactgggggcttgctttcagatgttgccagcggccccttctggatgtccccagctatgccgctgcgaggggcggctactgtactgtgaagccctgaacctgaccgaggcaccacacaatctcagtggtttgcttggcctgagccttaggtacaattcgctgtctgaactgcgggctggacagttcacaggccttatgcagctcacgtggctgtatttagatcataatcatatttgtagtgtccaaggcgacgcattccagaagctgagaagggtgaaggagctcacgttgtcatctaatcaaattacccaactgccaaatacgacatttaggcctatgcccaatttgagatccgtcgacctgtcgtataacaagctgcaagctctggctcccgatctgtttcacggtctgcgaaaactgacaaccctgcacatgagagcgaatgctattcagtttgtccctgtgagaatttttcaggactgccgctctctcaagttcctggacattgggtacaaccaattgaaatccctggctcgcaactcttttgccgggttgtttaaacttaccgagttgcacctcgaacacaatgacctcgttaaagtgaacttcgcccattttcctaggctgatctctcttcatagcctttgtttaagaagaaacaaggtggccatcgtcgtgtcaagcttggactgggtctggaacctggaaaaaatggatctgtccggaaacgagatcgagtacatggaaccacacgtgttcgagactgtgcctcacctccagagcctccagctcgattcaaaccgactcacttatatcgagccccgtatcctgaattcctggaaaagcctcacatccatcacattggctgggaatctgtgggattgtggccggaatgtgtgcgccctcgcatcatggctaaataattttcaagggcgatatgacggtaatcttcagtgtgcctcaccagagtacgcccagggcgaggacgttctcgatgccgtgtatgcgttccatctgtgtgaggatggtgccgagcctacttccggccatctactgtcagctgtgacgaatcgcagcgacttgggccctccagcttcgagtgccacaacgctagctgatggcggagagggacagcacgacggcacctttgaacccgctaccgttgccttgcccggcggcgaacacgccgagaacgccgtacaaattcacaaggtcgtgacgggaactatggcactgatcttctccttccttattgtcgttttggtgttatatgtctcatggaaatgtttccctgcaagcctccgtcaactcagacagtgtttcgtgacacagcgccggaagcagaagcagaaacagaccatgcaccagatggccgcaatgtccgcacaggaatattacgtcgactacaagcctaaccacatcgagggggccctggtgatcattaacgaatacggctcctgcacatgccaccagcagcctgcccgtgagtgtgaggtctag

SEQ ID NO: 122136 - DNA, 552 bp, Artificial Sequence
  Description of Artificial Sequence: Synthetic coding sequence
atggatttccttctcctcggcctgtgcctgtactggctactgcgccgcccatccggagtggtcctctgcttactgggagcatgctttcagatgctgccggcggcaccatccggctgtcctcaactgtgccgctgtgagggaagattgctctactgcgaagcactcaacttgacagaggccccccacaatctgagcggactgttagggcttagtctgagatacaattcactgagtgagctgagggcaggtcagttcacaggtttgatgcagctgacctggctctaccttgaccacaatcatatctgttcggtgcagggagacgcattccagaaattaagacgggtgaaggaactgacgctcagctccaatcagatcacccaattgccaaacacgacctttaggccaatgcctaacctgaggtcagttgacctcagctacaacaagttacaggctttagcgcccgatctcttccacggtcttagaaagctgaccaccctacatatgcgagccaacgcaatacaatttgtccccgtcaggatttttcaggactag

SEQ ID NO: 122137 - DNA, 1551 bp, Artificial Sequence
  Description of Artificial Sequence: Synthetic coding sequence
atgggtttgcacttcaaatggccccttggtgctcccatgctggccgccatctacgctatgtccatggtgctgaaaatgctgcctgccctgggaatggcgtgcccgcccaaatgcaggtgcgagaaactcctcttttattgcgatagtcaggggttccatagtgtaccaaacgcgactgacaagggctctctagggctgtcacttcggcacaatcacattaccgaactcgagagggaccaattcgcttcgttctctcagctgacttggctgcatctggatcacaatcagatcagcactgtcaaggaagacgcctttcagggactctacaagttaaaggaattgattttaagttcgaacaagattttttatctacccaataccacttttacccagctgatcaatctacagaaccttgacctgtcatttaatcaattgtcctctctgcacccagaactcttctacggcctgcgtaaactccagacactccacctacggtccaattccctcaggacaatccccgtgcggctgttttgggattgcaggagcctcgaatttctggatctgtcaaccaacaggctcaggagcctggccagaaatggtttcgccggccttattaagctgagggaactgcatctagagcacaatcaactcactaagatcaatttcgcccacttccttcggctgagcagtctgcataccctcttcctgcagtggaataagattagtaacctgacatgcggaatggagtggacttggggcaccctggagaagttggatcttaccggcaacgagattaaggcgatagatctcactgtgttcgaaaccatgccgaatcttaaaattctcctaatggacaataacaaacttaactcactggacagtaagatcctgaacagtctgcgaagtttaaccacggtgggtctttcaggcaacctgtgggagtgctctgcccgcatttgcgctctggctagctggctgggaagcttccagggtcgctgggaacactcaattctttgccactcacccgaccatacacagggggaagacatactcgacgcggtgcacggttttcagctgtgctggaacctgtctaccaccgtcacagtgatggcaaccacatatagggatcctaccacagaatatacgaaacgcatttcttcatcatcctatcacgtcggcgacaaagaaatcccgacaaccgctggaattgcagtgaccacggaagagcatttcccagagcccgacaatgcaatatttacacaaagagtcattacaggaactatggctctcctatttagttttttctttataatttttattgtctttatctcccgtaagtgttgccctcccacactgcgccgtattcggcaatgttcaatggtgcagaaccaccggcaactgaggtcccagaccaggttacacatgagcaacatgagtgatcagggaccctataacgaatacgaacctacgcacgagggcccattcattattattaacggctacggccagtgtaagtgtcagcagctgccctacaaggaatgtgaggtatag

SEQ ID NO: 122138 - DNA, 1746 bp, Artificial Sequence
  Description of Artificial Sequence: Synthetic coding sequence
atgggctttaatgtcatccgactcctctcaggttctgccgtagccctggtgattgcccccaccgttctcctcacaatgctctctagcgctgagcgtggctgcccaaaggggtgtaggtgcgagggcaaaatggtgtattgtgaatctcaaaaattgcaggaaatcccaagctccatctccgcggggtgcctcggcctttcacttaggtataactctctccagaaactgaagtacaatcaatttaaggggctcaatcagctgacatggctatatctggaccataaccacatctccaatatcgacgaaaatgcatttaacggtatacgaagactgaaagagctgattctgagttcgaaccggatttcctacttcctgaacaatacattccggcccgtcacaaacctccggaacctcgatcttagctataatcaactgcactcactgggaagcgaacagtttcgaggccttcgcaagctgctgtcgctgcacctgagaagcaatagtttgagaaccatccccgtgcgtatcttccaggactgccggaacttggagctgcttgacttgggatataatagaatcagatccctggcacggaacgtctttgccggtatgatcagactgaaagagctgcaccttgaacacaaccagttttccaagctcaatcttgctctgtttccaagattggtgtcactccagaatctgtacctacaatggaataagattagcgtaatagggcagactatgtcttggacctggagtagcctgcagcgtttggacctttctggaaatgagattgaggccttctctggcccttcagtctttcagtgcgtgcccaacctgcagcggctcaacctcgactctaacaagctaacatttatcgggcaggagatccttgattcctggattagcttgaatgacatctccctggccggaaacatttgggagtgttctagaaatatttgttctctggtaaattggctgaagagctttaaaggcctgcgagagaataccattatatgtgcctcccctaaagagttgcagggtgtgaatgtgatagatgcagttaagaactactccatctgcgggaaatccacaaccgagagattcgatcttgcgagggcactccctaaacccacctttaaacccaagctccctcgacccaaacacgagtcaaaaccccctctgccgcccactgtgggcgccacagaacctggccccgagaccgatgccgacgccgagcacatatcttttcacaaaattattgctggatccgttgccctgttcttgtctgttctggtgatcttgctggtcatatacgtcagctggaagcgctaccccgccagcatgaagcaactgcagcaacgatctttgatgagaagacaccgcaaaaaaaaacggcagtctctcaaacagatgacacccagcacccaagaattctatgttgactacaaacctactaataccgagacatctgagatgctgcttaatggcaccggcccttgcacctacaacaaatccgggtccagggagtgcgaaatacccctgagtatgaacgtgtctactttcctggcctacgaccagccaacgatctcctattgcggggtgcatcacgaattgctcagccataaaagctttgagaccaatgcacaggaagataccatggaaacccacttggagactgaactggatctcagtaccatcactaccgccgggagaatctccgaccacaagcagcagctggcttag

SEQ ID NO: 122139 - DNA, 1746 bp, Artificial Sequence
  Description of Artificial Sequence: Synthetic coding sequence
atggggtttaatgtgatcagactgctttctgggagcgctgtcgcattagttatcgcccccaccgtcttactcactatgttatccagcgctgagcgcgggtgtcccaaaggatgtcggtgcgaggggaagatggtgtactgcgaaagccaaaaactgcaggaaatcccatctagtatttccgcaggctgtctgggcctttcactccgctacaacagtttgcagaaacttaagtacaaccagtttaagggactcaatcagcttacatggttatacctggaccacaaccatatttctaatattgacgagaacgcctttaacgggattcggcggttgaaggagctgattctgagtagtaaccggatctcatacttcttaaataacacatttcggcccgtcacaaatctgcgcaacttagatcttagctataaccagctccacagcttagggtcagagcagtttaggggccttcgaaaactcctgtctctgcatttaaggagtaactcgctcagaacaattccggtgagaattttccaggattgcagaaatctggagctgttagacttaggctataataggattcgctcactggccagaaatgtttttgccggaatgatcaggctgaaggaactgcacctggaacacaaccagttctctaagctaaacctggccctcttcccacgcttggtgtcacttcagaatttatacctacagtggaacaagatttccgtgataggtcagaccatgtcctggacgtggtcttccttgcagagactcgatctcagtggaaacgagattgaggccttcagcgggcccagtgtgttccaatgcgtgcccaatctgcagagactgaacctggacagcaataaactcacattcatcggccaggaaatcttggactcctggatcagtttaaacgacattagtctcgccgggaatatctgggagtgttctcgaaacatctgctcactggtgaattggcttaagtcatttaagggactcagagagaatacaatcatttgcgcatcccccaaggaactccagggagttaatgttatcgatgccgtgaagaattactcaatctgcggcaaaagtaccacggaaagattcgatttggccagggctctgcccaaacccaccttcaaacctaaactgccaagacctaaacatgagagcaagccaccactgcctcctactgtgggtgcgaccgaacccggacccgaaactgacgctgatgctgagcatatcagctttcacaagatcatagctggatccgttgccctttttctgagtgtcctggtgattctgttggtaatctatgtgagctggaagcggtatcccgctagcatgaaacagctgcagcagaggtccctgatgcgaaggcaccgcaagaagaagagacagtccctcaagcagatgacacctagcacgcaggaattttacgtcgattacaagccaactaataccgagacgagcgagatgctgttaaacgggaccggcccctgtacttacaataagagcgggtctagggagtgcgagattcccctttcgatgaacgtgtcaacatttttggcatacgatcagcctaccatctcatattgcggcgttcatcacgaactcctctcgcataagtctttcgaaactaacgcgcaggaagacacgatggagactcacctagaaactgagctggatctaagcacaatcactaccgcgggcagaattagcgaccacaagcaacaactcgcttag

SEQ ID NO: 122140 - DNA, 1557 bp, Artificial Sequence
  Description of Artificial Sequence: Synthetic coding sequence
atgggatttcatctgattacccagctgaaaggaatgtcagtggtgttggtgctgcttcccactctgctcctggtgatgcttactggagcccagcgtgcatgcccaaagaactgtcggtgcgatggcaagatagtttactgcgagagccacgcgtttgcggacattcctgagaacatctctggagggtctcagggactgtcacttagattcaactctatccagaagctcaaaagcaatcagtttgcaggcctcaaccaactgatctggctgtacttagaccacaactacattagtagcgtggatgaggacgcctttcaggggatccgacgcctcaaggaactgattctttcctcgaacaagattacctacctccacaacaagaccttccatcctgttcctaatctgagaaatcttgacctaagttacaacaaactgcagaccctccagagcgagcagtttaaggggctcaggaagttaattatcttgcatctgcgtagcaattccttgaagaccgtgcctatccgggtttttcaggattgccgcaatctagactttttagatctgggctacaaccgcctgaggtccttgtcacgaaacgccttcgctggcctcctgaagctcaaggagctgcacctggagcacaatcaattctctaagattaattttgcccatttccccagactgttcaacctgcgtagtatctatctccagtggaacagaattcgcagtatttcacaaggtctgacttggacctggagcagcctgcacaacctcgacctgagcggcaacgacattcaagggattgagccagggacgtttaagtgtttgcctaatctccagaagttgaatctcgacagcaataagctaaccaatatatcccaggaaacagtgaatgcctggatatccctcatatctatcactctatccggcaatatgtgggaatgctcgaggtctatttgccctcttttctattggttaaaaaattttaagggtaacaaagagtcaactatgatatgcgcgggcccaaaacatatacagggggaaaaggtctcagatgcagttgagacatacaacatttgctctgaagttcaggttgtcaatactgagcggagtcacctagtgccacagaccccgcagaaacccctgatcattcccagacccaccatcttcaagccggatgttacccagagtacgttcgagacacccagtccatccccagggtttcagatacccggggctgagcaggaatacgaacacgtttccttccacaaaataattgctggtagcgtcgccctcttcttatcagttgctatgattttattagtgatttatgtctcttggaaacgttatcccgccagcatgaaacagctgcagcagcactcactgatgaaacggcggcgaaaaaaagcccgcgagagcgaacggcagatgaatagccctttgcaggagtattacgtggactacaagccaactaactctgaaaccatggacatctcagttaacggcagtgggccgtgtacatatactatttctggcagtcgagagtgcgaggtctag

SEQ ID NO: 122141 - DNA, 1773 bp, Artificial Sequence
  Description of Artificial Sequence: Synthetic coding sequence
atgggattccatctcatcacacagctcaagggaatgtccgtcgtactcgtcctgctgccaacgctacttctagtgatgcttactggagcccagcgggcttgccctaagaactgccgttgtgacggaaaaatagtgtactgtgagagtcatgcttttgccgatataccagagaatatttcaggagggtctcagggactgagtctgcgctttaactcaatccagaaactgaaatctaaccagttcgctggactaaaccagcttatctggctgtatctcgatcacaattacatcagctctgtggacgaggacgcgttccagggtattcgccggttaaaagaactcattttgtcatcaaataagatcacatacctgcataataaaacttttcatcccgttccgaatctgcgaaatctggacctgtcctacaataaactgcaaactctacagtctgagcagttcaaggggctgagaaaactgatcattctccaccttcgcagcaattcactgaagacagtgcctatccgggtcttccaggattgtcggaacctggacttcttggatctgggatataatcgtctgagaagccttagcagaaatgcatttgccggcctgctgaagctcaaggagcttcaccttgagcacaaccagttctccaagataaacttcgcccattttccccgcttgtttaaccttcgttcaatatacttgcagtggaaccggatccgctccatctctcagggactcacatggacttggagtagtctgcataatctggacctcagcgggaatgacatccaaggaatcgagccgggcacttttaagtgcctgcctaatctacagaagctcaatctggacagcaacaaattgactaacataagtcaggagactgtgaacgcatggattagccttattagcatcactctcagtgggaacatgtgggagtgttcgaggtctatctgtccattgttttattggcttaaaaacttcaaaggaaacaaggagtccactatgatctgtgccggacccaaacacatccagggagaaaaggtttcagatgctgttgaaacctataacatttgttcagaggtccaagtggtcaacactgagaggtctcacctggttcctcagaccccacagaaacctctgattatcccacggcctactattttcaagcctgatgtaacccagagcacatttgagacgccctctccttcccctggctttcagatccccggggcagagcaagaatatgagcacgtgagtttccataaaattatagctggcagcgtcgctctattcctgtcggtggccatgattttactcgtaatctatgtgtcttggaagagataccctgcttccatgaaacaattacagcagcactccctaatgaagcgaagaaggaagaaggccagagaatctgaaaggcaaatgaacagtccacttcaagagtactatgtagattacaagcccactaactcagaaacaatggacatctccgtgaacgggagcggaccatgcacgtacaccatttctggcagcagagagtgcgagatgcctcatcatatgaaaccactcccctattactcatacgatcagccagtgatagggtattgccaggcccaccagcctctccacgtcacaaaaggctatgagaccgtatctcccgagcaggatgaaagcccagggttggagctgggtcgtgaccacagcttcatcgcaacaatcgcaagatctgccgcacccgctatttacctggagaggattgctaactag

SEQ ID NO: 122142 - DNA, 1773 bp, Artificial Sequence
  Description of Artificial Sequence: Synthetic coding sequence
atgggcttccacctgatcacacagctcaagggcatgagcgtggtgctggtcctgcttccaacattgctcctcgttatgctgactggagctcagcgcgcctgtcccaagaattgtcggtgtgacgggaagattgtgtactgtgaatcgcacgccttcgcagatatacccgaaaacatatctgggggttcccagggactctcactccggtttaatagtattcaaaagcttaagtcgaaccaatttgctgggctgaaccagctgatatggctgtatctcgaccacaattacatttccagtgtggacgaagacgccttccaaggcattagacggctcaaagagctgatcctgagttcgaacaagatcacttatctccataacaagacctttcaccctgttccaaatctccgtaacctcgacctctcgtacaacaagcttcaaacgttgcagtcagagcaattcaaagggctaaggaagttgatcattctgcaccttcggtccaatagtcttaagaccgtgcctatccgtgtgttccaggactgcagaaatctcgatttcctggatctcggatataaccgcctgcgatcactgagcaggaacgctttcgctggcctcttgaaactcaaagagctgcacctcgagcacaatcagttctccaagattaacttcgcacacttccctcggttgtttaatttgcggtccatctacctacaatggaacaggattcggtctatctcacaaggactcacgtggacatggtcctctctgcacaacctcgacctgagtggaaacgatattcagggcatagaacctggcacatttaagtgcttaccaaatctgcagaagttgaatctcgattctaacaagctcaccaatatctcccaggagactgtgaacgcttggatcagcctgattagcatcacacttagtggtaatatgtgggaatgtagcaggtcaatctgcccacttttctattggcttaaaaattttaaaggcaataaagaatctaccatgatttgcgcgggtcctaagcacattcagggagaaaaggtgtcagacgctgtggagacttacaatatatgctctgaggttcaggtagttaacaccgagcgaagtcacttggttccacaaacacctcagaagcctctcattatacctcgacccaccatcttcaagccagacgttacacagtctacctttgagacccctagcccaagccctgggtttcagatacccggcgccgagcaggaatatgaacacgtgagcttccacaagattatagctgggtctgtggcactcttcttgagcgtggctatgattcttctagtgatctatgtgtcttggaagaggtatccagccagtatgaagcagttgcaacaacactcactgatgaaaaggcgcaggaagaaagctcgcgagagcgagaggcagatgaactctccgctgcaggaatattatgtggactacaagcctaccaattccgaaaccatggatatctctgttaacgggagcggaccctgtacctatacaattagcggttcccgtgaatgtgagatgccacatcatatgaagccgcttccctactatagctacgaccaaccagtaattggatattgccaggcccaccagccgttgcacgtgacaaagggatatgagactgtgtctcccgagcaggatgagtccccgggactggagctgggtcgcgatcattcttttatcgccactatcgcccgttccgctgcccccgctatttatctggaaagaatcgccaattag

SEQ ID NO: 122143 - DNA, 1776 bp, Artificial Sequence
  Description of Artificial Sequence: Synthetic coding sequence
atgcccgggtttcatcttattacccaactgaaaggtatgtcagtcgttctcgtgctgctgcccactctgctgttggtcatgctgacgggggcgcagcgggcctgtccaaagaattgcagatgtgacggtaagatcgtttactgcgaaagtcacgctttcgccgacatcccagaaaacatttccggcggctcacaaggtttatctttgcggttcaattccatccaaaagctgaagtctaaccaattcgccggactcaaccaattgatctggttatacctcgatcataattacatctcctcggtggacgaagatgcattccaaggcatcaggaggctgaaggagctgatcctgtcatccaacaagataacatatctgcacaacaagacctttcaccccgtgcccaacctcaggaaccttgacctgtcctataacaaattacagaccttgcaatcggagcaatttaagggtcttcgaaagcttatcatcctgcacctgcgatccaattcattaaaaactgtgcctattagggtgttccaggattgccggaatttagacttcctcgatctgggctataatcggttgagatccttgtccagaaacgccttcgctggtctcttgaaattgaaggagctgcatctggagcacaaccagtttagcaaaattaatttcgctcattttcctcgattgtttaacctccgcagtatctacttgcagtggaaccgtatccgcagcatcagtcaggggctgacatggacttggagctctttgcataatctggatttaagcggtaatgatatccagggtatagagcctgggacgttcaagtgtctgcccaacctgcagaaattaaatctcgactcgaacaagttgacaaacatcagccaggagaccgtcaatgcttggatcagcctgatatctattacactgtccggcaatatgtgggaatgtagtcgttccatctgccccctgttttactggctgaaaaacttcaagggaaataaagaatctacaatgatctgcgccggcccaaagcacatccagggagaaaaggtatctgatgctgtggagacctataatatttgtagcgaagtgcaggttgtgaacacagagcgcagtcatttagtacctcagaccccacaaaagccgctcattattccccgcccaaccatattcaaaccggacgtaacccagagcacattcgaaaccccctcgccctcgcccggtttccaaatcccgggggctgaacaggagtacgaacacgtttctttccacaagataatcgccgggagtgtggccctttttctttctgtcgctatgattctgctggtcatatatgtgtcttggaagcggtaccccgcttccatgaaacagcttcagcagcattccttaatgaaacgccggagaaagaaggcgagggagagtgaaagacagatgaatagcccactgcaagagtattatgtcgactacaagccaactaactcggagactatggacatttcggtcaacggatcaggcccttgtacgtacaccatttcaggctccagggaatgtgagatgccacatcacatgaagccactgccctactatagctacgatcagccagtgattggctattgccaagcccatcagcctcttcatgtgaccaaaggttatgaaacagtgtcacccgagcaggatgaaagtcccggactcgagctgggtcgggatcattccttcatcgcaaccatcgcccgttccgcggcccctgctatctacttagaacgaatcgccaattag

SEQ ID NO: 122144 - DNA, 579 bp, Artificial Sequence
  Description of Artificial Sequence: Synthetic coding sequence
atgaacaaaagggactatatgaacacgtccgtccaggaacctccgcttgattattcgtttcgcagcattcatgtgatccaggatctggtgaacgaggagcccagaactggattgagacctctaaaaagaagcaagtccgggaagagtctgacccagtcgttgtggctgaataataacgtgcttaatgatctgcgggattttaatcaggttgcctctcagttgctggaacacccagagaatctcgcttggatcgatctcagtttcaacgacttgacaagcattgatccagtgctgaccacatttttcaacctaagcgtactttacctccatgggaattctatccagagactgggagaggttaataaactggcagtgctgcctagacttcgatcgctcaccttacatggcaaccccatggaagaagagaaagggtacagacagtacgttttatgtacactgagtcgaatcactacctttgacttttcaggggtcacaaaggcagaccgcacaaccgccgaggtatggaaacggatgaacattaaacctaagaaagcgtggacgaagcagaatacactttag

SEQ ID NO: 122145 - DNA, 876 bp, Artificial Sequence
  Description of Artificial Sequence: Synthetic coding sequence
atgggcacaccatggagaaagcgcaagggaattgcgggcccaggcctcccagacctaagttgcgccctggtgctgcagccacgagcccaggttggaacaatgagtccggctatagctctggcatttctgccactcgttgttacactcctggtcagatatcgtcattacttccggctgctggtgaggaccgtgctgcttaggagcctccgagattgtctatccggcctgagaattgaggagcgcgctttttcctacgttctcacacatgcgttacccggcgaccccggacatattttgaccactttagaccactggtccagccggtgcgaatatttgagccacatggggcctgtgaagggccagatcctgatgcggctggtcgaggaaaaggcccccgcttgcgtcctagaattggggacatattgcggttactcaactcttctcatcgctcgggccctcccaccgggtggcagacttctgaccgttgagagagaccctagaaccgcagccgtggccgagaagctgatcagactggccggatttgatgaacatatggtggaactgatcgttggctcctccgaggatgtcattccttgtctccgcacccagtatcagctgagtcgcgccgatctggtgctactggcccatagacctcgctgctatctacgggatttgcagctgttggaggctcatgcactactgcctgcaggagcgacggtcctggcagaccacgtgctcttccccggcgcccctcgatttctacagtacgctaagagctgcggcagatatcgctgtaggctgcaccataccgggctcccggacttcccagcaattaaagatgggattgcccagctgacatacgcgggaccaggctag

SEQ ID NO: 122146 - DNA, 441 bp, Artificial Sequence
  Description of Artificial Sequence: Synthetic coding sequence
atgaacaagcgcgactatatgaatactagtgttcaagaacctcctcttgattacagtttccggtccattcatgtcatccaggacctggttaacgaggagccacgaactggactgaggcccctgaagaggagcaaaagtggaaagagtctgacccaatcgctttggctgaacaacaacgtgctgaacgatttgcgcgactttaaccaagtggcatcccagttgctggagcatccggagaatctggcctggattgacctaagttttaacgatctgacctccattgatccagtgctcaccaccttttttaacctgtctgtcctgtacctgcacggcaacagcatacagcggcttggagaggtgaacaaactcgcagtccttcccagacttcggtctctgaccttgcacggcaacccgatggaggaggagaaaggataccgctag

SEQ ID NO: 122147 - DNA, 756 bp, Artificial Sequence
  Description of Artificial Sequence: Synthetic coding sequence
atgggcactccttggcgaaagaggaagggtatcgcagggcccggcctgcccgatctttcctgtgcactggtcctacaacctagcctgcgcgattgcctgtccgggttacgcattgaggagagagcttttagctatgtcctgacacacgccctccctggggaccctggccatattctaaccaccctggatcactggtctagcaggtgtgagtacttatctcacatgggacccgtgaagggtcagatcctcatgagattagtggaggaaaaggcgccagcatgtgttctggaactcggaacttattgcggatacagcactctcctgattgctcgagcactaccccctggaggaaggttgcttactgtggagcgtgatcccaggacggccgctgtggcagaaaagcttattagactggcaggattcgatgagcatatggtggagctgatcgtgggatcttccgaagacgtgattccatgcctgaggacacagtatcagctctctagggcagatttggtcctacttgcgcaccggccaaggtgctaccttagggatctgcagctgctggaggcacatgcccttctgcctgctggggctacagtactggctgaccatgtattgttccctggcgcgcccaggtttctgcagtatgccaaaagctgcggaaggtaccgctgccgactgcatcatactgggctccccgattttcccgccatcaaggatgggattgcacagctgacatatgctggaccaggctag

SEQ ID NO: 122148 - DNA, 876 bp, Artificial Sequence
  Description of Artificial Sequence: Synthetic coding sequence
atgggaactccttggcggaagagaaagggcatcgccggcccagggctaccagatctgagttgtgcccttgtgttacagccgcgggcccaggtaggaacaatgtctcctgcaatcgcactcgctttcttgccacttgttgtcacgctgctcgtccgttatcggcactacttcaggttgcttgttaggaccgttcttctgcgctcccttcgggattgcctttccggtctgagaatcgaggaacgtgccttttcttatgtcttgacccacgctctgcctggcgatcctgggcacatcctgacaactctcgatcactggagctctcgctgtgagtacctgagccatatgggaccggttaaagggcaaatcctgatgaggcttgtcgaggaaaaagctccagcatgcgtactagagctgggcacttattgcggatacagcacgcttctcatcgcccgagcattgcccccgggcggcaggttgttgaccgtcgagcgcgacccacgcacagccgcagtggccgaaaagttgattcgcctcgcaggtttcgatgaacacatggtcgagcttatcgtgggtagttcagaagatgtcatcccttgtctacgaacgcagtaccagttgtcgcgggcagatcttgtactcctcgcgcaccgaccaaggtgttatctgagggatctccagcttttggaagctcacgccctcctgccggctggcgctactgttctcgctgaccatgtgttattccccggggctcctagatttttacagtatgctaagagctgcggtagatacagatgtaggttgcatcatacgggcctccccgactttccggcgataaaggacggcatcgcccagcttacatatgcgggaccaggttag

SEQ ID NO: 122149 - DNA, 477 bp, Artificial Sequence
  Description of Artificial Sequence: Synthetic coding sequence
atgaataagcgcgactacatgaatactagcgtgcaggagcctcctctggattactcattccggtcaattcatgtgatccaagacttggtaaatgaggagccacggaccggattgaggcccctgaaacgaagtaaaagcggcaagagcctcacacagtcgctatggctgaataataacgtgctaaacgacctgagagatttcaatcaggtcgccagccagctactggagcaccccgaaaatctcgcctggatcgatcttagttttaatgatcttacttcaatagacccagtcctgacaaccttttttaacctgtcagttttatatctgcatggcaattctattcaacggttgggcgaagttaacaagctggccgttctcccacggctgaggagtctgaccctgcatggtaatcccatggaggaagaaaaggggtaccgggtccctggatcggtggaaatgccccacaggccaccatag

SEQ ID NO: 122150 - DNA, 279 bp, Artificial Sequence
  Description of Artificial Sequence: Synthetic coding sequence
atgaacaagagagattacatgaatacatccgtccaggaaccccccttagattatagttttcgttccatacacgttattcaggatctggtgaatgaggagccccgtaccggcctgaggccgctcaagagaagtaaaagcggcaaaagccttacacagtcgctttggcttaataacaatgtcttaaatgacctcagagattttaaccaagtggcaagtcagctactggagcaccccgaaaaccttgcttggatagatctgtcctttaatgatcttacctag

SEQ ID NO: 122151 - DNA, 579 bp, Artificial Sequence
  Description of Artificial Sequence: Synthetic coding sequence
atgaataagcgagattacatgaacacaagcgtgcaggagcctcctctggactatagctttaggagcatccacgtgatccaggatctggttaacgaagagccacggacaggactgcgcccgctgaaaaggtcaaaaagtgggaagagcctgacccagtcgctgtggctcaataataacgttctgaacgacctgcgggattttaaccaggtcgcttctcagctcctagagcaccccgagaaccttgcctggatagatttgagtttcaatgacttgacttcaatcgaccccgtgctaactacctttttcaatctttctgtcttgtaccttcacggtaattctatccagcgactgggggaggtgaataagttggccgtgctgcctaggttacgaagcctaacccttcacgggaaccccatggaggaagaaaaggggtatcgccagtacgtgctgtgtaccctctctagaatcacaacttttgacttctctggggtcacgaaagccgatcggactaccgctgaggtgtggaagcggatgaatattaagcccaaaaaggcctggacaaaacagaacacactgtag

SEQ ID NO: 122152 - DNA, 477 bp, Artificial Sequence
  Description of Artificial Sequence: Synthetic coding sequence
atgaacaaacgagactacatgaacacctccgttcaggagcctcctctggattattcattccgatccatccatgtcatccaggatctggtgaacgaggaacctagaactgggctgcgcccgctcaagcgcagtaagtctgggaaatccctaacgcagagcctgtggcttaataataacgtgctgaatgacctgagagattttaaccaggtcgcgtcgcagcttcttgaacatcccgagaacttggcttggatagacctgtcctttaatgatctgacttctatcgaccccgtcctcaccacctttttcaacctgagcgtattgtacctgcatggcaattccatccagcgcctcggcgaggtcaataagctggctgtgttgccacgcttacgttcgttgactctgcacgggaatccgatggaggaggagaaagggtatcgagtccccgggagcgtggaaatgccccaccgccctccttag

SEQ ID NO: 122153 - DNA, 315 bp, Artificial Sequence
  Description of Artificial Sequence: Synthetic coding sequence
atgaacaaacgagattacatgaatacctccgtgcaggagccaccactcgactattcctttcggtccatccatgtcatccaggacctggtaaatgaggaaccccgcacgggcctgcgtccacttaaacggagtaagtctggaaagtctctgacccaaagcctgtggctaaacaacaacgtgctgaacgacctgagggactttaaccaggtagcttcacagctgcttgagcacccagaaaatttggcctggattgacctttcatttaatgacttgacatcaatcgacccagtactcactactttcttcaatctgtag

SEQ ID NO: 122154 - DNA, 525 bp, Artificial Sequence
  Description of Artificial Sequence: Synthetic coding sequence
atggtggaattccagcctagcgtgaccgacctggtgaatgaagagcctagaacaggccttaggccgctcaaaaggtcgaagtccggaaagtctcttacccaatctctgtggttgaacaacaatgttttaaacgatctccgggatttcaaccaggtcgcctcacagctgctggaacacccagagaacctcgcatggattgatctcagtttcaatgatctcacttcaatcgacccggtgttgaccactttcttcaatctgtcagttctatacctgcacgggaatagcattcagcggcttggggaggttaacaaactggcagttctcccccggttgaggtcattaactctccatggcaatccaatggaggaagagaagggatacaggcaatacgtgctgtgcaccctctcaaggataactacattcgacttttcaggtgtaaccaaagctgacaggactacagctgaggtttggaagagaatgaacatcaaacccaagaaagcatggacaaaacaaaacacactctag

SEQ ID NO: 122155 - DNA, 3231 bp, Artificial Sequence
  Description of Artificial Sequence: Synthetic coding sequence
atggcagagtttacgtcctataaggagacggcatcaagccgccatctgaggtttaagctgcagagtctctcccgcaggttagatgagctggaagaggcaacaaaaaatcttcagaaggctgaggatgaactgcttgacctgcaagacaaggtgattcaagccgaaggctccaattctagtatgctggcagaaatcgaagtcctgaggcaaagagttctccggattgaaggaaaggacgaggagatcaagagagcagaggacctatgtcgactgatgaaagaaaaactcgaggaggaggagaatctaactcgggaacttaagagtgaaattgaaagattgcaaaaacgtatggctgaactcgagaagttggaagaggcctttagcagaagtaagaatgactgtacacagctatgcctatccctcaatgaggagcggaatctcacaaagaaaatcagctcagagctggaaatgctgcgcgttaaggttaaggagctcgagagcagtgaggaccggctagacaaaaccgagcagagtctggcgtccgagctggaaaaactcaaaagcctaacactgtcctttgtaagcgaacgaaaatatctcaacgaaaaggaaaaagaaaacgagaagctaataaaagagctgacgcagaagctggaacagaacaaaaaaatgaatagagactatacacggaacgcaagcaacctcgagcggaatgatttgaggattgaggacggcataagcagcaccctaccaagcaaagagtcaaggagaaagggtgggctggattatctgaagcaggtggaaaacgaaactcgtaacaaatcagagaatgaaaagaatagaaatcaggaagacaacaaggtgaaagacctgaatcaagagattgaaaaattgaaaactcagatcaaacattttgagtcgctggaggaagaacttaagaagatgaaatcgaagaacaatgatttgcaggataattatctgtccgagcaaaataagaataagctcctggcctcgcaactggaggaaatcaagctgcaaatcaagaagcaaaaagaacttgaaaatggagaagtggaaggcgaggatgctttcctttccagtaagggacgacatgagaggacaaaattccgagggcacgggtctgaagcctccgtctccaaacacaccgctagggagctgtccccccagcacaagagagagcgcctgcggaacagggaatttgcattaaacaatgaaaattactcactctcgaataggcaagtatcatccccgtcatttaccaatcgccgtgcagccaaggcctcccatatgggggtcagtactgactcagggacccaggagacaaagaaaactgaggatagatttgtcccaggaagttcacaaagcgaaggtaaaaagagtcgagaacagccctccgtgttaagtcgataccccccagccgcccaagagcatagtaaagcttggaaggggaccagcaagcccggaacggagagcggactgaagggcaaggtcgaaaagacaaccagaaccttctcagacacaactcacggatcagtgccatccgaccccctgggacgcgccgataaagctagcgacacttcatcagaaaccgtattcggcaaacgtggacacgttctggggaacggaagtcaggtgacacaggccgcaaatagtggatgtagcaaggccattggggcgcttgcatccagtcgacgatccagtagtgagggattgtccaaagggaagaaagctgccaacggcttagaggccgacaattcatgtccgaactccaaggctccagttctctctaagtatccttatagctgccgatcccaggagaacattctgcagggattttcaaccagtcataaagagggagtgaaccaacccgccgccgtcgttatggaggatagcagtcctcatgaagctctcaggtgtagggtgattaagtccagcggccgtgagaagcctgattcagatgatgatttggatatagccagtctcgttaccgccaaattggtcaatacaaccatcacacccgaaccagagcccaaaccacagcccaactcccgcgaaaaggctaagacccgcggcgcacctagaactagcctattcgagaacgacaaagatgcagggatggagaacgagtcagttaagtccgtacgggcatctactaacacaatggagctgcctgatactaatggggccggcgtcaaaagtcagcgccccttctcccccagggaggcgctcagaagcagggctataataaagccagtcatcgtcgacaaagacgtgaagaaaatcatggggggttcaggaacggaaacgaccctggagaaacagaagcccgtctctaaaccgggacccaacaaagtaactagtagcatcaccatctatcctagcgattcctcttctccaagagctgctccaggggaagcccttcgcgagcgacacaccagtactagtaacatccaggtggggctggcagagctcactagcgtatcaaaccatgtttccagccccttcgaactgtctattcacaaacatgacatcacactgcagctggccgaggccgagcgcatggccgacggtccgctgaaggacaggcctgaaactgtggttagtaggtctagcattattattaaaccaagcgatcctgttgagcggaactctcacgcaccgcctgctgaaactattaggtggaagtcgcatagtgcaccttctgaggtgggcttcagcgacgcccgccacgttactgttaggaacgcttggaaatctaggcgcgaccttaagtccctggaggatccacccaccagaataggcaagaatgtggaaagcactaactctaacgcttacactcaaagatcctccacggacttcagcgagctggaacagcccaggagctgtctcttcgaacaaggcacccggagagtcggcccaagctccggcgatgcaccggagcctagctctagacgcactcagtcttcacttaccgtgagcgaagttcttactcgccggaatcgagtgggcgatactatcaccgtggccgcttggaaccacagcgctagcatggaagaagaaggggaggactgcaccctgtctgtctaccgccagctccataactctctggatcctagtgaactgcccgggaagcagggcctcccagagagcgggagagtcagagccgaagagcgcctcagacccacacggccttgtgcagaggagaattag

SEQ ID NO: 122156 - DNA, 3081 bp, Artificial Sequence
  Description of Artificial Sequence: Synthetic coding sequence
atggccgagttcacgtcgtacaaggagactgccagttcacgccatctgcggttcaagctccagagcctttctcgaaggctcgacgagctagaagaggcaactaaaaatctgcagaaagcagaagacgagttgctcgatttacaggacaaagtgattcaggcagagggaagtaattctagtatgctggcagaaattgaggtcctgaggcagagagtgttaagaattgaaggaaaagatgaggagatcaagagggcagaggatctatgtcgattaatgaaggagaagcttgaagaagaagagaatctgaccagagaactcaaatctgagatagagaggcttcaaaagcggatggctgagctggagaagctggaggaggctttctcaagaagcaagaatgactgtacccagctatgtctgagtctcaacgaggagaggaacctgactaagaagatatcaagcgagttggagatgctgcgggtgaaagtgaaagagttagagagtagcgaggaccgcctcgataagaccgaacagtccctggcttctgagctggaaaaactcaaatctctgactctgtcatttgtcagcgaacggaaatatcttaacgagaaggagaaagagaacgaaaagctgatcaaggaactcacgcagaagttggagcagaacaagaagatgaaccgcgattacacgcgcaatgcaagtaatttggagcgtaacgacctgagaatcgaagacgggatatccagcacgctgccatccaaggagtctaggcgtaagggcgggttagattacctgaagcaggtcgaaaatgaaactagaaataaatccgagaatgagaaaaaccgcaatcaagaggacaacaaggtgaaagatctgaatcaggagatcgagaaactgaagacccagataaaacactttgaaagtctggaagaagaactcaagaagatgaaatccaagaacaacgatctgcaggacaattatcttagtgaacagaacaaaaacaaactgctggcttcccagctcgaggaaatcaagttgcagattaaaaaacagaaagaactggagaacggagaggtcgagggcgaggatgccttcctgtcctccaaaggtaggcatgaaaggacaaaatttagaggtcacggaagtgaggcatctgtctctaagcacacagccagggagctgtcaccccaacataagcgggaaaggctccggaatcgcgaattcgccttaaataatgagaactatagcctgtccaacaggcaagtttcttctccatccttcacaaatagaagagcggctaaggcaagccacatgggcgtgtctacagacagcggcacgcaggagactaagaagaccgaagaccgttttgttcccggatcgtctcagtccgaggggaaaaaaagccgcgagcagccctctgtactttcacgttatccccctgctgcccaagagcacagtaaagcttggaaagggacttccaaacccggtactgagtctggacttaaggggaaggttgagaagactactagaaccttcagcgacaccactcacggtagcgtcccctcggatcctctgggccgtgcggacaaagcatccgacacaagctctgagacagtgtttggaaagcggggtcatgtactcggcaatggaagccaggtcacgcaggccgccaactctgggtgttctaaggccattggcgccctggctagctctagacgttctagcagcgaaggcctgtccaagggcaagaaagcagcaaacggcttggaggctgacaatagctgccctaattccaaagcccccgtcctctccaagtatccatactcctgcagaagtcaggaaaatatcctgcaggggttttctaccagccataaggaaggcgtcaatcagccagccgccgtggtaatggaagatagctcgcctcatgaggccctcaggtgtagggtgattaaaagcagcggacgtgaaaaacccgattcagatgatgatttagatattgctagcctagtcactgcgaaattagtcaatacgacaattacgcccgagccggagcctaagccccagcctaacagtcgagaaaaggcaaagaccagaggtgccccacggactagcctgtttgaaaatgataaggacgcaggcatggaaaacgaatccgtgaaatctgtgcgcgctagcaccaatactatggaactcccagatacaaatggggcaggcgtaaagtctcaacggccttttagcccaagggaagcactccgcagccgcgccatcattaagcccgtaatcgttgataaggatgtaaagaaaatcatgggcggaagcggaactgaaaccaccctcgaaaagcagaaaccagttagcaagccaggaccaaataaggtcacaagtagcatcacaatatacccgtcagattcatccagccccagggccgcacccggagaggcactccgggagagacatacatccacctctaatattcaagtcggcctagcggaactcacgtccgtttccaatcacgtgagctcacccttcgaactgtctatccacaaacacgacatcacactgcagctagctgaggctgaacggatggcagacggccctctgaaagacaggcctgagaccgtcgtatcccggtcatcgattatcattaaaccaagcgaccccgtggaaaggaactcccacgcccctcctgccgagaccatacgctggaagtctcactcagcgccgagcgaggtgggctttagcgacgcccgccacgttacagtgcgcaatgcgtggaaatccagacgagatctcaagagtctggaagatcccccaacacgcatcggaaaaaacgtggagtcgaccaattccaatgcctacactcagcgttcatccacagacttctcagaactggagcaacctagatcgtgtctattcgaacaaggaactcgccgcgtggggccatcttctggcgacgctccggagccgagtagtagaagaacccagagcagcctcacagtgtcagaagtgctcaccaggcgaaatcgcgtgggcgatacgattacagttgcagcgtggaatcattccgcttcaatgagctcctag

SEQ ID NO: 122157 - DNA, 3231 bp, Artificial Sequence
  Description of Artificial Sequence: Synthetic coding sequence
atggctgaattcacttcctataaggagactgcttcctcacgccacttgaggtttaagctgcagagcctgtctcggcggctcgacgaactggaggaggctacgaagaatctgcagaaggccgaggatgagctgctggatttgcaggacaaggtcattcaggctgagggaagtaactcaagtatgctcgcagagatcgaagtcctcagacagagggtacttaggatcgagggaaaagatgaggaaatcaagcgggcggaggatctttgtcgcctgatgaaggagaaactggaagaagaggagaatctcacgcgagagctcaaatcggagatcgagagactgcagaaacgtatggcagagctggaaaaactggaggaggcattttcaaggagtaagaacgactgcacgcagctatgcttgtctctgaacgaagaaagaaaccttaccaaaaaaatttcatctgaactcgaaatgctgcgcgtgaaggttaaagaacttgaatcctctgaggaccgacttgacaaaacagaacaaagccttgccagcgagctggagaagttgaagtctctcaccctgtctttcgtgagtgagcgcaaatacctgaatgaaaaggagaaagaaaacgagaagcttatcaaagaacttacccagaaactcgaacagaataaaaagatgaacagggactatactaggaatgcctcaaatctggagcgcaatgatttgaggatcgaggacggaatttcgtcgactcttccctctaaagagtcaagaaggaaaggaggcctcgactacctgaagcaggtggagaatgagacacggaataagtccgagaacgaaaagaataggaatcaggaagataacaaggttaaggacctgaaccaagaaattgaaaagctcaaaacccagatcaaacatttcgagtccctcgaagaggagctgaagaagatgaaatcaaagaataacgatctccaggataactatctcagcgagcagaataagaacaaattgctcgcctctcagctggaggagataaaactacaaatcaaaaagcagaaagagcttgaaaacggagaggttgaaggagaggacgccttcttgtccagtaagggacgacatgagcgcacaaagtttcgtggtcatgggagtgaagcatccgtgagcaaacacacggctcgcgaactatcccctcagcataagcgcgaacgcctgagaaaccgggaattcgccctgaataacgagaactactccttgtcaaatagacaagtgtcgtctccatccttcaccaataggcgtgccgccaaggcatctcacatgggggtctcaacggactccgggactcaagaaacgaagaaaactgaggatcgcttcgtcccaggctcttctcaaagtgagggcaagaagtctagggagcaaccctctgtgctgtctcgatacccgccggccgcacaagagcatagcaaggcctggaagggtacctccaaaccgggcacagagtccggcctgaagggcaaggttgaaaagacaacccggaccttttccgatactactcacgggtcagtgccttctgacccactgggacgggctgataaggccagcgatacgagctcagaaaccgtttttgggaagcgcggccacgtgttaggtaatggttctcaggtaactcaggccgctaattcggggtgttcaaaagccattggcgctttagcaagctccagacgaagtagctcggaggggttgagcaaagggaagaaagccgcaaatggactagaagcagataacagttgccctaactctaaagcacccgtgctatccaagtatccatactcttgccggtctcaggaaaatattctccaaggctttagtacaagccataaagagggggtcaatcagccagccgcagtcgttatggaagacagcagtccacatgaggcactccgctgccgcgttatcaagagttccggcagagagaaacctgacagcgatgatgatctggatatcgcttctctggtaactgcaaaactcgtcaatactacaatcaccccagagccggagccgaagccacagccgaactctcgggaaaaagctaaaactaggggggccccaaggacttctctgtttgaaaatgacaaggatgcaggtatggaaaacgaatcagttaagtctgttagagcctcgacaaataccatggaactgcccgatactaatggggccggcgttaagtctcagcgccctttcagccctagagaggctctgcgctctagagctattataaagccagtaatagtagacaaggatgtgaagaaaatcatggggggatcgggcacagaaacaacgctggagaaacagaagcccgtatctaagcctggacctaacaaagtgacatccagcatcaccatttacccttccgacagctcaagtccgagggccgcccctggtgaagccctccgggagagacacacttccacctccaacatccaggtgggcttggcagagctgacatcggtctcaaatcatgtgtcctcccctttcgaactgtccatccataaacacgacattacactgcagctcgcagaggctgaacggatggccgatggacccctgaaggatcgccccgagacagttgtttcacgttctagcatcatcatcaagccttccgacccggtagagcggaactcccacgcacctccagccgaaacgatcaggtggaaatcccacagcgcgccgtccgaggttggcttcagtgacgcacggcacgtgaccgtgagaaatgcatggaagtctaggcgggatttaaaaagcctggaggatcctccaacaaggattggaaagaacgtggagtctactaacagcaacgcatacacccaacgcagttcaaccgacttctccgaactagagcagccccggtcttgtctgttcgaacaggggacccggagggttggccccagctcaggcgatgctccagaaccgtcctcaaggagaacacagtccagtctcactgtgtctgaggtcctcactcggcgaaacagagtcggggacaccatcactgtcgcagcttggaaccactcggcgagtatggaggaggagggggaagactgcaccctcagcgtgtacagacagcttcataatagtctcgacccatctgagttgccaggaaaacaaggactcccggagtctgggagggtaagagcagaggaacgattaaggccgacaaggccttgtgccgaggagaactag

SEQ ID NO: 122158 - DNA, 3231 bp, Artificial Sequence
  Description of Artificial Sequence: Synthetic coding sequence
atggccgaattcacttcctacaaggagactgccagttcacgccatctgcgcttcaagttacagtcactatccagaaggttagacgaactcgaggaagccactaaaaatctgcagaaggccgaagacgaactcttagaccttcaggacaaagtgattcaggcagagggctcaaattcaagtatgctggcagagatcgaagttcttcgtcaaagggtactgagaattgaaggaaaggatgaggaaatcaagcgggccgaagacctgtgtcggctcatgaaagagaagcttgaggaagaggagaacctgacacgcgagctgaaaagtgaaatagagcgcctccagaaacgtatggctgagctggagaagctcgaagaagcgttttcacgtagcaagaacgattgcacacagctgtgcctttccctgaacgaagagcgcaacttaacaaaaaaaatctcctctgagcttgagatgctccgagtgaaggttaaggaattagagagttccgaagacagactagacaaaactgaacaatcacttgctagtgaactcgaaaagctaaagagcctgactctgagctttgtgtctgaaagaaaatatctgaacgagaaggagaaggaaaatgaaaaacttatcaaggagttaacacagaagctggaacagaataagaagatgaaccgcgactacacccgcaacgcatccaatctcgagcgaaatgacctgcgtattgaggacgggatctcttctactctaccaagcaaggagagccggagaaagggtggactagattacctgaaacaagtggagaatgaaacgagaaacaagtctgaaaacgagaagaacagaaaccaggaagataataaggtgaaagatttgaatcaagagatagagaagttgaagacccagatcaagcatttcgagagcctcgaggaggaactcaagaaaatgaagtcaaagaacaatgatctccaggacaactatctgtccgagcagaacaagaataagctgctagcatcccagcttgaggagataaagctccagataaagaaacagaaggagctggaaaatggtgaggtggagggagaggacgctttcctctccagcaaagggagacacgagcgtacaaagttccgcggacatggctctgaagcttcagtttccaaacacaccgcaagagagctcagccctcagcacaaaagggaaagattgcggaaccgcgagtttgccctcaacaacgagaattatagcctgagcaatcgccaggtgagtagtccctcctttaccaacagacgggcggccaaggcctcgcacatgggcgtcagtacggattccggcactcaagagactaagaagaccgaggaccggtttgtgcccggatctagccaatcagaaggtaagaaatctagggagcagccaagcgtcctgtccaggtaccctcccgccgcacaggaacactctaaagcctggaaagggaccagtaagcctggcaccgagtctggacttaaaggaaaagtcgaaaaaaccaccagaaccttctcagacaccacccacgggtctgtaccgtccgatccgttgggacgagcagataaggctagtgacacttcatctgagactgtgtttggtaagcgcggccatgtcctgggtaatggctcccaggtcacacaagcggccaactccggttgttccaaggccataggtgccctcgcgtcaagcagaagaagctcaagcgaaggcctcagcaaaggaaaaaaggccgcaaacggtctcgaggcggacaacagttgccccaattcaaaagctccagtattgagtaaatacccatacagctgtaggagccaggaaaacattctgcagggattctccacgagccataaagaaggtgtcaaccagcccgcggcggtggtaatggaagactcttctcctcatgaagctctgaggtgtcgcgtgatcaagtcttctggaagggagaagcctgacagcgatgatgacctggacatcgcatccctggtgaccgcaaagctagttaataccaccattactccagaaccagagccaaaacctcaacccaacagtcgggaaaaggcaaagaccagaggagcaccacgaactagtctgttcgaaaatgacaaagacgccggcatggaaaatgaaagtgtgaaaagcgtgcgtgccagcaccaatacaatggaattgcctgataccaacggcgccggagtgaagtcacagcgacccttcagtccccgcgaagcgttgcgcagccgcgccatcattaaacctgtcatagtcgacaaagatgtgaagaaaattatgggtgggagcggcactgaaacgacccttgaaaagcagaaacccgtctccaagcccggcccaaataaggtaacgagcagcattaccatctatccctccgactcctctagtccaagggcagctcctggtgaagcactgagagagcggcacactagcacctcaaatatacaggtgggtctggctgaacttaccagcgtgtcaaaccacgtttcaagcccctttgagctgtccatacacaagcatgatattactctgcagttagctgaggccgagagaatggcagacggtcccctgaaggaccgaccagaaacagtggttagccgcagctcaataatcattaagccctcagatccagtggagaggaattcacatgcgcctcccgccgagactatccggtggaagtcccattctgccccttcagaagtcggttttagtgacgcccggcacgtaacggtgagaaacgcctggaaaagccgtcgggatttaaaaagcctggaggacccacctaccagaatcggtaagaacgttgaaagcacaaattccaacgcctacactcagcgaagtagcaccgattttagcgagctcgagcaaccaaggagctgcctgttcgaacagggtactcgaagagtgggcccctcatccggtgacgcaccagagccttcatcccgccgaacccagtcgtccttgacggtctcagaggtgctgacaagacgaaaccgcgtcggtgacactattaccgttgctgcttggaatcattccgcttccatggaagaggaaggagaagactgcacccttagcgtctaccgtcagctacataatagtctggacccttccgagttgcccggcaaacagggccttccagagagcggacgcgtgcgagcagaagagcgtctccgccctacccggccatgcgcagaggaaaattag

SEQ ID NO: 122159 - DNA, 822 bp, Artificial Sequence
  Description of Artificial Sequence: Synthetic coding sequence
atggccgagttcaccagttacaaagagacggcttcgtcaaggcacctgaggttcaaacttcaatctctgagtaggcgtctggacgagctggaggaagccacgaaaaacctccagaaggctgaggatgagctcttggaccttcaggacaaagtcatacaggccgaggggtcaaatagctccatgcttgcagagattgaggttctaaggcagcgggtcctgcgtattgaaggaaaagacgaagaaattaaaagggcggaggacctctgccgcctgatgaaggagaagctcgaggaagaagagaacttaacacgcgaactgaaaagcgagatcgaacggttgcaaaaacgtatggccgaattagaaaagctggaggaagccttctccagaagcaagaacgactgtacccagctgtgtctctccttgaacgaggagcgcaatcttacaaagaagatcagctccgagttggaaatgttgcgagtaaaggtgaaagaacttgagtcttctgaggatagattggacaagaccgaacaatctttagcaagtgagctggaaaagctaaaatccctcactctgagtttcgtgagtgaacgcaaatacttaaacgagaaagagaaggagaatgaaaaactgatcaaggagctgacgcagaaactggagcagaataagaagatgaacagggattacacacggaacgcttctaatctggaaaggaatgacctgaggattgaggatggcatctcctcaacgcttccatctaaagagtctcgcagaaagggcggactggactatctgaaacaagtggaaaacgagaccaggaactag

SEQ ID NO: 122160 - DNA, 108 bp, Artificial Sequence
  Description of Artificial Sequence: Synthetic coding sequence
atggctgagttcacctcatataaagaaaccgccagttcccgccaccttcggtttaagctgcagagtctgtctcgacgcttggatgagctggaggaagctaccaagtag

SEQ ID NO: 122161 - DNA, 1041 bp, Artificial Sequence
  Description of Artificial Sequence: Synthetic coding sequence
atgaagttttcccctgctcactacctgttgcccctgctgccggcactcgtgctgtctacacggcaagattacgaggagctcgaaaagcagctcaaagaagttttcaaggagcgatccacaatcctccgtcaactgaccaagaccagccgcgaacttgacgggatcaaagtgaacctccaaagccttaaaaacgacgaacaaagtgccaaaaccgatgttcaaaagctgcttgaactgggacaaaagcagcgtgaagagatgaagtcacttcaggaagcccttcagaatcagttaaaggagacaagtgaaaaagcagaaaaacatcaggctaccatcaattttctcaagactgaggtggagagaaaatcaaagatgatacgcgacctgcaaaacgaaaacaaaagcctcaagaacaaattgctgtccggtaacaagctatgcgggattcacgccgaggagtcaaagaaaatccaggcacagctcaaagaactaaggtacggcaaaaaggatctcttgttcaaggcgcagcagttgacagatctggagcagaaacttgccgtggctaaaaatgagctcgagaaggccgcccttgatcgcgagagtcaaatgaaagctatgaaagagactgtgcaactgtgtctcacctcggtcttcagagatcagccccctccaccactctctcttattacttccaacccaacaaggatgttgctgcctccccggaacattgcttcaaagctgccagacgccgctgctaagtctaagcctcaacagtctgcatcagggaataatgagtcgagccaggtcgagagcaccaaggaaggaaatcccagcaccaccgcttgcgatagtcaggacgagggccgtccttgttccatgaagcataaggagagccctccctccaacgctactgccgaaactgaacctataccgcagaaactccagatgcccccttgttccgagtgcgaggtaaaaaaagcacctgagaaaccactaactagtttcgagggcatggctgccagagaggagaagatcctgtag

SEQ ID NO: 122162 - DNA, 783 bp, Artificial Sequence
  Description of Artificial Sequence: Synthetic coding sequence
atgaagtcactgcaggaagccctgcagaaccagttaaaagagacatctgagaaggcagagaagcaccaagctaccataaactttctgaagacagaggtcgagagaaagagtaaaatgataagagacctgcagaacgagaacaaaagcctcaaaaacaagctactgtccgggaacaaactatgcgggatccacgccgaggagtccaaaaagatccaggcccagctcaaagagttgcgctatggtaagaaggacctcctatttaaagcccagcaactgacggacctggaacagaaattggccgtggcaaaaaacgagctggaaaaagcagctcttgatagagagagtcaaatgaaggcaatgaaagaaaccgtccagctgtgcttaacatctgtcttccgggaccaaccccctccccctctctctctgatcacctctaatccaacacgtatgctcctgcccccgaggaacattgcttccaaactgcccgatgcggccgccaagtcaaagccacaacagagtgcttccggaaataatgagtcctcccaggtggagtctacaaaagaagggaaccccagtacaactgcctgcgattcccaagatgagggacgaccctgtagcatgaagcacaaagagtcgccgccctccaatgctacagccgaaaccgagccgattccccaaaaattacagatgcctccctgcagtgagtgcgaagtgaaaaaggcacctgagaaacccctcaccagtttcgaggggatggccgctcgagaagagaagatactgtag

SEQ ID NO: 122163 - DNA, 900 bp, Artificial Sequence
  Description of Artificial Sequence: Synthetic coding sequence
atggccgagctaggcttgaacgagcaccaccaaaacgaggtgattaattacatgcggtttgcacggtctaagagagggctccgtctcaagaccgttgactcatgcttccaggatctgaaggaaagcaggctagtggaggacacttttacaattgatgaggtgtccgaggtgctgaacggtttgcaggccgtggtgcactccgaagtggaaagcgaactgatcaacacagcgtacaccaacgtcctgctgcttagacaactgtttgctcaagctgagaagtggtacctaaaactgcagactgacatctccgaattggaaaatagggaactgttagagcaagtggccgagttcgagaaagctgagataaccagctcaaacaaaaagccaatcctagacgtgacgaagccaaaactggcccctttgaacgagggcggcactgctgaactgttgaacaaagagatcctgaggttgcaggaggagaacgaaaagctgaagagcagactgaagactattgagatccaggccaccaatgctcttgatgagaagtcaaaactagagaaggcgctgcaggacctgcagcttgatcagggaaaccaaaaagatttcatcaaagcccaggacttgtcaaacttggaaaacaccgtggcagctctgaagtctgagtttcagaaaacactgaatgataagacagaaaatcagaagagcctggaagaaaacctggccacagctaaacacgacctactcagagtgcaggagcaacttcatatggcggagaaagagctggagaagaagtttcagcagactgctgcctaccgaaacatgaaggagatactgaccaagaagaatgaccagatcaaagacttgaggaagaggttggcccagtatgaacccgaagactag

SEQ ID NO: 122164 - DNA, 849 bp, Artificial Sequence
  Description of Artificial Sequence: Synthetic coding sequence
atgcggtttgctcgaagtaaacgggggctgaggctgaagaccgttgattcctgttttcaggatttgaaagagagtcggcttgtggaagatacatttacgatcgacgaggtgagcgaggtgctaaatggtctgcaagccgtggttcactcggaagtagaatcagagctcatcaatactgcctataccaacgtgctgctgctgcggcagctgttcgcccaagccgaaaagtggtatttgaagctgcagaccgatatttctgagctcgaaaacagagagttactggagcaggttgccgaatttgagaaagccgagattacgtctagcaacaagaaacctatcttggacgtgaccaaaccaaaactggctcccctgaacgagggcgggaccgcagagctcctgaataaggaaatattgagactccaggaggaaaatgagaagttgaagtcccgattaaagacaatcgagatacaagccaccaacgcactcgacgaaaaatcgaaactcgagaaagcacttcaggacttgcaattggaccagggtaatcagaaagattttattaaggcgcaggacttgtctaacctcgagaacacagttgccgccctgaaatctgagtttcaaaaaacacttaatgacaaaaccgagaatcaaaaaagcctagaggagaatctcgcgacggcaaaacatgacctcctacgggtccaggagcaactacacatggcagagaaagaactcgagaagaagtttcagcagactgccgcctatcgcaatatgaaggagatccttactaagaaaaatgatcagatcaaagatctccgcaagcggctggcgcaatacgaaccagaggactag

SEQ ID NO: 122165 - DNA, 771 bp, Artificial Sequence
  Description of Artificial Sequence: Synthetic coding sequence
atgagaaaccaggatccggggaaaatgggcaggcaaaggaaaagcatcaagttgtaccctactcatccattggtcactttccctcgaagttgggccaagttccaagagaaagccctcctggttgaggacactttcacaatcgacgaagtgtccgaagtgctgaacggcctgcaggcagtagttcatagtgaagtggaaagtgaactaataaacaccgcctacaccaatgttctgctactccgacagctgtttgcccaagctgagaagtggtatctgaagctccaaaccgacatcagcgagctggagaacagggaactcctggagcaagtggccgaattcgaaaaggccgaaatcacatcaagtaataagaagcctatcttggacgtgactaagccaaaattagcaccactgaatgaaggaggaactgccgaactgcttaacaaggaaatactgaggctccaggaagagaatgagaaattaaaatccaggctcaaaacaattgaaatccaggccacaaatgcactggatgagaagagtaaacttgagaaagcgctgcaggaccttcaattggaccagggtaatcagaaagactttatcaaagcacaggacctgagtaatcttgagaacacagtagctgctctgaagtctgaattccaaaaaacactcaacgataagacggaaaaccaaaaaagcctggaggaaaacttggccaccgccaagcacgatctcctgagggtgcaggagcagctgcacatggccgaaaaaatttag

SEQ ID NO: 122166 - DNA, 441 bp, Artificial Sequence
  Description of Artificial Sequence: Synthetic coding sequence
atggtggatgagctggttctgctgcttcatgcattgttaatgcggcaccgggcactgtccatcgaaaactctcagcttatggagcagttgagacttctagtgtgtgaacgagcatcattgctccgccaggtacggcctccctcctgccccgttccatttccagaaaccttcaatggcgagtcatcacgcttgccggaattcattgttcagactgcatcttacatgctcgtgaatgaaaacagattctgcaacgacgccatgaaggtggcctttttgatttccctgctgacaggcgaagccgaggagtgggtggtgccgtatatagagatggactcaccgattctgggcgactatcgggctttcctggacgaaatgaaacaatgtttcggatgggatgatgatgaggacgacgacgacgaggaggaggaagacgattattag

SEQ ID NO: 122167 - DNA, 2220 bp, Artificial Sequence
  Description of Artificial Sequence: Synthetic coding sequence
atggcctcaatcttattgcggagttgtagaggacgtgcccccgcccgactgccaccacctccacggtacacagtgcctcgaggctccccaggcgatccagcccatttgagctgcgcaagtacacttgggctgaggaactgcctgaatgttccttttggctgctgcactcccatccaccctgtgtatacatcttctagaggcgatcacctcgggtgttgggcccttcggcccgagtgtctcagaatcgtgtcacgggcaccatggacttccacctccgtgggatttgtggccgtgggccctcagtgtctgccggtgaggggctggcactccagcagacccgtccgcgacgattccgtcgtcgagaaaagtcttaaatcactgaaggacaaaaacaagaagctggaggagggtggtcctgtgtatagcccacccgctgaggttgtagtgaaaaagtctctaggccagcgtgttctcgatgagcttaagcactattaccatgggtttagattactatggattgacactaagatcgccgctagaatgctgtggagaatcctgaacggccattccctgacaaggcgggagcgcaggcagtttcttagaatctgtgcagacctgtttaggctcgttcctttcctggtcttcgttgtcgttccttttatggaattcctcctgcccgtggcagtcaaactgttccctaatatgctgcccagtacgttcgagactcagtcactgaaggaggaaaggctgaagaaagagcttcgtgttaagctggagctggctaaatttttgcaagacactatcgaggaaatggctctgaaaaacaaggccgctaaaggatcggcgacgaaagatttctccgttttctttcagaaaattagggagaccggcgaaaggccgtctaacgaggagatcatgcggttcagcaaactgttcgaagacgagctcacactcgataacctgacccgccctcagttggtggccttgtgtaagctattggagcttcaatcaataggcactaacaactttctgaggttccagctcactatgcgtctgcggagtatcaaggcagacgataagctgatagccgaggagggtgtcgattcgttgaacgtcaaggagctccaagctgcttgccgtgccagaggaatgagagctcttggagttaccgaagaccgactcaggggacagctgaaacagtggcttgacttgcatctacaccaggagatcccgacgtcgctgctcattttatctagagctatgtacctgcctgacactctttcaccggccgaccagctcaaaagcaccctgcagacactgcccgagattgtggccaaggaggctcaagttaaggtggcagaggtggaaggcgaacaggtggacaacaaggccaagctagaggccacccttcaggaggaggccgcaattcagcaggagcaccgcgaaaaggaacttcaaaaaagatccgaggtggcgaaggactttgaaccagaacgggtggtggcagctccccagagacctggcaccgaacctcagcctgaaatgccagacacagtgcttcaaagtgagactctcaaggatacagcacccgtgttggaaggactgaaggaagaagagattactaaagaagagatcgacatcctttcagacgcctgctcgaagctgcaggaacagaaaaagagtttgacaaaggagaaagaagagctggagttactcaaggaggatgttcaggattattcagaagatttgcaggagatcaaaaaggaactaagcaagacaggcgaagagaagtatgttgaggaatctaaggctagcaaaagacttacaaagagggtccagcaaatgatcggtcaaatcgacgggctgatctcacagctggagatggaccagcaggcaggtaaactggcccccgcaaacggaatgcctaccggagagaatgttatctcagtcgcggaactgatcaatgcaatgaaacaggtgaaacacatacctgagtctaaactgacctctttggctgccgctttggacgaaaacaaggatggtaaagtgaacattgatgatttggtaaaagtgatcgagctcgtggataaagaagacgttcacatttctacatcacaggtcgctgaaattgtggccacactcgaaaaggaggaaaaagtagaggagaaagaaaaggccaaggagaaagcggaaaaggaagttgccgaagttaagagctag

SEQ ID NO: 122168 - DNA, 759 bp, Artificial Sequence
  Description of Artificial Sequence: Synthetic coding sequence
atgaggcatacatggccatttcggaacgtgcctttcggctgctgcacgcctatacaccccgtgtataccagttccagaggagaccatctcgggtgctgggccctgaggcctgaatgcttgcgcattgtgtctcgggccccctggacgagcacctctgttggctttgttgccgtgggcccacagtgcttgcctgtgcgtggctggcactccagccgccccgtgagagatgacagcgtggtcgagaagagcctgaagtcactgaaggacaagaataagaagctggaggagggaggccctgtttattctcctcctgcagaggtagtcgtcaaaaagtccctcggccagagggtgctggatgaacttaaacactactaccatgggttcagattactttggatcgatacgaagatcgcagcccgcatgctgtggagaattctcaatggacattcattaacgaggcgagaacgtcgccaatttctccgcatctgtgcagacttattcaggctggtcccttttctggttttcgttgtagtcccatttatggaatttctgctccccgtagcggtgaagttgttcccaaatatgctgccttcgacttttgagacacagagtctaaaggaagaacggttgaagaaggagctccgggtgaagctcgagctggcaaagttcctccaggataccatcgaagaaatggcgctgaagaacaaagctgccaagggcagtgccacaaaggacttctcggtgtttttccagaagtag

SEQ ID NO: 122169 - DNA, 4185 bp, Artificial Sequence
  Description of Artificial Sequence: Synthetic coding sequence
atggccgctctgctacggtcggctagatggctcctacgggcaggagccgctcctagattaccgctttcactgcggttgcttccaggggggccgggcagacttcacgccgcgtcatatctgcccgccgcccgggccggccctgtagccggtggcctgctctctcctgccaggctatatgcgatcgccgctaaagaaaaggatattcaggaggaatccactttcagctcaaggaagatttccaatcagttcgattgggcattgatgcggctggacctttccgtcaggcgcacgggcaggatccctaaaaagctgttgcagaaggtgttcaacgacacttgccggtccggggggctcggggggtctcatgcgctgctgctgttgcgttcatgcggctcgctgctgcccgaacttaaattggaggaaagaacagagtttgcccaccgtatctgggacactctccagaagcttggtgcagtttatgatgtgtctcactataacgcgttgttaaaagtttacctgcaaaacgagtacaagttctcacctacggacttcctggctaaaatggaagaagctaacattcagcccaacagggtgacataccagcgactcattgcgagctactgtaatgtgggggacatagagggcgccagtaaaatcctggggtttatgaagacaaaagatctcccggtgaccgaggcagtttttagcgcccttgtgaccgggcacgctagggctggcgacatggagaacgccgagaatatcctgactgtcatgagggacgccgggattgagcctggccctgatacctatctggccctcctgaatgcttatgcagagaaaggcgacatagaccacgtgaaacagaccctggagaaggtagaaaaatctgaactgcacctaatggatcgagatctgttgcagattatttttagcttctctaaggcaggctacccacaatacgtgtcagagatactggagaaggtgacatgcgaacggagatatattcctgatgcgatgaacctaatcctgctgctggttactgagaaactagaggacgtagccctgcagattttactcgcttgccctgtcagcaaagaagacggccccagcgtgttcgggtcctttttcctacaacattgtgtaacaatgaatacccctgtggaaaagctcaccgactattgtaaaaagttaaaggaagtgcaaatgcacagctttcccttgcagtttacactccactgcgcccttctggccaataagactgacctcgccaaggctcttatgaaagcagtgaaggaggagggcttccctattaggccacactacttttggcctctgttggtgggccgccggaaggaaaagaacgtccagggtatcatcgagatcttaaaaggaatgcaggagctgggggtccacccggaccaagaaacatacaccgactatgttatcccctgcttcgactccgtgaacagcgcccgagccatactgcaagagaatggttgcctgtccgactctgatatgttcagtcaagccgggcttagaagcgaggctgccaacggtaacctggatttcgtcctttcattcctgaaaagtaacacactgcctatctctcttcaatctataagaagttcattgctcctaggttttagaaggagcatgaacataaacctatggtccgagattactgaactcctgtacaaggacgggagatactgtcaggagcccaggggccccacggaagctgtgggttacttcctgtacaacctgatcgacagcatgtctgattcagaagtccaggcaaaggaggagcacttaaggcagtattttcatcaactggagaagatgaacgtgaagatcccagagaatatctaccgggggatccgtaatctcctcgagtcataccacgttccggaattgatcaaagacgctcacctattggtcgagtcaaagaacctggacttccagaagacagttcaacttacatccagcgaattggagagcacgctggaaacgctgaaggctgaaaatcagcctatcagagatgtgctcaaacaactcatccttgtgttgtgctccgaagagaacatgcagaaagctctggagctcaaggccaaatatgagagcgacatggtgactggcgggtacgctgcgctgattaatctgtgctgccggcacgacaaggtggaggacgcactcaacctgaaagaagagttcgatagattagactcctcagctgttttggacacagggaagtatgttggattggtcagggttctcgctaagcacgggaagttgcaggacgcaatcaatatcttgaaagaaatgaaggagaaagatgtgctgattaaagacacaaccgcactctcatttttccacatgctgaacggcgctgctctaaggggggagatagagacagtgaagcagcttcatgaagcaatagttactcttggcctggctgaaccatctaccaatatttctttccctctggtgaccgtacacctcgagaaaggggatcttagtacggcactggaagtcgccatcgattgctacgaaaagtataaagtcctgccacggatccacgacgtactctgtaagttggttgagaagggagaaaccgatctgattcaaaaagccatggacttcgtgagtcaggagcaaggggagatggtgatgctgtacgatttgttcttcgcattcttgcagactggcaattacaaagaggctaagaagattatagagactccgggcatccgggctcgctcagcaagactacaatggttttgcgacagatgcgtggccaataatcaggtcgaaaccctagagaagctagtagaactcactcagaaactctttgagtgtgaccgggaccagatgtattacaatctactgaaactctacaagattaatggtgactggcaaagggcggacgcagtctggaataagatccaggaagagaacgttattccacgcgagaagaccctgcgtctgctggctgagattttaagggagggaaaccaggaagtaccctttgatgtgcctgagttatggtatgaagatgagaaacattccctcaatagctcctccgctagcaccacagaaccggacttccagaaagatatactgattgcttgccggctgaaccagaagaagggggcatacgatattttcctgaacgcaaaggaacagaacattgtattcaacgccgaaacatactctaacctgatcaaattgctcatgtctgaagactatttcacgcaagctatggaggtgaaagcttttgccgagacccatatcaaaggcttcacattaaacgacgcggccaacagcaggctgattatcactcaggtgcgtcgcgattacctgaaggaggccgttacgactctcaagaccgtccttgatcagcaacagacaccatcccggctcgcggtgactcgcgtcattcaggccctcgccatgaaaggtgacgtggagaatatcgaggtggtgcagaagatgctgaacggcctcgaagacagcatagggttgtcaaagatggtgttcattaacaacatcgccctggcccagatcaaaaataataatatagacgccgccattgaaaatatcgaaaacatgctcacaagcgagaataaggtcattgagccacaatacttcgggctcgcatatctgtttcggaaggtgatcgaagagcaactggagccagccgtggaaaagatctccattatggccgaacgcttagccaaccagtttgctatctataaacctgttactgacttctttctgcaactggtcgatgctggcaaggtggatgacgcccgcgcgctgttgcaacggtgcggagctatcgccgagcagacacccatacttttgctttttctgctgcggaatagtcggaagcagggcaaagcttcaaccgtaaaatccgtgctggaactgatccctgagctcaatgagaaggaagaggcctataacagtctgatgaaatcatatgtctcagagaaagacgtgacttctgccaaggcactgtacgaacacctgactgccaaaaacactaagcttgacgacctgtttttgaaacgctatgcctctttgctcaaatatgccggggaaccagtgccttttatcgagccgccagaatcgttcgaattttacgcccaacagttacgcaaacttagggagaactcttcctag

SEQ ID NO: 122170 - DNA, 3264 bp, Artificial Sequence
  Description of Artificial Sequence: Synthetic coding sequence
atgcctccaccaatctgtcccccactcgcacctggaccatggcccggggggctcggcggcagccatgctctcctgctcctgcgttcttgcggaagcctgcttcccgagttaaagctggaggagagaacagagtttgctcaccgcatatgggacactctgcagaagctaggagcggtgtacgacgtaagccactataacgcccttctgaaggtctacctgcagaatgaatataaattttctcctaccgattttctggccaagatggaggaggcaaatatacaaccgaatagagtcacatatcagcgcctgattgcctcgtactgtaatgtaggcgacatcgagggagcgtcaaaaatcctcggcttcatgaagacaaaggacctcccagtcaccgaagccgtcttcagtgctctagtgactggccatgctagggcgggagacatggaaaatgctgagaacattttaactgtgatgcgggacgcgggaattgagcccggaccggacacctacctggctcttctaaacgcctacgcagagaaaggtgacattgatcacgtgaaacagaccttggagaaagtagagaaatctgagcttcacttaatggaccgcgacttgctccagatcatcttctctttttcaaaggccggctacccccagtatgtgagcgagatcctggaaaaggttacctgtgaacggcgttacatccccgatgcgatgaatctcattctcttgttagtgacagaaaaactcgaggatgttgctttgcaaattctgctcgcatgtcctgtgagcaaggaagacgggccgtcagtctttgggtccttctttttacagcattgtgtcactatgaacacaccagtggagaagctcacggattactgtaagaaacttaaggaggtgcaaatgcacagcttccccctgcagtttacactccactgcgcactgctggccaacaagaccgacctcgcaaaagcactgatgaaagctgtgaaagaggaagggttcccaatccgcccccactatttttggcccctcctggttggaagacggaaggagaagaatgtgcagggcataatcgagatccttaagggaatgcaggaactgggcgttcatcccgaccaggaaacctacactgactatgtcattccatgcttcgactctgttaattctgcgcgtgctatactgcaggaaaatgggtgtctttccgactctgacatgttctcccaggcagggctcagaagcgaagcagcgaatgggaaccttgacttcgtgctgtcctttctgaagtcgaacactctcccgatctcacttcaatcgataaggtccagccttcttctggggtttagacgaagtatgaatatcaacctctggagcgagattacagaattgctttacaaggacggcaggtactgtcaggagcccaggggtccaaccgaggcggtgggatactttctctacaacctgatcgatagcatgtctgatagtgaggtgcaggccaaggaagaacacctgaggcagtattttcaccaactggagaagatgaacgtgaaaatccctgaaaatatctaccgggggatcagaaacctgcttgagagttatcacgtacccgaacttatcaaagacgcacatctgctggtggagagtaaaaacttggacttccaaaaaacggtccagctcacctcgagtgaactggaatcaaccctggaaacactgaaagcggaaaaccagccaatccgggatgtactcaagcaactgatattggtgctctgcagcgaagagaatatgcagaaagcgttagaactgaaggccaagtacgaatcagacatggtaaccggcggttatgctgcgctcattaatctgtgctgtagacacgataaggtcgaagatgctctgaacctgaaagaggagttcgatagacttgactccagtgctgtgctggataccggaaaatatgtgggattggtccgagtactggctaagcacggaaaactgcaggacgcaattaacattcttaaagagatgaaagaaaaggacgttctcattaaagatacgacggctctctccttcttccatatgctaaacggagccgccttgcgtggcgagatcgaaactgtgaaacagctgcatgaggcaatcgttacgctgggactcgcggaaccctccaccaacatctcttttccactcgtgaccgtccacctcgagaaaggagacctgtctacagcccttgaagtggcgattgattgctacgagaaatataaggttctgccaaggattcatgacgtgctatgtaagttagttgagaagggcgagactgatctgatccagaaagcaatggattttgttagtcaggagcagggagagatggtgatgctgtacgatctgttttttgccttcttacagaccgggaattacaaagaagccaagaagattatcgagacgccaggcattcgggccagatccgcccgccttcagtggttttgtgatcgatgcgttgccaataaccaggtagaaacactcgagaaattggtggagctcacgcagaaattattcgaatgtgaccgagaccagatgtactacaacttgctgaaactgtataagatcaatggcgactggcaacgggccgacgccgtatggaataaaatccaggaggagaatgtaatcccgcgcgagaaaacccttcggctcctagcagagatcttaagagaaggtaatcaggaagtcccattcgacgtgccggagctgtggtacgaagacgaaaagcactcgttaaattctagttcagcttcaactaccgagccagattttcaaaaagacattttaatcgcttgcagactgaatcagaaaaagggcgcctacgatatttttcttaatgcaaaggagcaaaatatcgtgtttaatgcagaaacttactccaatctaattaagctgctcatgtccgaagactattttacccaggccatggaagttaaggctttcgcggagacgcacataaaaggctttactctgaacgacgccgccaactccaggcttatcatcacccaagtgcggcgggactacttgaaagaagcagtgacgactctgaaaacagttttggaccagcaacagacgccgagccgactggccgtgacccgggtgatccaggccttggctatgaagggggacgtggagaacatagaggtcgtgcagaaaatgttgaacggcttagaggatagcattggcttgagcaaaatggtgtttataaacaacattgcgttggcccagtag

SEQ ID NO: 122171 - DNA, 2856 bp, Artificial Sequence
  Description of Artificial Sequence: Synthetic coding sequence
atgcctggacccctcggactgctttgctttctcgccctcgggctcctgggctccgcaggccccagtggcgcagcccctccattgtgcgctgctccttgcagctgtgacggcgatcgacgagtggactgtagtggaaaaggactcaccgcagtgcctgaaggactttccgcctttacccaggcattggatattagtatgaataatatcacacagctgcctgaagacgccttcaaaaacttcccatttctggaggagctccaactcgccggaaacgaccttagctttatacaccctaaggcattaagcggacttaaagagctgaaggtactgactcttcaaaataaccaactgaagacagtgcctagcgaggccatccgcgggctctctgccctgcagtcactgcgtttggatgctaaccacataacttcagtcccagaggactcttttgagggcctggtccagctccgccatctgtggcttgatgacaatagtttgaccgaagtacccgttcatcccctgtctaacctcccgaccctgcaggcgctgacactggctctgaataagataagctccattcccgatttcgcatttactaacttatccagtctagtggttctgcatttacacaacaacaagatacgctcactatcgcagcactgctttgatggcctggacaacttggaaacactggatttaaattataacaaccttggtgaattcccccaagctatcaaggccttacctagcctcaaggaattggggttccactctaatagtatcagcgtgatccccgacggcgcctttgacggaaatcctctcctgcgtaccattcatctctatgataaccctctaagctttgtgggaaactcagcgtttcataatctgtctgatctccattcacttgttattcggggagcgagcatggtgcagcagttccctaacttgacaggcactgtgcatttagagtccctcactctcaccgggaccaaaatcagttcaatccctaacaatttatgtcaggaacaaaaaatgctaagaactttggacctatcatacaataacatcagagaccttccctccttcaacgggtgtcacgcattggaggaaattagtctgcagaggaatcagatctaccagatcaaggaagggactttccagggtctgattagcttacggattctggatttaagccgcaacttgatccatgagattcattctcgcgcttttgctaccctgggaccaatcaccaacttggacgtctccttcaatgaactgacttcttttcccacggagggtctgaacggtttgaaccagttaaagctggtcggaaactttaagctcaaggaagcccttgccgcgaaggactttgtcaacctgcggtcccttagcgtcccgtacgcttatcaatgctgcgccttctgggggtgtgactcctacgccaatctgaatactgaagataactctcttcaggaccacagcgtggcgcaggagaagggtacagccgacgcagccaacgttacttccacgctcgaaaacgaagaacacagccagatcattatccattgtaccccaagcacgggagctttcaaaccttgcgagtacctgcttggttcctggatgatcagacttaccgtgtggttcatcttcttggtggcattgttctttaacctcctggtgatactcaccactttcgcctcttgtacttcccttccaagctccaagctcttcatcggcttgataagcgtgtctaatttattcatgggaatttacaccggtatcttgaccttcttggacgccgtatcctggggccggtttgcggagtttgggatctggtgggagaccggttctggatgtaaggtggcggggttcttggccgtcttctcatctgagtcagcaatttttctcctaatgcttgctactgtggaaagaagtctgtctgcaaaggacatcatgaagaatgggaaatctaatcatttgaagcagtttcgggtcgccgccctcctcgcgttcctgggtgcaacggtggccggttgcttccccctgtttcatagaggtgagtattccgcatctcctttgtgcctgcctttcccgacgggcgaaaccccgtccctcggattcaccgtgacgctcgtcctgctgaatagcctggcctttctcctgatggccgtcatctatacgaagctttattgtaatctggaaaaggaggatctgtctgagaatagtcagtcctccatgattaagcacgtcgcatggttaatcttcaccaattgtatctttttttgtccggtcgctttctttagtttcgccccacttatcacagcaatttcgatctcgccagaaatcatgaaatctgttaccctcatttttttccctctgcctgcatgtctcaaccccgtgctttatgtgttttttaatcctaaattcaaggaagactggaaactgcttaaaagacgggtgacaaaaaaatcaggttccgtgtctgtgtctatatcgtcccaggggggctgcctcgaacaggacttctactatgattgcggtatgtatagccatctccagggtaacctcaccgtgtgtgactgctgcgagtcgtttctcctcacgaaacccgtctcctgcaaacacctgattaagtcccacagttgcccggcactggcggtggcaagctgccagagacctgagggatactggagtgattgtggaacccagtcagctcactcagactacgcggatgaggaggactccttcgtctctgactcatctgaccaagtccaggcctgtggcagggcttgcttctaccagtctagggggttccccctggtgcgatacgcttacaatctgcctcgcgtgaaagactag

SEQ ID NO: 122172 - DNA, 2724 bp, Artificial Sequence
  Description of Artificial Sequence: Synthetic coding sequence
atggatacaagtagactaggggtcctcctctcattacccgtcctgctccaactggccactggtggctcctctccacgcagcggggttctcctccgcgggtgtccaacgcattgtcattgtgaacctgacggaaggatgctgcttagggttgactgctcagatctggggctctccgagctgcctagtaacctctccgtgtttaccagctatctggacctttccatgaataacattagccagctcctgcccaaccctctcccctctttgcgtttcctggaggagctccggctggctggtaacgccctgacttacatcccaaagggcgcctttactggactctacagtcttaaagtgcttatgctgcagaacaaccaattacgccacgtgcctactgaagcactgcaaaatttgcgcagccttcaatctttgagattagatgccaaccatatcagttatgtgccaccaagctgtttcagcggcctgcactcccttaggcacctgtggctggacgataacgctttgacagaaatcccagtccaggcttttagaagtctatccgctcttcaggcaatgactcttgctcttaataaaattcatcatatccccgattacgctttcggcaatctgagttccctggtggtgctccatttacataataaccgtattcattcactgggcaagaaatgtttcgatggactgcatagtctcgaaaccctggatctgaactacaataacttggacgaatttcccaccgccattcgcaccttatcaaacctcaaggagttgggatttcattcaaacaacattcggtccatccctgagaaggcttttgtcggcaaccctagcttaattaccattcatttctacgacaatccaattcagttcgtcggccggagcgcatttcagcacctgcctgagctgcggactcttacactgaacggggccagccagataactgagttccccgacttgactggaactgccaacctagagtccctcacattgacaggggctcagatatccagcctgccacagaccgtatgcaaccagctccctaacctgcaggtgctcgacctctcctacaacctgcttgaagatttaccatccttcagtgtctgtcaaaaacttcagaaaatcgatttacgccacaatgagatctacgagatcaaggttgacaccttccagcagttactttccctgcgctcccttaatctggcatggaacaagattgctataattcatcctaacgcttttagcaccctgccaagcctgatcaaactcgatctcagctccaatttgttgtcctcttttccgataacaggtctgcacgggcttactcatcttaaactaaccggaaaccatgcccttcagtccctgataagttcggagaacttccccgagctgaaggtaatagaaatgccctacgcatatcagtgctgtgccttcggcgtctgcgagaatgcatacaagatctccaaccagtggaacaaaggggacaattcctcaatggacgacttacacaaaaaagatgcgggtatgtttcaagctcaagacgaaagagatctcgaagatttccttcttgattttgaagaagatcttaaggctttgcacagcgtgcagtgctctccatcacctggccctttcaagccatgcgagcacttgctggatggatggctcattcgaatcggcgtgtggaccattgccgttcttgcactgacctgcaacgccctcgtaacctcaactgtattccgaagccccctgtatatatccccaatcaagcttcttatcggggtgatcgctgccgtcaacatgcttactggagtgtcgagcgctgtgttagccggagttgacgccttcacatttgggtcgtttgctcgccacggggcctggtgggaaaacggcgtggggtgccatgttatcggctttctcagcattttcgccagtgagtctagcgtttttttattgactcttgctgcccttgagcgcggcttctctgtcaagtattctgccaagtttgagacgaaagctcccttctcatccctaaaagtgataatcttgctctgcgctctgctcgccctcactatggccgccgtgcctctgctgggagggtctaagtatggcgccagtccactgtgccttcccctgccttttggggaaccctccaccatggggtacatggttgccctgatcctcctgaattccctctgttttttgatgatgaccattgcatacaccaaactgtactgcaacttggacaagggggacttggagaacatttgggactgttcgatggtgaagcacatcgcgctcctgctgttcactaactgcatattgaactgccctgtcgcattcctgagtttcagttctctgattaatttaacttttatctctcccgaagtgataaagttcattctgttagtggtagtgcccctaccagcctgcttgaaccctctgctttacattctctttaaccctcatttcaaggaggacctcgtatccctaagaaaacaaacgtatgtgtggactaggagcaaacacccaagcttaatgagcataaattccgacgatgtggaaaagcagagctgcgattcaacccaggccttagtcacctttactagctcttccatcacatacgaccttcctccctctagcgtcccttcgcctgcgtacccagtcactgagagctgtcatctttcttccgtagccttcgtgccttgtctttag

SEQ ID NO: 122173 - DNA, 2334 bp, Artificial Sequence
  Description of Artificial Sequence: Synthetic coding sequence
atggacacatcccgcctgggcgtcctgctgtcacttcccgtgttgctgcagctggctacaggagggtcctccccccgcagcggcgtcctcctgaggggttgtccaacccactgtcactgcgagcccgatggaagaatgctgctccgagtcgattgcagtgatctaggactctcggagctgcctagcaacctctccgtgttcacttcctatttagacctgtctatgaacaatatttctcagctcctgccgaatccgctcccgtcgctgcgctttcttgaagaactccgcctggcagggaacgcattaacctacatccccaaaggtgcctttaccggcctctattcacttaaagttctgatgcttcagaacaaccaactgcgccatgttccaaccgaagccctccagaaccttaggagtctgcagtcgttaaggctggacgctaatcatatctcttacgtaccacccagttgcttctctggactccattcactgcgccatctgtggctggatgataatgcgctgactgaaattccagtgcaagccttcagaagcctgtccgcgctgcaggcgatgaccctggctctgaacaaaatacatcatattccagactacgcttttggaaatttatcttctttagtggtcctccacttgcacaacaaccggattcacagcctgggcaagaagtgtttcgatggtctacactcacttgaaactttggatctcaactataataacctggatgagtttcctaccgcaatccggactcttagtaatctcaaggagttgggttttcacagtaacaatatcaggagtattcctgagaaagcttttgtggggaatccatccctgattaccatacatttctatgacaacccgatccagttcgtgggtagatccgcatttcagcacttgccagagctgcggacactaacactgaatggggcgagtcagatcactgagtttcccgatttgactggcactgctaacttggaatctctgacccttactggcgctcagatttcctctctgccacaaacagtgtgcaaccagctccctaatctacaggtcctcgatctttcctacaacttacttgaagaccttccatctttttcagtgtgccaaaaactgcagaagatcgatttgaggcacaacgaaatctacgaaattaaggttgacactttccagcaactgctgtccttaagaagtctcaacctagcttggaacaaaatcgctatcatccatcctaacgccttctccaccctgccctcgcttattaagctggacctctccagtaatttgctgagttcattccccattacagggctccatggactgacccacttaaagctcacaggcaatcacgcacttcagagtctgatctctagcgaaaattttcccgaactgaaagtcatcgagatgccctatgcatatcaatgctgcgcctttggcgtctgcgagaacgcttataagatcagcaaccagtggaataagggggataactcatccatggacgatttgcataaaaaagacgccggaatgtttcaggctcaggacgaacgcgatctagaggactttctgctggactttgaggaggacttaaaagctctgcattcggtccagtgttcccccagtcccggaccattcaagccatgtgaacaccttctggatggatggctgatccgtataggagtttggacaattgctgtcctggctctgacttgcaacgccctagtaacttcaactgtgttccgtagtcctttgtatatatctcccattaagctgctgattggcgtaattgctgctgtcaacatgctgactggggtgtcttctgctgtgctcgcgggcgtggacgcctttacctttggaagctttgccaggcacggcgcatggtgggaaaacggtgtcggatgtcacgtcatcgggtttctctctatcttcgccagtgaaagctccgtgtttctgctcacactggcggctctagagcgaggctttagcgtcaaatactccgccaagtttgaaaccaaagccccattctccagcctaaaggtaattatattgttatgcgctctgctggccctgactatggccgctgtgcccctcctcggcggaagcaaatacggcgcctcacccctgtgtctgcccctgcttccacacgacgatcactgcctgcatcaggcccttctccagttcggccagggacggcccggcgagtatctgggcctgctctacggaaagacccattgccccgtggcccttcatcagctgcaccccaagctgccctgcgggttcttggtcttactgctcttcaataaaccctacatctaccagagctag

SEQ ID NO: 122174 - DNA, 2508 bp, Artificial Sequence
  Description of Artificial Sequence: Synthetic coding sequence
atggacaccagtagactgggtgtgctgctgagcctgcctgttctgctgcagcttgcaacgggaggatccagccccaggagcggcgtgctcctaagaggttgccccacccactgccattgcgaaccggacggccgaatgctgttacgcgtggattgctcagatcttggtctgtctgaattaccttccaacctgtctgtctttacaagttacctggacctgtctatgaataacatctcccagttacttcccaatccactacccagccttaggtttttagaagagctgagactcgcggggaacgccctgacctacatccccaaaggagcattcacgggcctgtattctctgaaagtgctgatgctccagaacaatcagctgagacatgtacctacggaggctctccagaatctccgtagtctgcagtcactacaccttcacaataatagaatccattccctgggtaagaaatgcttcgacggtcttcattccctggagacgctagacctaaactataacaacttggacgagttcccgaccgcgatccgcacactcagcaacctcaaggagttggggtttcactcaaacaacatacgcagtatcccagagaaagcatttgtcgggaatcctagccttatcaccatacacttttacgataaccccatccagtttgtcgggagatccgcattccagcacctgcccgaactgcggacacttacactgaatggcgcctctcagattactgaattccccgatctcactggcaccgccaatttggaaagtctgacactgactggggctcagatctcttccctgccccaaaccgtgtgtaaccagctcccgaatctccaagtgctcgatctctcctacaatctgctggaagatctgccgtcattcagtgtctgccagaagctccaaaagattgatctcagacataacgaaatctacgaaatcaaagtggatacttttcagcaactgctgtcattacgcagcctgaacttggcatggaacaaaatagccataatccaccccaacgccttctccacactgccatccctgattaaactggatctatctagcaatctcctttcctcattccctataactggcctgcacggcttaactcacctgaagttaacaggcaaccacgcgctgcagtcgctgatctctagcgagaattttccagaacttaaagtcatcgaaatgccttacgcataccagtgttgtgcatttggggtctgcgagaatgcatacaaaatatctaatcagtggaataaaggcgacaattcctctatggatgatctccataaaaaagatgctggcatgtttcaggcacaagatgagcgagatctcgaagactttctcctggattttgaagaggaccttaaagcgcttcactccgttcagtgctcgccgagcccagggccctttaagccctgtgagcacctgctcgacgggtggctcatcaggattggtgtctggaccatcgctgtgctggctttgacctgtaacgccctggtgacaagcaccgtgtttaggtctcccctatacataagcccaatcaagttactcatcggagttattgcggccgtcaatatgctaactggggtctcgtcggctgtactcgcaggggttgacgccttcacgtttggttccttcgcgcggcacggggcctggtgggagaatggggttggttgccacgttattggattcctttccatctttgcttccgaatcaagtgtgttcctgctgactctggccgccctggagcgcgggttcagcgtgaaatactccgcaaaatttgagactaaagccccattcagctcactgaaggtcataattcttctttgcgctctgctcgcactcaccatggccgcagttcccctgctcggaggcagcaagtatggcgcttcccctctgtgcctacctctcccttttggcgagccaagtaccatggggtacatggtagccctcatcctgctcaattctctctgtttcctcatgatgactatcgcttataccaagctgtactgtaacctggacaaaggcgacctcgaaaatatctgggactgctccatggtaaagcacatcgccctgcttctgtttacaaattgtatattgaactgtcccgttgcttttctctccttttcatccctgattaacttaacctttatctcccccgaggtgatcaaattcatactgttagtggtggtaccactgcccgcctgtctgaaccccttgttatacattctttttaatcctcattttaaggaagatctcgtaagtctgcgcaagcagacttatgtttggaccaggtctaaacatccttcccttatgagtatcaatagcgatgacgttgaaaaacaatcctgcgactccacccaggctcttgtgacctttacatctagctctatcacgtatgacctccccccctcatcagtccctagcccggcctaccccgtcaccgaaagctgtcacctaagttccgtcgcgtttgtgccttgcttatag

SEQ ID NO: 122175 - DNA, 2652 bp, Artificial Sequence
  Description of Artificial Sequence: Synthetic coding sequence
atggatacctctcggctaggggttctgctgtcccttccagtactactgcagctggcaaccgggggtagctccccacggtccggcgtgctgctgcgcgggtgcccgactcattgccattgtgagccagacggacggatgctcctccgcgtcgactgttccgacctcggattgtccgaactgccttccaatttatctgtctttactagttaccttgacctgtccatgaacaacatctcacaactcctccctaacccacttcctagccttcggttcctggaggaattgcgcttggcaggcaacgcgctgacctatatccctaaaggggcctttaccgggctgtattccctcaaggtcctgatgttgcagaacaatcaactccgccatgtgcccacggaagccctacagaatctgcgaagtctgcagtccttgagacttgatgccaatcatatttcatacgtgcctcctagttgtttcagcggcctgcacagtcttcggcacctgtggctggatgataatgcactgacagaaatccccgttcaagcatttcgatctctttcagctcttcaagccatgaccctggccctaaacaaaatccatcatatcccagattacgcctttggcaatttgagcagtctggttgtgctacacctacacaacaatagaattcacagtctgggcaagaaatgcttcgatggattgcacagccttgagactcttgatctcaactacaacaatctagacgaatttcctaccgctataagaaccctttctaacctgaaagagctccacttttacgacaatccgattcagtttgtaggacggtcagcgttccagcacttaccagaacttcgtacccttactttgaatggagctagccagatcaccgagttcccagacttgactggcactgcaaacttagagtcgttaaccctgactggagcacagatctctagtctgccacagaccgtttgcaatcagctgccaaatctgcaggtgttggaccttagttataacctgttagaagatctcccttctttttccgtctgccagaagctacagaaaattgatctccgccacaacgagatttatgagattaaagtggacacatttcagcagctattatctctgcggagtcttaacttggcatggaataagatcgccatcatccaccccaacgcgtttagcacactaccgtcgctgataaagctggacttatcctccaacctgctgtcatcttttcccattaccggattgcacggccttacccaccttaaactcactggcaatcatgctctgcagtcacttattagcagtgaaaatttccctgagctgaaagtgatagagatgccgtacgcttatcagtgttgtgcctttggagtgtgtgaaaacgcctacaaaatcagcaatcaatggaataagggtgataacagcagtatggatgatctccacaagaaagacgctggaatgtttcaggcccaggatgagcgcgatctagaggactttcttcttgattttgaggaagatctgaaagccctacacagcgtgcaatgcagtccctcaccaggacccttcaaaccgtgtgagcacctcctggatgggtggcttatcagaataggtgtgtggacaattgccgttctggcactaacctgcaatgccttggtgacttctaccgtttttagatctcccctttacatttccccgattaagctgctgataggggtgatagcagcagtgaacatgctgacaggagtgtcatccgcagtgcttgctggcgtggatgcgttcactttcgggtctttcgccagacatggtgcatggtgggagaatggagtcgggtgtcatgtgatcggattcctgtcaatctttgccagtgaatcctcagtgtttcttctcacgctggccgcgctggaaagaggctttagtgttaagtactccgcaaagtttgagacaaaggcccccttttctagccttaaggtgattatccttctctgtgccctgctggcattgactatggctgccgtgccactcctcggcggatccaaatatggagcttccccgctgtgcctgcctctaccgttcggggagcccagcacaatgggctacatggtagccttgatcctgctgaactccttgtgcttccttatgatgaccattgcctatacaaagttgtactgtaacctcgataagggcgacttagagaatatctgggattgctctatggtcaagcacatcgcacttctcctcttcactaactgcattctgaactgcccggtggcattcttgtcattcagctctttgattaaccttacgttcataagccctgaggtgatcaagttcattttattagtggttgttccactgcccgcctgcttgaatccactactctacatcctttttaacccccattttaaagaggacctggttagtctaaggaagcagacctatgtgtggaccagatccaagcacccatcactgatgtctattaacagcgatgatgtagaaaagcagtcttgtgacagcacccaagcccttgtgacgtttacgtcctcaagcatcacgtatgacctgccaccatctagtgttcctagcccagcctaccctgtcacggagtcctgtcacctgtcctccgttgctttcgtgccttgcttgtag

SEQ ID NO: 122176 - DNA, 2748 bp, Artificial Sequence
  Description of Artificial Sequence: Synthetic coding sequence
atgggccgtcctcgccttacccttgtgtgccaggttagtataataatctccgcacgagatctgtctatgaacaatctcaccgaattgcagccaggactgttccatcacctgagatttctggaagagctcaggctgtccggtaatcatctgtcacatatcccaggtcaagcgttcagcggactgtacagcctgaagattctaatgctccaaaacaatcagttgggtgggatccccgcagaagctctgtgggaactgccatcactgcagtctctgcggttggatgccaacctcatatccttggtgcccgaacgctcattcgaggggctctcgagtctccgccacctctggctggacgacaatgccctgaccgagattcccgttcgtgcactcaataacctgcctgcgctgcaagctatgacacttgctctaaaccgcattagtcatattcccgattacgccttccaaaatctgactagtcttgtcgtgctacacctgcacaacaaccgtattcagcaccttgggactcactctttcgagggcctgcataatttggagacgctcgatctgaactacaataaactccaggagttccctgtggcaattagaactttgggaagacttcaggaactcggtttccacaacaataacatcaaggccattcccgagaaggctttcatgggaaacccactgcttcagacgatccacttttacgacaatccaatccagttcgtgggtcgttctgcatttcagtatttgcctaaattgcacaccctgagcttgaatggtgcaatggatatccaggagttcccggacctgaaggggaccacttccctagagatccttactctcaccagggccggcattcggctgctgccatccggcatgtgccagcaattacctcggctgagagttctggagctgagccacaatcaaatcgaggaactaccttccctgcatcggtgtcagaagttagaggagattggcctgcagcacaatcggatttgggagatcggtgccgataccttctctcagctatctagtctgcaggcactggacctgtcctggaacgctattcggagcatccaccctgaggccttcagtaccctgcatagcctagtgaaactggacttaacagataaccaattgaccacgttacctctggcagggctaggagggctcatgcacctgaagttgaaaggcaatcttgccctgagtcaggctttcagcaaagactctttccctaaactgaggatcctcgaggttccctacgcatatcagtgttgcccatatggcatgtgtgccagtttttttaaagccagcggtcagtgggaggcagaggacttgcatttagacgatgaagagagtagtaaaaggcctttaggcctgctggctcggcaggccgagaatcactacgaccaggatcttgacgaattacagctcgaaatggaggactcaaagccgcatccatccgtgcaatgcagcccgacccctggccctttcaaaccttgcgagtatttatttgaatcctgggggatacgtttagccgtgtgggccatcgtactcctgtctgtgctgtgcaatggcctcgtgctgttaacggtgttcgcaggaggtcccgtgcctttgcctccagttaaattcgtagttggggcaatagcaggggccaacacattaaccggaattagctgtggcctgctggcttctgtagatgcactcacttttggacagttcagtgaatatggcgcaaggtgggagacggggctcggttgtcgggcgaccggctttctggctgtgctggggtctgaggcctccgtgctcctcctcactctggctgcagtacaatgttctgtgagcgtgagctgtgtaagagcttacggcaagagtccctccctgggcagtgtgcgtgctggagtgctgggctgtctggcactcgccggcctggccgcagcattacctctggccagtgtaggggaatacggcgcctctcctctgtgtcttccatacgccccaccggaaggacaacctgccgccctcggatttacagtcgctctggttatgatgaattccttctgcttcctggttgttgccggcgcctatatcaagctttattgtgatttaccacgcggcgactttgaagccgtgtgggattgtgccatggttaggcacgtcgcctggctcatctttgccgatggactgctgtattgtcctgttgctttcctttcctttgcatccatgttaggcttgttccctgtcacccccgaggcagtgaaatccgttctcctcgtggtgctgcctctgccggcatgcctaaacccattactctacttattgtttaatccccactttagagacgaccttaggcgccttaggcctagagctggcgattccggccccctagcctacgctgccgcaggcgagctcgaaaagagttcctgtgacagtacacaggcattggtcgcattcagtgatgtcgaccttatcttggaggccagcgaggcaggccgccctccaggccttgaaacatacggctttccttcagtaactcttatctcatgtcagcagcctggtgcccctagacttgaggggagtcactgtgtggaacccgaaggcaatcatttcggcaatccacagccctccatggacggcgagttgctcctgagggccgaggggtccacccctgctgggggcggccttagcgggggcggaggctttcagccgagtgggctcgcttttgcctcgcatgtgtag

SEQ ID NO: 122177 - DNA, 699 bp, Artificial Sequence
  Description of Artificial Sequence: Synthetic coding sequence
atgaataacctgactgagctccaacccggcctgtttcaccatttacgctttcttgaggagcttcggctgtcaggcaaccacttgtcacacatcccaggccaggcctttagcggcctctatagtctgaaaatccttatgttgcagaacaaccagctgggcggtattcctgccgaggccctctgggagctcccttctcttcagtcactgcgactggatgctaacctgattagcttggtgcctgagcggagcttcgaaggtctgagtagcctgcgacacctgtggctagacgacaacgccctaaccgagatcccggtcagggccctcaacaatctgcccgccctgcaggctatgactcttgccctgaatcgaatctcccacattcccgactacgcttttcaaaatctgaccagcctagtagtgctggacttaaattacaacaagttgcaagagttcccggtagccatccgcaccttgggacggttacaagagttatccctgaatggggccatggatattcaagagttccccgatctcaagggaactactagcctggaaattctgaccttaaccagagctggcatccgtctcttacccagcggcatgtgccagcaactgccacgcttaagggtacttgagctgtcccacaaccagatcgaggagctgccttccctccatcggtgtcagaagttggaagagtag

SEQ ID NO: 122178 - DNA, 2904 bp, Artificial Sequence
  Description of Artificial Sequence: Synthetic coding sequence
atgccatctcccccaggtctgcgggctctgtggctttgcgctgcactttgcgcaagcaggagggctggaggcgctccacagccaggcccggggccaacagcctgtcctgctccctgtcactgtcaagaggatggcatcatgctcagcgccgactgttctgagcttggcctctctgctgtccctggagacttggatcctcttaccgcttatttagatctgtctatgaataatctgaccgagctccaaccaggtttgttccatcatcttagatttctcgaggaactccgcctgtctggtaatcatttgagccatattccagggcaggccttttctgggctctatagtctgaagattcttatgctgcagaataatcaacttgggggaattccagccgaggctctttgggagttaccttcactgcagtccctgagactggatgcaaacctcatatctctggtacccgagcggagttttgagggcctgagttctctacggcacctgtggctggatgacaacgccttgactgagattcccgtacgggcgctgaataacctaccggcacttcaggccatgacacttgccctgaaccgtatctcgcacatcccagactatgcctttcagaaccttacgagcctggtagtgctgcatctccataataaccgaatacagcacctcggtactcactcatttgaaggactgcacaatctagaaacactcgatctgaactataacaagctccaggagtttcccgtggctatacgcactctcggacggcttcaggagctcggcttccacaataataacataaaagctattcccgagaaggccttcatggggaatcccctcttgcaaaccattcacttctacgataaccctatacaattcgtaggcagatctgcttttcagtatctgccaaagctgcacacccttagtctaaacggagctatggacatccaggaattcccagatctaaaaggaaccacatctctcgagattttgaccttgacccgcgccggaatccgtctgttgccctccggcatgtgtcagcagcttccaagactgcgggtattagagttgagccacaatcagatagaggagctgccaagtttacacagatgccaaaagctcgaggaaatcggcctgcagcataaccgaatctgggagattggcgcggacacttttagtcagctgtccagtctgcaggcgcttgatttatcttggaatgcgattagatctatccaccctgaagccttcagcaccctgcactcactggtcaagctggacctcacagataaccagttgactaccttgccattagcaggacttgggggactgatgcacttgaaactaaaggggaaccttgctctgtcacaagcctttagtaaggactccttccccaaactgaggatcctggaggtgccctatgcctaccaatgctgtccctacggtatgtgcgcaagcttcttcaaggcgtctggccagtgggaagccgaggatctgcatctggatgatgaggagtccagcaagcgcccactgggcttgttggcccgacaagcggaaaatcactacgatcaggatctggatgagctgcagcttgagatggaagatagcaaaccacatccttcagtgcaatgtagcccgacacccggtcccttcaagccttgcgaatatctgtttgagtcttggggaatccgtcttgcagtctgggccattgttctgctgtccgtcctttgtaacggcctggtgttgttgaccgtctttgcaggcggacctgtaccccttcctcccgtgaagtttgtggtcggcgccatagcgggagccaatacccttaccggtatcagttgtggcctcttggcatctgtggacgccctcacattcggtcagttcagtgaatatggggcgaggtgggaaaccggacttggctgccgcgccacaggattcttggcagtactcggttccgaggcaagcgttcttttgttgactctggccgcagtccagtgtagcgtttcagtctcttgcgttagggcgtacggcaaaagcccatctctgggctctgtccgggccggggtgttggggtgcttggcgctagccggattggcagccgccttgcctttggccagcgtcggagaatatggggccagtccactgtgtcttccatatgccccgcccgaagggcagcctgcagctcttggctttacggttgccctggttatgatgaacagtttttgctttctcgtggtggctggagcctatatcaaactgtattgcgatctccctaggggcgattttgaggcagtgtgggactgcgcgatggtccgccatgtcgcctggctaattttcgcggacgggctcctttattgtcccgtggcctttctgtctttcgcaagtatgttaggcctcttccccgtaacacctgaagccgtgaaatcagtactcctggtggtgttgcccttgcctgcctgcctcaacccattactgtatctcctgttcaaccctcatttcagagatgatcttcgccgtcttaggcccagggctggagattctggcccattggcatacgcagctgccggagagcttgaaaagtccagctgtgactctactcaagccctggtggcgttctccgatgtggatctcatcctggaggcaagtgaggccgggcggcctcctgggctggagacatacgggtttcccagcgtcactctgatcagttgccagcagcctggagccccccgcctggagggttcccactgcgtcgagccagaagggaatcattttggcaaccctcagccctccatggacggagaactgctcctacgggccgaaggttcaacacctgctggagggggactctcgggcggtggcggcttccagccatcgggcttggcttttgcgagccacgtttag

SEQ ID NO: 122179 - DNA, 228 bp, Artificial Sequence
  Description of Artificial Sequence: Synthetic coding sequence
atgcttagtgcagattgtagtgagctgggcctctctgcggtccctggggacctggatccactgacggcttatctagccgtaccaggcatggttgctgagggaaaggctgatcggacgggcggcggcggatcatcaaggcccgaaaagactaggcggtccctggaagaagccattgatagaactatcggaggcgctcaggagctgtgggccccagaggtgagctcatag

SEQ ID NO: 122180 - DNA, 2487 bp, Artificial Sequence
  Description of Artificial Sequence: Synthetic coding sequence
atgcgccttgaaggcgaagggaggagtgctagagccggacagaatctgagcagagccggatctgctcggagaggtgctccacgcgatttatctatgaataatctcactgaactgcagccgggcctgtttcaccatctgcggtttctggaggagctccggctgagtggcaatcatttaagccatataccggggcaagcctttagcggcttgtactccctgaaaattctaatgctccaaaacaaccagctaggagggattcccgcagaagccctctgggaactccccagtcttcagagcctggatctcaattataataaactgcaagagttccctgtagctattcggaccctgggacggctgcaagagcttggctttcataacaataacatcaaggccatccccgaaaaagcattcatgggaaatccgctcctgcagaccattcacttctatgacaatcctatacagttcgtgggacggtcagcctttcaatatttgcctaagttgcacacactctcacttaatggagccatggatattcaggagtttcctgaccttaaaggcaccacgtccctcgagatattgaccctcacacgtgctggaattagactccttccttccggaatgtgtcaacagctcccccgcctgcgggttctggaactgagtcataaccagattgaggagctgccctctttgcacagatgccagaagttggaggagatcggcctgcagcacaaccggatttgggagattggcgccgacacctttagccaactgtccagcctacaggcgctggacctgtcgtggaatgccattcggagtatccatcctgaagctttcagcaccctgcattcactggtgaagctggatttaacagataaccagctgacaaccttacccttagcgggcttgggcgggctcatgcatctcaagctaaagggtaacttagccctgtctcaggcgtttagtaaggactctttccccaaactgagaattctagaagtgccatatgcctatcaatgctgtccttatggtatgtgtgcgtcctttttcaaagctagcgggcaatgggaggccgaggacctgcatttagacgatgaggagagctccaagaggccgctggggcttcttgcgaggcaggccgagaatcactatgatcaggacttagatgaactacagctagagatggaggatagtaagcctcacccctctgttcagtgttctcccacacctggcccatttaaaccttgcgaatatctgttcgagtcttggggaatacggctggcagtgtgggccattgtactgctgagcgttctgtgcaacggattggtattgctgactgtgtttgccggcggacctgtcccgctacctcccgtaaagttcgtcgtaggagctatcgctggtgctaacaccttgacaggaatctcgtgcggcctattagcttctgtcgacgcactgacctttgggcagttttccgaatatggagcacggtgggaaacagggcttggatgtagagccacaggcttcctggcagtgctcgggagcgaagcgagcgtcctcctgctgacgcttgcagcggttcaatgcagtgtgtctgtttcctgcgtacgcgcttatggaaaaagtcccagtctcgggagcgttagggcaggcgtgcttggttgcctcgccctggccggactcgccgcggccttgcctctggctagtgtcggcgaatacggtgcctcacctctgtgcctaccttatgcccctccggaaggtcaacctgcagcgctcggctttaccgttgcccttgtgatgatgaattccttctgttttctggtggtcgccggtgcctatattaaactgtattgtgatctgcctaggggggatttcgaggctgtgtgggactgcgccatggtgagacacgtcgcctggctgatctttgctgatggactgctgtactgccccgtggcctttctttcattcgctagcatgctcgggctgtttcccgttacccctgaggccgttaagagcgtactgctggtggtcttgcccctcccagcctgcttgaatccactactctacctcctgttcaacccacatttccgtgacgacctccggcggctgcgccctcgagcaggggacagtggccctcttgcttacgcagcggcaggcgagctggaaaaaagctcctgcgattcgactcaggctttagttgccttctctgacgtagacctgattctggaggcatcggaggccgggcgccctcccggactagagacctacggcttccctagcgtgacgctgatcagctgtcagcagccaggcgccccccgcctggaaggatcccattgtgtcgagccagagggaaatcactttgggaacccccagccctccatggacggagagcttctacttagggcagaaggctcaacaccagcaggtggcggcctgtccggtggagggggattccaaccatcaggactcgcattcgccagtcacgtatag

SEQ ID NO: 122181 - DNA, 6039 bp, Artificial Sequence
  Description of Artificial Sequence: Synthetic coding sequence
atggagactctcaacggagcgggtgacaccggagggaagccaagcacaaggggcggcgatccagcagccagatcccggagaaccgagggtatcagagccgcatatagacgtggagatagaggcggagcccgggacctcctagaagaagcctgtgaccaatgtgcatctcagctggaaaagggacagcttctttccatcccagccgcttatggggatctggagatggtgcgctacttactgtctaaacgcctggtcgagctgcccactgagcccacagacgacaaccctgctgtggtggctgcctatttcggccacaccgccgtggtccaggaacttctggagcccctgactcctaaacaaactgagtgggaacagacggctcccttttccggaacctttcccctcagttgccatctgctgcctggaccatgttcccctcagaggttactgaattggatgctggcccttgcttgtcagcgcggacatctcggagtggtgaagctgctcgtgttgactcacggcgctgatcccgagagctatgccgtgagaaaaaatgagttccctgtgatcgtgagactccccctgtacgctgctatcaaatcaggaaatgaggacattgccattttcctactgcggcatggcgcatatttctgctcttacattctgcttgactctcctgacccaagcaagcatcttctgcgcaagtactttatcgaagcaagtcctctcccgagttcatatccaggcaaaaccgccctgagggtgaagtggtcgcacttgaggttaccctgggtggacctcgactggctcatagacattagctgccaaataaccgaattggacctgagtgctaattgtctggctaccctcccgagcgtgataccgtggggcctgatcaacctgcgcaagctcaatctctctgacaatcatctgggtgagttgccaggagtccaaagctctgacgagattatttgctcaagactgctggagattgacatcagtagcaataaactgtcccacttacctccgggtttcttgcacctctcaaagctgcagaaattgaccgctagcaagaactgtctcgagaagctgttcgaggaggaaaacgcaacaaactggatcggtctcagaaaactgcaagagctggatattagcgacaacaaactaactgagcttcctgcgctgtttttgcatagcttcaagtctttaaactccctgaatgtgtcgagaaacaatttgaaagtgttcccagatccatgggcatgtcctttaaagtgttgtaaggcttctcgaaacgctctcgaatgcctgcctgacaagatggccgttttttggaaaaatcacctgaaagatgtcgatttttctgaaaacgcgctgaaagaggtacctctgggacttttccaactggacgccctgatgtttctgagattacaaggaaaccagctggctgcattgcccccccaagaaaaatggacatgccgccagctgaagactctggacctgtccaggaatcagctgggcaagaacgaggatgggttgaagactaaacggattgcattcttcacaactagaggtcgccagagatccgggaccgaagcggctagtgtgctagagttccctgctttcctgtctgagagcctcgaagtactgtgtctgaatgataatcacctcgacactgtgccgccctctgtttgcctgcttaaaagcctatcggagctgtatctagggaataatcccggccttagagaacttcctcctgagctgggtcaattgggtaacctctggcagctagacacagaagacttaactataagcaatgttcccgccgaaattcagaaagagggtcccaaagctatgctgtcttacctgagagcgcaactgagaaaggccgaaaagtgtaaactcatgaagatgataattgtgggaccccctcgccagggcaagagcaccttattggagattctgcagactgggcgtgcacctcaggtggttcacggtgaagctaccattagaaccaccaaatgggagctgcagcgaccagccggaagcagagccaaagtagagagcgttgagtttaatgtgtgggacattggtggccccgctagcatggccacggttaatcagtgtttcttcaccgataaggcactgtacgttgtggtttggaacctggctttaggagaggaggccgttgcgaatttacagttctggctgttgaacattgaggccaaagcgcccaatgctgtggtactcgtcgttggcacccatctggacttgattgaagccaaattccgggtcgaaaggatcgccacgctgcgggcctatgtgctcgccctctgtcgctcccccagcggctctagagcaacagggttccccgatattaccttcaaacacctgcacgagattagctgtaaaagtctggaaggtcaggaaggactgcgccagcttatctttcatgtcacatgcagtatgaaagatgtgggctctactatcggctgccagcgtttagccggccgcttgatccctcgctcgtatctgtccctacaggaagctgtcctggctgagcagcagaggcggagcagggacgatgatgtacagtacttgaccgacaggcagcttgagcaactggtggaacaaacacccgacaatgacatcaaggactacgaggacctccaatccgctatcagcttcctgatcgaaacaggaactttgttacactttcctgataccagccacggactgaggaatctgtattttctggatcccatttggctgagcgagtgtttacaacgaatttttaatatcaaaggctcaagatccgtggccaagaatggggtgatccgggccgaagacttgcggatgctgctggtcgggactggtttcacacagcagaccgaggagcaatactttcaatttcttgctaaattcgagattgccctgcccgtcgctaacgactcctatctgctgccccacctcctgccctcaaagccagggctagatactcacggcatgagacatcccacggcaaatacgatccaacgagtctttaagatgagcttcgtgcctgtcggattttggcaaaggttcattgcacgcatgctgatttcgctcgcagagatggacttacagctgtttgaaaacaaaaagaacaccaagtcgaggaatcgaaaggtgaccatatacagctttactgggaaccagcggaatagatgttccacctttagggtgaaaaggaaccagaccatctattggcaggaggggttgttggtcacattcgacggaggctatttatctgtggaatcttccgatgttaactggaagaaaaagaaatccggagggatgaagattgtttgtcagtccgaggtgcgcgatttttccgcaatggctttcatcacggaccatgttaacagcctgattgaccagtggtttccagccctgactgcgacagaatctgacggtacaccactaatggaacaatatgttccgtgtcctgtatgcgaaacagcgtgggcacaacacacagatccatctgagaaatctgaagatgtccagtatttcgatatggaagactgtgtacttacagctatagagagggatttcatatcgtgccctaggcaccccgacttgcccgtgcctctgcaagaactggtgccagaattattcatgacggattttccggcgaggctattcctcgagaacagcaagcttgagcatagtgaggatgaaggctcagttctgggccaaggcggctccggcaccgtgatatacagagctcgctatcagggccagcccgtggccgtgaaacggttccatataaagaagtttaagaatttcgctaatgtaccagctgataccatgttgcgacatctcagagctaccgatgctatgaagaattttagcgagttccggcaggaagccagcatgctgcatgcactgcagcacccttgcatcgtcgcactcatcggaattagtatccatcctctgtgctttgccttagaattggctcctctgtcatccctcaatacagttctctctgaaaacgccagggacagttcctttatccccctggggcacatgctaactcaaaagatcgcctaccagattgcctcagggctggcttacctccataagaagaatatcatcttttgcgaccttaagagtgacaacattctagtgtggtccctcgatgttaaggaacacatcaacataaaactgtccgactatggcatatctcgacagtccttccacgagggggctctgggcgtggaggggacaccaggctaccaggctcccgagatcaggcctaggatagtgtatgatgagaaagtggacatgttttcctacggcatggtgctctacgagctactgtccgggcaacgtcccgccttagggcatcatcagttgcagatcgccaaaaaactgtcaaaaggaatccgccctgtactcggtcagccagaggaggtccagtttaggcggctgcaggccctgatgatggagtgttgggacactaaaccagaaaaaagacccctcgcattaagcgtcgtatctcagatgaaggatccaacttttgccacctttatgtacgaactgtgttgtggaaaacagaccgcattcttctctagccagggtcaggaatacactgtggtcttctgggatggaaaggaagaaagccgaaactatactgtagtgaacacagagaagggcctgatggaagtgcaaagaatgtgttgtccaggaatgaaggtgagttgtcagctgcaagtgcagagatctctgtggactgccaccgaagaccagaaaatctatatttacactttgaagggaatgtgcccactgaatacaccccagcaggccttagataccccggctgtggtgacctgtttcctggcagtgccagtcatcaagaagaactcgtacttggtgcttgccggcttggccgacggtctggtcgcagtgtttccagttgttcgtggcactcccaaagattcttgttcatacctgtgcagtcacactgctaatcgaagtaaattcagcatagcagatgaggacgcaagacaaaatccatatcccgtgaaggcgatggaggtggttaattccggctcggaagtctggtacagcaatggccctggtttgctagtgattgattgcgcttccctggagatatgtagacgactggaaccctacatggccccatctatggtgacaagtgtggtatgcagctcggagggccggggggaagaagtggtgtggtgtctggatgacaaagccaattctcttgtgatgtatcatagcactacgtatcagttgtgtgcacggtacttctgcggagtacccagtcccttacgagatatgttcccagtccgccccctggacaccgagcccccggcagcctcccacaccgccaatcccaaagtacccgagggcgacagtatcgctgacgtctccatcatgtacagcgaggagctgggaactcagattctgatccatcaagagtctttaaccgactactgctctatgagctcctattcatccagccctccgagacaagcagctcggtccccatcctctctcccttccagtcccgctagtagcagttccgtcccgttcagcacagactgcgaggactccgacatgctacacacgcccggggccgcctccgataggtccgagcatgatctgactccaatggatggggaaaccttcagtcagcacctgcaagctgttaagattttggccgttcgtgacctgatttgggtccctcgcaggggcggcgacgtaattgttatcggacttgagaaggactccggtgcccagagaggacgcgtgattgctgtgctcaaagctagggaacttacccctcacggcgtgcttgtcgatgccgccgtcgtcgcaaaggatacagtagtgtgcactttcgaaaatgaaaacactgaatggtgtttggctgtctggcgtgggtggggggccagagagtttgacattttttatcaatcctatgaagagctcggtcggctcgaggcttgcactcggaaacgccggtag

SEQ ID NO: 122182 - DNA, 6048 bp, Artificial Sequence
  Description of Artificial Sequence: Synthetic coding sequence
atggccggtatgtcccagcgacctccgagcatgtattggtgtgtcggtcccgaagaatctgccgtatgccctgaacgtgccatggagacactgaatggggctggcgacacgggagggaaaccctctacaaggggtggggatcctgccgcacgcagtcggcgcaccgagggaatccgagccgcttataggagaggcgatcgaggaggagctagggacctgctggaggaggcatgcgatcagtgcgcatcacagctggagaagggacaactactaagcattccagccgcttacggggatctggagatggttaggtacctgctgtccaaacgactcgttgaactacccacagaacccaccgacgacaatccggctgttgtggcagcttatttcggccacaccgcagtggtgcaagaactgcttgaatctcttcccggaccatgctcccctcaaaggcttctcaactggatgctggccctggcttgccagaggggccacctcggggtggtcaagctgttagtgctgactcatggcgccgaccctgagtcttacgctgtgaggaaaaacgaattccccgtaattgtccggctgcctctgtacgctgcgattaaaagcggaaacgaagacatcgctatttttctcctgcgccatggagcctacttctgtagctatatcctcctggactcccccgatccctctaaacaccttttaaggaaatacttcattgaggcaagtccattaccttcttcctatcctggaaagaccgcactgagagttaagtggtctcaccttcgtttgccttgggtagacctcgactggcttatcgatatctcgtgtcaaatcacagagttggacctgtccgcaaattgcttggccactctcccatcagtgatcccatggggtctgataaacctgcgaaagttaaatttgtcagataatcacctgggagagcttcctggagtgcaatcttctgatgagattatttgttccagactactggagatagatatatcaagcaacaagctttcccatcttccacctgggtttttgcacctatccaagttgcagaagctgacagcgagcaaaaattgcctagaaaagctgtttgaagaagagaatgccaccaactggataggactccgcaaactccaggagctcgatatttctgacaataaactcactgagttgcccgctctctttctgcacagctttaaaagcttaaattcactgaatgtttcacgcaacaatctgaaggtctttccggatccgtgggcctgccctttaaaatgctgtaaagctagtcgcaacgcattggaatgtttgcctgataagatggcggtgttctggaaaaatcatctgaaagacgttgacttctctgaaaacgcactgaaggaggtgcctttgggactgttccagttagacgccctcatgtttctcaggttgcaaggaaatcagctcgccgctctgccaccacaagaaaagtggacttgcagacagctgaaaacgctggacctgtcaagaaatcagcttgggaaaaatgaagatggacttaaaactaagcgaatagctttttttactactcgggggagacaacgctctggtaccgaagcagcatccgtgcttgagtttccagcattcctgagcgaatctcttgaggtcctctgtcttaatgataatcacctggacacggtgccgcccagtgtctgcctgttaaaatcactctccgaattgtacctgggcaataacccagggctcagggagcttcctcctgagctcggacagctcgggaatctgtggcaactcgataccgaggacctgacaatttccaatgtacctgctgaaattcagaaagagggtccaaaggccatgctgagctatctaagagcccagctgcggaaagctgaaaagtgcaagctaatgaagatgattatcgttggcccccctagacagggaaaatctacacttctggagatactgcagaccggacgtgcgccccaggtcgtccacggcgaggcgacaattcgcacgactaagtgggagctccagagacctgctggcagtagagcgaaagtggaatctgtggagttcaacgtttgggacattggaggtcccgccagcatggccaccgtcaaccagtgctttttcactgataaggccctctacgttgtggtctggaatttggccctgggtgaagaagctgttgcaaatttgcagttctggcttctcaacatcgaggccaaagcccccaacgcggtagttttggtggtggggacacatttggatttgattgaggctaaatttcgagtggagaggattgctaccctgagagcctatgtcctggctttgtgtagaagcccaagtgggagcagggccacgggtttccccgatattacttttaaacacctgcatgaaattagttgcaaatccctggaggggcaggaaggcctccgacagttgattttccatgtgacctgcagcatgaaagatgtgggttcaacaattggctgtcaacggctggcagggcggctaatcccacgctcttacctgtcactgcaggaggccgtgttggccgagcagcagagaaggtcacgcgatgatgatgtgcaatacctgaccgatcgccagttagaacagctggtcgaacagacaccagataatgacattaaggactacgaggacttgcaatccgcaatttctttcctgattgagacaggcacactgctccattttcccgatacaagccatggtctacggaatctttactttctggaccccatctggctttcagaatgcttgcagaggatattcaacattaaaggatccaggagcgtggccaagaacggggtcattcgagccgaggatctccgaatgttgcttgtggggaccggcttcacacaacagactgaggaacagtacttccagtttctggcaaagtttgaaatcgccttgcctgtcgccaacgatagttatctactgcctcacctcctgccatccaaaccgggtcttgacactcacggcatgcgccaccccacagcaaacaccatccaacgagtctttaagatgtctttcgttccagtaggcttttggcagaggttcatcgcaagaatgctgatttccttggctgagatggatctgcagctgtttgagaacaaaaagaacaccaagagccgaaatcgcaaagttacaatctacagtttcacaggcaaccagaggaacagatgctccacattccgggttaagcgaaaccagaccatatattggcaggagggactgctggtcacttttgacggcggatatctatccgtcgaaagttctgacgtcaattggaagaagaagaagagcggcgggatgaagattgtgtgtcaatccgaagttagagattttagcgccatggctttcattacagatcacgtgaatagcctcatcgatcagtggttccccgcactcacagccacagagtctgacggcactcctttgatggagcagtacgtaccctgcccagtttgtgagaccgcctgggcccaacacaccgatccctctgagaagtccgaggatgtacagtattttgatatggaagattgcgtgttgaccgctatcgagcgcgattttatctcttgtccgaggcatccagatctgccggtccccctccaggagctagtgcctgaactgtttatgaccgactttcctgcccggttgtttctggagaatagcaaattggaacattccgaggatgaggggagcgtcctcggacagggcgggagcggcaccgtgatataccgggcccgctaccagggacagcctgttgcggtgaaaaggttccacatcaagaaattcaagaattttgctaatgtgcccgcagacaccatgctgcgtcatcttagggccacagatgctatgaagaatttctcagaatttcgccaggaggccagcatgctgcacgccctgcaacacccttgcatagttgcgctgatcggcatcagtatccacccactttgctttgcgctagagctggcacctttatcatctctcaataccgtgcttagcgaaaacgccagggacagcagtttcataccgctgggccacatgctgactcaaaagatcgcctatcagattgcttcaggcctggcctacctccacaagaaaaacataatattttgtgatcttaaatcggacaatatcctagtatggagcctcgacgtcaaggagcacatcaatatcaaactgtcagattacggaatcagccgccagagctttcatgagggcgcactgggtgttgagggaacaccaggatatcaggccccagaaattcggccaagaatcgtctatgacgagaaggtcgacatgttttcatatgggatggtactgtacgagttgctttccggacagcgcccagccttggggcatcatcaactacaaatagccaagaaactgagcaagggaatcagaccggtgttagggcaacctgaggaagttcagttccggcgcttacaggccctcatgatggagtgttgggataccaaaccagagaaacggccactggcactttccgttgttagccagatgaaagacccaacctttgctacattcatgtacgagctctgttgcgggaaacagaccgcttttttttctagccagggccaggagtacacagtggtgttctgggacgggaaggaggagtcccgcaactatactgtggttaataccgaaaagggtcttatggaagtccagaggatgtgttgtcccgggatgaaggtgagttgtcagttgcaggtccaaagatcgctctggacggccactgaagatcagaagatttatatctacacgttgaaggggatgtgcccattgaacacaccgcagcaggcgctggataccccagccgtcgtgacgtgctttcttgccgttccggtgattaaaaaaaacagttacctcgttttggccgggctggccgatggcttagtggccgtttttccagtcgtcagaggaactccaaaagactcctgctcgtacctatgctcacatacggctaataggagcaaatttagcatcgccgatgaagacgcaaggcagaatccttaccccgtgaaagctatggaggtggtcaacagcggtagcgaagtttggtatagcaatgggcccgggttgctggtcattgattgtgcatccctggagatctgcagacgtctggaaccatatatggctcccagcatggtgacctccgtggtgtgctcttcagagggccgcggggaggaggtggtatggtgccttgatgacaaagctaactccttggtcatgtaccattctaccacctatcagctgtgcgccaggtacttttgcggcgtcccttcccccctgagagacatgtttcctgtgagaccactcgatacagaaccacccgctgccagccacacagccaaccccaaggtgccggaaggcgacagtattgccgacgtcagtatcatgtactctgaagaactggggacacagatcttgattcaccaggaatctttgacggactattgcagcatgtcgtcctactcatcttctcctccccgtcaggccgctaggtcaccgtcctccctcccatcctccccagcttcaagcagcagtgttccgtttagcaccgactgtgaggactccgacatgctacatacaccaggtgccgcttccgatcggtcggaacacgatttaacacctatggatggcgagaccttttcacaacacttgcaggcagtcaaaatactcgccgtaagggatttgatctgggtgcctcggcgtggaggcgacgtgattgtgattggtctcgagaaggactccggggcccagagggggagagtaatcgccgtgctcaaagccagagagttgaccccccatggagttctggtggatgctgcggtggtagccaaggacaccgtagtgtgcaccttcgaaaatgaaaataccgagtggtgtctggccgtgtggagaggttggggcgctcgggagttcgacatcttctaccagtcatatgaggagctcgggaggttagaggcctgtacccgtaaacgccggtag

SEQ ID NO: 122183 - DNA, 2025 bp, Artificial Sequence
  Description of Artificial Sequence: Synthetic coding sequence
atgcttcacgcactccagcacccatgcatagttgcactgattggtatctctattcacccgctgtgtttcgcactggaacttgccccattgtccagcctcaacactgtgctgtctgagaatgcgcgggacagcagtttcatacccctggggcatatgcttacgcagaaaatcgcataccaaatagctagcggactcgcttatctgcataagaagaatatcatcttctgcgatctgaagagcgacaatattttagtgtggagcctagacgtgaaagagcacattaatatcaaactttcagactatggaatttccaggcaatcgtttcacgaaggtgcgctcggtgttgagggtacccccgggtaccaggcaccagagatccgtcctaggattgtgtatgacgagaaggtggacatgttctcgtatggcatggtcctgtacgaattgctgagcggccagcggcctgctctagggcatcaccagttacagattgctaagaagctgtccaaggggattagaccagtgcttggccagcctgaagaagtacaattccgccgtctgcaggccttgatgatggaatgttgggatactaagcctgagaaaaggcctctcgcattaagtgtggtgtcccagatgaaagatcctacctttgctacttttatgtatgaactttgttgtgggaagcagaccgcatttttttcttcccagggtcaggagtacaccgtagtgttttgggatggcaaagaagagagccgaaactataccgtggttaacactgaaaaaggcctgatggaagtgcagagaatgtgttgtcccggaatgaaagtgagctgtcagctgcaggttcagaggagtctatggaccgccactgaggatcaaaaaatctatatatacacccttaagggtatgtgcccattgaatacccctcagcaggcactggacaccccagctgtagtgacgtgttttctggccgtgcccgtgatcaaaaaaaactcttatttggtgttggccggtctggccgacggtctggttgctgtgttccctgtggtccggggcacgccaaaggacagctgctcttacctgtgttctcacacagccaacaggtccaagttttcaatcgctgacgaggatgccagacagaatccataccccgtcaaggcaatggaagtcgtcaacagcggttcagaggtctggtactcaaatgggccaggattgttagttatcgattgcgcctctttagaaatctgcaggcggttggaaccgtacatggcacccagtatggtgacgtcggtagtgtgtagcagcgaggggaggggcgaggaggtggtttggtgccttgatgacaaagccaatagtctggtaatgtaccattctacaacttatcaactttgcgccaggtatttttgcggagtgccaagccccttacgtgacatgttccccgtccggcctctggatactgagcccccagcggcctctcataccgcgaatccaaaggtccccgagggcgatagcatcgcagacgtgagtatcatgtattctgaagaattgggcacacagatcctgattcaccaagaatcactgaccgactactgttccatgtcgtcttattcatcttccccgccccggcaggcagcacgaagcccttcatcactgccatcctcaccagcgagctccagctcagttccattctctaccgactgcgaggactcagatatgcttcatactccaggtgccgcctccgatcgctcagagcacgatctgactcccatggatggggagacattttcacagcacctgcaagccgtgaaaatcctggccgtgagggacctcatttgggttccgagacgaggtggggatgtcatcgtcatcggactggagaaagactcaggcgctcagagagggcgagtgatagccgtcctgaaagctagagaattgactccgcacggtatcatgcctgtaagcagtgtcaaagtgtgctgggcagggtggcctgttcgggatatggtctatatggtcgcagtcatgtag

SEQ ID NO: 122184 - DNA, 99 bp, Artificial Sequence
  Description of Artificial Sequence: Synthetic coding sequence
atggcaggtatgtctcagaggcctccttcaatgtattggtgcgtgggaccagaggagtccgcagtatgtccagagcgagctatggaaactctaaactag

SEQ ID NO: 122185 - DNA, 1506 bp, Artificial Sequence
  Description of Artificial Sequence: Synthetic coding sequence
atgttcagctatggcatggtgttatatgagctcctgtcaggccaacgccccgctctgggccaccaccagctgcaaatcgcaaagaaattgtctaagggaatccgcccggtgctcgggcaacccgaggaagtgcagttccgtcgcctgcaggcgcttatgatggagtgttgggacacaaagccagagaagcggccacttgcactctctgttgtgagccaaatgaaggaccctacttttgccacctttatgtatgaattatgctgtggaaagcagacagccttcttctcatctcaaggccaagaatacactgtggtcttctgggacggcaaggaagagtcacggaattacaccgtagtgaacacggaaaagggactgatggaagttcagcggatgtgctgccccggcatgaaggtatcctgtcagttgcaagttcagcgaagcctgtggacagcgacagaagaccaaaagatctatatctacacactgaagggcatgtgccctctcaacaccccacagcaggccctagacacccccgccgttgtcacgtgttttttagccgtgcctgtgattaaaaagaacagctacctcgtactggccgggctggccgacgggctggtggccgtgtttcccgtcgtccgaggcacacctaaggactcatgctcctacctgtgctctcatacggctaatagatcaaaatttagtatagctgacgaggacgctcgacagaatccttacccggtcaaggccatggaggtggtgaactcgggaagtgaggtttggtatagcaacgggcctgggcttcttgtcatcgattgcgccagcctggagatatgtcggcgtcttgagccgtatatggcaccttctatggtaaccagtgttgtgtgtagtagcgagggcaggggcgaagaggtggtatggtgtttggatgataaggccaatagtcttgttatgtatcatagcacaacctaccagctgtgtgcaagatacttctgtggcgttccttcacccttgcgggatatgttcccggtgcgaccactagacaccgaaccacccgcggccagccacaccgccaatcctaaagtgccagagggagatagcatagcggatgtctcaattatgtattccgaagagctgggcacacagatactgatccaccaggaatcattaaccgattattgttcgatgtcctcctactcttcatctccacctcggcaggccgcacggtccccctcctccttgcctagttcccccgctagtagctccagtgtgcccttttcaaccgattgtgaagactcagacatgcttcacacacctggagctgcctctgatagaagtgaacatgacctcaccccaatggacggggagaccttcagccaacatctgcaggcggtgaagatcctcgccgtgagagatctcatctgggtacctcgccgtgtggagatgttatcctccttggcatggagacgcatcctggccccaagcggtgcggaatcacttccttcctag

SEQ ID NO: 122186 - DNA, 7584 bp, Artificial Sequence
  Description of Artificial Sequence: Synthetic coding sequence
atggcaagcggatcttgccagggctgcgaagaagatgaagagaccctgaagaagctgatcgtcaggctcaacaatgtgcaggagggcaaacagattgaaactctggtgcagattctcgaagatcttctggtgttcacgtattctgagcgcgcttctaagctgtttcagggcaagaacatccatgtccccctgttgatagtgctcgactcctatatgcgggtcgcatctgtccagcaggtggggtggtccctgttgtgcaaattgatcgaagtgtgtcccgggacgatgcagtccctcatgggcccccaggacgttggaaacgactgggaagttcttggcgtccaccaactcattctgaagatgctgactgtccataatgcatctgtcaatctgtccgtgatagggttaaaaactctcgatctgctcctcacatccggaaagattacactgttgattttggacgaagaaagcgacatctttatgctaatttttgatgccatgcacagcttcccagcgaacgatgaagtccagaaactgggatgcaaggctctccatgtccttttcgagagggtgtccgaagagcagctgacggaatttgttgaaaacaaagactatatgatccttctgagcgccttgaccaatttcaaggatgaggaggagatagtgctccacgtgcttcactgcctccattctttagccatcccatgtaataatgtcgaagtcctgatgtccggaaatgtgcgctgttacaacattgtagtcgaggctatgaaagcctttcctatgtcagagagaatccaggaggttagttgctgtctgcttcaccgcctcactttagggaacttttttaacatactggtcctgaatgaggtacacgagttcgtcgtgaaggctgttcagcaatacccggaaaatgccgcactgcagatcagtgcgctgtcctgccttgcactgctcaccgagacaatttttctgaatcaggatctcgaagaaaaaaacgagaatcaagaaaacgatgacgagggcgaggaagacaagcttttctggctggaggcttgttacaaagcgcttacgtggcacagaaagaataaacatgtgcaggaagcagcctgttgggctttgaacaacctcttgatgtaccagaactccctccatgaaaagataggtgatgaagatggccatttccccgctcatcgggaggttatgctttcaatgcttatgcactcatcatccaaggaagtgtttcaggcttctgcaaatgcattgagcactcttctggagcagaacgtgaatttcagaaaaatcttgctgtcaaagggcatccaccttaacgttctggaattgatgcagaagcacatccactctcctgaggtcgcagagtccggctgcaaaatgctcaatcatctgttcgaggggagcaacacttctttagacataatggccgccgtggttccgaagatcctcacagtgatgaagcgacacgagacctctctgccagtgcagctggaagcactgagggccatactgcattttatcgtccctgggatgccagaagaatctagagaagacacggaatttcatcacaaactgaatatggttaagaaacaatgcttcaagaatgacatccacaagctcgtgctcgctgctctcaatcgcttcataggaaaccctggcatccaaaaatgtggtttgaaggtgataagtagcattgttcacttccccgacgctctggagatgctatcattggaaggcgcgatggatagcgtgcttcataccttacagatgtatcctgatgatcaagaaattcagtgcctcggcctatcccttattggttacctcattaccaagaagaatgtgtttattggcaccgggcatttactggccaaaatccttgtgtcttcgttatataggttcaaagacgtagcagaaattcaaaccaaaggattccagaccattcttgccatactgaagcttagcgcaagcttctctaagttgcttgtgcatcatagcttcgatctcgttatttttcaccagatgtcaagtaacatcatggaacagaaggaccagcaattcctcaatctatgttgcaagtgttttgcaaaggtcgcgatggatgattacctgaaaaacgttatgctggagagagcctgtgatcaaaacaatagtataatggttgagtgtttacttctgctgggggccgatgccaaccaggccaaggagggtagtagcctaatctgtcaagtctgcgagaaagagtccagtccaaaacttgtggagttgttacttaattctgggtctagagagcaggacgtccgaaaagcactaaccatatccataggcaagggcgattcccagatcatcagcctcctactccggaggctggccctggacgtcgccaacaactcgatctgcctaggtggtttctgcattggcaaggtggaaccttcctggctgggcccattgtttcccgacaagacgtccaatctcaggaaacaaaccaacatagcctctactcttgcacggatggtgatacggtaccagatgaagtctgccgtggaggaggggaccgctagcgggagcgatgggaatttctcagaagatgtgctctcaaaatttgatgaatggacatttataccagacagctcaatggacagtgtgttcgctcagtcagatgatctggatagcgagggctctgaaggctccttcctggtaaaaaaaaaatctaattccattagcgtgggcgaattttaccgggatgcggtccttcaaagatgcagtcccaatctgcaaagacactctaactctctgggcccaatctttgaccatgaggacctgcttaagagaaagaggaaaatcttgtccagcgatgatagtctgagaagctctaagctgcagtcgcatatgaggcactcggatagcatctcctcgctggccagcgagcgagagtatattacaagtctcgatctgagcgccaacgagctgcgggatatcgatgctctgtcacaaaagtgttgcattagcgtgcacctcgaacacctcgagaagttagagctgcatcagaatgctctcacaagttttccccagcaactgtgcgagacactgaaatctttaacccatctagacctgcactccaataagtttacttctttcccctcttatctccttaagatgagttgtattgccaatttagacgtgagccgcaacgatattggtcctagcgtcgtcctcgacccaaccgtcaagtgccccacactgaagcaattcaatctgagttataatcaactttcctttgtacctgagaacttgactgacgtggttgagaaactggagcagctcattctggaaggtaataagatctcaggtatttgttctcctcttcgccttaaggagttgaaaattctcaacctgagcaagaatcatatctcatcattatctgaaaatttccttgaagcctgtcctaaggtagaaagtttcagcgcccgaatgaattttctggctgcaatgcctttcctaccaccgagcatgaccattcttaagctgagtcagaataagttctcgtgcatccccgaagctatacttaaccttcctcacctcaggtcattggatatgtcgtccaacgatattcagtaccttcccgggccagcccactggaagtctcttaacttgcgggaactattattttcccataatcagattagcatactggatttatccgagaaggcctatctgtggagccgtgtggagaagctgcatctgtcacataataagttgaaagaaatccccccagaaatcggatgtcttgagaatctaacgagcctggacgtgagctacaatctggaactccgaagcttccctaacgagatgggaaagctgtctaagatatgggacttacccttggatgagctgcatttgaactttgatttcaagcatatcgggtgcaaagcgaaggacatcattcgttttctacagcaaaggcttaagaaggccgtgccttataaccgcatgaagctgatgatcgtgggcaataccgggtcaggtaagacaaccttgttgcagcagctgatgaagactaaaaagtctgacctcgggatgcaatctgcaaccgtcgggatcgacgttaaggattggcccattcaaattagagacaaacgcaagagagatctcgtgctgaacgtttgggacttcgctggccgggaagaattttattcaacgcatccacattttatgacacagcgagccctctacctcgctgtttacgacctaagtaaaggtcaagctgaagtggatgccatgaaaccctggttattcaatatcaaagcacgcgccagtagctctcctgtgatactcgtgggaactcacctcgatgtgtccgatgaaaaacagaggaaggcatgcatgagcaagataacgaaagagctccttaataaacgcggcttccccgctatccgcgactaccacttcgttaatgccacggaagaaagcgatgcattggctaagctgcgtaaaactattattaatgaaagcctcaatttcaagatacgcgaccagctggttgtcggacaactgattcccgattgctacgtagaacttgaaaagatcatactgtctgagcgcaaaaacgtgcccattgagttccccgttatagacaggaagcgcttgcttcaactagtcagagaaaatcaactgcagctggacgagaatgaattacctcacgcagtccacttcctgaacgagagtggcgtgcttctccacttccaggatccggcgcttcagctgtcagacctttattttgtggaaccaaaatggctgtgcaagattatggcccagatcttgacagtcaaggtcgaagggtgccctaagcaccctaaaggcattatatccagaagagatgtggagaagtttctgtcgaaaaaacggaaatttccaaaaaattacatgagccaatactttaaactgctggaaaagtttcagattgcactccctattggagaggaatatctgttggtaccaagctcactgtccgaccaccggccagtcatcgagcttccccactgcgagaatagcgaaataattatccgcctctacgaaatgccttactttccaatgggcttctggagccggttgatcaaccgtctcctggagatctctccctacatgctttcgggcagagagagagccttgcgcccaaaccggatgtactggaggcagggtatttacctgaactggtccccagaggcctactgtttagtcgggtctgaagtcctggacaatcaccccgagtccttccttaagatcacggtccctagctgcagaaagggctgcatccttctcgggcaggtggtggaccatatcgactcactcatggaagagtggtttcccgggctgctggaaattgacatatgcggagagggtgaaaccctcttgaagaagtgggcgctttacagctttaacgatggcgaagagcatcagaaaattctcctagacgatctgatgaaaaaggcagaggagggcgacttgctagtgaatccagaccagcctcgcttgactatacctattagccaaatagcccccgacttaatcctggccgatttgcccagaaatatcatgctgaacaatgacgaactagaatttgaacaggccccagaattcctcctaggagacggcagcttcggctctgtatacagagctgcctacgaaggagaggaggtggccgtgaaaattttcaataagcacacatcactccggttgctgaggcaagaattggtggtgttgtgtcaccttcatcatccttctttgatctctctcctggccgcaggcatcaggccccggatgctggttatggaattggcgtcaaaggggtctctcgataggctgcttcagcaagacaaggccagcctgaccaggacattacaacaccggatcgctctccatgtagcagatggcttacgctatctgcacagcgcgatgatcatctatcgggatctcaaaccacacaacgtgctcctgtttaccctgtacccaaacgcggcaatcatcgcaaagatcgccgattatggcattgctcagtactgctgtcggatgggcattaaaacctcggaagggaccccaggtttccgtgcccctgaggtagcacggggtaatgtgatctataatcaacaggctgatgtctactcttttggattactgttgtacgacattctgaccacaggcggcagaatcgtcgagggcctaaaattccctaatgaattcgatgagcttgagatccagggaaaattgccagatccggtcaaggagtatggatgcgccccttggccgatggtggaaaaacttattaagcagtgtctcaaagaaaatccgcaggagcggcctacatccgcccaggtgttcgacatcctaaattccgcggagttggtgtgtcttaccagacgtattttgctgcctaaaaacgttattgtggaatgcatggtcgccactcatcataacagccggaatgcctccatatggctggggtgtggacatactgaccggggtcagctctcatttcttgacctaaacactgagggctatacctctgaagaggtcgccgactcgaggatactgtgtctcgcattagtgcacctgccagtagagaaggaatcctggattgtgagtgggacgcagagtggaactctactcgtaatcaatactgaggacgggaagaagagacacaccctggagaagatgacagatagtgtgacttgcctctactgcaacagctttagcaagcagtccaaacagaagaattttctgctggtcgggacagccgacggtaagcttgccatatttgaagataagaccgtgaaattaaagggcgctgcacccctcaaaattcttaatattggcaacgtgtcaacccctctgatgtgtctttctgaatctacgaacagtactgaacgcaacgtgatgtggggcggttgcgggacaaaaatattttcattttcaaacgattttactattcagaaactgatcgagaccaggactagccagctgttttcttacgctgccttctcagattcaaacattatcacggtcgtggtggacactgcgctatatatcgcaaagcaaaatagccccgtagtggaagtatgggataagaagaccgagaaactgtgtggtctgatcgattgtgtgcatttcctgcgcgaagtgatggtcaaggagaataaagagtcgaagcacaagatgagctattccggaagagtcaaaaccctctgtctacagaaaaatactgccctgtggatcggcactggaggaggtcacatcctcctgctggatctttctaccaggcgcctgatccgggtaatttataacttttgcaacagcgttcgcgtcatgatgaccgctcagctggggagcctaaagaacgtcatgttggtgctaggctacaatcgaaaaaataccgagggaacccagaaacagaaggagatccaaagttgtttgactgtttgggatattaacttaccgcatgaggtgcagaaccttgagaaacatattgaagtacggaaggagctggccgagaaaatgcgaagaactagtgtggaatag

SEQ ID NO: 122187 - DNA, 582 bp, Artificial Sequence
  Description of Artificial Sequence: Synthetic coding sequence
atgacctcttcgtgtttcaggagcacaactcgccggtcactcagttcccagactgctcaaagattggtctgtccacagtttataaacggcaccgcaaaggacagtatcctgacttctcgctcccaggtgcccatcattctccagtggaacaaatcctccaagaaatttgtcccgcacggcgatatccccaatatggaggatgtgttggcagtgaagtctttcagaatgcaaaatacgctatacctgtcactaacccgattcatcggcgatagtagggtgatgaggtggaacagtaaacagtttgtagagattcaagctttaccctcccgcggcgctatgactctacagcccttctcatttaaggacaatcactaccttgcactcgggtccgattataccttctcccagatataccagtgggacaaagaaaaacagcttttcaaaaaattcaaggaaatctacgttcaggccccgagatcctttacagcagtttcgactgaccgccgagattttttttttgctagctcattcaaaggcaaaaccaagatctttgagcatattatcgtagaccttagcctctag

SEQ ID NO: 122188 - DNA, 1638 bp, Artificial Sequence
  Description of Artificial Sequence: Synthetic coding sequence
atggcgcttagaaggggtggctgcggggcacttggacttctgctgttgctcttaggcgccgcctgtctgatcccccggtccgcccaggttagacgcctagcaagatgtccagcaacgtgtagttgcaccaaggagtctattatttgcgttggttcctcttgggtgcctcgtattgtgcctggagatatttctagcctctccctggttaacggcacattctctgaaatcaaagacagaatgtttagtcacctgccgagcctgcagctgctattgctgaattccaactctttcaccataattcgtgacgatgcattcgctggcctgtttcacctcgagtacctcttcattgagggcaacaaaatcgagaccatcagccgcaatgcctttcgcggactacgagacctgacacaccttagcctggcgaataatcacattaaagccctacctcgggacgtgttcagcgacctggactcattgattgagcttgacttaagagggaataagtttgaatgtgactgcaaagccaagtggctgtatctgtggctgaaaatgacgaattcgacggtgtcagacgttctctgcatcgggcctccggagtatcaggaaaaaaaactcaatgacgtgacaagttttgactacgaatgtaccactaccgatttcgtggttcaccaaacacttccgtaccagagtgtctctgtcgataccttcaattctaagaacgatgtctacgtggctatagcccagcccagtatggaaaactgcatggtgttggagtgggaccatatagagatgaatttccgctcatatgataatattacaggacaaagcattgttggatgtaaagcgattctgattgatgatcaggtgttcgtagtggtcgcccaattgttcggcggctcccacatctacaaatatgatgagtcatggacgaaattcgtgaagtttcaggacattgaggttagtagaatatcaaaacccaacgacatcgaactgttccagatcgacgatgaaactttcttcgtcattgctgacagttccaaggctgggctgagcaccgtttacaagtggaactccaagggattttatagctatcagtcgctgcatgagtggttcagagataccgacgccgaattcgtggacatagacggcaaaagccatttgattttgagctctcgatcccaggtgccgattatcctgcagtggaacaaatcctccaagaaatttgtgccccacggagacattcccaatatggaggacgtgctggccgtcaaaagctttcggatgcagaataccctgtacctctcgttgacaaggttcattggcgatagcagggtcatgagatggaattctaagcagtttgtagaaattcaggccctgccatcccggggcgccatgacactacagcctttttctttcaaagacaatcactacttagccctggggagtgactataccttcagtcagatttaccagtgggataaggagaaacagctcttcaaaaagtttaaggaaatatatgtccaggctcctcggtccttcacagctgtaagcaccgaccgcagggatttttttttcgcaagctcattcaaggggaaaactaaaatattcgagcatatcatagtcgacctgtccctctag

SEQ ID NO: 122189 - DNA, 1647 bp, Artificial Sequence
  Description of Artificial Sequence: Synthetic coding sequence
atggccggactcagagctagaggcggccctggtcctggcttgctggccctcagtgcgttaggcttttgcttgatgttgcaggtgtccgctaagaggccacctaagactcctccttgcccacctagttgtagttgcacgcgcgacacagctttttgtgtcgatagcaaggctgtccccagaaacctaccttctgaggtgatctcactgactctagtaaatgcggctttcagtgagattcaagatggggccttttcccacctgcctctgttgcagttccttctcctgaacagcaacaaattcactctcattggggacaatgcttttaccggactcagccacctccagtatttgtttatagagaataacgatatatgggccctgagtaaatttactttccgggggctcaagagcctgactcacctgtccctggccaacaataacctacagacccttcctagagacatcttcaggcctttggacattctcaacgacctggaccttcggggtaatagtcttaattgcgattgcaaggtgaagtggcttgttgaatggctggcccacacgaacacaactgtggctcccatctactgcgccagtccccctcggttccaggagcacaaggtgcaagacctgcctctgcgggagtttgactgcatcacgactgacttcgtgttgtatcagacccttgccttccctgccgtgagtgctgaaccattcctgtattcaagcgacttgtatctggcactcgcccagcctggcgtgagtgcatgcacaatcctaaagtgggactatgttgagcggcagttgagggactacgatcgaatccccgcgccttcagccgttcactgtaaacccatggtcgtggatagccagctgtacgttgtggtggcacaactattcgggggtagctatatctatcactgggaccccaacacaacccgtttcaccaggctgcaagacatagatcctcagcgtgtgcgtaagccaaacgatctcgaggcctttcgaatcgatggtgattggtacttcgccgtggccgacagtagtaaagccggagcgacctcgctgtataggtggcaccagaatggcttctacagtcatcaagccctccacccgtggcaccgggacaccgatctagagttcgtcgacggggagggaaagcccagactcatcgtctcatcaagctcacaggcacctgtaatttatcaatggagccgaacccagaaacagttcgtggctcagggggaagttacccaagtgccagatgcccaggccgttaaacattttagggcaggacgggactcctacctgtgtctgtcaagatacataggcgactccaaaattcttcggtgggaaggcacccgctttagcgaggtccaggctctgcccagtagaggaagcctcgcactgcaaccattcctggtgggggggcggaggtacttggcgctaggatccgacttttcatttacgcagatataccaatgggatgaaggcaggcagaagttcgtgcgcttccaagagctggcggtgcaggcgcctagggcattttgctacatgcccgcaggcgacgcccagctactccttgccccttcatttaagggccagaccctggtgtaccgccatatagtggtagacctgtcggcgtag

SEQ ID NO: 122190 - DNA, 1614 bp, Artificial Sequence
  Description of Artificial Sequence: Synthetic coding sequence
atgggcggcgcaggcatcctgctgctcttgctcgctggcgctggcgtggtggttgcctggcgtccacctaaggggaaatgcccgttacgctgcagctgcagcaaggactcggcattgtgtgaggggtcacctgatctgccagtctcattctcccctactttactgtccctgtctctggtcagaacaggggtgacccaactgaaggcgggctctttcctgagaatcccatctctccatctattgttgttcacctctaactcatttagtgtgattgaggacgacgcattcgccggcttgtcccacctgcaatacctcttcatagaggataatgagattggatctatttcaaagaatgctctgcgtggtctccgtagcctcacccacctgtccctggccaacaaccacctggagaccctcccaaggtttctgttcaggggcctggatacgctcacacatgtggacttgcggggcaaccctttccagtgcgactgccgtgttttgtggctgctccagtggatgccaactgtgaatgcttccgttgggacaggtgcgtgtgcgggtcctgcatccctcagtcatatgcagctccaccacttggacccaaagacgttcaaatgtcgggctatcgaactgagttggtttcagactgtgggcgaatccgccctttctgtggaaccgtttagttaccaaggcgaaccccatatcgtgctggcgcagccgtttgctggaaggtgcttaatcctgtcatgggactattctcttcagagatttagacccgaagaagaacttccggccgctagtgttgtctcatgcaagcccttagtgctgggtcccagtttgttcgtgcttgcagcgcgcctctggggtgggtcacagctctgggcaaggccaagccccggattacggttagcccccacacagaccctagccccccgtcgtctgctaagacccaacgacgcagagctgctctggctggaaggacagccctgttttgtggttgctgacgcatctaaagccggtagtaccactttgttgtgccgggacggcccaggtttttatccacatcagagtttacacgcctggcaccgcgatactgatgcggaggcacttgagctggacggcaggcctcatttactgctggcttctgcatctcagcgaccagtcctgtttcactggaccggaggccggtttgagagaaggacagacattccagaggcagaggacgtctatgcgactcgccactttcaagctgggggagatgtcttcttatgtcttacaagatacatcggggactcgatggtgatgcggtgggacggctccatgttcagactattacagcagcttccatctcgtggcgcacatgtttttcagcctctcctcattgcgagagatcaactggccatacttggctccgatttcgcgtttagccaagtgctcagactggagcccgataaagggctgctggagcccctgcaggagctagggcccccagccctggtcgcaccacgagctttcgctcatattacaatggccgggcgaaggtttcttttcgcagcctgctttaaggggccaacccagatatatcagcaccatgagattgatctgtccgcttag

SEQ ID NO: 122191 - DNA, 1485 bp, Artificial Sequence
  Description of Artificial Sequence: Synthetic coding sequence
atgggaggagccggcatacttctcctgctgctggcaggtgctggagtcgtagttgcctggaggcctccaaagggtaagtgccccctgagatgcagttgcagcaaagatagcgccctctgtgagggctcacctgacctccccgtgtctttcagtcctacactactgagcttatccttggtgcgtacaggagtaacccagctcaaagcggggtcctttctgcgcattccctccctgcacctgttattgtttacctctaattccttctccgtgattgaggatgacgccttcgcaggcctcagtcatctgcagtacctgttcatagaggataatgagataggcagcatatcgaagaacgctttaaggggtctccgctccctgacccacctgtctttagcaaacaatcatctagaaacactgccgagatttctgtttaggggtctcgacaccctgacgcacgtggatctgaggggcaatccctttcagtgcgattgtcgagtgctatggctgctgcagtggatgccaaccgttaacgcatcagtcggcacgggcgcatgtgcagggccagcctcactatcacatatgcagctgcatcacttggatccgaaaacttttaagtgtagggccatcgagttatcctggttccagactgtgggggagagcgccctgtccgtggagccattttcctatcagggtgaaccccacatagtcctcgcccaaccattcgcaggcaggtgtcttatcctatcctgggactactcgctgcaaagattcaggcctgaggaggaactgcctggggaaccccccccccggccctcggcatgccctgcagcttgtctggccggactcacttgtctgcccacctcaccacaacgccctccttggtgtcccgctagtcactggtgctgggctagagctagtagctgctggctcccggcgtgtggcggggcccatagctgtgggccgggacctgtccccgcttgcgcctggccccaaaggcgcccttggccgaggggcggctgttgcggacctatgaccccttcctcctgtggatggaagggcaatccagcttcttggtggccaatgcctccccggcgcgctgcaccacgttgctgcgcggcaactggtcccgcgttcacccgaactcgggcatgcacgcctgggaccggaactaggactctcaggccttggtcatggacggcaggaccaacctgctgttggcctaggctgcccagtgggccttgttcctctactgggcctgtagctgcatcaagggacgcccagacatcaccaagaccccgtatgtccatgccacacgctacctctaggctggtgggcacatgtagctgtgcaagtcacgcgacccttggcactccctggagctgcgccggaacggccccctgcttcgtctgttgctcgaacttcccacgcgccgttcccaccagtagctcccattgtagtagtccaggtactagctggccgtcctag

SEQ ID NO: 122192 - DNA, 1617 bp, Artificial Sequence
  Description of Artificial Sequence: Synthetic coding sequence
atgggaggggcaggaatcctcctgcttctcctcgcaggggccggcgtcgtcgtcgcatggcgcccacccaagggcaagtgtcctcttagatgttcctgctctaaagattctgccctctgtgaagggtctccagacctccccgtgagctttagcccaaccctcttgagtctgtcccttgtcaggacgggagtgacacagctcaaagcgggctcattcctgcggatcccatcactccatctgctgttattcacgagcaactctttcagcgtcattgaggatgacgcctttgcaggactctcacatctgcaatacttatttatcgaagacaacgaaattggctctatctccaagaatgccctccggggtctgcgcagtttaacccacttaagcttggccaacaatcatctggaaactctgccacgtttcctgtttcgagggttggatactctcactcacgttgatctgcgaggcaaccccttccagtgtgactgccgggtgctctggctgctccagtggatgccaaccgtgaacgcctccgttggtaccggcgcatgtgctggtcccgcatctttgagccacatgcaactgcatcatctcgatcccaaaacatttaagtgccgggccatcgagctgagctggttccagactgtgggggagagtgccttatcggtagagcctttcagttatcagggtgaaccacatatcgtgctggctcagcccttcgcgggtagatgtctcatcctgagctgggattacagcctccaacgctttagacctgaggaggaactccccgccgctagcgttgttagctgtaaacctctcgtgctgggaccatcgctgtttgtccttgcagctaggttatggggtggcagtcaactgtgggctaggcccagtcctggattgcgcctggcgcccactcagactctggccccccgtcgcctactccgccccaacgacgccgaactgctctggcttgaaggacaaccctgttttgtagtagccgatgcctccaaggccggttcaacgacgctgctttgcagggacgggcctggcttttacccacaccaatcacttcacgcctggcatcgcgacacagatgcagaagcgcttgaattagatggccgcccccatcttttactcgctagcgccagtcaaagacctgtgctcttccactggacaggcggcaggttcgaaagaagaacagatatccccgaagcagaggacgtctatgctacacgacacttccaggccggaggcgatgtgttcctgtgcttgacgcgctatattggggattctatggtggtcatgaggtgggacggatctatgttccgattactgcaacagctgccctcgcggggagcacatgtgttccagcccctcctgatcgcccgggatcagttggccatactggggagtgattttgcattttctcaggtgttgaggctcgaaccggataaagggctcctggaacctctgcaggagttgggccccccagccttagtggctccaagggcattcgcccacatcacaatggctggcaggcgtttcttatttgccgcttgtttcaaaggtcctacccagatctaccagcaccatgagatagatctctcggcttag

SEQ ID NO: 122193 - DNA, 2091 bp, Artificial Sequence
  Description of Artificial Sequence: Synthetic coding sequence
atggctaccccagggtctgagccccaaccatttgtgccagccctctccgtcgccacactacatcctctgcatcaccctcatcatcatcaccaccaccatcagcaccacggcggaaccggcgcaccggggggcgccggtgggggtggaggaggcagcggcggatttaatttgcccctgaatcgcggactggaacgcgcactggaggaggcagcaaattcaggagggctgaatttgagcgcacggaaactgaaggaatttccacggactgctgccccgggacatgatctaagcgacacagttcaggccgacttatctaaaaaccggctagtggaagtacctatggaattgtgccattttgtttctcttgagattctgaatctgtaccacaactgcatccgcgttatccctgaggccattgtgaacttacaaatgctcacgtatcttaatttatccagaaatcagctgagcgcactgcccgcctgcctatgtggcctgcccctgaaagttttgattgcttctaataacaaactcgggtctctcccagaggagataggacaactgaaacagctgatggagcttgacgtgagttgcaatgagataacagccctccctcagcaaattggtcagctgaagagtttgcgcgaactcaatgttaggcgcaactacctgaaggtgttaccacaggagttagtggatttatccctggtgaagttcgactttagttgtaacaaggtgctggtgatccctatttgctttagggaaatgaagcagctgcaggtgctgcttttggaaaacaacccactgcagtcccccccagcccagatttgtactaagggcaaggtacatatttttaagtatctttccattcaggcttgccagatcaaaactgcggacagtctgtacttgcataccatggagcggccacatctgcatcagcacgtggaggacgggaaaaaggattcggacagcggagtcggcagtgacaacggagataaaaggctttcggccactgaacccagtgatgaggataccgtctctctcaatgtgcccatgtctaacattatggaggaggaacagataataaaggaggactcatgtcaccgcctgagcccagtgaaaggcgagttccaccaggaattccagcccgaaccatccctcttgggggattctactaatagtggcgaggaaagggatcagtttactgaccgtgcagacggacttcactctgagttcatgaactacaaagcccgggcggaggactgcgaagagcttctccgcattgaggaggatgtgcactggcagaccgagggcataatctccagctcgaaggatcaggatatggatatcgcaatgattgaacagctccgcgaggccgtggacttgcttcaggatcctaatggcctgtctactgacattacagaaagaagcgtgcttaatctttatcctatgggatcggccgaagcactcgaactccaggactctgcgttgaatggccagattcaacttgagacttcaccggtctgtgaagtccaatccgatctaaccctgcagtccaatggttctcaatacagcccaaatgagattagagagaattccccggcagtctccccaacaacaaactcaactgctccttttggattgaaacccaggtcagtatttctccggcctcaacggaacctggaaagtattgatccccaattcactatacggcggaaaatggaacagatgcgggaagagaaagaactggtcgagcagcttagggagtccattgaaatgaggctgaaggtatccctccatgaggatttgggagccgcactgatggatggcgttgtactgtgtcatctagtcaatcacatccggccacggtccgtggcttccatccatgtaccgagccccgctgtgccaaagctgtcaatggctaagtgtagaaggaacgtcgaaaattttctagaagcctgccggaagctcggtgtgcccgaggagaagctttgcctgcctcaccacatccttgaagagaaaggccttgtaaaggtgggaattaccatacaggccttactggatatcactgtgacaaaagccctgtttacttag

SEQ ID NO: 122194 - DNA, 2187 bp, Artificial Sequence
  Description of Artificial Sequence: Synthetic coding sequence
atggccactcccgggagtgagccccaaccattcgtgcccgcattaagcgtggctacccttcacccattacaccacccccaccaccatcatcaccatcaccagcaccatggaggtacaggggcgcccggcggtgcaggaggcggtggcggcggcagtggcggcttcaacctccctttgaatcggggcctggagcgcgccctggaggaggccgccaacagtggcgggctgaatctttccgcacgtaaactgaaagagttccccaggacagccgccccagggcacgatctttccgataccgtgcaggccgatctctcaaaaaatcggcttgtggaagtgcccatggaactgtgccatttcgtctccctagagattttgaatctctatcataattgcatcagggtaattcctgaagctatcgtgaatctccagatgttgacgtacctcaacctttcccgtaatcaactgtccgctctgcccgcctgtctctgtggccttccccttaaggtgctgatagcttccaataacaaactcgggtctctgcctgaggaaatcggacagctcaaacagcttatggaactcgacgttagctgtaatgagattacagcgctaccacagcagatcgggcagctcaagagtctccgcgagctgaacgtgagacggaattaccttaaggtgttgccacaggagctcgtagacctatcgcttgtgaagtttgatttctcctgcaacaaggtgctggtgatcccaatttgcttcagggagatgaagcagctccaggtccttctcctggagaataacccactgcaatccccccccgcccagatctgcacaaaggggaaggtgcacatcttcaagtatctaagcatacaggcctgtcaaattaaaaccgcagatagcttatacctccatacgatggagcggcctcatcttcaccagcatgttgaggacggaaaaaaggattccgatagcggggtcggatctgataacggggataagaggctctctgccacagaaccctccgacgaggataccgtgtccctgaatgtgcctatgtccaatataatggaagaagagcaaattattaaagaggactcatgccataggctatcacccgtcaagggcgagttccaccaagaatttcaacctgagccatccctcctcggagactccacgaacagtggagaggagagagatcaattcacagatcgggcagacggactgcattctgagtttatgaactataaggctagagccgaggattgtgaggagttgttaaggatcgaggaagatgtgcattggcagaccgagggaattataagttccagcaaggaccaggacatggatattgcaatgatcgaacagcttcgggaagctgtggacctgcttcaggacccaaatggattgtctaccgatattactgaaaggtcagttctgaacctttaccctatgggctccgcagaggccctggagctgcaggattccgcactaaatgggcagatccagttggaaaccagccctgtgtgtgaagtccaaagcgatctgacgcttcagtccaatggaagtcagtactctcccaatgagatcagggagaactctccagccgtctcccctacaactaattctacagcgcctttcggacttaaaccgcgatctgttttcctgaggccacagcgcaatttggagagtatagatccacaatttacgatcagaagaaaaatggaacagatgcgcgaggagaaagaactggtggagcagctgagggaatctatcgagatgcgcttgaaagtttcactgcacgaagatcttggtgctgccctgatggacggagttgtcctctgccacctggtaaatcatattcggccccgaagcgtagcctctattcatgtaccctcccccgcagtgcccaaactatccatggccaagtgccgtcggaatgtggaaaacttcttagaggcttgccgcaagttaggcgttccggaggcagatctgtgctctccctgcgatattctgcaattagacttccggcatatcaggaagacagtagacaccctgctcgccctgggtgaaaaggcccctccacctacttcggcgctcagaagccgggacttgatcggcttctgtcttgtgcatatcctctttatcgtccttgtgtacatcacttaccattggaacgccctgtcggcttag

SEQ ID NO: 122195 - DNA, 2292 bp, Artificial Sequence
  Description of Artificial Sequence: Synthetic coding sequence
atggccacgcccgggtctgaaccgcagccctttgtcccagccttgagcgtggcgaccctccaccccctccatcatccccaccatcaccaccatcatcaccagcatcatgggggtactggggctccagggggcgctgggggagggggagggggttccgggggattcaatctcccactcaaccgggggctcgagcgcgcattggaggaggccgccaattccgggggcttgaacctgagtgcccggaagcttaaggaattccctcgcacggccgcgcctggtcacgacttatctgacaccgtccaggcagatctgtcaaagaacaggctggttgaggtgcctatggaattatgtcactttgtctctctcgagatcctcaatctgtaccacaattgtatacgtgtgatcccggaagctatcgtgaacttgcagatgctgacttacctcaacctgtcccggaatcagctgtccgccctgcctgcctgtctgtgtggcctgcccttgaaggtgctcatcgcatcaaataataagcttgggagcctccctgaagaaatagggcagttgaaacagttgatggaacttgatgtgtcttgcaacgaaattactgctctgccacaacaaatagggcagctgaaatctttgcgagagttgaatgtgcggagaaactacctgaaggtcctgcctcaggagctggtggacctctcactcgtcaagtttgatttttcctgtaataaggtattagttatcccaatttgcttccgggaaatgaagcagctgcaagtcctgttactcgagaacaaccccctacaatccccccccgcacagatctgtaccaaggggaaggtccacatctttaagtatcttagcatccaagcctgccagataaagacagctgactccttgtaccttcatactatggagcgccctcacctccaccagcacgtggaagacggcaagaaagattcagactctggcgtgggcagcgacaatggcgacaagaggctctcagcaaccgaaccctccgacgaggacacagtgtcccttaatgtccccatgtccaacatcatggaggaagaacagatcatcaaggaggattcatgccaccgtctcagccccgtaaagggcgaattccaccaggagtttcaacctgagccctccctgctaggggactccaccaacagcggcgaagagcgcgaccagttcaccgatcgcgccgacggccttcattccgagttcatgaactataaagcccgcgccgaggattgcgaggagttactcaggattgaggaagacgtgcattggcagaccgagggaattattagctcaagcaaagaccaggacatggacatcgctatgattgagcagttgagagaggccgttgacctccttcaggaccctaatggactgtctaccgacataacggaaagaagcgttttgaacctttacccaatgggctctgctgaggccctggagttacaggatagtgcattaaacggtcagattcaactggagacctcacccgtctgcgaggtacagtccgacctgaccctgcagagcaatgggagtcagtacagcccaaacgaaatcagagaaaactcccctgctgtgtctcctactaccaattctaccgcaccgtttggactgaagcccaggagcgatcccgcactaatccttcctcctatctctttcaacaccctcacccaagctcagacctgggactctagctcatattccgtgccgtccgagggcgactctgataatgtcttcctgagaccgcagaggaatctcgaatccatcgacccacagtttactatccgacgaaaaatggagcagatgagggaggaaaaggaattggtggagcaattgagggagagcatagaaatgcgccttaaggtgtcacttcacgaggatctgggggcagctctgatggatggggttgtgctgtgccatctggtgaatcacattaggccccggagtgttgcctctattcacgtcccctctccggcagtacccaagctgagcatggcgaaatgccggcgcaatgtcgaaaacttccttgaagcctgtagaaagctgggtgtccccgaggccgacctatgcagtccgtgtgatatcctacagctcgacttcaggcatattcgcaagaccgttgacacactgttggccctcggagagaaagcaccgccacctacctcagccctcaggagccgggatctgatcggcttctgtctggtacatatcttgtttattgtgctggtgtacattacataccattggaacgcgttgagtgcttag

SEQ ID NO: 122196 - DNA, 3282 bp, Artificial Sequence
  Description of Artificial Sequence: Synthetic coding sequence
atggcccgccccgtgagaggcggactgggagcaccccgtcggagcccttgcctgctcctgctctggcttcttcttctccgcctggagccagttactgccgctgctgggcctcgagctccatgcgctgccgcctgcacctgcgcaggcgactccctcgattgtggcggtcgggggctggcagcacttcctggcgaccttccgtcatggacaagatccctgaacctttcatacaataaactatccgaaattgaccctgctggctttgaagatcttcctaacttgcaggaggtgtatctgaacaacaacgagctgactgctgttccctcacttggagcggccagctctcacgtcgtgagtcttttcctgcaacataataagatccgcagcgtagaagggagccagcttaaggcctacttatcgcttgaggttctggatctctcactaaataatattactgaagtgaggaatacctgtttcccccatggccctcctattaaggaactgaacctggcaggcaacagaattggcacccttgagttgggcgctttcgatggtctgtcccgaagtctcctaacgctgcgcctgtccaaaaaccgaatcacacagctccccgtaagagcctttaaactcccgagattgacccagctggatctgaacaggaaccggatccgcctgatcgaaggactaactttccaaggcttgaacagcctggaagtacttaaactgcagaggaacaacatctcaaagctgacagatggagccttttggggactgagcaaaatgcatgtcctccatctggagtataattcgctagtcgaggtgaactcaggttccttgtacgggttgacagctctgcaccaactgcatttaagtaataacagcatcgccaggattcacagaaaaggctggtctttttgccagaaactgcatgaactggtcctcagctttaacaatttgacccgtctcgatgaagagtccctcgccgaactgagcagcttaagcgtcttgcgtcttagtcacaatagcatcagccacatagcagagggagcctttaaaggactgcgcagcttacgagttcttgacctggatcacaatgagattagcggaacgatagaagacacctccggcgctttctcgggcctcgattccctgagtaagctgacactcttcggaaataaaattaagtcggtcgctaaacgagctttttctggactggaggggctggagcatctcaatttaggcggaaatgccatccgttcagtccagttcgacgcattcgttaagatgaaaaatttgaaggagctgcacatttcatccgatagttttctgtgtgactgtcagttgaagtggttgccaccttggctgatcgggcggatgctgcaggcctttgtcaccgccacatgcgctcatcccgagagtctgaaaggacagtccattttctctgtgcctcccgagtcatttgtctgcgatgattttctcaagccacagatcatcactcagcctgaaactacaatggctatggtcggtaaggacattcgttttacctgctccgccgcctcctcatccagttccccaatgacttttgcgtggaagaaggacaacgaggtcctgacaaacgcggacatggaaaattttgtacatgttcatgcccaggacggggaagtaatggagtatactaccatcctgcatctccgacaggtgacattcggccatgaaggaagataccagtgtgtgataacaaatcacttcggatccacctattcccataaagctcgactgacagttaatgtcctccctagtttcactaagacaccccatgacatcactattagaaccaccacgatggccagactggagtgcgcggcgactgggcaccccaaccctcaaatagcgtggcagaaagatggcggtactgatttccccgccgcacgggagcgtaggatgcacgttatgcccgatgatgacgtcttcttcatcaccgatgttaaaatcgacgacgccggcgtctacagctgcacagcccaaaattcagccggatccatttcagcaaatgccaccctgaccgtgcttgaaacaccttctctcgtggtgccactggaggatcgggtggtcagcgtcggggaaactgttgctctccagtgtaaagctacaggaaatccaccaccaaggatcacttggttcaagggtgaccggcctctgtcactgactgaaaggcaccacctcacacctgataatcaactgttggttgtgcagaacgtggtcgccgaggatgccggccgatatacctgcgaaatgagcaataccctgggtacagagcgcgctcacagccagctgagcgtcctgcctgctgcaggctgccgcaaagacggaactactgtagggattttcacaatagcagtcgtgtccagtatagtgcttacttcacttgtctgggtttgtattatctaccaaacccgcaagaaatctgaggagtattctgtcactaacacagacgagaccgtcgttcctccagacgtgccgtcctatctgtcgtcgcagggaaccctgtccgaccgccaggaaacagtggtgcgcactgaaggcggccctcaggctaatggtcatatcgagagcaacggcgtgtgtccaagagatgcatctcatttccctgagcccgacacccactcagttgcttgcagacagccgaaactgtgcgccggttctgcataccacaaggagccttggaaagcgatggagaaggctgaaggaaccccagggcctcataagatggaacacgggggtagagtcgtatgctcggactgtaatactgaggtggactgttatagccgcggccaggcatttcacccccagccagtctcaagggattcggcccagccctccgcccccaacggtcccgagcccgggggctccgatcaagagcatagcccccaccaccaatgctctcggactgctgcggggagttgtcctgagtgtcagggcagcctgtacccctctaaccacgaccgaatgctcacagcagtcaagaaaaaacctatggcttccctggacgggaagggcgatagctcctggactttggctaggttgtatcacccagatagcacagagctccagcccgcatcaagccttacaagcgggagtcccgaaagagccgaggcccagtacctccttgtaagcaatgggcacctccctaaggcttgcgatgctagccctgaatccaccccattgaccggtcaactgcccggcaaacaacgggttccactattactggcgcctaagagctag

SEQ ID NO: 122197 - DNA, 2991 bp, Artificial Sequence
  Description of Artificial Sequence: Synthetic coding sequence
aatctgagctataacaagctgtcagagatagatcccgctggcttcgaggacctgccaaatttacaggaagtttatcttaacaataacgagctaacagccgtcccctctctgggagccgcctcaagtcatgttgtaagcctgttcttgcaacacaataagatcagaagcgtggaaggcagtcagctgaaggcctatctgagtctggaagttctggatttgtcactgaataacattaccgaggtacgcaacacctgtttcccccacgggccacctatcaaagagttgaatctggccggaaacagaataggtactcttgagcttggggcctttgatggcctgtcccgttctctcctgacactccggctgagtaagaatagaattacgcagcttccagtgagagcgtttaaactgccacggttgacccagctagacctcaacaggaataggatcagattgatcgaagggttaacattccagggcctaaacagcctcgaggtcttgaaattgcaacgcaacaatatttctaagctgaccgacggtgcattctggggactgtctaagatgcatgtgctccatttagaatacaactcgctggtcgaagtgaactcgggttctctgtacggactgaccgccctccaccagttacacttaagcaacaactccattgctagaatacatagaaaggggtggtccttttgtcagaagctccacgaactcgttctgtctttcaataaccttactcgcctggatgaggagtcgctggctgagttgtctagcttgagtgtgctcaggctgagtcataacagcatttcccacattgctgaaggcgctttcaaaggactcagatcacttagggtgctagaccttgaccataatgaaatcagcggcacaattgaggatacgagtggcgcgttttctgggctagattcactctccaaactgaacctgggcggcaacgccattaggagtgtgcaattcgacgccttcgtaaagatgaaaaatttgaaagaactgcatatatcctccgactcattcctgtgtgactgccaacttaaatggctgcccccttggctcataggcaggatgctacaggccttcgtgaccgctacgtgcgctcatcctgagtctttaaaaggacaaagtatttttagtgtgccgcctgaaagtttcgtgtgtgatgatttcctcaagccacaaatcattacacaacctgaaactacaatggcaatggtgggcaaggacatacgctttacctgcagcgccgcctctagctcatcctcccctatgacgtttgcatggaagaaagacaacgaagtcctcactaatgcagacatggagaactttgtccacgtacacgcgcaggacggagaggttatggaatacactaccattctccatcttaggcaggtgacgttcggacacgagggtcgttaccagtgtgtgatcacaaaccacttcggaagcacctacagtcacaaagcccgacttaccgtgaacgtgctcccctcttttactaagacacctcacgacataaccatccgaactaccactatggctcgcctggaatgcgcggctacaggacacccaaacccgcagatcgcctggcagaaagatggtgggaccgacttccccgccgcacgggaaagacggatgcacgtaatgccggatgacgacgtctttttcatcaccgatgtgaagatcgacgatgctggagtttattcttgcactgcccagaacagtgccgggtccatcagcgctaacgctactctaactgtcctggagaccccaagcttggtggtccccttggaagacagagtggttagtgttggggaaaccgtagccctccaatgcaaggctacagggaaccctccacccaggattacgtggtttaaaggcgaccgcccactgtcgcttaccgagcgtcaccatttgacacctgataaccagcttctggttgtccaaaatgtggttgctgaggatgccggtcgctatacttgcgaaatgagtaatacactcgggaccgagcgtgcccattcgcaactctctgttcttccagcagcgggttgcagaaaagatggcactactgtgggcatcttcactatcgccgtcgtgtccagcattgtcctcacaagcctcgtctgggtgtgcattatctatcagacccgtaagaaaagcgaagaatactctgtgactaatactgacgagaccgtggtacctccagatgtgccctcttatctgtcttctcagggtactctgagtgacaggcaggagacagttgtacggactgaaggggggccacaagcgaatggccacattgaaagcaacggcgtgtgtcctagagatgcgtctcactttccagagccagacacacattcagtcgcgtgcagacagcccaaactgtgtgcaggctccgcataccataaggagccatggaaagccatggaaaaagccgagggcactcccggtcctcacaaaatggagcacggcggccgggtggtgtgctccgattgcaacacagaggtcgactgttattctaggggacaggcttttcatcctcagccagtgtcccgagactccgcccagccttccgctcctaacggtcccgaaccaggtggctccgaccaagagcatagtcctcatcaccagtgcagccggactgccgcgggttcttgcccagagtgtcagggttctctctatccatctaaccacgatcgaatgttgactgcagtgaaaaagaagccaatggcaagcctcgacggaaaaggagattcttcctggacactggcccgactgtatcatccagactctactgagctgcagccagcctcaagcttgacgagcggtagcccggaacgcgctgaagcccaatatctcctggtctctaacggccacttgcccaaagcctgtgatgcgtctcccgagtccactccacttaccggacagctccctggcaaacaacgtgtccccctcctcctcgcgcccaaaagctag

SEQ ID NO: 122198 - DNA, 3213 bp, Artificial Sequence
  Description of Artificial Sequence: Synthetic coding sequence
atggctcgccctgttagaggcgggctcggcgcaccaagaaggtcaccatgcctcttacttttgtggctgctcctgctgcgcctcgagcccgtcaccgcggccgccggccccagagctccgtgtgcggccgcctgcacatgtgcaggcgactcactggactgtggcggcagggggctggctgccctccccggcgatttaccatcctggactcgctccttgaacctttcttacaacaagctgtctgaaattgacccagctgggtttgaggacctccctaatctacaggaggtctacctgaataacaatgaacttacagcagtccctagtttgggggctgcatcatcccatgtcgtgagtctgttcttgcaacataataaaatccgctctgtggaaggcagccagttgaaggcgtacctgtccctcgaagtgttggacctatctttaaacaatattacggaggtgcgaaacacttgctttccccacggtccacccatcaaggaactgaacttggctgggaaccggattggaacactcgagcttggtgctttcgacggactgtccaggtcccttctgacactgaggctctctaaaaacaggataacacagctccccgtgagagcatttaagctaccccgcctgacacagctggacttaaacaggaataggataaggctgattgagggcttaacttttcaaggcttaaactcccttgaagtccttaaactccaaaggaacaacatttccaaactgaccgatggagctttttggggcttgtccaaaatgcacgtgctgcatctcgaatataattctctggtcgaggtgaacagtgggtcactttatggactcaccgcactgcaccaactgcacttgtccaataattcaatagctaggattcatagaaagggctggtctttctgtcagaaacttcacgagttggttctcagtttcaacaatctcactcggctggacgaggaatccctcgccgagttgagctccctatcggtactgcgcctcagccataactcaatatcccacatcgcggagggggctttcaagggcctgagaagccttagggtgttagatctggaccacaatgagatatctggcaccatagaagacacaagtggcgctttttctgggcttgacagtctcagtaagctgctcctgcttgaaccttcacaatctgccgggtgtagctcaccatcgcagcctcacatgtccgcaggtggacggacgctgttcggcaataagattaaaagtgttgcgaaacgtgctttttccgggctcgaaggcctcgaacacctcaacctcggtggtaacgcaatccgatccgtgcagttcgatgcttttgttaaaatgaagaaccttaaagaacttcacatttcttctgattcattcctgtgcgactgccagcttaagtggttgccaccatggctaattggccggatgctgcaggccttcgtgaccgctacgtgcgcccaccccgaatccctgaagggccagagtatcttctccgtgccacctgagagctttgtgtgcgacgactttctgaagccccagatcatcacacagccagaaaccactatggccatggttggaaaagatatcagattcacctgtagcgcagcttcttcctcctcatctcctatgactttcgcttggaaaaaggacaatgaggtgttgactaatgcagacatggagaatttcgtacacgtccacgcacaggatggagaagtcatggaatacacgacaatcctccacctgagacaggtcacttttgggcatgaaggacgttaccagtgtgtgattacaaaccactttggctctacttactcccataaggcccgtttgactgtcaatgtgttgccatctttcacgaaaaccccccacgatattactattaggaccaccacgatggcacgtctggagtgtgccgcgacagggcatccaaacccacagatagcttggcagaaagacggaggcactgatttccccgccgcgcagaccccaagcctggttgttcccctagaggaccgagtggtatcagtgggggagacagtggcactacaatgcaaggctaccggaaatcccccccccagaataacgtggttcaaaggcgatcggccactctctcttacagagcgccatcacctcacccccgacaaccagctcctggtggtacagaacgtcgtggccgaggacgccgggagatacacttgtgagatgagtaacaccctgggaaccgaacgggctcattctcaactgtcagtgcttcccgccgccggatgtcggaaggacggtaccactgtggggatattcacaatcgcagtcgtgtcatcaatcgtactgacgagcctcgtctgggtgtgtattatataccagacccgtaaaaaatctgaggaatatagcgtaactaacaccgacgaaacagttgtgccccccgacgtcccctcatatttaagttcccaagggactctgtctgatcgtcaggaaactgtcgtcagaaccgagggcggtcctcaggcaaacgggcacattgagagcaacggggtgtgcccccgagatgcatctcactttcctgagccagatacacacagtgtggcttgtcggcagcccaagctctgcgccggttcagcgtaccacaaagagccctggaaggctatggagaaagccgaaggcacaccaggtcctcataaaatggagcacggcggtagagtagtttgttctgattgcaacacagaagtggattgctatagccgcggccaggcattccaccctcagcctgtgtccagggacagtgcccagccctccgccccaaatggcccggaaccgggcgggagtgatcaggaacactctcctcaccaccagtgttcccggacagctgccgggtcctgtcccgagtgtcagggatcgttgtaccctagtaatcatgaccggatgctgacagccgtcaaaaagaaacccatggccagcctggacggaaaaggcgacagttcctggactctggcccggctgtaccacccggactctactgagcttcagcccgcaagttccctgacgtccgggagcccagagagggccgaggcccaatatctactggtgtcgaatggccaccttcctaaagcctgcgatgcctcccccgagtctacccctctaaccggacagctcccagggaagcagcgggtcccactgctgttagctcccaagtcctag

SEQ ID NO: 122199 - DNA, 3198 bp, Artificial Sequence
  Description of Artificial Sequence: Synthetic coding sequence
atggcgccggcccctctcggcgtgcccgaggagcagctccttggttgcagaagcagagttctctccagacttctgtttattgcccaaacagcactgctgttgctgccagccgctggggccggcctgtgtcctgcaccttgttcttgcagaatccctctcctggattgctctagacggaagctgcccgccccctcttggcgggctctgagcggccttctgccccctgataccgcaatcctcgattttagccataacagactcagcaattggaacatatccttggagagtcagacactgcaggaagtcaagatgaattacaacgagctgaccgaaattccgtattttggtgagcctaccagcaacatcacgcttctgtccctcgtgcataacattataccagagatcaatgcccaggcacttcagttctacccagctcttgaatctcttgacctcagcagtaacattatcagcgagatcaaaactagcagtttcccacgaatgcagctgaaatatctcaacctctcaaacaacagaattactacactggaagcaggttgcttcgacaacctgtcttccagtttgcttgtggttaagttaaacaggaatcggatgtcaatgatacctcccaagatttttaagcttcctcacctccagtttctggaactcaaacggaatagaattaagatcgttgaaggcctgaccttccagggcctagatagcttgcggtcacttaagatgcagcggaacggtatctcgaagctcaaggatggcgctttcttcgggttaaacaatatggaggagctggagctagaacataacaacctgaccagagtgaataaagggtggttgtatggccttcgaatgcttcagcagctgtacgtgtctcagaatgcaatcgagcggataagtcctgatgcctgggagttctgtcagcgactgagcgaactagacctcagctataaccagttgaccaggctagacgaatccgcctttgtgggcctctccctgttagagagactcaacttgggtgataaccgggtgacacacatagctgacggagtgttccgattcctgagtaacttgcagactttagatttgaggaacaacgagatctcttgggctatagaagatgcttctgaggcttttgccgggttgacgagtctaaccaagcttattctccaggggaaccagattaaaagcattacaaagaaagcatttatcggactggaaagcctggaacacctcgatctgaataacaatgccatcatgtccatccaggagaatgcattctctcagacccatctgaaagagctgatccttaatacatccagtctgctatgtgattgtcacctgaagtggctcttgcagtggctggtggataacaacttccagcactccgtgaatgtttcatgtgctcaccctgaatggcttgccggccagtcgatattgaatgtggatctcaaggatttcgtgtgcgatgacttcctgaagcctcagatcagaacgcaccctgaaaccattatagctctaagaggcatgaacgtcactctgacctgcacagcggtctcttcctctgattcgccaatgagcactgtttggagaaaagactccgagatcctctacgatgttgacacagagaactttgtcaggtactggcagcaggccggagaggccctggaatacacctcaatcctgcacctcttcaatgttaacttcaccgacgagggcaaataccagtgcatcgtcacaaatcacttcggctcaaattacagccaaaaggcaaagctgaccgtcaacgagatgccaagcttcttgaagaccccgatggacctgaccatcagaactggtgcaatggcgcgactcgagtgtgccgccgagggccaccccgccccccagatctcttggcaaaaagatgggggaactgacttcccagccgcccgcgaacgcagaatgcacgtgatgccggaggatgatgtgtttttcatcgcgaatgtgaaaattgaggatatgggaatttactcctgtatggcccaaaacacagccggggggctttccgcaaatgcgagcttgaccgtgctagagactccaagtttcatccggccccttgaggacaaaacagtgacaagaggagaaaccgcagtgctacagtgtattgccgggggatcccccgctccccgactgaactggacaaaggacgatggaccattactggtcaccgaacgacatttcttcgccgccgctaatcaacttctgattattgtcgacgctggactggaagacgctgggaagtatacatgcattatgagtaatactctgggcacagaacgcggtcatatttatctgaatgtaatctcatcccctaattgcgattcaagccagtcgtcaattggccatgaagatgatggttggacaaccgtcggaattgtcatcattgtggtggtgtgttgcgtcgtcggaacatctctgatatgggtcatcgttatatatcatatgcgcaggaaaaacgaggattattcaatcactaacacggaggagcttaacttacctgctgacattccctcttaccttagctctcagggaaccttatccgagccccaggaaggttattctaacagcgaagcaggatcacaccagcagctgatgccccccgctaacggctacatccacaagggcaccgatggaggtaccgggacaagagtcatctgttccgattgttacgacaatgccaacatctattctagaaccagagaatactgtccatatacctacattgcagaggaggatgtcctggaccagactctttcctcgctgatggtgcagatgccaaaagaaacctacctcgtccaccccccacaggataccacagctctcgaaagcctgataccttccgcgaaccgtgaacctagtgctttccccaccaaccacgagagaatctctgaaaagaagctgcccagcactcagatgtccggtgagactctgcagagaccggtgtggaacataaatagggagctgggactgccccatccaccattctcccagcaacccgtgcacgagtcgccccagctgcaccagaacgaaggactggcaggccgggaaccggactgttctgcctcctcgatgtcttgtcataggctgcaggatcacgctttcgatttcagcaggacacgcaatatacaagatggctccgaaggtacatag

SEQ ID NO: 122200 - DNA, 876 bp, Artificial Sequence
  Description of Artificial Sequence: Synthetic coding sequence
atggagtcagagcggagtaaacgcatgggtaatgcttgtataccattaaaaagaatcgcatacttcctctgtttactctctgcgctcctcctgactgagggaaagaaacccgccaagccaaaatgtccagccgtctgtacttgtacaaaagacaatgccttgtgcgaaaacgccagatccatcccgcgaaccgtcccgcctgacgtgattagcctgagtttcgtccgaagcggcttcaccgagattagtgagggctcttttttgttcacgccatcactgcagctgcttctttttactagtaatagctttgacgtgatctccgatgacgcttttatcggtttgcctcacctggagtacctcttcatagaaaataacaacatcaaaagtatctcaaggcacacattcaggggcctgaagagcctaattcacctcagcttggccaataataacctgcaaacattgcctaaagatattttcaaaggtcttgattccctcaccaatgtcgacctgcgggggaacagctttaactgtgactgcaagctgaagtggctggtcgaatggctgggtcatactaacgcaacagtggaggacatatactgtgaaggcccacctgagtataagaagcgaaagatcaactccctctcatccaaagacttcgactgcatcatcaccgagtttgctaaaagtcaggacctcccctaccagagcttatccattgacacgttcagctacttaaacgacgaatacgtggttatcgcccaacctttcaccggcaaatgtattttcctggagtgggaccacgtggagaagacattcaggaactatgacaacatcacagtgctgcgagaaatccatcgtttcacgaacatgtcctag

SEQ ID NO: 122201 - DNA, 1674 bp, Artificial Sequence
  Description of Artificial Sequence: Synthetic coding sequence
atggagtccgaaagaagcaagaggatgggtaatgcttgtataccactgaaacgaatcgcctattttctgtgcctcctctcagccctgctacttactgagggaaaaaagcctgccaagcccaagtgtccagcagtctgcacttgtacaaaagacaacgccttatgtgaaaacgcaaggtcaatcccccggacggtgccaccagacgtcatcagcttatccttcgtcagatccgggtttacagagatatccgagggctcctttctctttactccatcgcttcaactacttcttttcactagtaactccttcgatgtgatctccgatgacgcctttataggcctgccccacctggaatacctgttcatcgagaacaacaacatcaaaagcatatcaagacacacctttagagggcttaaatccctgatacatctcagtctggctaacaataacctgcagactctacccaaggacatcttcaaaggcctcgactctctgacaaatgtggatttgaggggcaattcctttaactgcgattgcaagctcaaatggttggtcgagtggctgggacataccaatgccacggtagaggatatttattgtgagggccctcccgaatataagaaacggaaaatcaacagtctgagttcaaaagatttcgactgcatcatcacagaatttgctaagagccaggatttaccttaccaaagtctgagtatcgacacctttagttatctgaacgacgagtatgtggttatcgcccagcctttcaccggcaaatgcatttttctggaatgggatcacgtggagaagacattcagaaattacgataacataaccggcacctccacggtcgtgtgtaagcctattgtgattgaaacacagctctacgtcatcgtggcacaactgttcggaggatcacatatttacaagcgggacagtttcgccaacaaattcatcaaaattcaagatatcgagattcttaagattcgcaagcccaacgatattgaaaccttcaaaattgaaaacaactggtatttcgttgtggcagacagtagcaaagctggcttcactactatctataagtggaacggtaacgggttctattcacatcaatctctccatgcctggtatcgtgataccgacgtggaatatctagagattgtcaggacgccgcagacactgcgtacaccccaccttattttgtcttcctccagccagcgtccagtgatctaccagtggaataaagccacccagctcttcaccaatcaaaccgatatacccaacatggaagatgtctacgccgtcaagcatttcagcgtgaaaggggatgtgtacatctgcctgactcgattcatcggtgatagtaaggtcatgaagtggggaggcagttcctttcaggatatacagaggatgcctagccgtgggagcatggtgttccagcccctccagatcaataattaccaatatgcaatattaggcagcgactattcgttcacacaagtgtacaactgggacgccgaaaaagccaagtttgtgaagttccaggagctcaacgtgcaggcccccaggtcctttactcacgtgtcgataaacaaaaggaactttctcttcgcctcctcattcaaagggaacactcagatctacaagcacgtgatcgtcgatctgtctgcctag

SEQ ID NO: 122202 - DNA, 1530 bp, Artificial Sequence
  Description of Artificial Sequence: Synthetic coding sequence
atggagtccgagagatctaagagaatggggaacgcctgcatcccacttaagcgcatcgcttattttttgtgcctgctgagcgccctattgctgacagaaggaaaaaagccagccaaaccaaaatgtccagccgtgtgcacgtgcaccaaggataatgccctttgtgagaatgcaagatcaatccctagaaccgtgcctcccgatgttatcagtctgtcattcgttcgttcggggtttacagaaattagcgagggatccttcttatttacgccctcactgcaattgttgtctcttgcgaacaataacctgcaaaccctgcctaaggatattttcaagggactcgactcgcttactaatgtagacctccggggcaattcattcaattgcgactgcaaattaaaatggctggttgaatggctggggcacacaaatgccacggtagaagatatttactgcgagggaccccctgagtacaaaaagagaaaaataaactcgctgtcttcaaaagactttgattgtatcatcacagaattcgccaaatcccaggatttgccctatcagtctttatcgatagatactttcagctatctgaacgatgagtacgttgtgatcgcacagcccttcacgggcaaatgcattttcctcgaatgggaccacgttgagaaaacgtttaggaattatgacaacattacagggacgtctacagtggtgtgtaaacctatcgtcattgaaacccaattatatgtgatcgttgcacaattgttcggtggcagtcatatctataagcgagactcgttcgctaataagttcattaagatacaggacatcgagatcctgaagatacgaaagcccaatgacatcgaaacattcaagatcgagaacaactggtactttgttgtagctgactcctctaaagctggcttcaccacaatttataaatggaacggtaatggcttttatagccaccaaagtctccatgcatggtacagggataccgatgtggaatatttagagatagtgaggaccccacagacccttagaacacctcatctaatattgtcgtctagcagccagcggcccgtcatctaccagtggaacaaagccacccagctcttcacgaaccagacagatattcccaatatggaggacgtctacgctgtcaagcatttcagcgtcaaaggggatgtgtatatctgtctcacccgcttcattggcgattctaaggttatgaaatgggggggcagtagctttcaggatatccagcgaatgcccagtcgaggaagcatggtgtttcaacccttgcagatcaacaattatcagtacgccattttgggcagtgattattcgtttacccaggtatacaattgggacgcagaaaaggctaagtttgttaagtttcaggagctaaacgtgcaggctccccgaagttttacccacgttagtatcaacaagcggaatttcttgttcgcctcctcgttcaaggggaatacacagatatataagcacgtcattgttgatctttctgcctag

SEQ ID NO: 122203 - DNA, 777 bp, Artificial Sequence
  Description of Artificial Sequence: Synthetic coding sequence
atgagcgcgtacccaaagagctataacccttttgacgatgacggagaggacgagggagccaggccagccccctggagagacgcacgagatctaccagatggacctgatgcacccgctgatcggcaacagtacctaagacaggaggtgctgaggcgcgccgaggctacagcggcctctacgtctaggagcctggctttaatgtatgaatccgaaaaagtgggggtcgcctcctctgaggaactcgctagacagcggggcgtactcgaacggacagagaagatggtagacaaaatggaccaggacctgaagatttcacaaaaacacataaactcaattaagtccgtttttgggggattggtgaactacttcaagagcaaaccggtggaaactcctcctgaacagaacggtaccctcactagtcagcccaataatcgtctgaaagaggccatttccactagcaaggaacaggaagcaaagtatcaggctagccatcctaacctcagaaagcttgatgacacagaccctgttcctaggggcgctggctcagcaatgagcaccgacgcctaccctaagaacccgcacctgagagcgtatcatcaaaaaatcgacagtaatcttgatgagctgagcatgggcctgggtaggctgaaggatattgccttgggaatgcagaccgagatcgaggaacaggacgatatattggaccgccttactactaaggtcgacaaactcgacgttaatattaagtccactgagcgcaaggttaggcagttatag

SEQ ID NO: 122204 - DNA, 2466 bp, Artificial Sequence
  Description of Artificial Sequence: Synthetic coding sequence
atggctgggccagggtcaaccgggggccagatcggcgctgcggccctggccggcggtgctcggagcaaggtcgccccatctgttgattttgatcatagttgcagcgattcagttgaatatttgacactcaactttgggcccttcgagactgtccaccggtggagaaggttaccaccatgtgacgagtttgtaggcgccagaaggtccaagcacacggtggtcgcttacaaggacgccatttacgtcttcggaggggataatggagcttttacaactggaacgccacccgctccacggtatcatcacagcgctgtggtgtacggtagctctatgttcgtttttggcgggtatacaggtgacatttattcaaattcgaatttgaaaaataagaacgacttgttcgaatataagtttgctactggccaatggacagagtggaaaatcgagggacgcctacccgtcgcaagaagtgcgcacggagccactgtgtatagcgataaactgtggatttttgcaggatatgacggcaacgcccggctgaatgatatgtggactatcggattacaagatagggagttgacttgttgggaggaggtggctcagtctggcgagataccgccctcttgctgtaactttcctgtggctgtatgtcgggacaagatgttcgtgttctccggccagtctggcgcaaagatcactaataacctgttccagttcgagttcaaagataaaacatggacgagaatcccaacagagcatctgcttcggggcagtcccccacccccccagcggcgatacggacacaccatggtggcatttgatcggcacttatatgtcttcgggggggcggctgacaacacactcccaaatgagctgcactgctacgatgttgacttccagacgtgggaggttgtgcagccgagtagcgacagcgaagtcgggggggcagaggttcccgagagagcttgcgctagcgaggaggtgcctacacttacctacgaggaaagagtcggcttcaagaagagtagggatgtgtttggacttgactttggtactacaagtgctaagcagccaacacagcccgcctctgagcttcccagcggaagactgtttcatgccgccgccgtgatttcggacgcgatgtacattttcggaggcaccgtggataacaacatcaggtctggcgagatgtaccggtttcagttctcctgttaccctaagtgtactctccatgaggattacggccgtctgtgggagtccagacaattttgtgacgtcgagtttgtgttgggggagaaggaggagtgtgtccagggacacgtagctatcgtgacagctcgcagcagatggttgcgacgtaagatcacgcaggcacgtgaacggctggcccaaaagctcgagcaggaagcggcccccgtacctcgagaggcccccggcgttgccgccggcggtgcccggccgcccttgctgcacgtggcgatcagagaggccgaagcccgcccgttcgaggtgcttatgcagttcctctatactgacaagatcaaatacccccgcaaagggcatgtcgaggacgtgctgcttataatggatgtctataagctggctctcagcttccagctatgcagactggagcagttgtgccgccagtacattgaggctagcgtggacctacagaacgtgctcgtggtttgcgagtctgccgcccgactgcagctaagccagctcaaggagcattgtctgaacttcgttgtcaaggagagtcactttaatcaagtgatcatgatgaaagagttcgagagactatcttcaccactaattgtggagatagtccgcagaaagcaacaacccccaccacgcacccctcttgaccagccagtcgacattggaacaagcttaatccaggacatgaaggcctacctcgagggagctggggcggaattctgtgacatcactcttctgctggacggacaccctcggcccgcacacaaggcgatcctggctgctagaagttcctacttcgaggcaatgtttagaagctttatgccagaagacgggcaggtgaacattagcattggggaaatggtgccatcccgccaggctttcgagtcaatgctgcgctacatttactacggtgaagtgaatatgcccccagaagatagcctatacctcttcgcggctccatactactatggattttataataaccgcttgcaggcctattgtaaacagaatctagagatgaatgtgacggtccagaatgtcctgcagattctggaggctgcagataagactcaagccctcgatatgaaacgacactgcctccacattatagtgcaccagtttaccaaagtgagcaagctgcctaccctgaggtcactgagccagcagctgcttctggacattattgatagcctggcctctcacatttctgataaacagtgtgcagaattgggagccgacatctag

SEQ ID NO: 122205 - DNA, 2400 bp, Artificial Sequence
  Description of Artificial Sequence: Synthetic coding sequence
atgaattacgatcctattgtctctaaagtggctgaagtgttagcttccggaagggctatcaggaagcgtgaggttgaacgctcaaagcataccgtcgtcgcctacaaagacgcaatttatgtgtttgggggagataacggcaaaactatgctcaacgacttgctgagattcgacgtgaaggactgcagttggtgccgtgcatttaccacagggactccacctgccccccgataccaccatagtgccgtggtttacggctcctccatgtttgtgttcggtggatatacaggggatatttattccaactccaatctcaagaacaaaaacgacctgtttgaatataagtttgctaccggccagtggacagagtggaaaatagagggtaggctgccagtggctcgatctgctcacggagctactgtgtacagtgataaactgtggatttttgcagggtatgatgggaatgcaagacttaatgacatgtggacaatcggcctgcaggatcgggagctgacttgctgggaggaagtcgcccaatccggagaaattcctcctagctgctgtaattttcccgtggccgtgtgtagggacaaaatgttcgtcttctctgggcaaagtggagcaaaaattaccaacaacctctttcaatttgagtttaaggataagacttggactcgtataccgaccgaacaccttctgcgcggcagtccaccacccccacaacgccgatatggacatacgatggtcgccttcgatcggcacctgtatgtgtttggaggtgcagcagacaataccctgccaaacgaactgcattgttatgacgtcgatttccagacatgggaggttgtccaaccctcctccgatagtgaggttgggggggctgaggtcccagaacgcgcttgtgccagcgaggaagtccccacattgacttacgaagagcgggtgggattcaagaagtctcgcgacgtgtttggcttagacttcggcaccacttctgcaaagcaacccacccagcctgcaagtgagcttcctagcgggcgactattccacgcggccgccgttatatctgacgccatgtatattttcggaggcacagtggataacaacatacggtctggggaaatgtaccggtttcagtttagttgttaccccaagtgcaccctacatgaggactacgggaggctgtgggagagtcgccagttctgcgacgtggaattcgtgctgggggagaaggaagaatgcgtgcagggccatgttgctattgtgactgccagaagtcgctggctacggagaaagatcacacaggccagagagagactcgcacagaaactggagcaggaagctgcaccggttccgagagaagctccaggcgttgctgcaggaggagccaggcctccacttctgcatgtggccatcagagaagctgaggcacgacccttcgaagtgttgatgcagttcctgtatactgacaagattaagtatcctaggaagggccacgtggaggacgtgcttttgattatggatgtatacaagctggccttgagtttccaactgtgtcggctggaacagctatgcaggcagtatatagaggcctccgttgatctacagaacgttctagtggtgtgcgaatctgccgcccggttgcaattgtcacagctcaaggaacattgtctcaatttcgtcgtgaaagagagccattttaatcaggtcataatgatgaaggaatttgagaggctctcgagcccactgatcgtagagatcgttaggcggaaacagcaaccaccgccgcgtacaccactggaccagcctgtagacattggcacttcgctgatacaggatatgaaggcatacctggaaggagccggggcagaattttgcgatataaccctgcttctggatggacacccgagaccagctcataaggccattctagccgcaagatcaagttattttgaggccatgtttcgaagcttcatgcccgaagatggccaggtaaacatctccatcggagaaatggtgccttcccgacaagcctttgaatccatgctgaggtatatctactatggagaggtgaacatgccacctgaagactcactatatctgtttgccgcgccctactactatggattctacaataaccgtttacaggcctattgtaagcagaatctggaaatgaacgttactgttcagaacgtattgcaaattctcgaggccgccgataagacccaggcccttgatatgaagcgacactgcttgcatattatcgtccaccagttcaccaaggtgtccaagttgccaacactccgttccctgtcgcagcaactgttgttggacataatcgactcactcgcttctcatattagcgacaaacaatgcgccgagctaggggccgatatttag

SEQ ID NO: 122206 - DNA, 1560 bp, Artificial Sequence
  Description of Artificial Sequence: Synthetic coding sequence
atgagctatccccagttcggctacccctacagttccgctccccaatttctcatggccacaaattctttgagcacttgttgtgagtctggcggcagaaccctggctgactctggccctgcagcgagcgcacaggctccagtatactgtcccgtatacgaatccaggttgttggcgactgcccgacatgagctgaatagcgctgccgcactgggagtctatggaggaccctacggtgggtcccaagggtacgggaactacgtgacttatggaagcgaggccagcgctttttactcacttaactcattcgattctaaggacgggagtgggtctgcgcacggaggcctcgcgccagccgctgctgcgtactatccctacgaaccagccttgggtcaatacccttatgaccgctatggcaccatggactccggcacacgccgcaagaatgccaccagagaaaccacctcaaccctgaaagcctggctccaagagcacagaaagaatccttacccaaccaaaggggaaaaaatcatgctggctattatcactaagatgactttgacccaggtctcaacctggttcgctaacgcccgccgcagactgaagaaggagaataaaatgacatggccaccccggaacaagtgcgccgacgagaaacggccttacgccgagggggaagaggaggagggcggtgaagaagaggcccgggaagagcccctcaagtctagtaagaacgccgaacccgttgggaaagaggagaaggaactggagttgtccgacctggacgacttcgatcccctggaggccgagccacccgcttgtgagttgaaaccaccattccattcattggacggaggcctggaacgggtgccagccgcacctgacggacccgtgaaggaggcgagcggggccctcaggatgagcctcgctgccggcgggggcgccgcccttgacgaggacctcgagcgcgccagatcatgtttgcgtagcgcagcagccggtcccgaacccttgcctggagccgagggtggcccccaggtgtgtgaagccaagctaggtttcgtgcctgctggcgcatctgccggactggaggctaaaccgaggatctggtccttggcacatacagctaccgccgctgcagccgctgccacttctctctcccagactgagttcccctcttgcatgctgaaacgccaggggccggcggccccagctgccgtaagctctgcaccagccactagtccatctgtggcactcccccactccggagcacttgacagacatcaagactcgccagtcaccagcctgcggaactgggtggatggggtatttcatgatcccattttgaggcattctaccctcaatcaggcctgggctaccgccaagggcgctctgctcgacccgggccccctgggccggtcccttggcgccggggcgaacgtgttaacggctccgctggctcgagcattcccccccgccgtgcctcaggacgcccccgccgctggcgctgcacgtgagctcttggctttgccgaaagctggcgggaagcctttctgcgcatag

SEQ ID NO: 122207 - DNA, 3036 bp, Artificial Sequence
  Description of Artificial Sequence: Synthetic coding sequence
atgatcgagaacagcatgtttgaagaggagcctgatgtggtggaccttgccaaagagccatgcctgcatcccctggagccagacgaggttgaatacgaaccaagggggagcagattgctggtcagaggtctcggagaacacgaaatggaggaagacgaggaggactacgagtcctccgctaaattactcgggatgagcttcatgaaccgctccagcggccttagaaatagtgcaactggctaccgccaatctcctgacggggcatgtagcgttccaagcgcaagaacgatggttgtctgcgcgtttgtgatcgtggtcgctgtctcagtgataatggtaatttacctgctgccaagatgcaccttcaccaaggagggttgccacaaaaaaaatcagagcataggactgatccagccgttcgcgactaacggcaagctgttcccttgggcacagatccgcctgccaaccgctgtcgtccctctccgctatgagctttctcttcatcccaatcttacaagcatgacttttagagggagcgtgaccatctcggttcaggcactgcaagtcacttggaatataatattacactcaaccggccacaatatctctcgggttacgtttatgagcgctgtgtcctcacaagaaaagcaggccgagattctcgagtatgcttaccacgggcaaatcgctattgttgcgcccgaggctctgctggctggacataactacactctgaagatcgaatacagcgccaatataagttcatcgtattacggcttttacgggttttcgtacacggatgagtctaatgaaaaaaaatactttgcagccactcagtttgaacctctggctgcaaggtcagcttttccctgcttcgacgagcccgcttttaaggccaccttcataatcaagataataagagatgagcagtatacggcacttagcaacatgccgaagaagtctagcgtagtgcttgacgatgggcttgtgcaagatgagttttctgaatcagtaaagatgagcacatatctggttgcattcattgtcggggagatgaagaacttaagccaggatgtgaacggcacgttggtttcaatctatgcagtacctgagaagatcgggcaggtacactacgctctagagaccaccgtgaaacttttggaattctttcagaactattttgagatccaatatccgctcaagaagttagacctggtcgcaattcctgatttcgaggctggggctatggagaactggggactgcttactttccgggaggagaccctcctgtacgacagtaatacatcctccatggcggaccgtaaactggtaacgaagatcattgctcacgagcttgctcatcagtggttcggaaacctagtcacaatgaaatggtggaacgatctctggctgaacgaggggttcgccaccttcatggagtacttttccttagagaagattttcaaggagctgagttcttacgaagatttcctcgacgccagattcaaaactatgaaaaaggactccctgaattcttctcatcccatttcctcttctgtgcagtcgtccgagcagatcgaggaaatgtttgacagtttgagctacttcaaaggctcttctctgcttcttatgttgaagacgtatctctcagaggacgtttttcagcacgcggttgttctttatctgcacaatcacagctacgcttcaatccaaagcgatgacctgtgggattcatttaatgaggtgaccaaccagaccctagatgtcaaaaggatgatgaagacgtggaccctccagaagggattcccactggtgacagtacagaagaagggcaaggaactgttcatacaacaagaacgattcttcctgaacatgaagcccgagatacaaccctcggatacgagctatctatggcacatacctctcagttatgttactgaaggtaggaactactccaagtatcagagcgtatccctgcttgataaaaagtctggcgtgattaaccttactgaggaagtcctgtgggttaaagtaaacatcaacatgaacgggtactacattgtgcactacgctgatgacgactgggaggctctgattcaccagttaaagatcaatccttacgtgctctccgacaaggacagagcgaacttaattaataatatctttgaactcgccggcctgggaaaggtcccactgaaacgggcattcgacctgattaactacctcggcaacgaaaatcatactgcccccattacagaggccctttttcagacggacctgatttataaccttctggagaagctcggatatatggatctggcaagccggctggtgacccgggtcttcaaactgcttcagaatcagatacaacagcagacgtggacagacgaagggacccctagcatgcgagagctccgcagcgctttgctggaattcgcctgtacgcacaatctggggaattgctccacgacagccatgaagctctttgacgattggatggcctctaacggaacgcagtctttaccaactgatgtcatgaccacggtcttcaaagtgggcgccaagaccgataaaggatggtcattcctgctgggcaagtacatctccatcggatcagaggccgagaaaaataagatcctggaagcgctggcctcttctgaagacgtccgtaaactttattggctaatgaagtctagtcttaatggcgataactttcggacccagaagctgtcctttattattagaaccgtgggacggcatttccctggacatctcctcgcctgggatttcgttaaggagaattggaataaactggtgcagaaattcccactgggatcctatacaatacaaaatatcgtcgccggcagcacatacctgttttctacgaagacacatctttctgaggtgcaggccttcttcgagaatcagagtgaggctacattcaggttgagatgcgtccaggaggcactggaggttatccaactgaacatccaatggatggaaaagaacctcaagtcactgacatggtggctgtag

SEQ ID NO: 122208 - DNA, 3450 bp, Artificial Sequence
  Description of Artificial Sequence: Synthetic coding sequence
atggccgagaggaaaggaaccgcaaaggtggacttcttgaagaaaatagaaaaggagatccagcagaaatgggacacagaaagagtcttcgaggtgaacgcctccaatctagaaaagcagacttccaaggggaagtatttcgtgacctttccatacccttatatgaacggccgactgcacctgggccacacctttagtctgtcgaagtgtgaagcttgcgcggataaattgaagagggagatcgagctgtacgggtgtccccctgatttccccgacgaagaagaagaagaggaagaaaccagtgtgaagacagaggacatcataatcaaggacaaggccaagggcaagaagtctaaggcggccgcgaaagctggtagcagcaaatatcaatgggggattatgaagtccttaggattgtcggacgaggagatagtcaagttctccgaggcggagcactggttggattactttccccccctggccatacaggatctgaagaggatgggactaaaggtggactggcgaaggtcatttatcacaaccgacgttaacccatactatgacagctttgtgcggtggcaattcttaactctgcgcgagcgcaataaaatcaagttcggaaaaaggtatacaatctattctccaaaggacggacagccgtgcatggaccatgacaggcaaactggagagggcgtggggccccaggaatatacactactaaagttgaaggtgctggaaccttacccgtccaagctatccgggctgaaaggcaagaacatatttctggtggctgctactctgcggcccgagacgatgtttggacagactaactgctgggtccgtccagacatgaagtacatcggatttgaaactgtgaatggggacatcttcatctgtacccagaaggcagccaggaatatgtcttatcagggctttaccaaggataatggggtcgtgcctgtggttaaagaacttatgggggaggaaattctgggtgctagcctgtctgcacctctgactagttacaaggtcatctacgtactgcccatgctgactataaaagaagacaagggcaccggcgtcgtcaccagcgtccccagcgattcacctgatgacattgcagctctgagggacctgaaaaaaaaacaggctctgcgcgcgaagtatggtattcgtgacgacatggttctccccttcgaaccggtgccggtaattgagatcccaggcttcgggaatttatccgccgtgaccatttgtgacgaattgaagatccagtctcagaacgatcgcgaaaaactagccgaagctaaggagaaaatttacctgaagggattctacgaagggataatgctggtcgacgggtttaaaggccagaaggtccaggatgtgaagaaaactatacaaaaaaagatgattgatgctggagatgctctgatttacatggagccagagaaacaggtgatgtcaagatcctcagatgagtgcgtggtagccctgtgtgatcaatggtacctagattacggcgaagagaattggaagaagcagaccagccagtgtctaaagaatctcgaaacattctgcgaggagacccgcaggaacttcgaagccactcttggctggctgcaagagcacgcttgctctcggacctacgggctcggcacccatttgccatgggacgaacagtggctaattgaaagccttagcgactccactatctacatggcgttttacaccgtcgcgcacctgctgcagggggggaatttgcatggacaggcggaatctccgctgggcattcggccccagcagatgactaaggaggtgtgggactacgtgttcttcaaggaggctccatttcccaaaacccaaatcgccaaggagaagttggatcaactgaaacaggagtttgagttttggtacccagtggacttgcgtgttagcggcaaggacctggtccccaaccatctgtcatactacctctataaccacgtagctatgtggcctgagcagtctgacaagtggccaaccgcagtgagggcaaacggccacctgctgttgaactcagagaagatgagtaaatccactggcaactttcttacactgacgcaggccatcgataagttcagcgccgatggtatgcgtctggcactcgcagatgcaggtgacacagtggaagatgctaatttcgtcgaagcaatggcggatgccggcatcctacggctttatacatgggtggagtgggtgaaagagatggtcgccaattgggactccctccggtctggccccgcctcgaccttcaacgatagggttttcgcatctgaattaaatgctgggatcatcaagacagaccagaactatgagaaaatgatgtttaaggaggcactcaaaactggattcttcgagtttcaggcagccaaggacaaataccgggagctcgcggtggagggaatgcacagagagctggtgttcaggttcatcgaggtacaaactttgttactggccccgttctgtccgcatctttgcgagcatatctggactttgctaggaaaacctgacagcatcatgaatgcaagttggcctgtggcaggtccggtgaacgaggtgttgattcacagctctcaatacttaatggaagtgacccatgatctcagactccggctgaagaattacatgatgcctgctaagggaaaaaaaactgataagcagcctctccagaaaccaagccactgcactatctatgtggcgaaaaactaccctccctggcagcacacaactctcagcgtcttgcgaaagcatttcgaagctaataacggaaagctccccgacaacaaggttatagccagtgagctgggaagtatgccagagctgaagaaatatatgaagaaggtgatgccctttgtggctatgatcaaagaaaatttggagaagatgggacctaggatcctcgatcttcagctcgagttcgacgaaaaggctgtacttatggaaaatatcgtttacctaacaaacagcctggaacttgagcacattgaggttaagtttgcaagcgaggccgaagacaagatcagagaagattgctgcccaggtaagccactgaacgtcttccgcattgaacctggagtttctgttagcctggtcaacccccaaccttctaacgggcatttctcaaccaagatcgagatacgacagggtgacaattgtgatagtattatacgtagattgatgaagatgaatcggggtatcaaagatctgagcaaagtaaagctaatgagattcgatgatccactccttgggccgaggcgggtaccggtcctgggtaaggaatacacagagaagaccccaatctccgagcacgcagtattcaacgttgatttgatgtctaaaaagatacatcttacagagaatggaatccgcgtagacattggcgatacaattatctacctggtgcactag

SEQ ID NO: 122209 - DNA, 480 bp, Artificial Sequence
  Description of Artificial Sequence: Synthetic coding sequence
atggccgagaggaaagggaccgccaaggtcgactttttaaaaaaaatcgaaaaggaaatccagcagaagtgggataccgagagggtcttcgaggtaaacgcaagtaacctcgaaaaacagaccagcaagggaaagtattttgttacctttccgtacccctatatgaatggcagactccatctaggacacactttctctctttccaagtgcgagttcgctgtggggtaccagcggctaaagggaaagtgttgtctgttcccattcggactgcattgtacgggtatgccaattaaagcttgcgcagacaagttaaaaagggaaatcgaactgtacggctgtccgccagacttccccgacgaggaagaggaggaagaggaaacatcagttaagacagaagatatcatcatcaaagataaagccaaaggtaagaagagtaaagctgcgaagttggatttgctgaatacttctggcgcgctgtag

SEQ ID NO: 122210 - DNA, 3531 bp, Artificial Sequence
  Description of Artificial Sequence: Synthetic coding sequence
atggctgagaggaagggcaccgccaaggttgatttccttaagaaaattgagaaagagattcagcagaagtgggacactgaaagggtgtttgaagtgaatgcctcgaacctggagaagcaaacttcaaagggaaagtatttcgtcacatttccttacccctatatgaatggacggcttcatttgggacataccttctctttaagtaaatgtgaatttgcggtgggctatcagcggttaaaggggaaatgttgtctctttccctttggacttcactgcactggtatgcctattaaggcgtgcgcagacaaattgaagcgcgaaattgagttatacgggtgcccgccagatttccccgatgaggaagaagaagaggaggagacctccgtcaaaaccgaagatattatcataaaagataaggccaagggaaaaaaatctaaggccgccgctaaggctggctcttctaagtaccaatgggggattatgaagagtctggggcttagtgacgaagaaatcgttaaattctccgaggccgagcattggctagactacttccccccgctggctatccaggacttaaagcgcatgggcctgaaagttgactggaggaggagcttcatcactacagacgttaacccctattacgacagctttgtgcggtggcagtttctgacgctgcgtgaacgcaacaagatcaaatttgggaaacgctatactatatactcccccaaagacgggcagccctgtatggaccacgacaggcaaacaggcgaaggggtgggtccgcaggaatatacactgcttaagttaaaggtgctggagccgtacccttcaaagctgagcgggctcaagggcaaaaacatcttccttgtagccgcaacactgagacctgaaaccatgttcggccagacgaattgttgggtgcgtcccgacatgaagtatatcgggttcgagacagtgaacggtgacatcttcatctgcacccagaaggccgccagaaatatgtcttaccagggctttactaaagacaatggagtcgtgcccgtcgtgaaggaactcatgggcgaagagatcctgggtgccagcctgagtgccccgctgactagttataaggtcatttacgtcctgcccatgctgaccatcaaggaggataaggggactggtgtggtgacgtccgtccccagcgattcacccgatgatatcgccgcactgcgagatctgaagaagaaacaggcactccgggcaaaatatggcatccgcgacgatatggtgttgccatttgagccagtgcccgtgattgaaattcctggattcgggaatctgtccgccgtaactatctgcgacgagttgaaaatccagtcccagaacgatcgggaaaaacttgctgaggccaaggaaaaaatttatctgaagggcttctacgagggcattatgctggtagatgggttcaaaggccaaaaggtacaggatgtgaagaaaaccatccaaaagaaaatgattgatgccggggacgctcttatctacatggaaccggagaaacaagtaatgtctaggtcatccgacgagtgcgtcgttgccctgtgcgatcagtggtatctcgactatggtgaagaaaattggaagaagcagacctcgcagtgcctgaaaaacctggaaacattctgcgaagaaacccggagaaactttgaggccactctaggttggttgcaggagcacgcatgctcccgcacatacgggttgggaacacacttgccctgggatgagcagtggctcattgaatccctgagcgacagcactatctatatggccttttataccgtggcccaccttttacaaggtgggaatctgcacggccaggcagaatctccactgggcatccggcctcagcagatgaccaaagaggtgtgggattacgtgtttttcaaggaggccccttttccaaaaacacaaatcgccaaagagaaattggatcaactgaaacaggagttcgaattttggtatcctgtggacctccgggtctctggtaaggatttagtgccaaatcatttgagctactatttgtacaaccacgtcgctatgtggcccgagcagagtgacaaatggccaactgctgttcgcgccaatggtcacctgttgctaaatagtgagaaaatgtccaagtccacaggtaactttctgacgttgacacaggcaattgataagttctccgccgatggaatgcggcttgctctggccgatgctggggacacagtagaagacgccaactttgttgaagctatggctgacgctggcatcttacggctctatacgtgggtggaatgggtgaaggaaatggtagccaattgggattctcttcgaagcgggccagccagcacgtttaacgacagagtctttgcctctgaattaaatgctggtatcataaaaacagaccagaactacgagaagatgatgttcaaggaggcactgaagacaggcttttttgaattccaggcggcaaaggacaaatacagagaattggccgtggagggtatgcacagagagctcgtctttcggttcattgaagtccagaccctgctgctggcgcccttctgcccgcatctctgcgagcacatctggactctgctgggcaaaccagatagcattatgaacgcctcatggcctgtggctggccctgtgaacgaagtgttaattcactccagccagtatctgatggaggtaacacacgacctgcgcttacgcctcaagaactacatgatgcccgctaagggcaaaaagacagacaaacagccactgcagaaaccgtcccactgcacaatttacgttgccaagaactaccccccttggcagcacaccaccctaagtgtgctccgtaaacacttcgaggctaataacggaaagttacccgataataaggtgatcgcatcggaacttggtagtatgcctgagctgaagaagtacatgaaaaaggttatgcctttcgttgccatgatcaaggaaaacctggagaaaatggggccacggatcctagacctgcagctggagtttgacgaaaaagccgtgctaatggagaacattgtgtacctgacaaactccctggagctggaacacattgaggtcaaatttgcgtcagaggcagaggataagatccgggaagactgttgtcccggcaaacctctcaatgttttccgtatcgaaccaggggtttctgtgagcttggtgaacccccagccatcaaatgggcatttctctaccaaaatagagatccggcaaggggataattgcgactctataattcgccggttaatgaaaatgaacagggggatcaaggatctcagtaaagtaaaacttatgcgattcgacgatccattgttaggccctcggagagtgccagtgcttggcaaggagtacaccgaaaaaactcccattagtgaacacgctgtatttaatgtagacctcatgtctaagaagattcatcttacagaaaatggcattcgggtggatattggggataccatcatttacctcgtgcattag

SEQ ID NO: 122211 - DNA, 3369 bp, Artificial Sequence
  Description of Artificial Sequence: Synthetic coding sequence
atgaatggccgcctacatcttgggcatacatttagcctgagcaaatgcgaatttgctgtgggctatcagagactgaaagggaagtgctgtctttttccattcggcctccattgcactggcatgcctattaaagcgtgcgcagataaattgaagagggagatcgaactctatggctgcccccccgattttcccgatgaagaagaggaagaagaggagacctctgtgaagacggaggatattatcatcaaagacaaggccaagggcaagaaatccaaagccgcagcgaaagccgggtcgagtaagtaccagtggggtataatgaaaagcttagggcttagtgacgaggagattgttaaatttagtgaggccgagcactggctggactatttcccacccctggcgatccaggacctcaaaaggatgggacttaaagtcgattggcgccgttcattcataaccaccgatgtcaacccctattacgactcctttgtcagatggcaattcttgacactgcgggagcggaacaagatcaaatttgggaaacgatacacgatctattctccaaaagacggccagccctgtatggatcatgacaggcagacgggggaaggagtggggccccaagaatatactctgctcaaattgaaggtactggaaccctatccttctaagctgagcggtctcaaaggaaagaacattttcctcgtggccgccaccttacgccctgaaactatgttcgggcagactaattgctgggtgaggcccgacatgaagtatatcggttttgaaacagtaaatggcgacatcttcatttgcacccaaaaagccgctagaaatatgtcctatcaggggttcactaaggataatggagtggtccctgtggtgaaggagctgatgggcgaagaaattctgggggcttccctgtccgcacccctaactagttacaaagttatctatgtcttacccatgctgacaataaaggaagataagggcaccggagtcgtcacctctgttccatcggacagccctgatgatattgctgcactcagagatcttaaaaaaaagcaggccctgcgagcaaagtacgggattagggacgacatggttcttcccttcgagccagtgcccgtgatcgagatccctgggttcggaaacctttccgcagtcactatttgcgacgaattgaagattcagtcgcagaatgatcgcgaaaagctggccgaggcgaaagagaagatttatctaaagggcttttatgagggcatcatgctggtagacgggttcaagggccagaaagtccaggacgtgaaaaagacgattcaaaagaagatgattgatgctggcgatgccctgatctacatggaacctgagaagcaggtgatgtctcgcagctctgatgagtgcgtcgtcgctttgtgcgatcagtggtatctcgactatggcgaggagaactggaagaaacaaactagccagtgtcttaagaatcttgagacattttgcgaggagactcggcgcaattttgaggcaacattgggatggctccaagagcatgcttgtagccggacctatggattaggcactcacctgccctgggacgagcagtggcttatcgaaagcctctcagattcgaccatctacatggccttttacacggtggcccatttgctccaggggggcaacctgcacggccaggccgaaagtcctttagggattagacctcagcagatgaccaaagaggtctgggactatgtgttctttaaggaagccccattcccgaaaactcaaattgcaaaagaaaaacttgatcagctgaagcaggagttcgagttttggtaccccgtcgatctgagggtttcgggcaaagacctggtacctaaccatctctcctattatctgtataatcacgtagctatgtggcctgagcagagtgataaatggcccaccgctgttagggccaacggtcacttgctactgaatagtgaaaaaatgtcaaagagcacaggaaatttcttaacactcactcaggcaatcgataaattttctgccgacggaatgcgactcgctttagcagatgctggcgacacagtggaggatgcaaatttcgttgaagcgatggctgacgccgggatccttaggctttatacctgggttgaatgggtgaaggagatggttgcgaactgggactcactcaggtcagggccagcatccacttttaacgaccgcgtcttcgcctccgagctaaacgccgggataatcaagacagatcagaactatgaaaaaatgatgttcaaagaggccctgaaaaccggttttttcgagttccaggctgccaaggacaagtacagggagttagcagtcgaaggcatgcaccgggagcttgtgttccggtttatcgaagtgcagacgctgttactggcccccttttgtccacatctgtgcgagcatatctggacccttctggggaaacccgactctataatgaatgcttcctggcccgtcgctggccctgtgaatgaagtgttgatccattcatctcagtacctaatggaggtcactcacgacctgagacttcgtctgaaaaattatatgatgccagctaaggggaagaagacagataaacagcctttgcagaaaccaagtcactgtaccatctacgtagcaaaaaattaccctccctggcagcacaccacactgtcagtcctgaggaaacatttcgaggcgaataacggcaagctgcctgacaacaaagttattgcctcggagttagggtccatgccagaactcaagaagtatatgaagaaagtgatgcccttcgttgccatgataaaagagaacctggagaaaatgggacctagaattctggacttgcagctggagttcgatgagaaggccgtgctgatggagaatattgtgtatctcaccaactccttggagctcgaacatatcgaggtgaaatttgcttcagaagcagaagataaaatccgcgaggactgctgtcccgggaagcctcttaatgtctttcgcatcgaaccgggcgtgagcgtatccttggtgaatccacagcctagtaatgggcatttcagcaccaagatcgagatacggcagggcgataattgcgatagcatcatccggcggctgatgaaaatgaaccgaggtattaaggatctgtccaaagtaaagttaatgaggtttgacgacccactgctgggtccacgccgggtgccggtgctggggaaggagtatacggagaaaacccctattagcgagcatgcggtattcaacgtggacctgatgtctaaaaaaatacacctcaccgagaacgggatccgtgtggatattggggataccatcatctacttggtgcattag

SEQ ID NO: 122212 - DNA, 372 bp, Artificial Sequence
  Description of Artificial Sequence: Synthetic coding sequence
atgtggcccgagcagagcgacaagtggccaaccgccgtccgggctaacggacatctgctgctcaactccgaaaagatgtccaaatcaaccgggaattttctcaccctaacacaagccattgacaagttctcagccgatgggatgcggctggccctcgcggacgcgggggacaccgtggaggacgctaattttgtggaagcgatggcagatgcggggattttaaggctgtatacctgggtggaatgggttaaggagatggtcgccaactgggatagtctgaggtctgggcctgctagtaccttcaatgatcgcgtgttcgcgtcagaactcaacgcggggattatcaaaacagatcagactatgaagcggtag

SEQ ID NO: 122213 - DNA, 1458 bp, Artificial Sequence
  Description of Artificial Sequence: Synthetic coding sequence
atgtggcctgagcagagtgataaatggcccaccgcagttcgagcaaatggacatctactcctgaacagtgaaaagatgtccaaaagtactggcaatttccttaccctcactcaggccatagataagttttccgctgatggcatgcgtctggctctcgccgacgctggggacaccgtcgaggacgcgaatttcgtcgaagctatggccgatgccggcatcttgcgcctgtacacatgggtggagtgggtaaaggaaatggttgcaaactgggatagcctgcgcagtggacccgcatccacttttaacgatcgcgtgtttgcaagcgaattaaacgctgggattatcaagaccgatcagaattatgagaaaatgatgttcaaagaagccctgaaaaccggattttttgagttccaagccgctaaggacaagtaccgtgagctggccgttgagggaatgcaccgcgagctggtgtttcggttcatcgaggtgcagaccctgctgttagctccattctgtccccacctttgcgaacacatctggactctcttgggaaagccagatagcatcatgaatgctagttggcccgttgccggaccagtgaatgaagtgctgatccactcctctcagtaccttatggaagttactcatgacctcagactgcggttgaagaattacatgatgccagcaaaaggtaaaaaaaccgataagcagccactgcagaaaccttcccattgcacaatatacgttgcaaaaaattaccctccttggcagcacactactctgtcggtgctgcggaagcactttgaagcaaataacggcaaactcccagacaacaaggtgatcgcaagcgaactggggagcatgcccgagctgaaaaaatacatgaagaaggtgatgccattcgtcgccatgattaaagagaacctcgagaaaatgggtccccgcattctagacctgcagctggagttcgacgagaaagctgttctcatggagaatatagtctacctgactaatagcctcgagctggaacatatcgaagttaaattcgccagcgaggctgaagacaaaatcagggaggactgctgccccggaaaacccctgaatgtctttcggattgagccgggagtcagcgtaagcttagtgaatccgcagccttctaacgggcatttttcaacaaagatcgagattagacaaggcgacaattgcgatagtatcattaggagacttatgaagatgaatagagggatcaaggatctttctaaggttaaacttatgcgctttgatgatccactgctcggcccccgccgagttcccgtcttgggtaaggaatacacagagaaaacccccattagcgaacatgccgtgttcaacgttgacctgatgtccaagaaaatccaccttaccgagaacggcataagagtggatatcggggataccataatctacctggtgcattag

SEQ ID NO: 122214 - DNA, 3393 bp, Artificial Sequence
  Description of Artificial Sequence: Synthetic coding sequence
atggccgagcggaagggcacagcaaaggtggattttcttaagaagatcgagaaggagatccagcagaagtgggacactgaaagagtgttcgaagtaaacgcctctaacctggagaagcagactagcaaggggaaatactttgtgacctttccctacccatatatgaacggtcgtttacatcttggccataccttctcactctccaagtgtgagtttgccgtgggataccagaggctcaaagggaaatgctgcctttttccttttggcctccactgcacaggtatgcccattaagagcaaggccgccgccaaggccgggtcttcaaaataccagtggggcataatgaaaagtctcgggttaagcgacgaggagatagtgaagttttctgaggccgagcattggctcgattattttccgcccctagccattcaggacctgaagcgcatgggcctcaaagtggattggcgccggagcttcatcactactgacgttaatccatattatgattctttcgtgcgttggcagttcctgacactcagggagcggaataaaatcaagttcggaaagcgctataccatttactcccccaaagacggacaaccttgcatggatcacgatcggcagactggggagggggtaggaccccaggaatacacgcttcttaaattaaaggtgcttgagccctacccctccaagctcagtggccttaaggggaagaatattttcttggttgccgccactcttaggcctgagactatgtttggacagacaaattgctgggtgaggccagacatgaaatacatcggctttgaaactgttaacggcgacatcttcatctgtactcaaaaggctgccagaaatatgtcctaccagggctttacgaaagacaacggcgtggtgcctgtggtgaaagaactgatgggggaggaaatcctgggtgcctcactctctgctcccctgacaagctacaaggtgatctatgttctacccatgctgacaattaaagaagataagggcaccggagtggtaacaagcgtgccgtccgacagtccagacgacatcgcggccttacgggacctgaagaagaaacaagcattgcgagccaaatacgggattcgggacgatatggtcttgccgtttgaacccgtgcccgttatagaaataccggggttcgggaacctgagcgcagtgaccatctgcgatgagctaaagatccagtcgcagaatgacagggaaaaattggccgaggccaaggaaaaaatctaccttaagggcttctacgagggcatcatgctggtagatgggttcaagggccagaaggttcaggacgtgaaaaagacaatccaaaaaaaaatgattgacgccggagatgctctgatatatatggaaccagagaagcaggtgatgtctaggagttcagatgagtgtgtggtcgcgctgtgcgatcaatggtacctggattacggagaagagaattggaaaaaacagacctcccagtgtctgaaaaacctggaaactttctgcgaagaaacaaggcggaacttcgaagccactcttggctggcttcaggaacatgcctgctctcgtacgtatggcttaggtacacacctgccttgggacgaacagtggctcatcgagtcgctttccgatagcacaatttatatggcattctatacagttgcccaccttcttcaaggcggaaacttacacggacaggccgaatctccgttgggtattcggccccagcagatgacgaaggaggtctgggactatgtctttttcaaggaggcgcctttcccgaaaacacaaattgcgaaagagaagcttgaccaactgaagcaggagtttgaattttggtaccccgtggatcttcgggtaagtggcaaggatctcgtgcctaaccacttgagttattacctgtacaaccatgtggcgatgtggcccgaacagagcgacaagtggcctaccgcggtccgagcaaatggacacttgcttcttaactcagaaaaaatgtccaaaagtacaggtaattttctgactctaacgcaagccatcgataagttcagtgcagacggaatgaggttagctctcgctgacgctggggataccgttgaggatgctaatttcgtcgaggccatggcggacgccggcatcctgaggctgtatacatgggtggaatgggtgaaggaaatggtggcaaactgggacagcctgcgctcaggccctgcctccacgtttaacgatcgcgtcttcgcatcggagttgaacgcaggtatcattaagactgatcagaactacgaaaaaatgatgtttaaggaggctctgaagacaggattctttgagtttcaggcggccaaagacaaataccgggagctggccgtggaaggaatgcacagggaactggtcttccgatttattgaagttcagacgctcctgttggcacccttctgtcctcacctgtgtgaacatatttggaccctgctcggaaagccggactcaataatgaatgcatcttggccagtggccggcccggtcaacgaagtacttatacattccagtcagtatcttatggaagtgacccacgatctccggttacgcctgaaaaactacatgatgcctgcgaaaggcaagaagacggacaagcagcctttgcagaagccaagtcattgcactatctacgtggctaagaattatcccccttggcagcataccactctgtcagtgctgcgcaaacattttgaggccaacaatgggaaactgcctgacaataaggtaatagcctctgagctgggctctatgcccgaactgaagaagtacatgaagaaggtgatgccctttgtagctatgatcaaggagaatcttgagaaaatgggacccagaattctggatttgcagctggaatttgatgaaaaggcagtgctgatggagaacattgtatacctgactaattcactcgaactcgaacatattgaggtaaagttcgcatccgaagctgaggacaagatccgcgaagattgctgtccagggaaacccctgaacgtgttccgcatagagccgggcgtgtcagtgtctctggtgaatccccagcctagcaacgggcatttctccacaaagatcgagattaggcagggtgacaactgtgattccataattagacgactgatgaagatgaaccgcggtataaaagacctctcaaaagtgaagctgatgcggtttgacgacccgcttctcggcccccggagagtccccgtgctcgggaaggaatataccgagaagacgcccattagcgagcatgcggtttttaatgttgatctaatgagcaagaaaattcacctgactgaaaacgggattagggtggacattggtgataccatcatatatctcgtgcattag

SEQ ID NO: 122215 - DNA, 2712 bp, Artificial Sequence
  Description of Artificial Sequence: Synthetic coding sequence
atggcatccgtgtggcaaagactgggcttttacgcctcactcctgaaaaggcagctgaatggcggtccagatgttattaagtgggaaagaagggttattcccggatgcaccaggtctatctacagcgccactgggaaatggactaaagagtacactctccagactagaaaagatgttgaaaaatggtggcaccagcgcattaaggaacaggcttccaagatctccgaggccgacaaatcaaaacctaagttctacgtccttagcatgtttccctatcccagcgggaagctgcacatggggcacgtgcgcgtgtacacaatttctgataccattgctcgcttccagaagatgcggggcatgcaggtgattaacccaatgggctgggacgccttcggcctgcctgccgagaatgcggctgtggaaaggaacctgcaccctcagagttggacacagagcaatattaaacacatgcgcaaacaacttgatcgcttggggctatgcttcagttgggacagagaaataactacatgcctgcccgactattacaagtggactcaatacctgttcattaaactttacgaggccggtctcgcctatcagaaggaggcgctggtgaactgggatcccgtggaccagactgtccttgccaatgaacaggtggacgagcacggatgctcttggcggagcggagctaaggtcgagcagaagtatttgaggcaatggttcatcaagactacagcatacgccaaggctatgcaggatgccctggccgatctgcccgagtggtatgggattaagggcatgcaagcacactggattggcgattgcgtggggtgtcatctggactttaccttaaaggtgcatggccaggcgacaggggagaaacttactgcttatacggccactcctgaggcaatttacggcacaagccacgtagcgatctctccatcccacaggttgctgcacggtcattccagcctgaaagaggccttgaggatggcgctggttcctggaaaggattgtctgacgcccgtgatggcggtaaatatgctcacgcagcaggaagtccccgtcgtgatcctggccaaagcagaccttgagggttccctggactctaagattgggattccgagcacaagttctgaggacacaatcctagctcagacccttggtctggcatacagcgaagttatcgagacccttcctgacgggaccgaacggctgagctcttccgccgagttcaccggaatgacacgacaggatgctttcttagctctcacgcagaaggctcgaggaaagagagtgggcggcgacgtcactagtgacaaactaaaggattggcttatctcccgccagcgctactgggggactccaattcccattgtccactgtccagtgtgcggaccaactcctgtccctttggaggatcttcccgtgactctgcccaatatagcttccttcaccggcaaaggtggccctcctctggcaatggcaagcgagtgggttaactgctcatgtccgcgctgtaaaggagccgccaaacgtgagacagataccatggataccttcgtggatagtgcttggtactatttccggtacaccgacccacacaacccacactcacctttcaacaccgctgtggccgactattggatgcctgtggatctgtatatcggaggtaaagagcacgcggtgatgcatctgttctacgcccgttttttttcccatttctgccacgaccagaagatggtcaagcatagagagccgttccacaagctcctggcacagggcctgataaaggggcaaacattcaggctaccaagtggacagtacctgcagcgggaggaagtggatctgaccggttcagttccggtgcatgccaaaaccaaagaaaagctggaagtgacctgggaaaagatgagcaaatcaaagcataatggtgtggatcctgaagaagtagttgaacagtatggcatcgataccatccgcttgtacatactgttcgccgccccaccagagaaagatatcctatgggacgtgaagactgatgcgctgccgggcgttctgcggtggcagcagaggctgtggacattgaccacccgattcatcgaagctagagcctctggcaagagcccccaaccccagcttctcagcaacaaagaaaaagctgaggcaaggaaactgtgggaatataagaattccgtaatttctcaggtgacgactcacttcaccgaagacttttctcttaattccgcgatttcacagctcatgggactttcgaatgcactcagtcaggcctcacagtccgtgattctgcacagccccgagtttgaggatgctctgtgtgctctgatggtaatggctgcacctctggccccgcacgtgacctctgaaatatgggctggcctagcattggttccacgaaagctctgcgcccactacacgtgggacgcttctgtcctcctgcaagcttggcctgccgtagaccccgagtttctgcaacagccggaggtcgtgcagatggccgtgcttatcaacaataaagcctgcggtaaaattcccgtgccccaacaggttgcaagagatcaagacaaggtacatgaattcgtgctccagtccgagttaggtgttcggcttctgcagggacggagcatcaaaaaaagttttctgtcaccacggaccgcactcatcaattttctagtgcaggactag

SEQ ID NO: 122216 - DNA, 2583 bp, Artificial Sequence
  Description of Artificial Sequence: Synthetic coding sequence
atggcctccgtgtggcaacgcctggggttttacgccagcctccttaagagacagctaaacggcgggccagatgtgataaagtgggagagacgtgtcatccctggatgtactaggtctatctattcagctactggcaaatggacaaaggagtacaccctccagacccggaaggatgtggagaagtggtggcatcaaagaattaaagagcaggcttcaaaaatatcagaggcggacgtgattaaccccatgggatgggatgcattcggtctgcccgccgaaaacgccgctgtggaaaggaacctccatccccagtcctggacacagagtaatatcaagcacatgagaaaacagctcgatcgtttaggtctgtgcttctcctgggatcgagaaatcactacatgcctgcccgattactacaagtggacacagtacttgttcattaaactgtatgaggccggcttagcttatcagaaggaggctctggtgaactgggatcctgttgaccagaccgtactcgcaaacgagcaggttgatgaacacgggtgctcgtggcgcagtggagccaaggtcgagcagaaatatttgcgccaatggttcatcaagaccactgcatacgcaaaagctatgcaggacgctctggccgatctgcccgaatggtatgggatcaaagggatgcaggcccattggataggggactgcgtagggtgccatctggactttactctgaaggtgcacggccaggcgactggcgagaagctgacggcctacaccgcgacacccgaggctatttacggcacttctcatgtggcaattagccccagccaccgcctccttcatggccacagctcattaaaggaggccctacgcatggccctggtcccaggcaaagactgccttacgccggtgatggcggttaatatgctgactcagcaagaggtgcctgtagtgatcctggccaaggcagaccttgagggatccttggatagtaaaatcggcatcccgtcgacttccagcgaggataccatactagcccagactctcggtctggcatactccgaagttatcgagacactcccagatgggacagaacggttaagttcatccgccgagtttacgggaatgacacgacaagatgccttcttggctctcactcagaaagcccgggggaaacgggtgggcggtgacgtgacaagcgataaactgaaggattggctcatttcccggcagcgctactggggcacacccatccccatcgtgcactgtccagtgtgcgggcccactccagtgcccctggaagatctgccagtgacattgcccaatattgcctcctttacaggtaaaggagggcctcccttggctatggcctctgagtgggttaattgtagttgtccccgctgtaagggcgctgccaaacgagaaacagacacaatggatacctttgttgactcggcctggtactacttccgttacaccgacccacataacccacactcacctttcaatacggccgttgccgattactggatgcccgttgatctatacatcggtggcaaggaacacgcggtgatgcacctgttctacgcccgctttttttcccatttctgccacgaccagaaaatggtcaaacacagagagccttttcataaactgctggcacaggggttgattaagggtcagacattccggctcccgtcagggcagtacctgcagcgtgaggaagttgacctgactggcagcgtgccggttcacgccaaaaccaaggaaaagctcgaggtgacctgggagaagatgagtaaaagcaaacacaacggcgttgacccagaggaggtcgtcgagcagtacgggatcgacaccataaggctttatatcctgttcgcagcccctccggagaaggatatcctatgggatgtcaaaaccgacgcactgcctggcgttctgagatggcagcagcgcctatggaccctgaccacaaggtttatcgaggctcgcgctagtggcaagagtccccaaccccagcttttatcaaataaggaaaaagcagaagctagaaagctgtgggagtataagaatagtgtgatttcccaggtcactacgcactttacagaggacttttctctgaactctgccatttcccagctcatgggcctctccaatgcgctaagccaggcaagccagagcgtgatcttgcatagcccagaattcgaagacgctctctgtgctctgatggttatggccgccccactggcacctcacgtgacaagtgagatctgggccggactggccctggtgccccggaaactgtgtgcgcattacacttgggacgcgagcgtgttgcttcaggcatggcccgccgtggacccagaattcctccagcagccagaagtggtgcagatggccgttctgattaacaataaggcctgtggtaaaattccagtcccccaacaggttgcaagggaccaggataaggtccacgaattcgtgcttcagagcgaactgggggttcggctgctgcagggacgatcaataaaaaagtcattcttgtctcctcgaacagctctgatcaattttctggttcaggactag

SEQ ID NO: 122217 - DNA, 2712 bp, Artificial Sequence
  Description of Artificial Sequence: Synthetic coding sequence
atggcctcagtgtggcaaagactgggcttttacgcctctctgttgaagcgtcagctgaatggaggccccgacgtgattaagtgggagcggcgagtgatccccggctgtactcgaagtatttacagcgccactggtaagtggaccaaagaatacacccttcagacccgtaaagacgtggagaagtggtggcatcagaggatcaaggaacaggcctccaagatctctgaagccgataagagtaaacccaaattctacgtgctttcaatgtttccctacccatccggcaaactgcacatggggcacgttcgcgtttacaccatctccgatactattgcacgatttcaaaagatgcgcggcatgcaggtgattaacccaatggggtgggacgcttttggccttcccgccgaaaatgctgccgtggaacggaacctgcacccacagagttggacccagtctaacattaaacatatgcggaaacagttggatcgcctcggcctgtgtttttcctgggacagggagataactacttgtctgcctgattattataagtggacgcagtacctctttattaaactgtacgaggcagggttagcctatcagaaggaagccctggtgaactgggatccggtggaccagactgtgctggccaatgaacaggtggatgaacacggttgctcctggcggtcaggcgcaaaggtggaacaaaagtacttaaggcagtggtttataaagactacagcctacgccaaagccatgcaggacgccttggctgacctgccagagtggtacgggataaagggcatgcaggcccattggatcggcgactgcgtggggtgccatctggatttcaccttaaaggtacacggtcaagcaaccggtgaaaagctgactgcatatactgctacccctgaggcaatttacggcacctcccatgtggccatctctccaagtcaccggctactccatggccattcaagcctaaaggaggcactccgtatggcgctcgtgcctgggaaagactgtcttacgcctgtcatggctgtgaacatgctaacccagcaggaggtccctgtggtgatcctggctaaagcagacctcgagggatccttagacagcaagatcggcataccttctaccagtagcgaggacacaattctggcccaaaccctgggactcgcctattcggaagtgatcgaaactctgccagacggtaccgagagactcagctcttccgcggagtttactgggatgacccgccaggacgctttcctggcgctgacacagaaggcgcggggcaaacgagtgggaggcgatgttacttccgataagctgaaggattggctaatttctcggcaacggtactggggtacacctatacctatcgtgcattgcccagtctgcggtcccacccccgtacccctcgaagaccttccagtgacactgccaaacattgccagtttcaccgggaaaggaggtcccccactggcaatggcaagcgaatgggtgaactgcagttgtccccgatgcaaaggggcggcaaagagagaaaccgacactatggacacatttgttgattcggcatggtattattttcggtacacggaccctcacaaccctcattctccctttaataccgcggtggccgactactggatgccagtggacctttacatcggaggtaaagagcatgcggtgatgcatcttttttacgccagattttttagccacttttgccacgatcaaaaaatggtcaagcatcgtgagccttttcacaagttgttggctcaggggctgattaaagggcagacctttaggctgcctagtggacaataccttcaacgggaagaggtggatcttacaggctcagtccccgtccacgctaagactaaggagaagctagaagtgacgtgggaaaaaatgtccaaatccaaacataatggggtcgatcccgaagaggtagtggagcaatatggtatcgacaccatcagactatatatcctgttcgccgcgcccccagagaaggacattctttgggacgtgaagaccgatgcccttcctggcgtgctgaggtggcagcaacggctgtggacactaactactcggttcatcgaagcacgcgcatcagggaagtcacctcagccacagcttttgagtaataaagagaaggctgaggcgcgaaagctgtgggagtataaaaacagtgttatcagtcaggtcacaacccactttactgaagactttagtcttaatagtgcgatctcccaactgatggggttgagtaacgcgctgtctcaggcctctcaaagtgttattttacactctcccgagtttgaggacgccctatgtgccttgatggtaatggccgctcctttggccccccatgttacttctgagatttgggcagggctggccctcgttccaagaaaactctgcgcccactatacttgggacgccagtgtgctcctccaggcttggcccgcggtggatccggaatttctgcagcagccagaagttgtacaaatggccgtgctcattaataacaaggcttgcggtaagatccctgtgccacagcaagttgctcgagaccaagacaaggtccatgaattcgttctccagtccgagctaggtgtgcggctcctgcagggccgctcaatcaaaaaatcctttctatctccccggacagccctgattaattttttagtgcaggactag

SEQ ID NO: 122218 - DNA, 345 bp, Artificial Sequence
  Description of Artificial Sequence: Synthetic coding sequence
atggccagtgtgtggcagcggcttgggttttatgcctcactgcttaaacgtcaactcaatggcggacctgatgtcataaagtgggagaggcgggtgatcccagggtgtactagatcaatctactcagccaccggcaaatggacgaaagagtacaccctgcagactcgtaaagacgtagagaaatggtggcaccaacgtatcaaggaacaggcctccaagatttccgaggcggataagtcaaagcctaagttctatgtcctgagcatgttcccgtacccaagcggaaaactccacatgggtcacgtgagggtgtatacaatctcggacactattgcgagattttag

SEQ ID NO: 122219 - DNA, 609 bp, Artificial Sequence
  Description of Artificial Sequence: Synthetic coding sequence
atgaaagttctggctgccggtgtcgtccccctcctgctcgtgctgcactggaaacatggagcaggatcccctctacctataacccccgtgaatgcgacatgcgcaataaggcacccctgccacaacaacctgatgaatcagattcgcagtcagctcgcacagctgaatggtagtgcaaatgcactctttatcctgtattacaccgctcagggcgagccttttccgaataatctggacaagttatgtggccctaacgtgacggatttcccgccctttcatgccaacggtacggagaaagccaagctcgtggaactgtaccggatagtcgtctacctggggactagcttggggaacatcactagggaccaaaaaatactgaacccctccgcactgtcactacactctaagttgaatgctaccgccgacattttacgcgggctgttaagcaacgtgctttgtaggttatgtagtaagtaccacgtgggtcacgtcgatgtaacttatggccccgatacatctggcaaggacgtatttcagaagaagaagctgggctgtcagctgctgggaaaatataaacagataatagcggtcttggcgcaagctttctag

SEQ ID NO: 122220 - DNA, 3294 bp, Artificial Sequence
  Description of Artificial Sequence: Synthetic coding sequence
atgatggatatctatgtgtgtctgaaacgccctagttggatggtcgacaataaacgaatgaggactgccagcaacttccagtggctgctgtcaactttcattctgttgtacttaatgaatcaagtgaatagccagaagaaaggcgccccacacgatctgaagtgcgtcacgaataacctgcaggtgtggaactgctcttggaaggcaccatctggcactggtaggggtactgactacgaggtgtgtattgagaatcggtctagaagctgttaccagctggagaagacttctatcaaaatccctgccttaagtcacggtgattacgagatcacgattaattcgctgcatgactttggcagttcgacaagcaagttcaccctaaacgaacagaatgttagcttgattcccgatacccctgagatcttaaacttaagcgccgacttttcgaccagtaccctgtatcttaaatggaacgaccgaggatctgtctttcctcaccgcagcaacgtaatatgggagataaaggtgctgagaaaggaaagcatggagctcgtgaagctcgttacacataataccaccctcaatggcaaggacaccctgcatcattggtcttgggcaagtgatatgcctctggagtgcgctatccatttcgttgagataaggtgctatattgataatctccattttagcgggctagaggagtggagcgactggagccctgtgaagaatatctcctggatccctgattcccagaccaaagtgtttccgcaagataaagtcattctcgtcggctcagatatcacattttgctgtgtgtcccaagagaaagtactgagcgctctgataggacatacaaattgtccactgattcatctcgacggggaaaatgtggcaatcaagataagaaatataagtgtttctgcgtcttctggcaccaatgtggtctttaccacagaggataatatcttcggtacggtgattttcgcaggctacccacctgacacaccccaacagttgaactgtgaaactcacgacctgaaggagatcatctgtagttggaaccccgggagggttacagcactggtcggacctcgcgcgacctcatataccttggtcgaaagtttctccgggaaatacgtgcgactgaaaagagctgaagctcctactaacgagtcataccagctattatttcagatgcttcccaatcaggagatttataactttaccttaaatgcccataatcctctgggtagatcacagagtacaattttggtgaatatcacagagaaagtgtaccctcacacccccacaagttttaaagtgaaggatattaactccacagccgtcaaactgagctggcacctccccggaaattttgccaaaataaatttcctgtgtgaaatcgaaatcaaaaaatccaatagcgttcaagaacaacgaaacgttacgataaagggcgtagaaaacagttcctatctggtggcactagacaagctgaacccttatactctttacacctttagaatccggtgcagcacggagaccttttggaagtggtctaagtggtccaacaaaaaacagcacctcactacggaggcctcaccaagtaaaggccctgatacgtggcgcgaatggtcgagcgacggaaaaaacctgattatttactggaagcccctcccaattaacgaggcaaacgggaaaatcctgagctataatgtgagctgttccagcgacgaagaaacacagtccctatccgagatcccagacccacagcacaaagctgaaattcgactggataagaacgactacatcatcagcgttgtcgctaaaaactccgtgggctcatcccctcctagcaagatcgcctcaatggagatccccaacgatgacctgaagatcgagcaggtggttggcatgggaaaaggaatcctgctgacatggcactatgacccgaacatgacctgcgactacgtaatcaagtggtgcaacagttccaggtccgaaccgtgtttaatggactggcgcaaggtgccgtccaacagtacggagaccgtcatcgaatctgacgaatttcgccccggcataaggtacaacttttttctgtatggctgccggaaccagggttatcaacttctcaggtctatgatcggctacattgaggagctggcaccgatagtagctcctaattttaccgtcgaggatacttccgctgacagtatactggttaagtgggaggatatacctgtagaagaacttaggggattcttgcggggctaccttttttactttgggaaaggcgagcgcgatacaagcaaaatgagagtgctggaaagtgggaggtcggacatcaaagtgaaaaacataacagatatttctcagaagacacttcgtatcgcggatctacaaggcaaaacatcgtatcatctggttctgagagcttatactgatggtggtgtcggccccgagaagtcgatgtacgtggtgacaaaagagaatagtgtggggctaatcattgccatactgatccctgtggccgtggcagtgatcgttggcgtcgttaccagtattctgtgctacagaaaaagggaatggattaaggaaacattctaccctgatatccccaaccctgaaaattgcaaggctcttcagttccagaagagtgtgtgcgagggatctagcgccctgaagaccttggagatgaacccctgcaccccaaataacgtcgaggttttagaaacccgaagcgccttccctaagatcgaggacactgagattatcagccctgtcgcagagaggccagaggacaggtccgacgccgagcccgaaaatcacgtcgtggtgagctattgcccaccaattatagaagaggagatccccaatcctgctgccgatgaggcaggcggaactgcacaggtgatttacatcgacgtccaaagtatgtatcagcctcaggcaaaacccgaagaggagcaagagaacgatcctgtgggcggcgctggctacaaacctcagatgcacctccccatcaactctaccgtggaggatatcgccgcggaagaggacctggacaagaccgctggctatcgtccacaggccaacgttaatacttggaacctggtaagccctgactcccctcgcagcattgatagcaatagcgaaattgtgtctttcggatctccgtgctccattaactccaggcaatttctcattcctcccaaggacgaggattcgcctaagagtaatggcggcgggtggagcttcactaacttcttccagaacaagcctaacgattag

SEQ ID NO: 122221 - DNA, 3294 bp, Artificial Sequence
  Description of Artificial Sequence: Synthetic coding sequence
atgatggacatctacgtgtgcctcaaaaggcccagctggatggtggacaataaaaggatgagaacagcctcaaatttccaatggctcctgtcgacattcattcttctgtacctgatgaaccaggttaacagtcagaaaaagggcgccccgcatgacctgaagtgtgtcaccaacaacttacaggtgtggaattgttcctggaaggccccgagcgggacgggacggggaaccgattacgaggtgtgcattgagaacaggagcagatcatgttaccagctcgaaaagaccagtataaagattccggccctgagccatggagattatgagataacgatcaatagccttcatgatttcggctcctccacgagtaagttcactctaaatgagcaaaacgtttccctgatccctgacacccctgagatcctgaacttatcggccgatttctctacctccacactgtacctcaaatggaatgacaggggcagtgtgttcccccacagatctaacgtcatctgggagattaaggttctgaggaaggaaagcatggagctggtgaaactggtcactcacaatacaactctaaacggtaaggataccttgcatcactggagctgggctagcgatatgcccttggaatgtgccatccattttgttgaaatccggtgttatatcgacaatctgcattttagcggtctcgaagagtggtctgattggtcccccgtgaagaacatatcatggataccagactcccagacaaaggtctttccccaggacaaagtgatactggtcggaagcgatatcaccttctgctgcgtgagccaggaaaaggttctctctgccctcattggccacaccaactgcccactcatacacctagacggagaaaacgtggccatcaaaattcgaaacatatccgtcagtgcttcctccgggaccaacgtcgttttcacgacagaagacaatatcttcggcacagtcatctttgctggttacccacctgacacaccccaacagctcaactgtgagactcatgacctcaaagagatcatttgcagctggaatcctggacgagtaactgctttggtcgggccccgggcaacgtcatatacacttgttgagtcattctctggcaaatatgtgcgactgaagagggccgaggcgccgaccaacgagtcctaccagttactgttccagatgctccccaatcaggagatctacaattttaccttaaacgcccacaaccccctgggaagatcccagtccaccattctggtgaacattacagagaaggtgtacccgcatacccctacctccttcaaggtgaaagacatcaattccaccgccgtcaagctcagctggcatttacccggcaattttgccaagattaactttttgtgtgagatcgaaataaaaaagagcaacagtgttcaggagcagaggaatgtgacaatcaaaggcgtcgaaaatagcagttacctcgtggcattggataagttgaacccatataccttgtatacctttagaatcagatgttctactgagaccttctggaagtggtctaagtggtcaaataaaaaacaacacttgacaaccgaagccagccccagcaagggaccagacacttggcgggagtggtcttccgatgggaaaaacctaattatttactggaagcccctgcctattaatgaagccaatggaaagattctttcttacaatgtcagttgctcgtctgacgaggaaactcaaagcttatccgaaatccccgatccacagcacaaggctgaaatacgcttagataagaatgactatataatttctgtcgttgctaaaaattctgtcggatcctctcccccctccaagatagccagcatggaaattccaaacgatgacttaaagattgagcaggtcgttggtatgggtaaaggtattctgctgacctggcactatgatccaaatatgacttgcgattacgtaatcaagtggtgtaactcctctcgatcagaaccatgtctgatggactggcgcaaagttcctagcaattcgacagaaaccgtaattgagagtgacgagtttcgaccagggatccgctataatttcttcttatacggctgtcgaaaccagggataccaactgctgcgttccatgatcggatacattgaagagttagcccccatagtcgcacccaatttcactgtggaggatacatctgccgacagcatcttggtgaaatgggaggacatccccgtagaagaactccgcggcttcctccgcggctatttattctactttggcaaaggggaacgggacacctctaagatgcgggttctcgaaagcgggcgctctgacataaaagttaagaatataacagacatcagccaaaaaaccctgcgaattgctgatctgcagggaaaaacctcctaccacctagtccttcgcgcatatacagacgggggagttggccccgaaaaatccatgtatgtagtgaccaaggagaactctgtcggcctgatcatagccatcctgatccctgtcgcagtggccgtgatcgttggagttgtgacttctatcttatgttatcgcaagcgcgaatggatcaaggaaacgttttaccccgatattcctaacccagagaactgtaaggcactccaatttcagaagagcgtgtgtgagggatcttccgctttgaagaccctggagatgaatccctgtacacctaacaacgtggaagtgcttgaaacgaggagtgcctttccaaaaatcgaagatactgaaatcatttcccccgtggcagagcggccagaagataggtctgatgcagaaccagaaaaccatgtggtggtgtcctattgcccacccatcatcgaggaggagatcccaaatcctgccgcagacgaggctgggggaactgctcaggtcatttatatagatgtgcagtcaatgtaccaaccacaagcaaagcctgaagaggagcaagaaaacgatcccgttgggggcgccggttacaagccccagatgcacctgcctattaatagcactgtcgaagacatcgccgcagaggaggatctcgacaaaaccgctgggtatcgaccccaggcaaatgttaacacatggaacctggtttctcccgactcaccccggtctatcgactccaatagcgagatagtaagcttcggaagcccttgcagcattaattctcgacaattcctgatccctccaaaggatgaagactcccccaagagcaatggtggcgggtggagctttaccaacttttttcagaacaagcctaacgactag

SEQ ID NO: 122222 - DNA, 381 bp, Artificial Sequence
  Description of Artificial Sequence: Synthetic coding sequence
atgatggatatctatgtgtgtctcaagagacctagctggatggtcgacaataagcggatgcgaactgcctccaactttcagtggctcctttcgacgttcattctgctctacttgatgaaccaggtgaattctcagaaaaagggagcccctcatgacttgaagtgtgtcacaaataaccttcaagtttggaattgtagttggaaagcacccagcgggacgggccgcggaactgactatgaggtctgcatcgaaaaccggtcccggagttgctatcagctggaaaagacttccataaagattccggccctgagccacggggactatgagattaccattaacagtctgcatgattttggatcttccacttccaaattcacctag

SEQ ID NO: 122223 - DNA, 228 bp, Artificial Sequence
  Description of Artificial Sequence: Synthetic coding sequence
atgatggacatctacgtgtgcctaaaacgacctagttggatggtggacaacaagagaatgcgcactgcctctaactttcaatggttgctctccacatttatccttttgtatctgatgaatcaggttaactctcagaagaagggagcgcctcatgatcttaaatgcgtgactaacaacctccaggtatggaattgttcatggaaagccccttctggtaccggccgatag

SEQ ID NO: 122224 - DNA, 456 bp, Artificial Sequence
  Description of Artificial Sequence: Synthetic coding sequence
atgttttcgacgaaagcgctactgctggccggattgatctcaacagctctggctggtccttgggccaacatttgcgccggtaaatcttcaaatgagattcgaacatgtgacaggcacggatgtggacagtactccgcccagcgtagccagaggcctcatcagggagtggatatcctttgttctgcaggaagcacagtatatgccccttttaccggtatgatcgtgggccaggagaagccttatcagaacaaaaacgctatcaacaacggtgttagaatcagtgggcgtgggttctgtgttaaaatgttctatatcaaacccatcaagtataaaggaccgataaaaaagggagagaagcttggtacactgctccctcttcagaaagtttacccagggatccagagccatgtgcatattgagaactgcgactcctctgaccctacagcttacttgtag

SEQ ID NO: 122225 - DNA, 1128 bp, Artificial Sequence
  Description of Artificial Sequence: Synthetic coding sequence
atgactccaatactgactgtgctgatctgtctgggcctgtcactggaccctaggacccacgtccaggccggtccacttcctaaaccaacgttgtgggcagagcccggctcagtgattacacaaggctctccggtaacattacgatgccaagggtccctggaaacccaggagtaccacctataccgtgaaaaaaagaccgctttgtggattacccgtatcccgcaggaactggtaaagaagggccagtttcctatcctcagtattacttgggaacacgctggcaggtactgttgcatttacggatctcataccgctgggctaagtgagtcgagtgacccactcgagcttgttgtcaccggtgcatattcaaagcccaccctatctgccttacccagcccagtggtcacctcaggcgggaatgtgactatccaatgtgatagccaagtggccttcgatgggtttatcctgtgcgttagcaaaaaacctagcctgagcgttcaaccgggcccggtggtggcacctggggagaagctgacatttcagtgtggttcagacgcaggttatgacagatttgtcttgtataaggaatggggaagagattttttgcagcggcccgggcgccaacctcaggctgggctgagccaggcaaattttactcttggccccgtgtcaagaagctacggcggccaatacacatgttcaggtgcctacaatctgtcttcagaatggagcgccccctcagaccccttagatatcctgattacaggacagatacgggcaagaccgttcctgtcagtacgaccagggccaaccgtcgcaagcggagaaaacgtgacactgctatgccagagccaaggcgggatgcatacatttctcctgactaaggagggggctgctgattctcccctgagattaaagtctaagcgacagagccacaagtatcaagccgagttccctatgtctccggttacttctgcacacgctgggacatataggtgttacggttctttgtcaagcaatccctacttattgacacacccatcagatcccctggaacttgttgtgtcaggagcagcagagacactcagcccaccacaaaataaatccgatagtaaggccggggagtag

SEQ ID NO: 122226 - DNA, 1956 bp, Artificial Sequence
  Description of Artificial Sequence: Synthetic coding sequence
atgacaccaatcttaacagtgctgatatgccttggtcttagcctaggaccccgaactcacgtgcaggcaggtcatttgcccaaaccaaccctgtgggccgaaccaggaagtgtgattacacaaggatctcccgtaacattacggtgccagggcggacaagaaacacaggagtacaggttgtaccgggaaaaaaagacggccctgtggattacgagaatcccccaggaactggtaaagaaaggccagtttcccattccaagcattacttgggaacacgctgggagatatcggtgttactatggaagtgatacagctgggcgaagcgagagtagcgatcccctggagctggtagtcacaggtgcctatatcaagccaactttaagtgctcagccatctcccgtggtaaattcaggtggaaatgtgattctccaatgtgattcacaggttgctttcgacggttttagcctttgcaaggagggagaggatgaacatccccagtgcctgaatagccagccccatgctcggggctcttcaagagccattttttccgtgggaccagttagccctagccggcgctggtggtatcgatgttacgcatacgattccaactcgccttatgagtggagcctgccgtccgacctcctggagcttctggtgctcggcgtaagcaaaaaaccatcattgtccgtacaacccgggcccatcgttgcccccgaagagactctgactctgcagtgcggatccgacgctgggtataatagattcgtcctgtacaaagatggcgagcgggatttccttcaactggcaggcgctcagccccaggccggcttgtcgcaggccaactttaccctgggaccggtcagtagatcttatggcggccaatataggtgctatggcgcgcacaacctcagctcagagtggagcgctccttcagaccccttggacattctgatcgccggccagttctacgatcgagtgtctctaagcgtgcaacctgggccaaccgtcgcctcaggggaaaatgtcacacttctatgccagagccaaggctggatgcagactttcctgttgacaaaagagggtgccgctgacgatccttggagacttcgatcaacttatcagagccaaaaatatcaagcggagtttccaatgggacccgtgaccagcgcccatgccgggacatatagatgctatggatcccagtcctcgaagccctatctgctgacgcacccttcagatccgctcgagctggtcgtgagcgggcccagcggcggaccaagctcacctaccactggccctactagtacatccgcaggacctgaggaccaacctttaacgcccactggttctgaccctcagtccggccttgggcggcacctcggggtggtgattggaatactcgttgcagtgatcctgctactgctgttgctcctgctgcttttcttgattctcaggcaccgccgccaaggcaagcactggacaagcacacagaggaaagctgactttcaacaccccgccggcgccgtcggacctgagcctacggatcgcggattgcagtggcgatcctcgcccgctgccgacgcccaggaagaaaacctttacgccgccgttaaacacactcaaccagaggatggagtggagatggatacgcgcagcccacacgatgaggatccacaggcggttacatatgctgaggtgaagcattccagaccgagaagggagatggcctcgcccccttcccctctctctggcgagttcctagacaccaaggacaggcaagctgaagaagatcgccaaatggacaccgaagccgccgccagcgaagccccccaggacgtgacctatgcccaactgcacagtctgacactgcgccgtgaagccaccgagcccccaccgagtcaggaagggccctcaccagctgtcccttcaatttatgccaccttagccattcactag

SEQ ID NO: 122227 - DNA, 1956 bp, Artificial Sequence
  Description of Artificial Sequence: Synthetic coding sequence
atgacacccattctcacagtgctgatttgcctcggcctctccctgggtcccaggactcacgtgcaggctgggcacttgcccaagcctaccctgtgggccgagccaggtagtgtgatcacccagggatctcctgtgactcttcgttgtcagggaggccaggagacccaagagtaccgtctgtatcgcgaaaagaagacagcattgtggattacacggattccacaagaactcgtgaagaagggtcagtttccgattccttcaattacgtgggaacatgctggacgctaccggtgctattacggctctgataccgctggtcgtagtgaatcctcagatccacttgagctggtggtgaccggggcttatataaagcccactttgagtgctcagccctccccagtggtgaactcaggggggaacgtcatactccagtgtgactcccaggtggcttttgatgggtttagtctgtgcaaggagggagaggatgagcacccccagtgtcttaattctcaaccacacgcaaggggcagcagccgggccatcttttctgtgggtcctgtgagcccaagtcggcgctggtggtataggtgttatgcctatgattccaatagcccatacgagtggagtctgcccagcgatctcctggaactgctggtgttaggcgtgtctaagaaacctagtctgtctgtccaacctggcccaattgtggcaccggaagaaacactaaccttgcaatgcggctcggacgcagggtacaaccggtttgtcttatataaggacggagaacgcgactttctgcaacttgccggcgcccagccccaggcaggtctgagccaggccaacttcacacttggcccagtttcaaggagctatggaggccagtaccgatgctatggagcccataacctgtcctccgagtggagtgcccccagcgacccgctcgacattctcattgctggacagttctatgacagagtgagcctgtcagtacagcccggcccgaccgtggcttcaggcgaaaatgtgactctattatgtcagagtcagggatggatgcaaacgttcttactgacgaaagagggcgccgcagatgatccttggcggttgcggtccacctatcagagtcagaaataccaggccgagtttcctatgggcccagtgacctccgctcacgctgggacctatcgctgctatggctcccagagtagcaaaccctatttgctaacacaccccagcgaccccttggaactcgtagtgtccggcccatctgggggacccagctcgcctacaaccggacccacctcaacaagcggaccggaggatcaaccgctgacaccaacaggaagtgaccctcagtccggtctcgggcgccatctgggggtggttataggtatacttgtcgccgtgatcctgctgctcctacttcttctgctcttgtttctgatcttgaggcaccggaggcagggtaaacattggacttccacacaacgcaaagctgatttccagcacccagccggagccgttgggcccgagcctaccgacagagggctccagtggaggtcttcacctgctgccgacgcacaagaggaaaatctatatgccgctgtgaagcatactcaacctgaagacggggtggagatggatacaaggcagagcccacatgatgaggatccccaggccgtcacctacgccgaagtaaaacatagtcggccgaggagagagatggcttctcctcccagtcctttaagtggggaattcctggatactaaagatcggcaggccgaggaagatcgtcagatggatacagaggctgccgctagcgaggcgccccaggatgttacatacgcgcagttacattcattgacgctgcgccgcgaggctaccgagccaccaccatcccaagagggacccagcccagctgtcccaagcatctacgccactctggccatacattag

SEQ ID NO: 122228 - DNA, 1794 bp, Artificial Sequence
  Description of Artificial Sequence: Synthetic coding sequence
atgactcccatcgtgaccgtcttgatctgccttggattgtcgttaggtccacgcactcatgttcagactggaacaatccccaagcctaccctgtgggccgaaccggactctgtcattactcaaggcagccctgtgaccctcagctgccaaggaagcctcgaagctcaggagtataggctgtatcgagagaagaagagtgcctcctggattacgagaattcgtccggaacttgtgaaaaacggccaattccacatcccgtccattacttgggaacataccggccgttacggctgccagtactatagcagagcaaggtggtctgagttatctgaccccctggtccttgtgatgaccggcgcgtatccaaagcctaccctgagcgctcagccgagcccagttgtgaccagtggcggacgagtgactttgcaatgtgagtctcaggtcgccttcggaggctttattctctgtaaggaaggagaggaggagcacccacagtgcttaaatagccagccgcatgcgcggggatcttctagggctattttctctgtaggtcctgtgtcccctaatcgcaggtggtcccaccgatgctacggttacgatctgaacagtccctacgtttggtcaagtccctcagaccttctggagttactggtgcccggtgtgtcgaagaaacccagtctgagtgtacagcccggacccgtagtggctccaggagagtctctgacgctgcaatgcgtgtctgacgtgggatacgacaggttcgtgctttataaggaaggcgaaagagatctccgacagcttcccgggaggcagccccaggctggcctgtcccaagccaactttacgcttggacctgtgtccagaagctatggcggtcaataccggtgctacggagcgcacaacctgagctcagaatgtagtgccccttcggatcctctggatattctcattaccgggcagattcgaggcactccatttatatcagtgcagcccgggccaaccgtagccagtggtgagaatgtgaccctgctgtgtcagagctggcgtcaattccacaccttcttgctgactaaggcaggtgccgctgacgcacctctgcgtctgcgcagcattcacgagtacccaaagtaccaggctgagtttccgatgtcccctgtgacatcggcacacgctggtacctaccgatgttatggaagtttgaatagcgacccgtatctccttagccatccatcagaaccgttggaacttgtcgtgtctggcccatcaatggggtcctccccacccccaacgggtcccatatctacgcccggtccagaagaccagcccctgactcccacaggttctgaccctcaaagcggcctcggccgacacttgggcgtcgtaatcggaatactggtcgccgtggtgctgctattgctcctactgctgcttctgtttctgatcctgcggcatagacgacagggcaaacactggacgtcgactcaaagaaaggcggatttccagcaccccgccggagccgtgggacctgaaccaactgatcggggcctccagtggagaagcagtcccgccgccgacgctcaggaggaaaacttgtacgcggcagttaaggatacccagcccgaggacggagttgaaatggatacccgcgccgctgcatcagaggccccgcaagatgtgacttacgctcagttacattctctgacattgcgtcgtaaggctaccgagcctcccccatctcaggaaagagagccccccgcggagccaagcatatatgcaactctggctatacactag

SEQ ID NO: 122229 - DNA, 1899 bp, Artificial Sequence
  Description of Artificial Sequence: Synthetic coding sequence
atgacaccggcacttacagcactcctgtgtctcggcctttctttgggaccccgcacacgcgtgcaggccggaccttttcccaagcctaccttatgggccgaacccggctccgtgatctcatggggctcaccggttacaatttggtgccaaggatcccaggaggctcaagaatacaggctgcacaaagagggatcacccgaacctttggaccgcaacaacccactggagccaaagaataaggcacgcttttccatcccctcgatgaccgagcaccatgcaggaaggtataggtgccactactactcttccgccggatggtccgaaccaagcgatcctctggagatggtcatgactggcgcctattctaaaccaacccttagtgccctgccttctccagtggtggcatctggcggaaacatgactctccggtgtggttctcagaagggctaccaccactttgtgctaatgaaggagggcgagcaccaacttccacggaccttggattcccaacaactgcactctcggggatttcaagctttgttcccagtaggccccgtgacaccttcacaccgttggcgctttacatgctactactattatactaataccccctgggtatggtcccacccctctgaccccttagagatcctgccatctggggtatccagaaagccatctctgctgactttacagggtcctgtgttggcgccaggccaatcactcactttacagtgcggctctgatgtgggctataaccggtttgtgctttacaaggagggtgagagggatttcctccaacggcccggacaacagccccaagcgggtctatcacaagctaattttactctcgggcccgtgagtccatccaacgggggtcaatataggtgctacggcgctcataacctgagtagcgagtggtcagccccatctgatcctctgaatatcttgatggccggccagatctacgataccgtttctttgtcagcgcagcccggccccacagttgcctcgggcgagaacgtaaccctgttgtgtcagtcttggtggcagttcgacacattcctattgacaaaagagggcgccgcgcatcctcccctgcgcctcaggagcatgtacggagctcataagtatcaggccgaattccccatgtccccggtcacctccgctcacgctgggacgtacagatgctatggaagttactccagcaacccacatttgctcagccatccttcagagcccctggagctggttgtgtctgggcacagcggaggctcgtccctgccaccgacaggtccaccaagtacgccaggtctggggcgctaccttgaggtcttgattggcgtgagtgttgctttcgtgttactgctcttcctgctgctctttctgttgttgagaagacagcgccattcaaaacatcgaacatcggatcagcgcaagacagacttccagcgccctgctggggctgcagaaaccgaacctaaggaccggggactgctccggcggtccagccccgctgctgacgtgcaggaagagaatctctatgccgccgtaaaggacactcagagcgaggacagagtggaacttgactcccagcagagcccccacgatgaggaccctcaggcggtgacatatgcccccgtgaagcactcctccccccggcgtgaaatggcaagccccccaagttcactctcgggagagtttctggacaccaaggaccgacaggtcgaagaggaccggcagatggacaccgaagccgcagctagtgaagcctcacaggacgtgacctatgcccaactgcattcattaactctaaggcgcaaggcaacagaaccccccccgtcccaagaaggcgaacctccggccgagccgagcatctacgcaactttggctatccattag

SEQ ID NO: 122230 - DNA, 1344 bp, Artificial Sequence
  Description of Artificial Sequence: Synthetic coding sequence
atgatccccaccttcacggctctcctgtgcctaggcctttctctgggacctaggacacacatgcaggcaggccctctgccgaagccaaccctgtgggccgaacccggctccgtgatcagctggggaaactccgtcactatctggtgccagggtacactggaagcaagagagtaccgcctggacaaggaagagtcacccgctccttgggaccgacagaaccccctggaaccaaaaaacaaagcccggttcagtatcccgagcatgacagaagattacgccggaaggtatcggtgttattacagatccccagtaggctggtcgcaaccatccgaccccctggagttagtgatgaccggcgcctattcaaagccaactttgtccgctttaccttctcctctggtaacgtcgggaaaaagcgttaccctcctgtgtcagtcacgaagtccaatggacaccttcctgttgatcaaggaacgtgcagctcatcctctgttgcacttgcgcagcgaacacggggcgcagcagcaccaggcagagtttccgatgtccccagtgacctccgttcatggggggacatacaggtgctttagttctcatggcttctctcactacttgttatctcatccgagtgacccactggaactgatcgtatcagggtcactggaggatcctcggccatctcccacacgtagcgtaagcactgccgcaggtccagaggaccaacctctaatgccgacgggtagcgtgcctcattccggactgaggcggcactgggaagtgctgatcggggttctggtggtatccattttgctcctgtccctccttctgtttctgctgcttcaacattggaggcagggaaagcaccggaccctggcccagaggcaagcggatttccagaggcctccaggggctgcagagcctgagccgaaagatggcggcttgcagcgtagaagctcgcccgccgccgacgttcagggcgagaatttttgtgccgctgtaaagaacactcagcccgaagatggagtggagatggacacgcggtcgccccacgatgaagatcctcaggccgttacttacgcgaaggtgaaacacagtaggccaaggcgcgagatggcctcaccgccaagccccttgtccggggagtttctggacacaaaagataggcaggcagaggaagatcgtcagatggacactgaagctgctgcttccgaagctccacaggacgtgacttatgcacaattgcattcatttactctgaggcagaaagctactgaaccgccaccaagtcaggaaggagcttcacctgcagaacccagtgtgtacgctacccttgccatccactag

SEQ ID NO: 122231 - DNA, 1476 bp, Artificial Sequence
  Description of Artificial Sequence: Synthetic coding sequence
atgaccctcaccctgtccgttcttatatgcctgggcctgtcagtcggacctcggacctgcgtacaggccggcacactgccaaaacccactctttgggccgaaccagcatccgtcatcgcaagagggaaacccgtcaccctgtggtgccagggacccttggaaacggaagagtacaggctcgacaaagaaggcctgccctgggcccggaagcgacagaacccacttgaacccggtgcaaaagcgaagtttcacatcccgtctactgtgtatgacagcgctggcagatatcgatgttattatgagacccctgcaggttggtccgaaccaagcgaccccttggagcttgttgctaccggcgtgtcccgtaaaccatctcttctcataccacaaggaagcgtggtggcccgtggtgggtccctcaccctccaatgtcgaagcgatgtggggtacgacatatttgttctgtacaaggaaggagagcatgatctcgtccagggaagcggtcagcagccccaggctgggctgagccaggctaacttcacattagggccagtcagccgaagtcatggaggacagtacaggtgctacggcgcgcacaacctgtccccacggtggtccgctccctctgatccacttgacattctgatcgctggactgataccagacatccccgctctgagtgtgcagcccggcccgaaagtggcttctggagaaaatgtcactcttctgtgccagtcgtggcatcagatagacacgttcttcctgacaaaggagggcgccgcccatcccccgctttgccttaagtccaagtaccagtcttatcgtcaccaggcagagttctcaatgagtcctgtgaccagcgcccagggtgggacctaccgctgttattccgctattaggagttacccctacctcttgtcctcacccagctatccacaagagctggtggtgagtgggccctcaggagatccgtcactgtcccctacagggagcactccaacccccgctgggccggaggaccaaccactgacaccaaccggcctggatccgcaaagtgggctgggtcgtcatctgggtgtggtaaccggggtgtcggtagctttcgtccttctcctgttcttgctgcttttcctgctcctgcgacataggcatcagtccaaacacaggacctccgcacacttctatcgtcccgccggggctgcaggcccagagccaaaagaccagggcctacaaaaacgagcctcccccgtcgcagatatccaggaggagattctgaatgctgcggttaaggatacccaaccaaaagatggtgtggagatggatgctcgagcggccgccagcgaggctccacaggacgtcacctatgcccagcttcactccctcacccttcgtagagaggcaacagaaccccctccttctcaggagcgtgagccccccgctgagccttctatatatgcccccctagccatccactag

SEQ ID NO: 122232 - DNA, 1470 bp, Artificial Sequence
  Description of Artificial Sequence: Synthetic coding sequence
atgacccccatcgtaacagtcctcatctgtttgcgactgagcctgggaccccgtacccatgtgcaggccgggaccttacctaaaccaaccctctgggcggaaccgggaagtgtgattacccaagggagccctgttacgctgtggtgccagggaattctcgagacgcaagaatatcgcctttatcgcgagaagaagaccgcaccctggatcacgaggatcccgcaggagatcgtcaagaaaggccagttccccatccctagcattacgtgggagcacacaggtagataccgatgtttctatggaagccataccgctggttggtcagagccatccgatccattagaactggtcgtgacgggcgcctatattaagcccacgcttagcgcgttgccatctccggttgtgacttcgggggggaatgtcaccctacattgcgtgtcccaagttgcgtttggtagttttattctctgcaaggagggcgaagatgagcacccccagtgcttgaattctcagccacgtacccacggttggagcagagcaatcttttccgttggacctgtttccccgagccggcgttggtcatacagatgctatgcctatgattctaattccccacacgtctggtcactgccttccgatttattggaactgctggtcttaggggtatctaagaagccatcactgtctgttcagccagggcctattgtggccccaggcgagtcattgactctccaatgcgtctcggacgtaagttacgatagatttgtgctgtataaggagggtgagagggacttccttcaacttcccggaccacaaccgcaggccggcctgagtcaggcaaactttacactgggccccgtctcacgaagttacggtggccagtaccggtgtagtggcgcctacaacttatcctctgaatggtccgccccatcggatccgctggacattctgatcgccggccagttccgtggtcggccgttcatatcagtgcaccctggtcccaccgtagcttctggggagaatgtcactttgctatgccagtcatggggccccttccacacgttcctgctcacaaaagccggagcggcagacgctcccctccggcttcgctccatccatgagtacccaaagtatcaggccgagtttcccatgagccctgtcacttctgcccacagtggtacatacaggtgctacggcagcctaagctcaaatccataccttctctctcacccttcagattcactagagctaatggtgtcaggggctgccgagacgttgagccctccgcagaacaagtctgactccaaagcgggggccgctaacaccctgtcccctagtcaaaataagactgcttcacacccccaggattacactgttgagaatctgatccgcatgggcattgccgggctggtactcgtggtgttaggtattctcttgtttgaggctcagcactctcaacgctccctttag

SEQ ID NO: 122233 - DNA, 1401 bp, Artificial Sequence
  Description of Artificial Sequence: Synthetic coding sequence
atgactccaattttgacagtgctgatatgtctggggcttagcttagggccccgtactcatgtgcaggcagggcacctgcctaagcccactctgtgggccgagcctggctccgtcatcatccagggatcacccgtcaccctgcggtgccaagggtccctccaggcggaagagtaccacctgtaccgggagaacaagagcgcttcctgggttcgacggatccaggagccaggcaagaatggacagttcccaattcctagcattacctgggagcacgccggaaggtaccactgtcagtactattctcacaaccatagcagtgagtattctgatcctctcgaactcgtggtgaccggggcttacagtaagccaactctcagtgctctcccgtctcctgtcgttacgctgggtggtaacgttaccctacagtgcgtgagtcaggtcgcttttgacgggttcattttatgcaaagaaggcgaagacgaacacccacaaagattgaattcccatagtcacgctcgaggatggagctgggccatcttttccgtcggcccagtgagtccatcaaggcgctggtcttatcgctgctatgcctatgacagcaattccccatatgtgtggtctctaccatccgaccttctcgaattgctcgtgccaggagttagcaagaagccttcccttagcgtgcaacctggccctatggtggctcctggagagtctttgaccctgcaatgtgtgagcgatgttggctatgatcgctttgtcctatacaaagagggtgagagagactttctgcaacgtcccggttggcagccccaggccgggcttagtcaagctaacttcacccttggtcctgtgagcccctctcacggcggacagtataggtgttatagcgctcataatctgagcagtgaatggagtgctcctagtgaccctttagatatacttattacaggccaattctatgaccggccttccctgtctgtacaaccggtccccactgttgctccgggaaagaacgtgacactcctctgccagagcagaggccaattccacacctttctgctgaccaaggagggggcaggccacccacctttacatctgagatctgaacaccaagcccagcagaatcaggctgagtttcggatgggccctgtcacttccgcccatgtgggcacttaccgctgttatagctctcttagttctaatccttacttgctgtctctacctagtgatcccctggaactagtcgtgtccgcttccctcgggcaacatccccaggactacacagtcgaaaatctcatccgaatgggtgttgccggactcgtcctggtggtcctgggcatcctgctctttgaagctcagcatagtcagcgttcactgcaagacgccgccggaaggtag

SEQ ID NO: 122234 - DNA, 1452 bp, Artificial Sequence
  Description of Artificial Sequence: Synthetic coding sequence
atgacccctatcctgacggtgctgatttgcctgggcctgtctttgggcccccggacccatgtccaggcgggccacctccccaagcctacactatgggcggagcctggctctgtaatcatacagggctctcctgtcacccttagatgccagggctcattgcaggctgaggagtaccacctgtatagagaaaataagtccgcctcttgggtgagaaggatacaagagcctgggaagaacgggcagtttccaatcccctccattacctgggagcatgctgggaggtatcattgccaatactactcgcataaccacagcagcgaatattctgaccccctggaactggtagtcaccggggcttatagcaagcctaccctcagtgctctgccgagcccagtcgtgaccctgggagggaatgtgaccctgcaatgcgtctctcaggtagcgttcgatgggtttatcctctgtaaagaaggcgaagacgagcacccacagcgcctgaactctcattcacatgcacggggctggagttgggccattttctccgtgggacccgtctccccatctcgtcggtggagctatagatgttatgcctacgatagcaactcgccgtacgtttggagtcttccttccgacctgctggaactcttggtccccggagtgagcaagaagccctctctgagcgttcagcctggaccaatggtggcaccgggtgagtccctcacgctgcagtgtgtctctgatgtcgggtatgaccggttcgttctttacaaggagggcgagcgagattttctccagaggcccgggtggcaaccccaggccggcctgagtcaggccaatttcaccctgggcccagtgagtccctctcacggcgggcagtaccgctgctactctgcccacaacctatcctctgaatggagcgccccttctgatccgttggatatactcattactggccagttttatgaccggccatccctcagcgtgcagcccgtgcccacagtggcccctggaaaaaacgttacactcctctgccagagtcgaggtcagtttcacaccttcctgctgaccaaggaaggtgccggtcatcctccattgcacttgagatccgagcaccaggcccagcaaaatcaggccgagttccgcatgggcccagtcactagcgcccacgtgggcacttacagatgttactctagcctatctagtaacccttatctcctcagcttgccgagtgatcctctggagctagtcgtgagtgaggccgccgaaactctgtcaccatcccagaacaagaccgactcaacaacgacctctctcggccaacaccctcaagattacacagtggaaaaccttataaggatgggagtagccggccttgtgctggtcgtcctcgggattcttctgttcgaggctcagcatagccaacgtagtctccaggacgccgccgggcggtag

SEQ ID NO: 122235 - DNA, 1452 bp, Artificial Sequence
  Description of Artificial Sequence: Synthetic coding sequence
atgacacccatcctgactgttctgatctgcctcggcttatcccttggcccccggactcatgtacaggctggtcatctaccgaagccaaccctgtgggccgagcctgggagcgtgatcatccaggggagccctgtcaccctgcgatgccagggatcactgcaggccgaagagtaccatctgtatagggaaaacaagtctgcatcctgggttcggaggatacaggagccaggtaaaaacgggcaattccctatccctagtatcacctgggaacatgctgggagataccattgccagtattactcccacaaccacagttccgaatactcagaccccctagaactggtggttacaggcgcgtactcgaagcccactctgtctgctttgccctcaccagtcgtgacccttggtggcaacgtcactttgcagtgtgtaagtcaagtggccttcgatgggtttatcctgtgtaaggagggagaggatgagcacccccagcggctgaattcccatagtcacgccaggggctggagctgggccatcttcagcgtgggcccggtgtcaccttctagacggtggtcctacagatgctatgcctacgatagcaactcaccttacgtgtggtccctaccaagcgacctgctggaactgcttgtaccaggcgttagtaagaagccgagcttgagtgtccagcctggacctatggtcgctccaggcgagagcctgacattgcagtgcgtcagtgacgtgggttatgaccgcttcgtgctgtataaagaaggagagcgtgattttctccagcgccccggatggcagcctcaggccggattgtcccaggctaattttacattgggacccgtgtctccttctcatgggggccagtaccgttgttattcagctcataacctgtcctcagagtggagtgctccaagtgatcctcttgacatcctgatcactggacaattttatgatcgcccgtccctctccgtgcagccagtgcctactgtggccccaggcaagaacgtcactttactttgtcagagccggggacagttccatacgtttctgttgacaaaagaaggagctggccatccgcctctgcatctgcggtcagagcaccaggcccagcaaaatcaggctgagttccgcatgggcccagtgacgtccgcccacgtcgggacttatcgatgctactctagcctgtcaagtaacccatatctcctttctctgccatccgaccctctggagctcgttgtaagcgaggctgcagaaactctcagcccatcacagaacaaaactgactccactacaacaagcctcgggcagcatccccaggactataccgtcgagaatctgatacgaatgggggtggcaggattggtactggttgtgttaggaatcttgctgtttgaagcgcagcatagccagcggtctctgcaggacgccgcaggtaggtag

SEQ ID NO: 122236 - DNA, 984 bp, Artificial Sequence
  Description of Artificial Sequence: Synthetic coding sequence
atgacgcccattctgaccgtccttatctgccttggcctaagcctaggaccgcgcacccacgtccaggccggtcacctgcctaaacccacgctgtgggcagagcctgggagcgtcattattcagggcagtccagttacactgaggtgccagggctcattacaggctgaggagtaccacctttacagagaaaacaagtctgcttcgtgggtcagacgcattcaggaacctggcaaaaatggtcagttccccataccctcgattacatgggagcatgcgggccggtaccactgccagtactattcccacaatcactccagcgaatattccgatcccctcgaattggtggtgactggagcatactcaaagcctacccttagcgctctgcccagtccagtcgtgacccttggtgggaacgtgaccttacaatgcgtttcacaggtggcatttgacggcttcatcctctgcaaggagggcgaagacgaacatcctcagcgtctgaactcccacagccacgccagggggtggagctgggccatcttttcagtggggcctgtgagccccagcaggagatggagctaccgctgctacgcctacgactcaaactccccatatgtatggagcctgccatccgatttgctcgaactcctggtgccaggggtctcaaagaaacccagcttaagcgtgcagccaggacctatggtcgccccaggtgaatccctcaccctgcaatgcgtgtctgacgtcggatatgaccggttcgtactgtacaaggaaggtgaacgggattttttgcagcggcctggctggcaaccccaggccgggctctctcaggccaatttcaccttagggcctgtttcgccgagccacggggggcagtacaggtgctactccgcccacaatctttcatctgagtggagcgccccaagcgaccccctggacatcctcatcactggtcagttctacgacaggccctccctgagctag

SEQ ID NO: 122237 - DNA, 1320 bp, Artificial Sequence
  Description of Artificial Sequence: Synthetic coding sequence
atgacacccattcttacagtgctcatctgtctgggactcagcctggatcctaggacacatgtccaggctggtcccctgccaaaacccacattgtgggcagaacctggaagcgtgatcacacagggatcgcctgtaacactcaggtgccagggctccttggaaacccaggagtatcacctttaccgcgagaaaaaaacagctctatggattacacgcatccctcaggagctcgtgaaaaaaggacagtttccaatactgagtataacatgggaacatgctgggaggtactgttgcatatatgggtcccacaccgctggtttatctgagagttccgatcccttggagttggtcgtgacaggcgcttattccaaaccaaccctttccgctcttccgtcacccgtggtgacctcaggcggtaatgtcactatccagtgtgattcgcaggtcgcctttgatggcttcattctttgcaaggagggcgaggatgagcacccacagtgcctgaatagccacagtcatgctcgaggatcgtctcgggctatatttagcgtcggacctgtgagccccagtcggcgctggagttaccgctgctacggatatgatagcagggcaccatatgtctggtcacttccctccgatttgctcggattacttgtgccgggtgtgagtaaaaagccctccctttccgtgcaacctggcccagtggtcgcccccggggagaagctgacctttcagtgcggttcagacgccggctatgatagatttgtgctctataaggaatgggggcgggattttctacaacgacccggcaggcaaccacaggcagggctgagccaggcgaatttcaccctaggtcccgtgtctaggtcttatggagggcagtacacatgctctggagcttacaatctgtcatctgagtggtcagccccatctgacccactcgacatactgattaccggccagattagagcacggccatttttgtcggttaggccaggacctacagtggctagcggggagaacgtgacactgttatgccagtctcaaggcggcatgcacacgtttcttctgaccaaggagggggcagccgattcaccgttacggttgaagagtaaacgacagagtcacaaatatcaggcagaattccctatgagcccagtaaccagcgcacacgccgggacgtacaggtgctacggtagcctgtctagtaacccgtacctcttaacacacccatcagaccccctcgaactggtcgtgtcaggggctgccgagacgctttcgcccccccagaataagtccgactcaaaggccggcgaatag

SEQ ID NO: 122238 - DNA, 1371 bp, Artificial Sequence
  Description of Artificial Sequence: Synthetic coding sequence
atgcacagaggcttgatccacccacagagcagcgccgtaggcggagatgccatgaccccgattttgacagtcttgatctgcctcggtctctcccttgaccctcgcactcacgtccaggctggaccactcccgaaaccaaccctgtgggcagagccgggtagtgtgattactcagggttctccagtaacgctgcggtgccagggcagtctcgaaacccaagaataccatctgtatagagagaagaaaaccgccttatggattactagaattcctcaggagctggtaaaaaaaggccagtttcctatcctgtccataacctgggaacatgctggtcgatactgctgtatctacgggagccacacagccggactgagtgagagcagcgacccgctagagttggttgtgacaggggcctattccaagccgaccttgtcagctttaccaagtcccgttgtaacatctggaggcaacgttaccatccagtgtgactctcaagtcgccttcgatggcttcattctctgtaaagaaggggaggacgagcatccgcaatgcctgaactctcatagccacgcgagggggtcctccagggcaatcttctccgtgggtcccgtcagtcctagccggaggtggagttaccgctgctacggatacgactctagagccccctacgtttggagtcttccgtcagacctattgggcctgctggtaccaggcgtgagtaaaaagcctagcctgagcgtacagcctggtcccgtggtcgcgcctggagagaagctgacattccagtgcggcagcgatgcgggttacgacagatttgtgctgtataaggaatgggggcgagacttcctgcagcggcccggccggcagccccaggccggcctctctcaggcaaatttcactctaggcccggttagccgatcatatggagggcagtacacatgtagtggcgcgtataatttaagctctgagtggtctgcgccatctgaccccttggacattctgattaccggccagatccgagcccggccgtttctgtcagtcaggccagggccgaccgttgcttctggcgagaatgtgaccctgctctgccagagtcagggcggaatgcatacctttttactcaccaaagagggggcggcagatagccctctgcgcctgaagtctaagcgccagagccataaatatcaagctgagtttccaatgtctcccgttacatccgcacacgcaggcacttatagatgctacgggtccctctcctccaacccttacctccttacacatcccagcgacccgctggagctggtcgttagcggggctgccgaaaccctgtctcccccacaaaacaaatccgattctaaagcgggggagtag

SEQ ID NO: 122239 - DNA, 1959 bp, Artificial Sequence
  Description of Artificial Sequence: Synthetic coding sequence
atgactcccatcctgactgttcttatctgtttgggtctctctttaggcccaaggacgcacgtgcaggccggccatctcccaaagccaacgctctgggccgaacctgggtccgtcatcacccagggatctcccgtaacactgaggtgccaaggcgggcaagagacacaggaataccgattgtatcgggaaaagaaaaccgctctctggatcacccgtatcccccaagagctggtgaagaaggggcagtttccgattccctctatcacatgggaacacgccggacgctaccggtgttattacggctctgatactgccggaaggtcagagagttcggacccactggagttggtggtcactggggcttatattaagccgaccctctccgcccagccaagccccgtagtgaattccggcgggaatgtgatcttacagtgtgacagtcaggtcgcctttgatggcttcagtctgtgtaaggaaggcgaagatgagcatccacagtgcttaaacagccaaccacacgcacgcgggtccagcagagccatcttttcagtggggcctgttagtccctcccgacgctggtggtatcgctgctacgcctatgactctaactctccctatgaatggagtttacctagtgacttgctcgagctgctggtcctgggcgtcagcaaaaaaccctcattatctgtgcagcccggccccatcgtggctccggaggagactctaactctacagtgtggcagcgacgctggatataaccgctttgtgttatataaggatggcgagagagacttcctgcagctggcgggcgcgcagccacaggccggtctcagccaggctaacttcacactgggccctgtcagtcgcagctacggtggtcagtaccggtgctatggggcacacaatctcagtagcgaatggagtgcccccagcgacccactggatattttgatcgctggccaattctacgacagggtcagtcttagcgtgcaacccggcccaactgtcgcgtccggcgagaacgtgaccttattatgtcagtcacagggttggatgcagacctttctgctaactaaggaaggtgccgcggacgacccatggaggctgaggtctacgtatcagagtcagaagtaccaagctgagtttccaatgggccccgttaccagtgctcatgcaggcacataccgatgctacggctcccagagcagtaaaccctatctgctgacacatccgagcgacccgttggaacttgtggtgtctggaccaagcggaggcccttctagcccaacaaccggacccacatcaacatctgcaggtccagaagaccaaccgttgacaccaacaggatcagatccacagtccggactgggtagacaccttggcgttgtgattggtattctggtcgccgttattctgctgctgctgctgttactgctgctgtttctcatcctgcggcacagacgccagggcaaacattggacctcaacacaacgcaaggcagattttcagcatcccgccggggccgtgggccccgagccgacagatcgaggtctgcagtggcgcagttcccctgctgctgatgctcaggaagagaatttatacgccgcagtgaagcacactcagccagaagacggggttgagatggatacaaggcaatcgccgcatgacgaggacccccaggcagttacctacgcagaagtgaagcatagtcgtcctcggagggagatggcctcaccaccctccccattatccggtgagttccttgacactaaagatagacaggccgaagaggatcgacaaatggacactgaggctgcagcttccgaggccccacaagacgtcacatacgcacagttgcactccctgacactccgtagggaggcaacagaacctccaccctcccaggagggcccctcccccgctgtgccaagcatatatgccacattggccatacactag

SEQ ID NO: 122240 - DNA, 1953 bp, Artificial Sequence
  Description of Artificial Sequence: Synthetic coding sequence
atgacgcctattttgaccgtcttgatctgtctaggcctgagcctggggccacgaactcacgtgcaggccggacatctacctaagcctacattgtgggccgaacctgggagtgtcatcacccagggcagcccggttactctgagatgccagggaggccaggaaacccaagagtaccgactttaccgggagaagaagacggctttgtggatcacccggatcccacaggagctcgttaaaaaaggccaatttcccattccttccattacatgggagcacgcaggaaggtatcgctgttactacggatccgatacagcgggacgttcagagagttctgacccccttgaactggtggtgacgggggcgtacataaagcctacactgagtgcccaaccttctcctgtggtgaactcggggggtaacgttatactacagtgtgactcacaggtcgccttcgacgggttctccctttgtaaggagggcgaggacgaacatcctcagtgtctgaatagccagccccatgctagagggagttcaagggccatcttttccgtagggcctgtgtccccatctaggcgctggtggtatcgttgttacgcgtacgattcaaactcaccttacgaatggtctctgccctctgatctgctcgagctgctcgtcttaggggtgagcaagaaaccaagccttagtgtgcagcctggcccgatagttgcccccgaggaaaccctcaccttgcagtgtggatctgacgccggctacaatcgatttgtgctctataaggatggggaaagagactttctccaactggccggcgcacagccgcaggctggactgtcgcaggccaactttactctcgggcccgtgagtagaagctacggaggccaataccggtgctacggggcccacaatctgagcagcgaatggtcggctccatcagaccccctggatattctgatagcaggtcagttttacgatcgggtgtcactctcagtccagcctggtccaactgtcgcatccggtgaaaatgtgacactcctctgtcagtcccaggggtggatgcagacttttttgcttaccaaggagggcgctgcagatgatccctggcgcttgagaagcacataccagagccagaagtatcaagctgagtttccaatgggacctgtgacaagcgctcatgctggaacgtaccgctgttatggcagtcagtcttcgaagccataccttctgactcaccccagcgaccccctggagcttgtggtgtcagggccctcaggcggaccctccagtcccactactgggcctacctccactagtggcccagaagaccagccccttactccaactggtagcgacccgcagagtggcctggggcgtcacctgggggtagtcatcgggattttggtggccgtaattctgctcttacttctccttcttctcttgtttctgattctgaggcacaggcgacaaggcaaacattggacatcaactcagcggaaggccgattttcagcaccccgctggggccgtgggcccggaacctacggatagagggcttcagtggaggtctagtccagccgcggacgcacaggaggagaatctttacgccgccgtgaagcatacacagccggaggatggagtggagatggatacccgttccccgcacgatgaagatcctcaagcagttacatacgccgaggtgaagcatagcaggccccgccgcgaaatggctagtcccccgtcaccgctcagtggtgaatttctggatactaaggatcggcaagccgaggaggatcggcaaatggataccgaggccgcagcatccgaggctccgcaggacgtcacatatgcacaacttcactcccttaccctaaggagagaagccacggaaccaccccctagtcaggaaggtccgagccctgctgtgccatctatttatgctacgctggccatacactag

SEQ ID NO: 122241 - DNA, 1953 bp, Artificial Sequence
  Description of Artificial Sequence: Synthetic coding sequence
atgactccaattctcaccgtgctgatttgcttggggctgtccttgggtcccaggacacacgtccaggccgggcatctgccaaaaccaaccctctgggccgagccagggtccgtcattacacagggatccccggtgaccttacgttgtcagggtggccaagagacacaagagtatcgactgtaccgggaaaagaagactgccttatggataaccagaattcctcaggagctggtgaaaaagggtcagtttcccattccctccattacatgggaacatgctgggcgataccggtgctactacgggtctgatacggccggcagatcggagagtagtgaccctctcgaactggtcgtaaccggcgcttacatcaaacccactctgagcgcccagccatccccggtagtcaactcaggcggcaatgtaatactccaatgtgattcccaagttgctttcgacggtttcagtctctgcaaggaaggagaagatgagcatcctcagtgtctgaattcacagcctcacgctaggggctcttcacgtgctatattctcagtgggcccggtgagcccctcgcgaagatggtggtatagatgctatgcatacgactcgaattccccctacgagtggtccctgcccagcgatctgctggagcttttggtgctgggggtatcaaagaagccctctctatccgtgcagcccgggcccatcgtagctccggaggagaccctcaccttgcaatgcggatccgatgctggatacaacagatttgtattgtacaaggacggtgagagagactttttacagctggcgggggcacagccgcaggccggcctatcccaggcaaatttcaccctggggcccgtgtcaaggtcctatggcggccagtatcgctgctatggcgcgcataatttgagctcggagtggagcgctccttctgatccactggacattctgatcgccgggcagttttacgatcgagtgagcctgtcggtgcagcctgggcctacggtcgcttccggcgaaaacgtgacactcctgtgtcagtcccaagggtggatgcagacctttttgctgacaaaggaaggagcagcggacgatccctggaggctgaggtctacttaccagagccagaaataccaggctgagtttcccatggggcctgtgactagtgctcatgcgggcacttatcgctgctatggctcacagagctccaaaccctacttactcacccatccatccgaccccttggagttggtcgtaagcggtcccagcggcggcccctcaagtcccactaccggaccaacaagcacctcaggtccagaagaccagccgctgacacctacgggatcagatccccagagcggacttgggcgccacctaggcgttgttattgggatcctcgtggccgtgatcctcttgttgctcctcttgctgttgttgttcttaattctgcggcaccgccgccaggggaagcactggacctctacccagagaaaggctgactttcagcaccccgctggggcagtgggtcctgagccaactgatagaggcctacagtggcgtagctctccagctgccgatgctcaggaagaaaatttgtatgctgctgtgaagcacacgcaaccagaggacggtgtggaaatggatacgagatcaccgcatgacgaggatccacaggctgtgacctacgctgaggtgaaacatagccggcctaggagagagatggcaagcccaccttccccgctgtccggcgaattcctcgacacgaaagatcgacaagctgaggaggacagacagatggatacggaggctgccgcatctgaggccccacaggatgtcacatacgctcagttacatagcttaacgttgaggcgcgaagcaacagagcccccaccgagtcaggagggtccgagcccagccgtgccctccatttacgctactctcgccatccactag

SEQ ID NO: 122242 - DNA, 1905 bp, Artificial Sequence
  Description of Artificial Sequence: Synthetic coding sequence
atgaccccaatccttacagtgcttatttgcctcggcctgtccttaggacctaggacacatgtccaggcgggtcatctgcccaaacctaccctgtgggcagaaccaggctccgttataacacaagggtctcctgtcactctacggtgtcagggcggacaagagacccaggaatacaggctgtacagggagaagaagaccgcactgtggatcacaaggataccacaggagttggtcaaaaagggacagtttccaattccaagcataacgtgggagcacgctggtcgatacaggtgttactatggcagcgatacagccggtcggagcgaatcctcagacccattagaactggtggtgactggcgcctatatcaagccaacactcagtgcccaacccagtccagttgtgaactcaggcggtaacgtcattctgcagtgcgactcgcaggttgcatttgacggattcagcctgtgcaaagaaggggaagatgagcatcctcagtgcttgaacagccagccccatgcacgcggctcgagtcgcgctatcttttctgtcgggccagttagcccctcacgcaggtggtggtaccggtgctacgcatatgatagcaatagtccctatgaatggtcattaccatcagatctgctagagctcctcgttctgggtgtctctaaaaagccttccctgtctgtgcaacccggaccaatcgtggcacccgaggaaaccctaaccttgcagtgtggcagtgacgcgggctacaatcggttcgtgctgtacaaggatggagaacgcgacttcctgcagctggccggagctcagcctcaagccgggcttagccaggccaactttaccctgggtccagtttctcgcagctatggaggacaatataggtgctacggtgcccacaatctttcctcagaatggtccgcgccttctgaccctctggacatacttatcgccgggcagttttacgatcgtgtgagtctgtccgtccagcccggcccaacagtcgccagcggtgagaacgtgacactgctatgccagtcacagggatggatgcagacctttttattgacaaaagagggcgccgccgacgacccttggcgactgaggagcacttatcagtcccaaaaataccaagcagagttccccatgggccctgttacatcagctcacgcagggacatacaggtgttatggcagccagtcctccaaaccatatctgttaacacacccatccgacccgttagagttggtggtatctgctggccccgaggatcaaccactgacaccaaccggcagcgatccccagagcggcctgggaagacacctgggagtagtgatcggcatcctagttgcagtcattctcctgctgttactgctgctgctcctctttctgatcttgcgacatcggcgacagggaaaacattggaccagcacacagcggaaggctgacttccagcaccccgccggggctgttggccccgaaccaacggatcgaggactacaatggcgcagcagtccggctgctgacgcccaggaggagaatctctacgctgccgtgaaacatacgcagccggaggatggcgtagagatggacacccggtctcctcatgatgaagaccctcaagcagtcacgtacgctgaagtgaaacacagtagacctagaagggaaatggcatctcctcctagccctctgtctggagagttccttgatacaaaagataggcaggcggaagaggacaggcaaatggataccgaggccgctgcatccgaggccccacaggacgtaacatacgcccagctccattctttaactttgcggcgcgaggccactgagccaccgcccagccaggaggggccctccccagccgtcccctctatctatgcgacgttagcaattcattag

SEQ ID NO: 122243 - DNA, 1953 bp, Artificial Sequence
  Description of Artificial Sequence: Synthetic coding sequence
atgactcctattttaacggtgcttatatgcttaggcctgagcctcggcccgagaactcacgtacaagccggacatctccctaagccgaccctgtgggcagagcccggaagtgtgattacccaagggagccccgtgacgctccggtgccaggggggtcaggagacacaggaataccgtctctaccgcgagaagaaaaccgctctctggatcacaagaattccgcaggaactggtcaaaaaaggtcaattccctatcccaagcattacatgggagcatgctggacggtataggtgttattacgggtcagacaccgctgggcgcagcgagtcttccgatcctctggagctagtggtgaccggcgcttacatcaagccaacactgtctgcacagccctcaccagtggtgaattcagggggcaacgtgatattgcaatgcgattcccaggtcgccttcgacggatttagtttatgcaaggagggcgaagacgaacaccctcagtgtttgaacagccagccacacgcacggggctctagtcgtgctatttttagtgtggggccagtgagcccttcacgtcggtggtggtaccgctgttatgcctacgacagtaattctccctatgagtggagcctgccctccgatcttcttgagctgctcgtgctcggagttagtaagaaaccctcgctgtctgtacagcccggccctatcgtggcccccgaagagactctgaccttacaatgcgggtccgacgccggatacaaccgctttgttctttataaggatggcgaaagagatttcctgcagctcgcgggggcccaacctcaggctgggctatcgcaagcaaacttcacactggggccagtgtcaaggagctacgggggccaatatcgctgttacggtgcccataatctgtcttcggagtggagcgctccctcagacccactcgacattctcatagccggacagttctacgatagggtttccctctcagtgcagcctggcccgaccgtggcttctggcgaaaacgttactctcctctgtcaaagtcagggatggatgcagacttttctgctgactaaagaaggggccgcagacgatccctggcgccttcggtccacctaccagagccagaaatatcaagctgagtttcccatgggcccggtgacaagtgctcacgccggcacttatcgctgctatggcagccagagttcgaaaccatatcttctcactcacccttccgatccactcgagctggtcgtttccggaccctccggaggcccatcttcacccaccacaggccccacttctacctcgggaccagaggatcaacccctaaccccaacaggctccgacccgcagagtgggctcgggcgccacctgggtgtggttatcggtatcctggtggctgtgatactgttactactgcttcttttactcctgttcctgatcttgcggcaccggcgccagggcaaacactggactagtacacagcgaaaggccgactttcagcatccagcaggagcagtgggtcctgaacctaccgaccgcggcctacaatggagatctagtcccgccgctgatgcgcaggaagagaacctgtatgctgccgtgaagcacactcagcctgaagacggtgtggagatggacaccagatctccccacgatgaagaccctcaggctgtgacctacgcggaagtgaagcattctcggccaaggcgggaaatggcaagcccaccctccccattgagcggcgagtttctcgatacgaaggacagacaggcagaagaggacagacagatggacacagaggcagccgcttccgaggcacctcaggacgtgacctatgcacaacttcactctctgactctcagaagagaggccacagagccccccccatcccaagagggaccaagtccagcagtaccctcaatatacgcaacactcgccattcactag

SEQ ID NO: 122244 - DNA, 1533 bp, Artificial Sequence
  Description of Artificial Sequence: Synthetic coding sequence
atgacacctattctgacggtccttatctgcctgggcctgagcctgggcccccgtacacacgtgcaggcaggccacttgccaaaacccacactttgggctgaacccggcagcgtgattacacagggctctcccgtgacgcttaggtgtcaggggggccaggaaacgcaggaatatcgcctttacagggagaaaaagaccgcgctgtggattacacgaattccccaggagttagtgaagaaagggcagtttcccataccaagcattacatgggaacatgcgggcaggtatcgctgctattatggaagtgatacagcagggcgctctgagagcagtgaccctctagagctggttgtcacaggcgcctacatcaagcctacactgtctgcacagccttccccagtagtaaactccgggggtaatgttattttacagtgtgattcccaggtagcttttgatggcttctctctgtgtaaagaaggcgaggacgagcacccgcaatgccttaactcgcaaccccacgctcgaggctcttctagagctatcttcagtgtgggacccgtttccccctctagacgatggtggtacaggtgttatgcatacgatagtaatagcccatatgaatggtcactgcctagtgatcttctggagctcctggttctgggcgtcagcaagaaacccagcctctccgtgcaacccggaccaatcgtagctcccgaggagactctcactctacaatgtgggagtgatgctggctacaataggtttgtcctctataaggatggcgagcgtgatttcctgcaactggcaggagctcagccgcaggcgggcttgtctcaggccaatttcacgctgggccctgtgtctcggagctatgggggacaatatcggtgctacggggcccacaatttatcttctgagtggtctgccccaagtgaccccctggatatcctgatcgccggccagttttacgaccgcgtctctctgtctgtccaaccaggccccaccgtggcctcaggtgaaaacgtgactctactgtgccagagccaagggtggatgcagacatttctgttaactaaggaaggtgccgcagatgacccatggagactccgctccacctaccagtcccaaaagtaccaggcagagtttcccatgggccccgttacatccgcccatgcagggacgtaccgctgttacggaagccaaagctctaagccctatctccttacgcacccgtcagatcccttggagctcgtagtgtctgggccttctggcgggcccagtagtccaacgaccggaccaaccagtacgagtggcccagaggatcagccactcacacctacaggttctgatccccaatctggcctgggccgccatctgggagttgtgattggaatcttggtcgccgtgatccttctgctgctcctgctgcttttgctgtttcttattctgagacatcgaaggcagggtaagcactggacgtctagccctgctcagctgccaatgccccgcaagaagacctccatgctgccctag

SEQ ID NO: 122245 - DNA, 1797 bp, Artificial Sequence
  Description of Artificial Sequence: Synthetic coding sequence
atgacacctatcgtcaccgtactgatatgtctcggactctcccttggaccgaggacccatgtgcagacggggaccatccccaagcctactttgtgggccgagcccgatagtgtcatcacccaaggctcacctgtgacactgtcctgccagggtagcctagaggcgcaggagtaccgtctttaccgggagaagaagagcgcgtcctggattaccaggatcaggcccgaactggtgaaaaatggccagtttcacataccctccatcacatgggagcacacgggaaggtacgggtgccaatattattctcgggcccgctggtctgaattgtcagatcctctggtcctggtgatgaccggagcctatcccaagccaaccctgtccgcccagccaagtccagtcgttacctccggcggccgggtgacgctgcagtgcgagtctcaggtggctttcggtgggttcatcctgtgtaaggagggggaggaggagcaccctcagtgtcttaattctcaacctcatgctcgggggagtagccgagccatcttcagtgtaggccctgtgtctcccaataggcggtggagccaccgctgttacgggtacgacctgaatagtccttatgtgtggagcagcccttcggatcttctcgagcttctcgtacccggcgtgtccaagaaacctagcctctcagtgcagcccggccctgtggtggcgcccggagagtcactgactttacagtgtgtgtccgatgtgggctacgatagatttgtactttacaaggagggcgaacgggacttgaggcagctgcctgggaggcaaccacaggctgggctatcccaggctaacttcaccctaggaccagtcagcaggagctatgggggacaataccgatgttatggtgcacataacctgtcaagcgagtgctccgccccctcggaccccttggatatactgattaccggtcagatcaggggaacccccttcattagtgttcagcccggtcctactgtagcctcaggggagaatgtaacccttttgtgccagtcttggagacagtttcatacctttcttctcaccaaggctggcgctgccgacgccccgctgcgacttcggagtatccatgagtaccccaagtaccaggctgaatttccgatgagccctgtgacatccgcgcatgcagggacctatcgctgttacggctctctcaattcggatccctacctgctcagtcacccatcagagccattggaattggtggtgtcaggcccttctatggggtcttcccctccgcctacaggccctatatccacccccgccggtcccgaagaccagcccttgacaccgaccgggagcgacccacagtctggcttgggaagacatctaggcgtggtcattggcattctggtggccgttgtgcttctgctgctgctattactgctactctttctgatcctacgccacagaagacaaggaaaacattggacctccacgcagagaaaggctgactttcagcacccagcaggcgcagtcggcccagagcccactgacagaggcctgcagtggaggtcctcacctgctgcagacgcccaggaggagaacctgtatgctgcggtcaaagacacccagcccgaggatggcgtagaaatggacacgagggcagccgcctcagaagcacctcaggatgtcacctatgcccagctgcattctttaactctgaggcggaaggccacagagcccccccccagccaggaacgagaaccaccggccgaacccagtatctatgcaacgctggccattcattag

SEQ ID NO: 122246 - DNA, 1449 bp, Artificial Sequence
  Description of Artificial Sequence: Synthetic coding sequence
atgaccggcgcttaccccaagccgaccctcagcgctcagccttcccccgtcgtgaccagtggagggcgcgtgacactgcaatgcgagtctcaggtcgcgttcgggggctttatcctttgtaaagaaggggaggaggaacacccacaatgcttgaattcacagccccacgccaggggcagcagccgcgcaatcttcagcgtcggcccagtaagtcccaaccggcgctggtctcaccggtgttatggatatgatttaaattccccttacgtatggtccagtccttcagacttactcgaattattggtgccaggagtgtcaaaaaaacctagcctcagcgtgcagccagggccagtcgtggctccgggtgagtctctgaccctgcaatgcgtgagcgatgtcggatatgaccggttcgtgttgtacaaagagggagagagagatctacgtcaactccccgggcggcagccacaagctgggcttagtcaggcgaatttcaccctcggtcccgtgtcccggtcttacggcggacagtatcgctgctacggagcccacaacctgtccagtgaatgctcagctccttccgatccactggacatcctcatcaccggccagattagaggcaccccctttattagcgtccagcccgggcctaccgtcgcgtctggagagaatgtgactctgctctgccagtcctggcgacagttccacaccttcctcctcaccaaggctggagccgccgatgcaccacttcggctgcgctccatccacgaataccctaagtatcaggctgaattcccgatgtcacccgtcacttcagctcacgccggcacatatagatgttacgggtctctgaacagtgacccgtatctgcttagccatccgagtgagcccctggagctggtcgtgagcggaccaagcatgggcagcagcccccctcccaccggtcccatcagtactccagctggcccggaagatcagcccctgacacctacaggcagcgacccacagtcaggactgggccgacatctgggggtcgtaatcggtattttagtggctgtggttctactgctgctgttgctgttgttgctcttcctaattctacgtcaccgccgacaggggaaacactggacaagcacgcagcgcaaggccgacttccaacaccccgctggagccgtagggccagaacccacagataggggcctgcagtggaggtctagccccgcagccgatgctcaggaggagaatctgtatgccgccgtcaaggatacccaaccggaagatggagtagaaatggatacccgtgcggcagccagcgaggctccgcaggacgttacatacgctcagctgcactcattgaccttaagaagaaaggccacggaacctccaccctctcaggagagggaacctcctgctgagcctagtatctatgctacactggccattcactag

SEQ ID NO: 122247 - DNA, 1932 bp, Artificial Sequence
  Description of Artificial Sequence: Synthetic coding sequence
atgacccctgccctcactgcactgttatgtttgggcctgtctctcggacctcgcacgcgcgtgcaggctggaccttttccaaaacccaccttgtgggccgaacccggatccgtgattagctggggctctcctgttactatatggtgccaggggtctcaggaggctcaggaatacaggttgcacaaggaaggcagccccgagcctctggaccgtaacaaccctctagagcccaaaaacaaggccaggttttccatccccagcatgactgaacaccacgcggggaggtaccggtgccactactattccagtgctggctggagcgaaccatccgatcctctcgagatggtcatgacgggtgcatattccaagccgacactgtccgccctgcctagccccgtcgtagcatccgggggtaacatgaccctgagatgcggcagccagaagggctaccaccactttgttctcatgaaggagggcgagcaccaacttccccgcactctggatagccagcaactgcacagcagaggatttcaggccctgttccccgttggcccagtgaccccaagccacagatggcgcttcacgtgctattactactacactaataccccttgggtgtggtctcatccttccgaccctttagaaatactgccttcaggggtttcccgaaaacctagcctgcttaccctgcaaggccctgtgttagcaccaggacagagcctaacccttcagtgcggcagtgatgtgggatacaaccgcttcgtgctctacaaggaaggtgagcgagactttctccagcggccagggcaacagcctcaagccggcctgtcccaagcaaattttacactgggtccagtcagcccctcaaatggcggccagtaccgctgttacggcgcccacaacctgtcgtccgagtggtcagcccctagcgatcccctgaacatcttgatggcaggtcagatttatgataccgtgtctctgtctgcccagccaggacctactgtagcatcaggggagaatgtgacgctactgtgtcagagctggtggcagtttgacaccttcctcttgaccaaggaaggcgctgcacacccacctttgaggcttcgcagtatgtacggcgcacacaagtatcaagctgagttcccaatgtctcccgtgacttccgcccacgccggcacgtacaggtgttacggtagctacagcagcaatccacacttactgagccatccctccgagccgcttgagctcgtagtctccggtccagaggaccaacccctcaaccctccgggatcaggccctcagaatccacccgggctggggagtggtgccggcactagagccgcaggtcttggtcgctacctggaggtgctaatcggagtatctgtggctttcgtcctcctcctgtttctgttgttgttcttgcttctcaggagacagcggcactctaaacatagaacttccgaccaacggaagacagatttccagagacctgcaggagccgccgagactgagccgaaggacaggggattgctgcgcagaagcagtccagccgcagacgtccaggaagagaatttgtatgcagcagtcaaagatactcagtcggaagacagagtagagttggattcacagagtcctcatgacgaagacccacaggctgttacctacgccccagtcaagcattcatcaccccggcgcgagatggcctctcctccatcaagccttagcggggagttcctggatactaaggatcggcaagtggaagaagatagacagatggacacggaggcagccgcgtctgaggcctcccaagatgtaacgtatgcccagcttcactcactgacgctgcgcaggaaggccaccgagccgcccccctcacaggaaggtgagcctcctgccgagccgtcaatatacgccacactcgccatccattag

SEQ ID NO: 122248 - DNA, 1896 bp, Artificial Sequence
  Description of Artificial Sequence: Synthetic coding sequence
atgacacccgcactgactgccctgctgtgtttgggtctatctcttggccccaggacccgtgtgcaggccggcccctttcctaaaccaacgttgtgggctgaaccaggctccgtgatcagctggggctctccagtgacaatttggtgccagggaagtcaggaggcccaggaatataggctccataaagaaggctcccccgagccactggaccgtaataatccgcttgagccgaaaaataaggcccggttcagcattccgtccatgaccgagcatcacgctggcagatacagatgccattactattcatccgctggatggtccgaaccttctgatcccctggagatggtcatgaccggggcctatagcaaacctaccctgagcgcccttccgagccccgtcgtagcatcaggtgggaacatgactcttcgatgtggttctcagaaaggttaccaccattttgtcctcatgaaagaaggcgaacatcaacttcctcggacgctggacagccagcagctgcactctcgtggattccaggccctgtttcccgtggggcctgtgacgccatctcacagatggcgctttacatgttactattactacacgaatacaccatgggtatggagccacccctctgatcctctggaaatccttccctctggcgtgtcacgcaaaccgtccttgctcacgctgcagggaccggtgcttgccccgggccagtcattgacgctccagtgcggcagcgacgtggggtacaaccgctttgtcctgtataaagaaggcgagagggatttcctccagcggccaggccagcaaccccaggccggtctctctcaggccaacttcacacttggaccagtcagtccatctaacggaggccaatacagatgctatggagcccacaatctctcctccgaatggagtgcacccagtgatccactcaatatcttaatggcaggccaaatctacgacacagtgagcttaagcgctcagcctgggcccacggtcgcttcaggtgagaacgttactctgttatgccagtcttggtggcaattcgacacctttttactgaccaaggagggggctgcgcatcctccccttagactgaggtcaatgtacggggctcataagtatcaggctgagtttcccatgtctcccgtgacatctgcccacgccggtacttatcgctgctatggatcctactcgtctaatccccacctactgagccacccatccgagccactcgagttggtcgtgagcggtcactccggtggcagtagtctgccacccacaggacctccaagcaccccagggctcggaaggtatctggaagttctgattggcgtttccgtggcctttgtactgcttttgttcttgctactcttcctgctattacgacgccagcggcactctaagcatcggacttccgaccaaaggaaaaccgattttcaacgaccggctggtgcagccgaaaccgagccaaaagataggggattgctgcgtcgctcctccccagctgccgatgttcaagaggagaacttatacgccgccgtgaaggacacgcagtccgaggatcgtgtggagctcgactcacaaagcccccatgatgaagaccctcaggccgtgacctacgcacccgtgaaacacagttcccccaggagggaaatggcatcaccaccgagtagcctgtcaggtgaatttttagacacaaaggatagacaagtggaagaagatcggcaaatggacaccgaggccgctgcatctgaagcttcacaagatgtgacctatgcccagctgcattcactaactcttcggcgcaaagcaacggaaccacccccatcccaggaaggtgagcccccagccgagcccagcatctacgccactctcgcaatccattag

SEQ ID NO: 122249 - DNA, 1947 bp, Artificial Sequence
  Description of Artificial Sequence: Synthetic coding sequence
atgacgcccgccctcacagccctcctttgcctcgggctaagcctgggcccgcggacacgggtgcaggccggcccatttccaaagcccactctgtgggctgaacccggaagtgtcatctcctggggaagccccgtcaccatctggtgccagggaagcctcgaggcacaggagtaccaactggataaagaaggttcacccgagccactggatagaaataacccccttgagccaaaaaataaggctagattctccattccttctatgacacagcaccacgcaggtcggtaccgttgtcactattacagttccgctgggtggtcggagccttccgaccctcttgagctcgtgatgacgggggcttactctaaacccactctttctgcacttccatcaccagtggtcgcgagcggcggcaatatgacactccgttgcggctcccagaagggctatcatcatttcgtactgatgaaagaaggtgaacaccagctgcccagaaccctcgacagccagcaattacattctcggggctttcaagctctctttcccgttggaccagtgactcccagtcatagatggcggtttacttgctattattactacaccaacaccccttgggtgtggagccatcccagcgatccgctcgaaattttaccttctggtgttagtcgcaagccctcacttctgactctccagggccctgttctcgcgcccgggcagtcactgactttgcaatgcggaagcgatgtgggatacaatcgatttgtgctgtacaaagagggcgaacgtgattttctccagagaccgggtcagcagccccaggctggtcttagtcaggccaattttactcttggacccgtgtcaccatccaacggtgggcagtacagatgctacggagcccacaacctgtcatctgagtggtctgccccctcagacccacttaacatcctgatggcaggtcagatctatgacactgtgtcactctccgcacagcctggcccgacagttgccagcggcgaaaatgtgacgcttctgtgtcagagctggtggcagtttgacacctttcttctcacgaaggaaggcgctgctcaccctcctttacggttgagatcaatgtatggcgcccacaagtaccaggccgagttccccatgtcacccgtcacctctgcgcatgccggcacgtaccgatgctacgggtcatacagttctaatccgcacctgctttcacacccgtccgagccattggaactagtcgtgagcgggcacagcgggggttcatcactgccacctaccgggcccccttccacccctggaggcccggaagatcagcctctcaacccgcccggtagcggacctcagaaccgattggggcgttacctggaagtgctcattggcgtatcggtagcctttgtgctcctgttatttcttctgctctttctactattgcggcgtcagaggcacagtaagcatcgcacaagtgatcaacgaaagaccgattttcaacggcctgctggtgccgccgagacagagccaaaagaccgcggccttctcaggcggtctagccccgcagcagatgtgcaggaagagaacctatatgctgccgtgaaagacactcagagtgaggatcgcgtggaactcgattcacaatctccccacgacgaggatcctcaagccgtgacatacgcacccgtgaagcactcaagtcccaggcgggagatggcctctccgccatcgtctttaagtggggagtttttggacacaaaagaccgtcaggtagaggaggatcggcagatggacactgaggccgcagcctctgaggcgtctcaggacgtcacctatgctcagctgcacagcctaacactccgtcggaaggcaacggagccccctccatcccaggagggcgagccccctgccgaacccagcatatacgccactcttgctatccattag

SEQ ID NO: 122250 - DNA, 1896 bp, Artificial Sequence
  Description of Artificial Sequence: Synthetic coding sequence
atgacccccgccctgaccgctttgctctgcttgggcctatctcttggcccacggacccgcgtgcaggccgggccatttccaaagccaacactgtgggctgagcctggcagcgtcatctcgtgggggtctcccgtgacaatttggtgtcaaggatctcaggaggcccaggaatatagactccataaagagggttcacccgagcccctggaccggaataaccccctagagccaaagaacaaggctaggttttctattccttccatgaccgaacatcacgctggcaggtacagatgccattactattcaagtgcaggatggtccgagccctctgatcctctggaaatggtcatgaccggagcctattcaaaacctacattgagtgccttgccttcacccgtggtcgcatcaggtgggaatatgacactacggtgtggcagtcagaagggctaccaccacttcgtccttatgaaggagggcgagcaccaactgcctcgcacgctggattctcagcagctccactctaggggttttcaagcactattcccagtgggcccagtaaccccgtcccatcgctggcgctttacgtgctattactattatacaaatacaccatgggtgtggtcccatccaagcgatccacttgaaatcttgccaagcggtgtgtcccgcaaaccgagtctacttaccctccagggcccagtcctcgcccccggtcagtccctgacactgcagtgtggtagcgatgttggctacaaccggtttgtgctctacaaggagggagagcgtgacttcttgcagaggccagggcagcagccacaggccggactgtcacaggccaacttcaccctgggaccagtgagtccgagtaacggtggccagtataggtgctacggtgcccacaacctgtcaagcgaatggtcagccccatcagaccccttgaacattctcatggccggccaaatatacgataccgtgagcctgagtgctcagcccggacctaccgtggcctccggagaaaacgtcacactgctgtgccaatcttggtggcagtttgatacttttttactgaccaaagagggggctgcccatcctcccttacgtttgcggtccatgtatggagctcataaatatcaggccgagttccctatgagccccgtgacctctgcccatgctgggacctacaggtgctacgggtcctactcctccaacccacacctgctgagtcacccaagtgaaccacttgaattagtagtgagcggacattccggaggaagctcattaccacccacgggaccgccttccacccctggcttgggtcgctacctcgaggtgttaatcggtgtgagtgtcgcttttgtactgctgctcttcttactgttattcctgctgctccgaagacaacggcattccaagcaccgcacctcagatcagcgcaagactgactttcagaggcctgcaggcgctgctgaaacagagcctaaagatcgaggccttctgcgacggtcgagtccagccgccgacgtgcaggaggaaaatctgtacgcagccgttaaagacacacagtcagaggaccgggtggaattggattctcagagcccccacgatgaagacccacaggctgtcacatacgctccagtgaaacactcatcccccagacgggaaatggccagtcctccctcgtcacttagcggagaattcctcgacacaaaggatcgccaggtcgaagaagacaggcagatggacacagaagctgccgcctcagaggcgtcccaggacgttacttacgcccagctccatagtctcaccctccggcggaaggccaccgaaccacccccaagccaggagggggagcctcctgccgagccgtctatctatgctacactggctatacattag

SEQ ID NO: 122251 - DNA, 477 bp, Artificial Sequence
  Description of Artificial Sequence: Synthetic coding sequence
atgacacctgctctgacagccttgctgtgtttggggctgtctcttggccctcggacgcgagttcaggcaggacctttccctaaacctactctctgggccgaacctggctcagtcatctcctggggttccccagtcaccatttggtgccagggatcgcaggaggcccaggagtaccggctgcacaaagaggggtccccggagccgttagatagaaacaacccattagaacccaagaataaggcccgattctcgatcccttcaatgaccgagcaccatgctggcaggtacagatgccactactacagctctgctgggtggtctgaaccaagcgatccacttgaaatggtaatgactggcgcttatagtaagccaacgttgtccgcactgccgtcccccgtcgttgcgtcgggtggaaacatgacccttaggtgtgggagtcagaaaggctaccatcatttcgtccttatgaaagaatag

SEQ ID NO: 122252 - DNA, 1347 bp, Artificial Sequence
  Description of Artificial Sequence: Synthetic coding sequence
atgatcccaacttttacagccctgctgtgcctggggctgagtttaggccctcgtacccacatgcaggctggtcctctgcctaaacctaccctgtgggctgagccagggagcgtgatttcctggggaaactctgtcaccatttggtgtcaagggacacttgaggcccgagagtacaggcttgacaaggaggagtctcctgccccttgggatcggcagaatcccctcgaaccaaaaaataaagcccgattctctattccctccatgacagaagactatgcgggcaggtacagatgttattataggtcccctgtcggatggtcacagccgtcagatcccctcgagttggtcatgaccggagcctactctaagccaactctctctgctttgcccagccctctcgtgacttctggcaaatcagtaaccctcttgtgtcagtctcggtcacctatggacactttcctgctgatcaaggagagagccgcccacccactcctgcatctgcgctctgagcacggggctcagcagcatcaggctgaatttcccatgtctccagtcacctccgtccatggaggcacatataggtgcttctcatcacacgggttcagccactacttactgtcccatccctcagatccgctcgaactaattgtctcagggtctctggaggaccctcgaccatcgcctaccaggagcgtgagtacggccgctggccccgaggaccagccacttatgccgaccggaagcgtgccacactccggccttcggagacactgggaggtcttaatcggcgtgttggtagtaagcattctcctcctgtcgttgttattatttctcttgctgcagcattggcgacaggggaaacatcggactctggctcagcgacaggcagacttccagagaccccctggagccgcagagccagaacccaaagacggaggcctccagcggagatccagccctgccgctgacgtgcagggcgagaacttctgcgccgcggttaaaaacacccagcctgaggatggtgttgagatggatacgaggcagtcaccccacgatgaggatccacaggctgtcacgtacgcaaaagtgaaacactccaggccacgacgcgaaatggccagccccccgtctcccctatctggcgaatttttagacacaaaagacaggcaggccgaggaggatagacagatggacacagaggcggcggcttccgaagcaccacaggacgtaacttacgcccaattgcactcttttactctgcgacagaaggcgacagaaccccctccatcacaggaaggggcctcccctgctgaaccctcggtgtacgccaccctggcgatccattag

SEQ ID NO: 122253 - DNA, 1347 bp, Artificial Sequence
  Description of Artificial Sequence: Synthetic coding sequence
atgattcctacatttaccgctttgttgtgcctcggtctgtctcttggacctaggacccacatgcaggctggtcctctgccaaagccaacgttatgggcagagcctggctctgtgatttcttggggaaactccgttaccatttggtgccagggcacactggaagcaagagagtaccggcttgacaaggaggagagtccagcaccatgggataggcagaatccactcgaacccaagaacaaagcacggttcagcattccgagtatgaccgaggactatgccggtaggtaccggtgttactatagatcaccggtgggctggtctcaaccatctgaccccctagaactggtaatgaccggcgcctattcaaaacctacgctgtcagctctgccctctcctctggtcaccagtgggaagagcgtgacgttgctctgtcagtcaagaagtcctatggacacattcctcttgattaaggaacgggccgctcatccactgcttcatcttcgctcagagcatggagcccagcagcatcaggccgaattccccatgtcaccagtaacctccgtacacggcggcacttaccgctgtttcagctctcacggctttagtcactacctgttatctcatccttccgacccacttgagctgatagtgagcggaagtctggaggatccaaggccaagccccacacgttccgtgagtaccgctgcaggacccgaggatcagcccttgatgcccacagggtctgtgcctcattcaggactgcgaagacattgggaagtgctcatcggcgtactggtcgtatcgattttgcttttgtccttgctcttgttcctgttactacaacactggcgtcagggaaaacaccggacactggctcagcggcaggccgattttcagaggcccccaggcgcagcggaacccgagccaaaagacggtggattgcaaagacgttcaagtccagcggcagacgtgcagggggagaacttttgcgcagcagtaaagaacacccagcccgaggacggggtggaaatggacaccagacagagccctcacgatgaggatcctcaggcggtgacgtacgccaaggtaaaacacagccggccaaggcgggagatggcatctcctccatcaccactgtctggcgagttccttgatacaaaggaccgacaggccgaggaggaccgacagatggacacggaagctgcagcctccgaagcacctcaggatgtgacatatgcacaactacactccttcacccttcgacagaaggcaacagagccccctcctagccaagagggcgcctctcccgctgaaccctctgtttatgctactcttgccattcattag

SEQ ID NO: 122254 - DNA, 1773 bp, Artificial Sequence
  Description of Artificial Sequence: Synthetic coding sequence
atgacactgactctctcagtattgatttgcctcggattgtctgttggaccaagaacttgtgtgcaggcaggaacattacctaagccaacgctctgggcggagcctgcctctgtgattgcaaggggaaaacccgttactctctggtgtcaaggcccccttgaaaccgaagaataccgcctcgataaggaaggactgccctgggcgagaaaacgacagaatcctcttgaaccgggagcgaaggccaagtttcatatacccagcacagtctatgattccgctggacggtaccgatgctactacgagactcctgcgggatggtccgagccatcagacccgcttgaactagtcgcaaccgggttctacgcagagcctactcttttggcactgccaagtcctgtcgtggcctctgggggaaatgttacactacagtgcgacaccttagacggcttgctgaccttcgttctggtggaagaagagcagaaactgcctcggactttgtattcccagaagctgcccaagggaccatctcaagccttgtttccagtggggccggtcactcctagttgcagatggcggttccgatgctactactactacagaaagaatccgcaggtctggtccaatccatctgacttgttagaaatcctcgtgccaggagtgagccggaagccttcactccttatcccccagggcagtgttgttgcgagaggcgggtcgctaacactgcaatgcaggagtgacgtgggatacgatatatttgtgctttataaagaaggcgaacatgacctcgtgcaggggtcaggccagcagccccaggccggactgagccaggctaatttcaccttaggtcccgtatccaggagccacggcggacagtatcgctgttacggcgcccacaatctgagcccgcgctggtccgcaccaagtgatcccctggatatcctaatcgccggactgataccggatataccggccctctcagtacagccgggaccaaaagtggcgagtggagaaaacgtgacgctcctttgtcagtcttggcatcagatcgacaccttctttttaaccaaagaaggagcagctcatccccctctgtgtttaaagagcaaataccagtcttataggcaccaagccgagttctctatgagtcctgtgacgagcgctcaaggcggaacctacagatgttattctgcgataaggtcctatccctatctgctgtcttctccatcttacccccaggagctggttgtatcagggcctagcggcgacccaagtctgtccccgacaggatccacccccacccctggccccgaagatcagcccctgactcctactggacttgacccacagagcgggttggggcgccacctcggggtggtgactggcgtttctgtggccttcgtcttactgttgtttctcctgttgttccttctgctcagacaccgacaccaaagcaaacatagaactagcgcacatttctatcgtcccgccggagccgccggtcccgagccaaaagatcaaggtcttcagaagagagctagcccagttgcagatattcaagaagaaatcttgaacgcagccgtgaaagacacgcagcccaaagacggcgtcgaaatggatgccagagccgctgcttctgaagcgcctcaggatgtgacatacgcccagctgcattccctgacattgcggagggaggctacagagcctcctccaagccaggagcgtgagccccccgccgaaccttccatctacgcaccactagcaatccattag

SEQ ID NO: 122255 - DNA, 1776 bp, Artificial Sequence
  Description of Artificial Sequence: Synthetic coding sequence
atgacgctgactctgagcgttctgatctgccttggtctgtcggtaggacccagaacatgcgttcaggccgggaccctcccaaagccaactttgtgggccgagcccgcaagtgtgattgctcgtggcaagccagtgaccctctggtgccaggggcctcttgagaccgaggagtacaggttggataaagaagggcttccatgggccagaaagcggcagaatcccttggaaccaggggcgaaagcgaagtttcacatacccagcacagtgtacgatagtgcgggcagatatcgctgctactatgagaccccggctggatggagtgagccctctgatcctctggagctggtggcgactgggttctacgctgaacccactctcctcgccttgccttcccccgttgtggcttcagggggaaacgtgacactacagtgcgacactctcgatggacttctgacatttgttttagtcgaggaagaacagaaattgcctcgtacgctgtactcccagaaacttcccaaaggcccatcacaggccctgtttccagtgggccctgtaacaccctcgtgcaggtggcgcttcagatgctattactattacaggaagaatccccaggtgtggtcaaatccctctgatctgcttgaaatcctggtccccggcgtgtcacgcaagccctcactcctaatcccgcagggatccgtcgtagctcggggggggagtctaaccctgcagtgtaggagtgatgtgggttatgacattttcgtgctttacaaggagggtgagcatgacctcgttcaggggtccggacagcaaccgcaggcggggctgtcacaggccaacttcactctgggtccggtttcccgttcacacggcggccagtacagatgttatggagcccataatctgagtcccaggtggtcggccccaagcgaccctctcgatatcctcatcgccggacttattccggatatcccagccctgtctgttcagcccggccctaaggtggcctccggcgaaaacgtgactctgctatgccagtcatggcaccaaatcgacactttttttttgacaaaggagggcgccgctcatccgccactgtgtctgaagtctaagtaccagagttacaggcatcaggccgaattctcaatgagcccagtcacctctgcccaaggcggaacgtatcgatgctactcagctatcagaagttacccttacttactctcctcaccttcttacccacaggagttggttgtcagtggaccgtccggagatcccagtctgtctccaacaggatcgacacctactcctgccgggccggaggatcagcctcttacacctacaggattggatcctcagtccgggctcggaagacacctaggcgtcgttactggagtgtctgtggcatttgtgctgctgctctttctgctcctgtttttgctcctcagacaccgccaccaaagcaagcataggacctcggcccacttttaccgccctgccggcgctgccggaccagagcctaaggaccagggactgcagaaacgagccagtcccgtggctgatattcaggaggagatactgaatgctgccgttaaggacacccaaccaaaagacggcgtcgaaatggatgcccgggcagcagcctctgaggcccctcaggacgtcacatatgcgcagttgcattcccttaccctgaggcgcgaggcgaccgagcctcccccaagccaggagagggaaccacctgcagagccttcaatttacgcccccctggctatacattag

SEQ ID NO: 122256 - DNA, 1869 bp, Artificial Sequence
  Description of Artificial Sequence: Synthetic coding sequence
atgactcttacacttagcgtgctgatctgcctcggtctctccgttggcccccgcacttgcgtgcaggccggaactctgccaaagccaactttatgggccgaaccagcttcagtgatcgcccgcggaaagcccgtgacactgtggtgccagggcccccttgagaccgaagaataccgattggacaaagaagggctgccatgggcccgtaagaggcaaaaccctctagagcccggggcaaaggctaagtttcacatccctagcactgtctatgattccgccggaagataccgttgttattacgagacgcctgcaggatggagcgaacctagcgaccccttggaactggtggccacggctctgccttcaccggtcgttgcctccgggggtaatgtgactttgcagtgcgataccctggacggcctcttgaccttcgtgctggttgaagaagaacagaagctgccaagaaccttatattctcagaagctgcccaagggccccagccaggcgctgtttccagttgggccagtgacaccttcctgcagatggcgttttagatgctattactattatcgcaagaatccacaggtgtggtccaacccgagtgacctgctggagatcttggtgcctggcgtttcacgcaaaccaagtctgctaatccctcagggatctgtggtagcccgagggggaagccttacattgcagtgcagaagcgacgtcgggtatgatatattcgtgctttacaaggagggagagcatgacttggttcagggaagcgggcagcaacctcaggccggactgtctcaggccaacttcactctcgggcctgtgagcaggagccatggcgggcagtatcgctgctatggagcacacaatctctcccctcggtggagtgctccatcagacccgctggacattctgatagccggcctcatccctgatattcccgccttgtccgtacagccaggccccaaagtcgcttctggtgagaacgtgacactgttgtgtcagagctggcaccagatagacaccttctttcttaccaaggaaggggcagcacaccctccactctgtctcaagtctaagtaccaatcatatagacaccaggccgagttttccatgtccccagtgacttctgcccagggcgggacataccggtgctattcggccattcggtcttacccgtacctgctgagttctccaagctatccccaggaactggtggtgagtggcccatccggcgatccttccctaagtcctaccggaagcaccccaacccctgcaggaccagaagatcagcctttgactccaaccgggctggacccgcagagtggcctgggccgccatcttggggtggtgacaggagtatcagtcgcctttgtcctgcttcttttcttgctccttttcctgctcttacgtcatcgacaccagtctaagcaccgcactagtgctcacttttatcggcctgctggcgccgcgggaccggaaccaaaggaccagggccttcagaagagagcatccccagtggctgatattcaggaggagattctaaatgctgccgtgaaggatacacaacctaaggacggtgtcgagatggatgcgcggcagtcaccacatgacgaggacccacaggccgtcacctacgcagaggtcaagcattcgcggcctagacgagagatggccagcccgccctcccccctgtccggtgagttcttagacacgaaagatcggcaggctgaggaggataggcaaatggatacggaacgggtgctcagttcaccaggcccccaagcctcacctccccccccccgctctctcccacttactctgccaaggtgtcgcctactgcatctgaagccgcctcgaatgtag

SEQ ID NO: 122257 - DNA, 2595 bp, Artificial Sequence
  Description of Artificial Sequence: Synthetic coding sequence
atgggctgctggggtcagcttctggtctggttcggggcagccggagctatactgtgcagctcccctggcagccaggaaacttttctgcgaagtagccccctgccccttgcctccccctcacctagagaccccaaggttagcgcacccccctccatactggaaccagcatctcccctgaacagccctggtaccgaaggctcttggctttttagtacctgcggcgcctcaggacgccatggccctacacagacacagtgtgacggcgcttacgcaggcacctctgtagtggtgactgtcggtgctgccgggcagctgcgaggtgtgcagctgtggcgcgtccccggccccggtcagtaccttattagcgcctatggcgccgctgggggtaagggtgctaagaaccatctgtcacgggctcacggagtgtttgtgtcagcaatattttcgttgggcctgggcgagagcctctacatcctggtgggacagcagggagaggatgcatgccccgggggctcgccagaatcccagcttgtttgcctcggagagtctcgcgctgttgaggaacacgccgccatggatggaagcgagggagtccccggctccagaagatgggctggtggaggaggcggcggaggcggagccacttacgtgtttagggtgcgcgctggggagctggaacctctccttgtcgctgctggaggtggcggccgcgcctacttacgccctcgggatcggggccggacccaggcttccccagaaaagctggaaaatcgctccgaagccccggggtcaggcggccgtggaggagccgcaggtggaggtggtgggtggacatctcgcgctcctagccctcaggctggtcggtctttacaggagggggccgaaggcggtcaaggctgcagcgaggcctgggccactctcgggtgggcagcagctggcggctttgggggcgggggaggggcttgcacggcaggcggaggcgggggggggtatcgcggaggagacgcctctgagaccgataatctatgggcagatggagaggatggagtgagcttcattcatccctcaagtgagttgttcctgcagccacttgcggtgaccgaaaaccacggtgaggttgagattcgacggcatcttaactgttcccactgtccacttagggattgccagtggcaggctgagctgcagttagccgaatgtctgtgtccagaaggaatggaattagccgtagataatgtaacctgcatggatttgcacaagccaccggggcccctggtgcttatggtcgctgtcgtagctacaagcaccctttcattattaatggtgtgtggtgtgctgatccttgtgaagcagaaaaagtggcagggccttcaagaaatgaggctgccctcccctgagctggagctaagcaagctccggacgtctgcaatccggacagctccaaacccctattactgccaggtggggctgggaccagcacagtcctggcctctgcctcccggagtaacggaggtgagccctgctaatgtgacccttcttcgcgctctaggacatggggcatttggggaagtgtacgaagggttggtgattggactccctggagactcaagcccactacaggtggccattaaaacccttcctgagctctgttctcctcaggacgagctagactttctaatggaagcacttataatatctaaatttcgacatcaaaacatagtgaggtgcgtggggctaagtctgcgggctactccacgtctgatcctgcttgaactaatgagtgggggagatatgaagtctttcttgcggcacagtagacctcacctgggacaaccttcacccctcgtcatgagggacctcctacagcttgcccaagatatcgcccagggttgtcactatctagaggagaaccacttcatccaccgggatatagccgcaaggaattgtctcctgtcttgtgccggcccctcacgagtggcgaaaattggagacttcggcatggcacgtgacatctatcgcgccagctactatagacggggcgacagagccctgctgccagtgaagtggatgccacctgaggccttcctggaaggtatttttactagtaagacggatagctggagtttcggtgttttgctgtgggaaatctttagcctgggttacatgccatacccaggtagaacaaatcaggaggtgttagacttcgttgtgggtggcggccgcatggatcccccgcgcggctgccctgggcccgtttaccgcatcatgacgcagtgctggcagcacgaacccgaattgcgaccctcatttgcgtctatccttgagcggctccagtattgcacacaggacccagacgtcctgaatagtcttctgccaatggaacttggaccaacacccgaggaagagggcacaagtggcctcggaaaccggtccctggagtgtctgcgcccgccacaacctcaggaactatccccagaaaagttgaagtcttggggcggcagtcccctgggtccgtggctttcttctgggctgaagcctcttaaaagcagaggcttgcaaccgcagaacctttggaaccccacttacaggtcatag

SEQ ID NO: 122258 - DNA, 2412 bp, Artificial Sequence
  Description of Artificial Sequence: Synthetic coding sequence
atgggatgttggggccagctgcttgtgtggtttggggccgccggtgccatcctctgcagttccccggggtctcaagagaccttccttcgtagcagcccattgccgctggcatctcctagtcccagagatccgaaagtctcggcccctccttccattcttgaaccagcttctccgttgaactcgcctggtaccgagggcagctggttgttctccacatgtggcgctagcggccggcacggccctacacagacacaatgtgatggcgcttacgccggcacatctgtggtcgtcacagtgggcgcagccgggcaacttagaggcgtgcagttgtggagggtgccgggacctgggcagtacctcattagtgcttacggtgccgctggcggtaagggcgcaaaaaatcacctgagtcgtgcacatggagtgtttgtgagtgccattttctctctggggctgggagagtccttatatatcctggtcggccagcaaggtgaggatgcctgccccggcggaagtcctgagagtcagctggtctgcctcggtgaatctcgcgctgtggaggagcacgccgctatggatgggtctgaaggcgtgccaggaagcagaaggtgggctggcgggggaggcggggggggaggggccacttacgtcttccgggtcagggcgggcgagctggagcccttgctagtcgcggccggaggaggcggccgagcatatcttcgtccccgagacagaggccgaacccaggcgagcccagaaaagctggagaacaggtccgaagcaccgggaagtggcggcaggggcggcgcagctgggggtgatgctagcgagaccgataacctttgggccgatggtgaggacggggtctcgttcattcacccctcatccgagttatttctccagccactcgctgtcacagagaaccatggcgaggtagagatccgtaggcacctcaactgtagccactgcccactgagagactgtcagtggcaagcagaactgcagttagctgagtgcctgtgccctgaagggatggagctcgctgtggataacgtcacctgtatggacctgcataaaccaccgggccctctggtgctaatggttgctgtcgtggccaccagcaccctgtcgctgctcatggtgtgtggggtcctcatcctggtgaaacagaagaagtggcaagggttgcaggaaatgagacttccttcacccgaattggaactttcaaagctgaggacatcggcgatccggacagcgccaaatccttattattgtcaggtcggcctggggccagcacaatcatggccgcttcccccgggggtcaccgaggtgtcgcccgccaatgtgacattgctccgcgccctggggcacggagcgtttggggaagtctacgaagggttggtaatcggactccctggggactcatcgcccctgcaggttgcgattaaaacccttcctgagctgtgctccccacaagacgaactcgacttcttaatggaggcgctgatcatctctaagttccggcaccagaacattgtgcggtgcgtcggactcagccttcgggcaacaccccgtctgattctgctggagctaatgagcggcggggacatgaagagcttcctgagacattccaggccacatctgggccaaccctcgcccttggtcatgagggatctgttacagctggcccaggacatcgctcaaggatgccactaccttgaagaaaaccactttatccacagggacattgccgcccgaaattgtctacttagctgcgctggaccctcgagggtcgcaaagatcggggatttcggcatggctcgcgacatatacagggcttcatactatcgacggggagatcgagcactgctgcctgttaagtggatgccacccgaagcttttttagaggggattttcacctccaaaacagactcatggagctttggtgtgttactgtgggaaatcttcagcttggggtatatgccttaccctggccggacaaatcaagaggttttggatttcgtggtcggtgggggcaggatggatccgcctagaggttgccctggccccgtgtaccgcatcatgacacagtgttggcaacatgaacccgagttgcgaccaagctttgcttctatcctggagcgactgcagtactgcacgcaggacccagatgtgctgaattctctcctgcctatggagttgggtccaaccccagaagaggagggcacatccgggctcggtaatcgcagtcttgaatgtctgcgtccacctcaaccccaggagctgtcccccgagaagctgaagagctgggggggttcccccctgggcccttggttgtccagcggcctcaagcccctgaagtctcgcggtcttcaaccgcaaaacttatggaaccccacgtacagaagttag

SEQ ID NO: 122259 - DNA, 1437 bp, Artificial Sequence
  Description of Artificial Sequence: Synthetic coding sequence
atggggtgctggggtcagctgcttgtctggtttggagcggccggggccatcctgtgtagctcacccgggagccaggagacctttttgaggtcttctccactacccctcgcttctccttccccccgtgaccccaaggtttcggcacccccgtccatcctcgagccagcaagccccctcaattctccgggaacggaggggtcatggctcttctcaacctgcggagccagcggccgacacggtcctacccagactcagtgcgatggcgcttacgccggtacttctgtggtggtgaccgtcggcgccgctggacagttaaggggcgtgcagctatggcgtgtgccaggacccggccagtatttgataagcgcttatggagctgcaggcggcaaaggggccaagaatcatctctccagggcccacggcgtgttcgtaagtgccatcttctccctcggactgggtgagagtctctatatccttgtggggcagcagggtgaggacgcctgccccgggggttcaccagaatcccagctcgtctgtcttggcgagagtagggctgtcgaggaacatgcagccatggacggctcggaaggggtcccagggagcaggcggtgggcaggtggcgggggtggaggcgggggcgccacgtacgtgttcagggttagagcaggcgaactggagcccttactggttgccgccggaggcggagggagagcctacctgcgtcctcgtgatcgggggcgcacacaagcttcccccgagaaattggagaatcggagtgaagcccccgggtctggtggcaggggaggggcagccgggggcggcggcggctggacgagtcgcgccccatcccctcaggcagggaggtccctgcaggagggtgctgagggcgggcaagggtgctccgaggcctgggccacactggggtgggctgctgcaggggggttcggaggcgggggcggcgcctgtacagcaggcggcggtgggggtggatataggggtggtgacgcctctgagaccgataacctctgggccgacggtgaggatggcgtctcttttatccatccaagcagcgagttattcttacaaccactcgctgtgactgagaaccacggcgaagtagagatcaggaggcatctgaactgttctcactgtcccctgcgggattgtcagtggcaggccgagttgcagctggcagagtgtctgtgtcccgaggggatggagctggcagtcgacaatgtgacctgcatggatctgcataagccacctgggcctttggtcttaatggtcgcagttgtagctacctctaccttatcactcctgatggtatgcggggtgttaatcctcggaacaaagcgcctagctgggaccgttgactcaaggctgctcctgtctagcgagttgggctgggtgagcgctggtggcggaagaaggaggtag

SEQ ID NO: 122260 - DNA, 2205 bp, Artificial Sequence
  Description of Artificial Sequence: Synthetic coding sequence
atgggctgctggggccagcttctagtttggtttggggctgccggggcaatcctgtgcagcagcccggggtcccaagagacctttctgagatctagcccgcttccgctggcttctccatcacccagagaccctaaagtcagtgcccccccttctattctggagcccgcttcaccgcttaactcgcccggaacagagggttcttggctgttttccacatgcggagccagcggtagacatgggccgactcagacacagtgcgacggggcatacgccggtaccagtgtcgtggtgactgtcggagccgctggtcagcttaggggggtgcagctttggcgcgttcctggccccggtcagtacctgatttctgcatacggcgccgccgggggcaaaggggctaagaatcatttgagtcgggcccatggggtttttgtctccgcaatcttctctctgggactgggcgaatctctctacatccttgtgggacagcagggcgaggatgcctgccccggcgggagcccggaaagccagctagtgtgcctgggcgagagccgcgcagtggaagagcatgccgccatggatggctctgagggtgtgccaggctcccggcggtgggccggtggaggcggagggggaggaggagccacctacgtattcagggtgcgcgcaggcgagctagagcctctacttgtcgctgcaggcggggggggacgagcctatttaaggcctcgggacaggggccgaactcaagcaagtcccgagaaacttgagaatcgctccgaggctcccggcagtggcggtagagggggtgccgccgggggcgatgctagcgagaccgacaatttgtgggccgacggggaggatggcgtttcatttatacatccatcaagcgaattattcctacagcctcttgcagtgacagagaatcatggagaggtggagatcagaagacatcttaactgtagccactgcccccttcgcgattgtcaatggcaggcggagttgcagctggctgagtgcctctgtcctgaagggatggagcttgctgtggacaacgtgacctgcatggacctgcataagcctcctgggcccctcgtattgatggttgcggtcgtggccacaagtacgttgtcactcttaatggtgtgcggcgtactgatcctggggggcgcctggccagggcccgtgctagcctccgctacccgttgtcaccggggatttccatcccaatgttattccgctcagactctgcccgaattgtgctctccccaggatgagttagactttctcatggaggctttaattatcagtaaattcagacaccaaaatatcgtgaggtgcgtgggattgagccttagggccaccccacgattgattctgctggaactcatgagcgggggtgacatgaagagttttttacgtcacagtagaccgcatttaggtcaacccagcccattggtgatgagggacctgcttcagctggcccaggatatcgcccaggggtgccactacctggaagagaaccattttatccaccgcgatatcgccgctaggaactgcctcctcagctgtgccgggccttcccgcgtggccaagataggcgactttggcatggcaagagatatctacagggccagctattacaggaggggcgatcgagccctgctgcctgtgaagtggatgcctccagaagccttcctcgaaggcattttcaccagcaaaactgactcctggtcttttggagttctgctgtgggagatcttctctctgggttacatgccttacccaggcaggacaaaccaggaggttctagatttcgtcgtgggggggggccgtatggatccacctaggggctgccccggcccggtgtaccgaatcatgacccaatgttggcagcacgagcctgaactgcggccgtcgtttgcctcaatcctcgagaggctgcagtactgcacccaagatccggatgtcctgaactcgttgttgcccatggaactggggcctacccccgaggaagagggcaccagtggactcggaaataggtcgttagagtgcttgcgcccaccgcagccccaggagctgtcacccgagaagctgaagtcctggggtggctctccactcggcccgtggctttcatcaggcctcaagccactgaagagtcgcggcctgcagccacagaatctctggaaccccacatatcgctcatag

SEQ ID NO: 122261 - DNA, 180 bp, Artificial Sequence
  Description of Artificial Sequence: Synthetic coding sequence
atgctgagcagaaatgacgacatttgtatctacgggggccttggtttaggcgggctcctgctgctggctgtggtactcctgtccgcctgcctttgctggttgcataggagaggccctggcctcttgcgcgcaggaactccgctatgtattagcgccgaggccgcctccgcacagcagtag

SEQ ID NO: 122262 - DNA, 201 bp, Artificial Sequence
  Description of Artificial Sequence: Synthetic coding sequence
atgctcagcaggaacgatgacatctgtatatacggaggactaggcctcggggggctcctcctgctagccgtcgtactcctttccgcctgtttatgctggttgcatcggagagcaccaagtgtgctggtgcccggacccggccttctgagggccggaacacccctatgcatcagcgcagaagccgcgtccgcccaacaatag

SEQ ID NO: 122263 - DNA, 222 bp, Artificial Sequence
  Description of Artificial Sequence: Synthetic coding sequence
atgcttagccggaatgacgtgaagcgcctggaaagatcctggcacttactttcatggtcccaggcccaggggagcagcgaacaggagcttcactatgcttcccttcaaaggctgcctgtgccttcaagcgaggggcccgacttgcgaggtcgggataaaagaggaacgaaagaagatccaagggccgactacgcttgcatcgccgagaataagcctacatag

SEQ ID NO: 122264 - DNA, 201 bp, Artificial Sequence
  Description of Artificial Sequence: Synthetic coding sequence
atgctgtcacggaacgacgtgaagcgcctcgagcgcagctgggcacagggttcatccgagcaggaactgcattatgctagtcttcagcgcctgccagtgccatcctcagaaggccccgatcttaggggacgggacaaaaggggcaccaaggaagacccaagagcagactatgcatgtatcgcagagaacaagcccacatag

SEQ ID NO: 122265 - DNA, 108 bp, Artificial Sequence
  Description of Artificial Sequence: Synthetic coding sequence
atgttaagccgaaatgatgcaccgtcggttctcgtcccgggcccggggctgctgagggccggcacacccttatgcatctccgccgaagccgcttcagcacagcaatag

SEQ ID NO: 122266 - DNA, 315 bp, Artificial Sequence
  Description of Artificial Sequence: Synthetic coding sequence
atgctgagcagaaacgatgatatttgtatctacggagggctgggactcggtgggctgctattgcttgcagtggtgcttttgagtgcatgtttgtgttggttgcacagacgcgtgaagagactggagcgctcatggcacctgctgtcttggtcacaggcacagggaagtagcgaacaagaattacattacgccagcctacagcgattgccagtgccgagtagtgagggtccagatctcagggggagagacaagagagggactaaggaagatcctagagcagattatgcctgtatcgctgaaaataagcccacttag

SEQ ID NO: 122267 - DNA, 42 bp, Artificial Sequence
  Description of Artificial Sequence: Synthetic coding sequence
atgctgtcacgaaacgatgaggccgcgtctgcacagcagtag

SEQ ID NO: 122268 - DNA, 108 bp, Artificial Sequence
  Description of Artificial Sequence: Synthetic coding sequence
atgttatcacggaatgacgccccctctgtcctagttcccgggccgggcttgctaagagccggaactccactctgcatttcagctgaagccgccagtgctcagcagtag

SEQ ID NO: 122269 - DNA, 276 bp, Artificial Sequence
  Description of Artificial Sequence: Synthetic coding sequence
atgatttatgtgtcgaccggcgcttggggctgggcaggcagttgtttctggcagtggtctttttgtccccccgcttgtgtaggttgtatcgaagagcacttgctctcgtggtcgcaggcccaaggttcctctgaacaagagctccactacgcttccctgcagagactgcccgtccccagcagcgaaggaccggatctgaggggacgtgacaaacgcggaaccaaagaggaccctagagcggattatgcttgcattgctgagaacaagcctacatag

SEQ ID NO: 122270 - DNA, 156 bp, Artificial Sequence
  Description of Artificial Sequence: Synthetic coding sequence
atgctgagtcggaacgacgtcaagaggctcgaacggagctggcggctgcccgtcccttcctctgagggccccgatctgcgcggcagagacaaacgaggcaccaaagaagacccaagagcagattacgcctgcatcgccgaaaataagcctacttag

SEQ ID NO: 122271 - DNA, 192 bp, Artificial Sequence
  Description of Artificial Sequence: Synthetic coding sequence
atgcacttgtgccggggctgtcaatgtccagccgtcagggacctgacatcaggcgctgagacccgggaggcgcccaggagaattcaggagctaaccatgcctgccctcctgcgtacaaaccctcccgagcatccccgacacctcccacagcccaggagggtggatagggtgccactgtggagttctcagtag

SEQ ID NO: 122272 - DNA, 222 bp, Artificial Sequence
  Description of Artificial Sequence: Synthetic coding sequence
atgctgagcagaaatgatgttaaacggttagaacgctcatggcacttactgtcatggtcccaggcccaagggtctagcgagcaggaattgcactacgccagtctgcaaagactcccggttccatcctccgaagggccagaccttcgcggtagagataaaagaggtactaaagaagatccgcgggccgactacgcatgtatcgccgaaaataaacctacatag

SEQ ID NO: 122273 - DNA, 108 bp, Artificial Sequence
  Description of Artificial Sequence: Synthetic coding sequence
atgctttctaggaacgacgctcctagcgtcctggtcccaggtccagggctcttgcgcgccggaactccgctgtgtatttccgccgaagccgcatctgcccagcagtag

SEQ ID NO: 122274 - DNA, 201 bp, Artificial Sequence
  Description of Artificial Sequence: Synthetic coding sequence
atgctgagtagaaacgacgacatctgcatttatggcggactggggctgggcggtctcctcctgctggctgtggtgctcctgagcgcttgcttgtgttggcttcataggagggctccatcggtgcttgtgccaggcccaggcctgctcagggctggtacccctttgtgcatcagcgcagaggcagccagcgcccaacagtag

SEQ ID NO: 122275 - DNA, 315 bp, Artificial Sequence
  Description of Artificial Sequence: Synthetic coding sequence
atgctaagtaggaatgacgatatctgcatttatgggggcctggggctgggaggattgttactgctcgctgttgtattgctgtccgcgtgcctgtgctggctgcaccgcagagtaaagcgactggaaagatcatggcacttgctttcttggtcccaagcccaggggtcaagtgagcaggaactgcactacgcatctctgcagagactgcctgtcccaagctctgagggtcctgatctgcgaggacgcgataagaggggcacgaaggaagatcctcgtgctgattatgcctgcatcgcggagaataaaccgacatag

SEQ ID NO: 122276 - DNA, 135 bp, Artificial Sequence
  Description of Artificial Sequence: Synthetic coding sequence
atgctgagcagaaatgacgacatctgtatctatggaggactcggcttggggggcctactgttgctggccgttgttcttctgagcgcgtgtctctgttggctccacagacgagaggccgctagcgcccaacagtag

SEQ ID NO: 122277 - DNA, 201 bp, Artificial Sequence
  Description of Artificial Sequence: Synthetic coding sequence
atgttgagccgaaatgacgacatatgcatctacggaggcctgggactcggagggctgctactgctcgcagtggttttgctgtcagcctgtctgtgttggcttcaccgacgcgtgaagcggctggagaggagttggcgcctgccagtcccatcatctgaaggccctgatctccgtggacgggacaagcgcggtactaagtag

SEQ ID NO: 122278 - DNA, 201 bp, Artificial Sequence
  Description of Artificial Sequence: Synthetic coding sequence
atgcttagccgcaatgatgtcaaacggttggagcgaagttgggcccagggctctagcgagcaagagttacattacgcgtcactgcaaagacttccagtgccaagctctgagggcccagacctgcggggacgcgacaaaagggggaccaaagaggatcccagggctgactatgcctgcatcgctgagaacaagcctacctag

SEQ ID NO: 122279 - DNA, 294 bp, Artificial Sequence
  Description of Artificial Sequence: Synthetic coding sequence
atgctctcaaggaatgacgacatatgcatctatggggggcttggcctgggaggactactgttacttgctgtcgtgttgctctccgcctgcttatgctggttgcatcgacgggttaaacgattagagaggagctgggctcagggcagctcagaacaggaactgcactatgccagcctgcagagactcccggtgccctccagtgaaggccctgatttgaggggacgagacaagaggggaaccaaagaggatccgagagctgattatgcctgtatagctgagaacaagcctacctag

SEQ ID NO: 122280 - DNA, 180 bp, Artificial Sequence
  Description of Artificial Sequence: Synthetic coding sequence
atgttgtcgagaaatgacgatatttgtatttacgggggcttgggactcgggggcctgctgctactggctgtcgtacttctgtccgcctgtctgtgttggctccatagacgcggacccggcctgctgcgagccggcaccccactttgcatcagcgccgaggcagcatcagctcagcagtag

SEQ ID NO: 122281 - DNA, 87 bp, Artificial Sequence
  Description of Artificial Sequence: Synthetic coding sequence
atgctgtctaggaacgatggcccaggtctgctgcgcgccgggaccccgctgtgtatctcggcagaagccgcatcggcgcagcaatag

SEQ ID NO: 122282 - DNA, 87 bp, Artificial Sequence
  Description of Artificial Sequence: Synthetic coding sequence
atgctcagcaggaacgacggcccaggtttactgcgagcaggtacccccctatgcatatccgcagaagctgctagcgcccagcagtag

SEQ ID NO: 122283 - DNA, 87 bp, Artificial Sequence
  Description of Artificial Sequence: Synthetic coding sequence
atgctcagcagaaacgacgggcctggcctcctacgcgccgggacccccctttgcattagcgccgaggccgcgtcggcccagcagtag

SEQ ID NO: 122284 - DNA, 87 bp, Artificial Sequence
  Description of Artificial Sequence: Synthetic coding sequence
atgctctcccgcaacgatgggccggggttgttaagagccggcacaccgctttgtatctcagccgaagctgcctcggcacagcaatag

SEQ ID NO: 122285 - DNA, 42 bp, Artificial Sequence
  Description of Artificial Sequence: Synthetic coding sequence
atgttaagccggaacgacgaggccgctagcgcacagcaatag

SEQ ID NO: 122286 - DNA, 249 bp, Artificial Sequence
  Description of Artificial Sequence: Synthetic coding sequence
atgctgtctaggaatgacgatatctgcatctacggggggctgggcctcggcggtctgctgctgcttgccgtggtgttgctaagtgcctgtttgtgctggttgcaccgccgcgtgaagcgcttggaaaggagttggcgtcttcctgttccttcatcagagggtcccgatcttagaggtcgggataagcgggggacaaaagaggaccctcgcgcagactatgcttgcatcgccgagaataagccgacatag

SEQ ID NO: 122287 - DNA, 201 bp, Artificial Sequence
  Description of Artificial Sequence: Synthetic coding sequence
atgttgtcgagaaatgatgttaagaggctggaacgctcctgggctcagggctcatcagagcaggaactgcattatgccagtctgcagcgactgcccgtccccagcagcgagggcccggatttgcgaggcagagataagaggggaacgaaggaagatcctagggctgattacgcttgcattgccgagaataaaccaacctag

SEQ ID NO: 122288 - DNA, 201 bp, Artificial Sequence
  Description of Artificial Sequence: Synthetic coding sequence
atgcttagcaggaatgacgtgaagcggctggagagatcctgggcacagggatctagtgaacaggaactgcattacgccagcctgcagcgtctgcctgtgcccagcagcgaaggtcctgacctccggggcagagacaagcggggaacgaaagaggaccctcgggccgattatgcttgcatcgccgaaaacaaacccacctag

SEQ ID NO: 122289 - DNA, 294 bp, Artificial Sequence
  Description of Artificial Sequence: Synthetic coding sequence
atgctgtctcgtaacgatgacatttgtatctatggcgggctgggacttggaggcctgctgctccttgcggtcgtgctgctgtctgcatgtctgtgttggctccatagaagagtgaagcgcttagagaggtcttgggctcagggtagctccgaacaggagctccattatgcctccttacagcgcctgcctgtgccaagtagtgagggacccgatcttcggggacgggacaaacggggaactaaagaggatccacgtgccgattacgcttgcatcgcggagaataagccaacatag

SEQ ID NO: 122290 - DNA, 156 bp, Artificial Sequence
  Description of Artificial Sequence: Synthetic coding sequence
atgctgtcccggaatgatgtgaaaaggctggaaagaagttggaggcttcccgttccctctagtgagggacccgacctaagaggacgcgacaaaaggggtacaaaggaagatcctagagcagattatgcctgtattgccgagaacaaaccaacttag

SEQ ID NO: 122291 - DNA, 294 bp, Artificial Sequence
  Description of Artificial Sequence: Synthetic coding sequence
atgttgtcgcgcaacgacgatatttgcatttacggaggactaggactcgggggccttctcctcctcgccgttgtgctgctaagcgcatgtctgtgttggttacataggagggtgaaaaggttggaacgtagctgggcacaaggttcgagcgagcaggagctgcattatgcatccctccagcggctgccggtcccgtcctccgagggcccagatctgcgcggcagggacaagcggggaaccaaagaggaccccagagccgattatgcttgtatcgcagagaataaacctacctag

SEQ ID NO: 122292 - DNA, 315 bp, Artificial Sequence
  Description of Artificial Sequence: Synthetic coding sequence
atgctcagcaggaacgacgacatttgcatttatgggggtctgggcttaggtggtctgctgctgcttgccgtggttctcttatcagcatgtttgtgttggctgcatcgccgcgtaaagcgtttggaacgtagctggcacctgctgtcctggtcacaggcacagggctcgtccgagcaggagttacattacgcctctcttcagaggctgcccgtgccatctagcgagggcccagatctgaggggacgtgacaagagggggacgaaagaggacccaagggctgactacgcctgcatcgccgagaataagcctacctag

SEQ ID NO: 122293 - DNA, 132 bp, Artificial Sequence
  Description of Artificial Sequence: Synthetic coding sequence
tatcgcggaatgatgatctacgtttcaacgggtgcctggggctgggctgggtcatgtttctggcagtggagcttttgcccaccagcgtgcgttgggtgtattgaggaacggctgccagtgccaagcagctag

SEQ ID NO: 122294 - DNA, 111 bp, Artificial Sequence
  Description of Artificial Sequence: Synthetic coding sequence
atgctatctagaaatgacgacatctgcatttatggggggctggggttgggtggactattgctgttagccgtcgtcctactgagtgcttgcctgtgttggctgcatagatag

SEQ ID NO: 122295 - DNA, 315 bp, Artificial Sequence
  Description of Artificial Sequence: Synthetic coding sequence
atgctgtcacgtaacgatgacatctgcatctacggtggacttggcttgggcggactattgctgttggcggttgtgcttctgtcagcctgcctgtgttggttgcacagacgggtgaagaggctggagagatcttggcatctactctcctggtcccaagcccaaggttcatccgagcaggaactccactatgcaagtctccagcgactacctgtcccttcatccgagggccctgacttgcgcggtagagataagagaggcactaaagaagatccccgggccgattacgcatgcatcgccgaaaataagcctacatag

SEQ ID NO: 122296 - DNA, 141 bp, Artificial Sequence
  Description of Artificial Sequence: Synthetic coding sequence
atgctgagtcgcaatgatgacatttgcatttatggtgggctcggactgggaggactcctgctgctggccgtggtcctactatctgcatgtttgtgttggcttcacagacgggaacattgccttgccctggaacctctttag

SEQ ID NO: 122297 - DNA, 42 bp, Artificial Sequence
  Description of Artificial Sequence: Synthetic coding sequence
atgctctcaaggaacgatgaagcagcaagcgctcagcagtag

SEQ ID NO: 122298 - DNA, 87 bp, Artificial Sequence
  Description of Artificial Sequence: Synthetic coding sequence
atgctgtcgaggaacgatggcccagggctgttacgagccggaacgccgctgtgtatctcggccgaggccgcatccgctcaacagtag

SEQ ID NO: 122299 - DNA, 201 bp, Artificial Sequence
  Description of Artificial Sequence: Synthetic coding sequence
atgctctcccgtaatgatgtgaaacggctagagcgatcttgggctcaggggtcttccgagcaggaactacactacgcctccctacagcgcctgcctgtgccatcctctgaaggacccgacctgcggggcagagataaaaggggtaccaaagaggaccctagagcagactacgcttgcatcgccgaaaacaaacccacctag

SEQ ID NO: 122300 - DNA, 87 bp, Artificial Sequence
  Description of Artificial Sequence: Synthetic coding sequence
atgctttcgcgaaacgatggccctggcttactccgggccggaacacccctttgcatttctgcagaagccgctagtgcacaacaatag

SEQ ID NO: 122301 - DNA, 87 bp, Artificial Sequence
  Description of Artificial Sequence: Synthetic coding sequence
atgctaagtcgtaacgatggtccaggcctcctgagggccgggacccctctctgcattagtgctgaggctgccagtgcacagcaatag

SEQ ID NO: 122302 - DNA, 132 bp, Artificial Sequence
  Description of Artificial Sequence: Synthetic coding sequence
tgaagtcgcaatgacgatatctgcatctacggcggactgggtctcgggggcctgctgctgctggctgtggtccttttgtctgcctgcctgtgttggctacacaggcgggaggccgccagtgcccaacagtag

SEQ ID NO: 122303 - DNA, 156 bp, Artificial Sequence
  Description of Artificial Sequence: Synthetic coding sequence
atgctgtctaggaacgatgtcaagaggctggaacggagttggcgactgcccgtgccctcttcagaaggccccgacctgcgaggcagggacaaacgggggaccaaggaggatcccagagcagattacgcctgtatcgctgagaataagcctacctag

SEQ ID NO: 122304 - DNA, 108 bp, Artificial Sequence
  Description of Artificial Sequence: Synthetic coding sequence
atgcttagtcgaaacgatgccccatccgtcctcgtcccaggacccggcctgctccgcgctgggacccctttatgcatcagcgccgaggctgcgtccgcgcagcagtag

SEQ ID NO: 122305 - DNA, 42 bp, Artificial Sequence
  Description of Artificial Sequence: Synthetic coding sequence
atgttaagtaggaatgacgaagcagcttcagcgcaacagtag

SEQ ID NO: 122306 - DNA, 294 bp, Artificial Sequence
  Description of Artificial Sequence: Synthetic coding sequence
atgttgtcaaggaacgatgacatctgcatctacggaggacttgggcttggcggcctgcttctgctggctgtcgtgcttttaagcgcatgtctctgttggttacaccggcgggtcaagcggctcgagcgtagttgggcccagggttcgagtgagcaggaactgcactatgcttccttgcagcgcttacccgtgccctctagcgagggtcctgacctgcgtggacgggataagcgcggtactaaagaggatcctagggcggactacgcatgtatcgccgaaaataaacccacctag

SEQ ID NO: 122307 - DNA, 201 bp, Artificial Sequence
  Description of Artificial Sequence: Synthetic coding sequence
atgttatccagaaacgacgtgaaacggctcgagagatcttgggctcagggatcctctgaacaagagctccattatgcaagtctacagaggctgccagtcccctcttccgaagggccggaccttcgcgggcgcgacaagcgcggtacaaaggaggaccctcgtgcagattatgcctgcattgctgagaataagccgacatag

SEQ ID NO: 122308 - DNA, 141 bp, Artificial Sequence
  Description of Artificial Sequence: Synthetic coding sequence
atgctctctcgcaatgatgatatatgcatttacggaggcttaggacttggcggtctgctactcctggccgtggtcttgctgtcggcttgcttatgctggctccatagacgcgagcactgccttgcccttgagccactctag

SEQ ID NO: 122309 - DNA, 132 bp, Artificial Sequence
  Description of Artificial Sequence: Synthetic coding sequence
tgatctcgaaatgatgacatatgtatttacggcgggctgggactgggcggacttctcttgctggccgtcgtcctgctgtccgcctgtttatgttggttgcatcggcgcgaggccgcatcggcccagcagtag

SEQ ID NO: 122310 - DNA, 141 bp, Artificial Sequence
  Description of Artificial Sequence: Synthetic coding sequence
atgctgagtcgcaatgatgatatttgtatttatgggggattgggcctggggggcttgttgctgctggccgttgtgttgctgagtgcttgtctttgttggttgcaccgcagggagcactgtttggccctcgagcccctgtag

SEQ ID NO: 122311 - DNA, 87 bp, Artificial Sequence
  Description of Artificial Sequence: Synthetic coding sequence
atgctgagccgaaatgacgggcctgggctgctaagagcagggactcccctctgtatctcggcggaggcagcctctgcccagcaatag

SEQ ID NO: 122312 - DNA, 132 bp, Artificial Sequence
  Description of Artificial Sequence: Synthetic coding sequence
tgaagccggaacgacgatatttgtatctatggaggactgggactggggggcctcttgctgctcgccgtagttctcttatcggcctgcctctgctggctgcaccgcagggaggctgcctctgcgcagcagtag

SEQ ID NO: 122313 - DNA, 201 bp, Artificial Sequence
  Description of Artificial Sequence: Synthetic coding sequence
atgctgtctcgaaatgacgtgaagagactggaaagaagctgggctcaggggtcttctgagcaggaactgcactacgctagcctgcaacggctccccgtgccatccagcgagggtcccgatctgagaggcagagacaagagagggacaaaggaggatcccagagctgattatgcttgcatcgccgaaaataagcctacttag

SEQ ID NO: 122314 - DNA, 180 bp, Artificial Sequence
  Description of Artificial Sequence: Synthetic coding sequence
atgctgtcgagaaatgacgatatctgcatctacggtgggttgggactgggcggactcttgctgctggcagtggtcctgttatcagcctgtctatgctggctgcaccgaagggggccaggactccttcgtgccggaaccccactgtgcatcagtgccgaagctgctagcgctcaacagtag

SEQ ID NO: 122315 - DNA, 222 bp, Artificial Sequence
  Description of Artificial Sequence: Synthetic coding sequence
atgcttagccgaaatgatgtgaaaagactcgagcgttcgtggcacctgctgtcttggtcccaagcccagggcagctctgagcaagagctgcattacgcctcactccagaggctgcctgttccgtcctccgaagggcccgacctccgaggacgggataagcgaggaaccaaggaggacccaagggctgattatgcttgtatcgctgaaaacaaaccgacttag

SEQ ID NO: 122316 - DNA, 201 bp, Artificial Sequence
  Description of Artificial Sequence: Synthetic coding sequence
atgctctctcgcaatgacgatatttgtatctatggcggcctgggcctgggcggtctcctgctcttagccgtggtcctgttgtctgcatgtctgtgttggctccatcgccgggccccctctgtgctggtccccggtccgggccttctgagagcagggacaccgctttgtataagcgcggaagcagcctctgcacaacagtag

SEQ ID NO: 122317 - DNA, 201 bp, Artificial Sequence
  Description of Artificial Sequence: Synthetic coding sequence
atgctgtctcgtaacgacgtgaaaaggctggagcgttcatgggcccaaggttcctctgagcaggaactccattatgcaagcctgcagcgtctgcctgtcccaagttccgagggaccagaccttcgagggcgcgacaagagaggcactaaggaggaccctcgggctgattatgcgtgcattgccgagaataaacctacttag

SEQ ID NO: 122318 - DNA, 87 bp, Artificial Sequence
  Description of Artificial Sequence: Synthetic coding sequence
atgctcagtaggaatgacggacccgggctgctgagggccggaacccctctatgtatttccgctgaggctgcctctgcccagcagtag

SEQ ID NO: 122319 - DNA, 249 bp, Artificial Sequence
  Description of Artificial Sequence: Synthetic coding sequence
atgttgtctcgcaatgacgacatctgcatttacgggggactcggacttgggggtcttctgctgctggccgttgtactcctgtccgcatgcctttgctggctacacagacgagtgaagagactagagaggtcctggcggctaccagttccatccagcgaaggaccggatctgaggggaagggataagcggggaactaaagaagaccctcgcgccgactacgcctgcattgccgagaataagcccacatag

SEQ ID NO: 122320 - DNA, 156 bp, Artificial Sequence
  Description of Artificial Sequence: Synthetic coding sequence
atgttgagccgaaatgatgttaaaaggctcgagcggagttggagactgcccgtgcctagcagcgaaggacccgaccttcgggggcgggacaaaagggggactaaggaagacccaagggctgactacgcttgtatcgcagaaaataaacccacttag

SEQ ID NO: 122321 - DNA, 180 bp, Artificial Sequence
  Description of Artificial Sequence: Synthetic coding sequence
atgctcagtaggaacgatgacatttgtatctatggcggactcggactggggggcttgctgctgctcgccgtcgtcttgttgtccgcctgtctatgttggctgcaccgccggggtcccgggctgctgagagcagggacacctctatgtatttccgctgaggcagctagcgcacaacagtag

SEQ ID NO: 122322 - DNA, 201 bp, Artificial Sequence
  Description of Artificial Sequence: Synthetic coding sequence
atgttaagccgaaatgacgtcaaaaggttggaaaggtcctgggcacagggtagtagcgaacaggaactgcactacgctagcctccagaggctgcccgtcccgagctctgaaggccctgaccttcggggcagagataaacggggcacaaaagaagacccacgggccgattatgcatgcatcgccgaaaataaacctacctag

SEQ ID NO: 122323 - DNA, 156 bp, Artificial Sequence
  Description of Artificial Sequence: Synthetic coding sequence
atgctgagccgcaatgacgtgaaacgcctggaacgcagttggcggctgcctgttccctcatccgagggacccgatctgcgggggcgggataaaagaggaaccaaagaagatccccgcgcagactacgcctgcatcgccgaaaataagcctacatag

SEQ ID NO: 122324 - DNA, 249 bp, Artificial Sequence
  Description of Artificial Sequence: Synthetic coding sequence
atgctgagtcggaacgatgacatatgtatttatggcggcttaggactaggaggattattgctcctcgcagtcgtgctcttgtctgcttgtctctgttggttgcatagaagagtgaagagactagaacgcagctggcgcctgcccgtgccatcgtctgaagggcccgatttgagaggccgcgataaaagggggacaaaggaggatcccagggcggactacgcatgtattgcagaaaacaaaccaacttag

SEQ ID NO: 122325 - DNA, 141 bp, Artificial Sequence
  Description of Artificial Sequence: Synthetic coding sequence
atgctttcgcgtaatgacgatatatgcatttacggggggctgggattaggagggctactgttgcttgcggtggtgctgttatctgcttgcctatgctggctgcaccgtcgcgaacattgcttagccctagaacccctttag

SEQ ID NO: 122326 - DNA, 108 bp, Artificial Sequence
  Description of Artificial Sequence: Synthetic coding sequence
atgctttctcggaatgacgccccctccgtactagttcctggacccggattactgcgcgcagggacacctctgtgtatatctgctgaagctgccagcgctcaacagtag

SEQ ID NO: 122327 - DNA, 249 bp, Artificial Sequence
  Description of Artificial Sequence: Synthetic coding sequence
atgctatctcggaatgatgatatttgtatctacgggggcctgggcctggggggtctgctgctcctggctgtagtgctgttgtctgcatgcctgtgctggctccatcgtagagtcaagcgcttggaacgctcatggagattacctgtgcctagctccgaagggccagacctgaggggacgcgataagcgaggaaccaaagaggaccctcgggccgattacgcctgtatcgctgaaaataagcccacttag

SEQ ID NO: 122328 - DNA, 87 bp, Artificial Sequence
  Description of Artificial Sequence: Synthetic coding sequence
atgctgagtagaaatgacggcccgggcttactgcgcgcgggcactccattgtgcatctctgccgaggccgcttccgctcagcagtag

SEQ ID NO: 122329 - DNA, 294 bp, Artificial Sequence
  Description of Artificial Sequence: Synthetic coding sequence
atgctgtctaggaacgatgacatttgcatctatggcggtctcggccttggggggctcttactcctggccgtggtgctgcttagtgcctgcctctgctggcttcatcgcagagtcaaaagactcgaacgtagctgggcccagggatccagtgagcaggagttacactatgcatctctgcagaggctgccagttccaagtagcgagggtcccgacctgcggggcagggataaacgtggaacaaaggaggaccccagagcagactatgcatgcattgctgaaaataagcccacttag

SEQ ID NO: 122330 - DNA, 87 bp, Artificial Sequence
  Description of Artificial Sequence: Synthetic coding sequence
atgcttagcagaaatgatggcccgggcctgctccgagccggtaccccactctgcatttcggcagaggctgcttcggctcaacagtag

SEQ ID NO: 122331 - DNA, 108 bp, Artificial Sequence
  Description of Artificial Sequence: Synthetic coding sequence
atgctatctcgtaatgacgcaccctccgtccttgttcctggtcctggtcttctgcgggcagggacccctctgtgtatctcggctgaggcggccagcgctcaacagtag

SEQ ID NO: 122332 - DNA, 294 bp, Artificial Sequence
  Description of Artificial Sequence: Synthetic coding sequence
atgctgagtcgaaacgacgatatttgcatttacggcggactggggcttggtggcctcctgctactcgccgtggtcctcttgtcagcttgtctgtgttggctccatcgtcgggttaagcggttggagaggagttgggcccaggggtccagcgagcaagagttgcattacgcctcattgcaacgtctcccagtgccatcaagcgaaggaccggacctccgcggtcgagataagaggggcaccaaggaggatcccagagcagattatgcttgcattgccgagaataaaccgacatag

SEQ ID NO: 122333 - DNA, 201 bp, Artificial Sequence
  Description of Artificial Sequence: Synthetic coding sequence
atgctgtcgcgtaatgacgtgaaacgactggagcgctcctgggctcagggctcaagtgagcaagaactgcactacgcatcactgcagcgactgcccgtgccaagctcagaggggcctgatctgcgtggacgcgacaagcgcgggaccaaggaggaccctcgcgccgactacgcttgtattgcagaaaataaaccgacctag

SEQ ID NO: 122334 - DNA, 201 bp, Artificial Sequence
  Description of Artificial Sequence: Synthetic coding sequence
atgctatcccgaaatgacgtaaagaggctggagcgttcttgggcccagggcagctccgagcaggagctgcactacgccagcttgcagcgcctaccagtaccatccagcgagggccctgaccttcgtggtcgagacaaacgcgggacaaaagaggatccacgggcggattatgcgtgtatcgctgaaaataaacctacctag

SEQ ID NO: 122335 - DNA, 42 bp, Artificial Sequence
  Description of Artificial Sequence: Synthetic coding sequence
atgctttcccggaatgacgaggctgctagcgcccagcagtag

SEQ ID NO: 122336 - DNA, 87 bp, Artificial Sequence
  Description of Artificial Sequence: Synthetic coding sequence
atgctgagtcgcaacgatggccccgggctcctgcgggctggaacgcctttgtgcatttctgcagaagccgcgtcggcgcagcaatag

SEQ ID NO: 122337 - DNA, 111 bp, Artificial Sequence
  Description of Artificial Sequence: Synthetic coding sequence
atgctctcgcgaaacgacgacatctgcatttacggcggcctcggtctgggcggactgctgctgcttgcagtggtcctattaagtgcttgcctgtgttggctgcatcgatag

SEQ ID NO: 122338 - DNA, 294 bp, Artificial Sequence
  Description of Artificial Sequence: Synthetic coding sequence
atgctttcccgaaatgacgatatttgcatctatggggggctcggtctcggtggcctgttgctcttagcagtggtcctgctctcggcgtgtttgtgttggctgcatagacgcgttaaacgccttgaaagaagttgggctcagggcagctcagagcaggagctacactacgcttcacttcagcgcctgcctgtgccgtcctcagaggggccagatctgagggggagagataaacggggaacaaaagaagacccccgcgcagactatgcctgtattgccgaaaataaacccacctag

SEQ ID NO: 122339 - DNA, 180 bp, Artificial Sequence
  Description of Artificial Sequence: Synthetic coding sequence
atgctgtccagaaatgacgatatatgtatctacgggggtctcgggctgggaggcctgctgttactagctgtggttctcttgagtgcgtgtttatgttggctccacaggaggggccctggtttgcttcgcgcggggacccccttgtgcatttctgctgaagccgcctccgcgcaacagtag

SEQ ID NO: 122340 - DNA, 294 bp, Artificial Sequence
  Description of Artificial Sequence: Synthetic coding sequence
atgctgagccgcaacgacgacatctgtatttacggcggtcttgggctaggcggtctcctcctgctggccgtagtgctcctttccgcatgcctgtgctggctgcacaggcgagtgaaaaggcttgagcggtcatgggcccaggggtcttcagagcaggagctacactatgcttcattacagcgcctgccagtccctagttcagagggacctgacctgcggggtcgggacaagagagggaccaaggaggatccccgtgctgattacgcctgcattgctgaaaacaagcctacttag

SEQ ID NO: 122341 - DNA, 201 bp, Artificial Sequence
  Description of Artificial Sequence: Synthetic coding sequence
atgctttcccggaacgacgacatttgcatctatggcgggctcggtcttggagggctgctgctgctggccgtggtgctgctaagcgcctgtttatgctggctgcacaggcgggccccctccgtgctcgtgcctggtcccggcctcctcagagccggcacacctctgtgtatatccgctgaggccgcgtcagcacaacagtag

SEQ ID NO: 122342 - DNA, 87 bp, Artificial Sequence
  Description of Artificial Sequence: Synthetic coding sequence
atgctgagcagaaacgacggacctggactgctgcgggccggcactcctctctgcatcagcgctgaggcggcctccgcccagcaatag

SEQ ID NO: 122343 - DNA, 180 bp, Artificial Sequence
  Description of Artificial Sequence: Synthetic coding sequence
atgcttagtaggaatgatgacatctgtatctatggcggactgggactgggagggttgctgctgctcgcagttgtgttgctgagcgcatgtctgtgctggctgcatagaagaggccctggcctcctgagagccgggaccccactgtgcatcagcgccgaagcggccagcgctcaacagtag

SEQ ID NO: 122344 - DNA, 201 bp, Artificial Sequence
  Description of Artificial Sequence: Synthetic coding sequence
atgctatctagaaacgacgtcaagagactggagcgatcctgggcccaaggcagttccgagcaagagctacattatgcttcattgcagaggcttccagtgccttcaagtgagggacccgatttgagaggccgagataaaaggggcaccaaggaagatcctagggctgattatgcatgcattgctgaaaataagccgacttag

SEQ ID NO: 122345 - DNA, 108 bp, Artificial Sequence
  Description of Artificial Sequence: Synthetic coding sequence
atgctctccaggaacgatgcgcccagcgtgctggtgccgggccctggattactccgggcaggtaccccactctgcatctcggctgaggccgcttccgcacaacaatag

SEQ ID NO: 122346 - DNA, 201 bp, Artificial Sequence
  Description of Artificial Sequence: Synthetic coding sequence
atgctaagtaggaatgatgtgaagaggctggaaaggtcctgggctcaaggctcaagcgagcaggaactgcactatgcctccctgcagcggctacctgtgccaagcagtgaagggcctgaccttcgagggcgcgataagagaggaactaaagaggatccccgagcggactatgcctgcatcgctgagaacaagcctacctag

SEQ ID NO: 122347 - DNA, 87 bp, Artificial Sequence
  Description of Artificial Sequence: Synthetic coding sequence
atgcttagccgcaatgatggaccaggcctgctgcgggctggcacccccctgtgcatctctgctgaggccgccagcgctcaacagtag

SEQ ID NO: 122348 - DNA, 108 bp, Artificial Sequence
  Description of Artificial Sequence: Synthetic coding sequence
atgctgtcccggaatgatgcaccctccgttctagttcctggaccaggtctgctaagagcgggtactcccttgtgcatcagtgcagaggctgctagtgcgcagcagtag

SEQ ID NO: 122349 - DNA, 132 bp, Artificial Sequence
  Description of Artificial Sequence: Synthetic coding sequence
tagtcaaggaacgacgacatatgcatctacggaggcctaggtctcggagggctgctgctgctggctgtcgttttactgagtgcttgcctctgctggctccaccgccgagaagctgccagcgcccagcagtag

SEQ ID NO: 122350 - DNA, 111 bp, Artificial Sequence
  Description of Artificial Sequence: Synthetic coding sequence
atgttaagccggaatgatgacatatgcatctacggaggcctcgggctgggcggactgttgctccttgctgtggttctcctctctgcgtgtctttgctggctgcaccggtag

SEQ ID NO: 122351 - DNA, 111 bp, Artificial Sequence
  Description of Artificial Sequence: Synthetic coding sequence
atgttatcacgcaatgacgacatctgtatctatggaggactgggcctagggggtctcctgttgctagcagttgttctgctgtctgcatgcctgtgttggctgcaccgttag

SEQ ID NO: 122352 - DNA, 201 bp, Artificial Sequence
  Description of Artificial Sequence: Synthetic coding sequence
atgctaagcaggaacgacgtgaagcggctcgaaaggagctgggcccaaggctcttctgaacaagagctccattacgcttcactacagcgactgccagtaccctcgtccgaaggccccgatttgagaggccgggataaacgcggcactaaagaggatcctcgcgcagactatgcttgtatcgccgagaacaagcccacctag

SEQ ID NO: 122353 - DNA, 294 bp, Artificial Sequence
  Description of Artificial Sequence: Synthetic coding sequence
atgctatcccgtaatgacgatatatgcatctacggtggtctcgggcttggcggcctgctcttgttagcggtcgtactgctgtctgcctgtctttgctggttacacaggcgagttaagcggctggagcggagttgggctcagggaagctctgagcaagaactgcattacgcctcacttcaaaggctgcctgttccatcaagcgaagggcctgatttacgcggtcgggataaacgcggcacgaaagaagatcctagggctgattatgcctgcatcgcggaaaacaaaccaacgtag

SEQ ID NO: 122354 - DNA, 87 bp, Artificial Sequence
  Description of Artificial Sequence: Synthetic coding sequence
atgctgtctcggaatgacggcccaggcttgctacgtgctggtactccactctgtataagcgcagaagctgcttccgcccagcagtag

SEQ ID NO: 122355 - DNA, 315 bp, Artificial Sequence
  Description of Artificial Sequence: Synthetic coding sequence
atgctttcacggaacgatgacatatgcatttacgggggtcttggattgggagggttactcctactggccgtggtcctcctctctgcctgtttgtgctggttacacagacgcgtcaagagactggaacgatcatggcacctgctaagctggtcacaggcacagggaagctctgaacaggaattacattacgcaagcctgcagcggctccccgtgcccagctccgaaggccctgatctgcgaggacgggataagcgtggcacaaaagaagacccacgggccgattatgcatgcatcgcggagaacaagccaacatag

SEQ ID NO: 122356 - DNA, 201 bp, Artificial Sequence
  Description of Artificial Sequence: Synthetic coding sequence
atgctctcaaggaacgatgttaagcgccttgaaaggtcgtgggcacaagggtcttctgagcaagagcttcattatgcttcccttcagaggctgcccgtccccagcagcgagggaccagatctgcgtgggagagacaaacgagggacaaaggaggaccccagagcggattatgcatgcatagcagagaacaagcctacctag

SEQ ID NO: 122357 - DNA, 111 bp, Artificial Sequence
  Description of Artificial Sequence: Synthetic coding sequence
atgctctctcgtaacgacgatatttgcatttatgggggcttaggactcgggggactgctcctgctggctgtggtgctcctgtcagcttgtctttgctggctgcacaggtag

SEQ ID NO: 122358 - DNA, 294 bp, Artificial Sequence
  Description of Artificial Sequence: Synthetic coding sequence
atgctatcaaggaatgacgatatttgtatctacggcggactgggattaggcggcctcttattactggccgtcgtgctcctgtcagcctgcctttgttggcttcaccggagagtgaagcgtctcgaaaggtcttgggcccaggggagtagtgaacaagagcttcattatgcttccctgcagcggctgcctgtgccctcgagcgaaggtcccgatcttcgcggcagggataagagaggaaccaaggaggaccccagggctgattacgcatgtatcgctgagaacaaacctacgtag

SEQ ID NO: 122359 - DNA, 156 bp, Artificial Sequence
  Description of Artificial Sequence: Synthetic coding sequence
atgttgagtcggaatgacgtaaaaagactggaaaggtcttggagattgcccgtcccgtcatccgagggtcctgatctccgcggccgcgacaagaggggcacaaaagaagacccacgcgccgactacgcgtgcatagctgagaataaaccaacctag

SEQ ID NO: 122360 - DNA, 315 bp, Artificial Sequence
  Description of Artificial Sequence: Synthetic coding sequence
atgttgagcagaaatgacgatatctgtatatacgggggtctcgggctaggaggcctcctactgctcgctgtcgtgcttttgagcgcttgcctgtgttggctccacagacgggtgaagaggctcgaacggtcctggcatctcctgtcttggtcgcaggcccaagggagttccgaacaggagttacactacgctagtctccagcgcttgccagtgccctcgtcagaagggcctgatctgagaggtcgggataaaagaggtacaaaagaggaccctcgcgccgattatgcttgtatcgccgaaaataagccaacatag

SEQ ID NO: 122361 - DNA, 294 bp, Artificial Sequence
  Description of Artificial Sequence: Synthetic coding sequence
atgctgagtaggaatgatgatatatgcatctacggggggctagggcttggcggtttactgctcctggcagtggtgctcctgtcggcttgcttgtgctggctgcaccggcgggttaagcggctggagaggtcgtgggcgcagggcagcagcgagcaagagctacattacgcctctctgcagagactgcctgtcccatctagtgagggaccagacctgcgcggcagggataagcgcggcaccaaagaggatccccgggcagactatgcatgcatcgccgagaataagcccacctag

SEQ ID NO: 122362 - DNA, 315 bp, Artificial Sequence
  Description of Artificial Sequence: Synthetic coding sequence
atgctgagccgcaacgacgacatttgtatctacggcggtttgggcctgggaggcttgctgctgttagcagtggtgctcctttctgcatgcctttgctggctccatcgccgggtcaagagactggaacgctcttggcacctcctgtcctggtcacaggcccaggggtcgtctgagcaggagctgcattatgcatccctgcagcgactacccgtcccttcatccgaaggccctgacttaagagggagggataagcgcggtaccaaggaggatccccgagccgattacgcctgtatcgcggagaataaaccaacttag

SEQ ID NO: 122363 - DNA, 156 bp, Artificial Sequence
  Description of Artificial Sequence: Synthetic coding sequence
atgctgtctagaaatgacgtgaaacgccttgagagaagctggcgattgcccgtgcccagttccgaggggccggaccttagaggcagggacaagcgcggtaccaaagaagacccaagagccgactacgcatgcatcgccgaaaataagcccacctag

SEQ ID NO: 122364 - DNA, 201 bp, Artificial Sequence
  Description of Artificial Sequence: Synthetic coding sequence
atgctcagtcgcaacgacgacatttgcatctacggcgggctagggttggggggcctcttgcttttggccgtcgttctgctgagtgcctgcctctgttggttgcacagacgggcaccatcagtcctcgtgcccggcccagggctactgcgcgccggtactcctctgtgtattagcgcagaagcagcctccgcgcaacagtag

SEQ ID NO: 122365 - DNA, 111 bp, Artificial Sequence
  Description of Artificial Sequence: Synthetic coding sequence
atgctttcacggaacgacgacatctgcatttacggtgggctcgggctcggcggtcttctcctactcgcggtcgtactgctgtcagcctgcctctgttggcttcacaggtag

SEQ ID NO: 122366 - DNA, 222 bp, Artificial Sequence
  Description of Artificial Sequence: Synthetic coding sequence
atgttgagcaggaacgatgtgaaaaggctggagagatcgtggcatctgttgagttggtcacaggcccaggggagctccgagcaggagctgcactatgcctcactgcaaaggttaccggtcccatcctctgagggccctgacctgcggggacgggacaaacgcggtacaaaagaagaccctagagctgactatgcctgcatagctgaaaataaaccaacatag

SEQ ID NO: 122367 - DNA, 201 bp, Artificial Sequence
  Description of Artificial Sequence: Synthetic coding sequence
atgcttagtagaaacgatgtcaaacgtctggaaaggtcatgggcccagggcagctccgagcaggaactgcattacgcgtcattacagcgattgcccgtccctagcagcgaaggtccagacttgagaggccgcgacaagcgcggcaccaaagaggacccaagggccgactacgcatgtatagcagaaaataaacctacttag

SEQ ID NO: 122368 - DNA, 201 bp, Artificial Sequence
  Description of Artificial Sequence: Synthetic coding sequence
atgctatctagaaacgacgtgaaaagactggaacggtcttgggctcagggaagcagcgagcaagaactgcactacgcgagcttacagagactacctgtgccatcctcagaggggccggacctccggggacgagataagcgggggaccaaagaggacccaagagccgattacgcgtgtatagccgagaataagcccacatag

SEQ ID NO: 122369 - DNA, 108 bp, Artificial Sequence
  Description of Artificial Sequence: Synthetic coding sequence
atgcttagccgtaacgacgccccatccgtacttgtgcccggcccaggcctactgagggctggaacaccactatgtatttctgctgaggccgcctccgcccaacagtag

SEQ ID NO: 122370 - DNA, 87 bp, Artificial Sequence
  Description of Artificial Sequence: Synthetic coding sequence
atgctgagcaggaatgatgggcccggccttttgcgggcaggcacacctctgtgcatctccgcagaagccgcctcagctcagcaatag

SEQ ID NO: 122371 - DNA, 141 bp, Artificial Sequence
  Description of Artificial Sequence: Synthetic coding sequence
atgctctcccgaaatgatgacatctgcatctatggcggcttgggtctggggggcctgctgctgcttgctgtggtgctgctgagcgcgtgtctatgctggctgcaccgaagggaacactgtcttgcgcttgaacccctttag

SEQ ID NO: 122372 - DNA, 141 bp, Artificial Sequence
  Description of Artificial Sequence: Synthetic coding sequence
atgctgtctcggaacgacgacatatgtatttacggtggccttggcctcggaggcctgctgctgctcgcagttgtgctcctttccgcctgtctttgttggttacatcgtcgtgagcattgtctggcactagagcctttgtag

SEQ ID NO: 122373 - DNA, 201 bp, Artificial Sequence
  Description of Artificial Sequence: Synthetic coding sequence
atgctaagtcggaatgatgacatctgcatttatggcggattaggtctaggtggactcttgttgctagctgtggtccttctttctgcatgcctatgctggctgcaccgccgagctccatctgtactggtgcccggacctggcctcctccgagcaggcactcctctctgcatttccgcagaagccgcttcggcccagcagtag

SEQ ID NO: 122374 - DNA, 141 bp, Artificial Sequence
  Description of Artificial Sequence: Synthetic coding sequence
atgttgagcagaaacgacgacatatgcatatacggcgggctggggctcggaggcctgcttctgttggccgtggtcttgctgtcagcttgcctctgttggctgcacagacgcgagcactgtcttgccctggagccgttgtag

SEQ ID NO: 122375 - DNA, 87 bp, Artificial Sequence
  Description of Artificial Sequence: Synthetic coding sequence
atgctctctcgcaatgatggacccggactgttacgggccgggaccccactctgcatcagtgccgaggctgcatccgcacagcagtag

SEQ ID NO: 122376 - DNA, 294 bp, Artificial Sequence
  Description of Artificial Sequence: Synthetic coding sequence
atgctcagtcggaatgacgacatctgtatctacggaggtttgggccttgggggccttctgttgctggcagtcgtgcttctgagcgcttgtctttgctggctccatcggcgcgtcaagcgcctcgagcgctcgtgggctcaggggtcttccgagcaagagctacactatgcatccctacagcggcttcctgttccatcatctgaggggcctgatctcaggggccgcgataaacgtggcactaaggaagatccacgggctgactatgcctgtattgccgagaataaacccacttag

SEQ ID NO: 122377 - DNA, 180 bp, Artificial Sequence
  Description of Artificial Sequence: Synthetic coding sequence
atgctgtccagaaacgatgacatctgtatctacggtggtctagggttgggcgggctcctgttactcgcagtggtattgctatccgcttgcctctgttggctgcataggcgcggccccggactgttgcgagcaggaacaccactgtgcatatcagccgaggccgctagcgcacagcagtag

SEQ ID NO: 122378 - DNA, 294 bp, Artificial Sequence
  Description of Artificial Sequence: Synthetic coding sequence
atgctgagccggaatgacgacatttgtatctacggcggtctgggcctgggtggtctgctgcttctagctgtggtcctgttaagcgcgtgtctgtgctggttgcatcgccgagttaaacgcttggagcgatcttgggcccagggcagctctgaacaagagttacactacgcttctctgcaaaggctgcctgtcccaagcagtgaggggccagacctgagaggccgcgacaagcggggcaccaaagaggatccacgagctgactatgcatgtatagccgagaacaagcccacgtag

SEQ ID NO: 122379 - DNA, 87 bp, Artificial Sequence
  Description of Artificial Sequence: Synthetic coding sequence
atgctgtctagaaatgacgggccaggtctgctgcgggcggggactcccctttgtatcagcgctgaggctgcttcggcgcaacagtag

SEQ ID NO: 122380 - DNA, 111 bp, Artificial Sequence
  Description of Artificial Sequence: Synthetic coding sequence
atgctgagccggaacgatgacatttgcatttacggcggcctaggcctaggtgggctgcttctcctagcagtggtactactctccgcatgtctttgctggctgcataggtag

SEQ ID NO: 122381 - DNA, 156 bp, Artificial Sequence
  Description of Artificial Sequence: Synthetic coding sequence
atgctcagtagaaatgatgtcaagcgcctggaacgatcctggagattgccggtcccttcctcagagggccccgacttgaggggtagggacaaacggggcaccaaggaggatccccgtgctgactatgcctgtatcgccgaaaataagcccacttag

SEQ ID NO: 122382 - DNA, 42 bp, Artificial Sequence
  Description of Artificial Sequence: Synthetic coding sequence
atgctgagtaggaacgacgaagcagcctcagcccaacagtag

SEQ ID NO: 122383 - DNA, 201 bp, Artificial Sequence
  Description of Artificial Sequence: Synthetic coding sequence
atgctgtctaggaacgacgttaaaaggcttgaacggagttgggcccagggatctagcgagcaggagctccactatgctagtctgcagagattaccggtgccttcctccgagggcccggacctacggggcagagacaaacgcggtacgaaagaagacccgagggcagattatgcatgcattgccgagaataagcctacttag

SEQ ID NO: 122384 - DNA, 87 bp, Artificial Sequence
  Description of Artificial Sequence: Synthetic coding sequence
atgctctcaagaaatgacggccctggtttgttacgggccggtacgcccctgtgcatctcggccgaggcagcttccgcacagcaatag

SEQ ID NO: 122385 - DNA, 315 bp, Artificial Sequence
  Description of Artificial Sequence: Synthetic coding sequence
atgttgagtcgcaacgacgacatctgcatttatggcggactcggcttgggcggcctgttgttactcgccgttgttctcttgagcgcttgcctgtgttggttgcatcggagagtgaaacgactggagcggagttggcatcttctcagttggtcacaggctcagggatccagcgaacaggaactccactacgcatcattgcagcgactgcctgttcctagctcagaagggccagatctccgagggcgtgacaaacgcggcaccaaggaagatccaagagccgactatgcttgcatcgccgaaaataagccgacgtag

SEQ ID NO: 122386 - DNA, 249 bp, Artificial Sequence
  Description of Artificial Sequence: Synthetic coding sequence
atgctaagcaggaatgatgatatctgtatttatggcgggttagggttaggcggcctgctgctattagccgtcgtgctgctttccgcctgcctttgttggctgcaccggagggtaaagcgcctcgaacggagctggaggctcccagtgccgagctccgaggggcccgatctccgcggcagagacaagagaggaacgaaggaggatcctagggccgactatgcctgtatcgccgagaacaagcccacatag

SEQ ID NO: 122387 - DNA, 201 bp, Artificial Sequence
  Description of Artificial Sequence: Synthetic coding sequence
atgctgtctaggaacgatgtaaaacgcttagagagatcctgggcccaagggagttctgaacaggaactgcattacgcctcacttcaaaggctgccagttccatcatctgaaggccccgatttgcggggccgcgacaaacgcggtaccaaggaggatcctcgtgccgactacgcttgcattgcagagaataaaccaacatag

SEQ ID NO: 122388 - DNA, 87 bp, Artificial Sequence
  Description of Artificial Sequence: Synthetic coding sequence
atgctgtctcgtaatgatggccccggactgctgagggccggaacacctctctgcatcagcgcagaggccgcttcagcacagcagtag

SEQ ID NO: 122389 - DNA, 132 bp, Artificial Sequence
  Description of Artificial Sequence: Synthetic coding sequence
taaagcaggaacgatgacatctgcatatacggaggtctcggactcgggggcctattgcttctggcagtagtcctcctttctgcatgcctgtgctggctccatcgccgggaggccgcaagtgctcaacagtag

SEQ ID NO: 122390 - DNA, 249 bp, Artificial Sequence
  Description of Artificial Sequence: Synthetic coding sequence
atgctcagtcgcaatgacgatatatgcatatatggcgggctgggcctgggaggcctcctgctattggccgtggtgctcctgtctgcctgcctgtgttggttacaccgtcgggtaaagcgtctagaaagaagctggcggctgcccgtcccgagcagtgagggcccggaccttagaggacgcgacaagaggggtaccaaagaagatcctcgggccgactatgcctgtattgccgagaacaaacccacctag

SEQ ID NO: 122391 - DNA, 201 bp, Artificial Sequence
  Description of Artificial Sequence: Synthetic coding sequence
atgttaagcaggaacgatgtgaaacgactcgagcgatcgtgggcccaggggagcagcgagcaggagctccattatgcaagcttacagcggctgcctgtaccttcttcagaaggacctgatctcaggggaagagataagcgcggaactaaggaagatcccagggccgactacgcatgtattgctgagaataagccaacatag

SEQ ID NO: 122392 - DNA, 180 bp, Artificial Sequence
  Description of Artificial Sequence: Synthetic coding sequence
atgctgagcagaaatgacgacatttgtatctatggaggactgggcctgggaggactgctgcttctggctgtggtgctcttgtcagcctgcctctgctggttgcacagacgcgggcccggcctgctgagggcaggaacaccactgtgtatctccgcagaggccgcatccgcccaacagtag

SEQ ID NO: 122393 - DNA, 87 bp, Artificial Sequence
  Description of Artificial Sequence: Synthetic coding sequence
atgctttccagaaacgatgggcccgggctgttacgcgccggtactcctctctgcatctccgctgaagccgcctccgcacagcagtag

SEQ ID NO: 122394 - DNA, 249 bp, Artificial Sequence
  Description of Artificial Sequence: Synthetic coding sequence
atgctgtctcgcaacgacgacatttgtatttacggagggttgggtctcggtggactcctgcttctggcagtcgtgctgttgtcagcttgtttgtgctggttgcaccggcgcgtgaagcgccttgagcggtcgtggagactgcccgtaccaagctctgaggggcccgatctgcggggtcgagacaagcgtgggactaaggaggatccgagggcggattacgcctgtatagctgaaaataagccgacgtag

SEQ ID NO: 122395 - DNA, 111 bp, Artificial Sequence
  Description of Artificial Sequence: Synthetic coding sequence
atgctctctagaaacgatgacatttgtatctatgggggtctggggctaggcgggctgctgctgttggcggtagtgctgctcagtgcctgcttgtgctggttgcaccgctag

SEQ ID NO: 122396 - DNA, 222 bp, Artificial Sequence
  Description of Artificial Sequence: Synthetic coding sequence
atgcttagtaggaatgatgtgaaaaggttggaaagatcttggcacctgctctcctggagtcaggctcagggctcatctgagcaggagcttcattatgcaagcctccaacgactgccggtccctagctcagaaggccccgaccttagaggtagagataagcgagggaccaaggaggaccctcgcgcagattacgcctgcatcgccgagaataaacccacatag

SEQ ID NO: 122397 - DNA, 201 bp, Artificial Sequence
  Description of Artificial Sequence: Synthetic coding sequence
atgctgagccgaaatgacgttaagaggctcgagcggagttgggcccagggcagcagtgagcaggaacttcactacgcttctctgcagcgcttaccagtgccatcgtccgaaggcccggacctgagaggccgagataaacgggggaccaaagaagacccacgtgccgactacgcctgtatcgcagagaataagcccacatag

SEQ ID NO: 122398 - DNA, 87 bp, Artificial Sequence
  Description of Artificial Sequence: Synthetic coding sequence
atgctgtctcgaaatgacgggccaggccttctgagggccggcacccccctgtgtatatctgccgaggcagcgtccgctcagcagtag

SEQ ID NO: 122399 - DNA, 201 bp, Artificial Sequence
  Description of Artificial Sequence: Synthetic coding sequence
atgctgagcaggaacgacgacatctgtatctacggcggtctggggctcggcggtcttttattattagccgtagtcctgttgtccgcttgcctgtgctggctacacagacgggcgccatccgttctggttcccggccccggcctcctaagagccggcacacccctgtgtatctctgcagaggccgccagtgcgcagcagtag

SEQ ID NO: 122400 - DNA, 222 bp, Artificial Sequence
  Description of Artificial Sequence: Synthetic coding sequence
atgctttcaagaaatgacgtcaagcgtttagaaagaagctggcatctgttgtcctggtcacaggcacagggaagcagtgagcaggaactgcattacgccagtctccaaaggctgcctgtcccctcgtcagaagggcccgacttgaggggccgggataaacggggcacgaaagaggatcctcgcgctgattatgcatgtatcgccgaaaataagccaacatag

SEQ ID NO: 122401 - DNA, 201 bp, Artificial Sequence
  Description of Artificial Sequence: Synthetic coding sequence
atgctatcacggaatgacgatatctgtatctatggaggcctcggactgggcgggctgctccttcttgccgtcgtcttactgagtgcgtgcctgtgttggttgcatcggagagcaccaagtgtgctcgtccccggcccgggcctccttagagccggcactccactgtgcatctctgctgaggctgcctcggcccaacagtag

SEQ ID NO: 122402 - DNA, 87 bp, Artificial Sequence
  Description of Artificial Sequence: Synthetic coding sequence
atgctgtctcggaatgacggacccggtctgttgcgtgctggaacacctctctgtatttccgcagaggcagctagcgcacagcagtag

SEQ ID NO: 122403 - DNA, 87 bp, Artificial Sequence
  Description of Artificial Sequence: Synthetic coding sequence
atgttgtcaagaaatgacgggccaggactcttgcgcgcagggacacctctctgcatctctgccgaagctgcctccgcccagcagtag

SEQ ID NO: 122404 - DNA, 87 bp, Artificial Sequence
  Description of Artificial Sequence: Synthetic coding sequence
atgttatctagaaatgatggtccgggcctgctgcgcgccggcacaccactatgcatctctgctgaggccgcgagtgcccagcaatag

SEQ ID NO: 122405 - DNA, 87 bp, Artificial Sequence
  Description of Artificial Sequence: Synthetic coding sequence
atgttatctcggaatgatggacccggactgctgagagccggcacaccactttgcatctccgctgaggcagcatcagcccagcagtag

SEQ ID NO: 122406 - DNA, 294 bp, Artificial Sequence
  Description of Artificial Sequence: Synthetic coding sequence
atgctgagtcggaatgacgatatttgtatttatggcgggctgggtctgggcggcctattgttgcttgcagttgtgctgttatcagcttgcctctgctggctacacaggagggttaaacgacttgaacgatcctgggcccagggctcttctgagcaagagctgcactacgcctcactccagcgactccccgttccatcttctgagggcccagatctcagaggacgggacaagagaggaaccaaagaggaccctcgcgcggactacgcttgtattgcggaaaacaagcccacttag

SEQ ID NO: 122407 - DNA, 222 bp, Artificial Sequence
  Description of Artificial Sequence: Synthetic coding sequence
atgctatcaagaaacgacgtgaaaagactggagcggtcctggcacctgctgtcatggtcccaagcgcagggcagctccgagcaggagttgcactacgcctcgctccagagactgcccgtgccctcctccgagggaccagaccttcgcgggagagacaagcgagggactaaggaagacccgagagcggactatgcctgcattgccgagaacaagccaacgtag

SEQ ID NO: 122408 - DNA, 87 bp, Artificial Sequence
  Description of Artificial Sequence: Synthetic coding sequence
atgctgagccggaacgacgggcccggacttctgagggcaggtactcctttatgtatttccgctgaagccgcaagcgcccagcagtag

SEQ ID NO: 122409 - DNA, 294 bp, Artificial Sequence
  Description of Artificial Sequence: Synthetic coding sequence
atgctgtcccggaacgacgacatctgcatttacggaggcctgggtctgggcggtcttcttctcctcgctgtggtgctgttatccgcatgtctctgttggcttcaccgacgggttaagaggctcgagaggtcgtgggcacagggcagcagcgaacaggagcttcattacgcgtcccttcagaggcttcccgttccatcctctgaggggcccgatctaagggggcgggataagcgcggcactaaggaagatccccgcgcagattatgcgtgcatagctgagaacaagccaacctag

SEQ ID NO: 122410 - DNA, 201 bp, Artificial Sequence
  Description of Artificial Sequence: Synthetic coding sequence
atgctttcacgcaacgacgtaaaacggctcgagaggtcttgggcacaaggcagctctgagcaggagctacattatgcatcgctgcagcggttacccgtccccagtagcgagggcccagacttgagagggagggacaagcgcgggaccaaagaagacccccgggcagattatgcatgtattgctgagaataagccaacttag

SEQ ID NO: 122411 - DNA, 87 bp, Artificial Sequence
  Description of Artificial Sequence: Synthetic coding sequence
atgctatcacggaatgacggtcctgggctgttgcgcgcgggaacacctttgtgcatcagcgctgaagccgcatctgcacaacagtag

SEQ ID NO: 122412 - DNA, 201 bp, Artificial Sequence
  Description of Artificial Sequence: Synthetic coding sequence
atgctctcccgcaacgacgtgaaaaggctcgagcgaagttgggcccagggcagctccgagcaggaattacactatgcatcgcttcagcggttacccgtcccctccagcgaaggaccagatcttagaggccgggataagcgggggacaaaagaggatcccagggcagattacgcttgcatcgcagagaacaaaccaacgtag

SEQ ID NO: 122413 - DNA, 42 bp, Artificial Sequence
  Description of Artificial Sequence: Synthetic coding sequence
atgctgagtcggaacgatgaggctgcttctgcgcaacagtag

SEQ ID NO: 122414 - DNA, 132 bp, Artificial Sequence
  Description of Artificial Sequence: Synthetic coding sequence
tatcgcggcatgatgatatatgtatctactggtgcctgggggtgggccggcagttgcttttggcagtggagtttctgtccccccgcctgcgtagggtgcatcgaggaacggttacctgtgccatcttcctag

SEQ ID NO: 122415 - DNA, 201 bp, Artificial Sequence
  Description of Artificial Sequence: Synthetic coding sequence
atgctgtccaggaatgacgtgaagagactggaaaggtcgtgggcccaggggtcgagtgagcaagaactgcactatgcctcactacagagacttcctgtgccttccagtgaaggacccgatctgagaggtcgggacaagaggggaaccaaagaggatcctagagcagactatgcctgcatcgccgaaaacaagcctacttag

SEQ ID NO: 122416 - DNA, 294 bp, Artificial Sequence
  Description of Artificial Sequence: Synthetic coding sequence
atgttgtctaggaatgacgatatttgtatctacggaggtctgggtttaggtgggctactccttctggctgtggtcctgctgtccgcatgtctgtgttggcttcaccgtcgcgtgaagcgcctggaacgctcatgggctcagggctcttcagagcaagaactgcactacgctagcttgcagcggctgcctgtcccttcctctgagggtccagatttgagagggcgcgacaaacgtggcactaaagaggaccctcgtgcggattacgcctgcattgccgagaacaagcctacttag

SEQ ID NO: 122417 - DNA, 222 bp, Artificial Sequence
  Description of Artificial Sequence: Synthetic coding sequence
atgctgagtaggaacgatgtcaaacgtctggaacgctcatggcaccttctgagttggtctcaggctcagggatctagtgaacaggagctacactacgccagtcttcagcgtctgccagttcccagttccgagggccccgatctgagaggacgtgacaagcgaggcacaaaagaggatccacgcgcagattacgcctgcattgccgaaaataagcctacttag

SEQ ID NO: 122418 - DNA, 42 bp, Artificial Sequence
  Description of Artificial Sequence: Synthetic coding sequence
atgttaagcaggaatgacgaggccgctagtgctcagcaatag

SEQ ID NO: 122419 - DNA, 276 bp, Artificial Sequence
  Description of Artificial Sequence: Synthetic coding sequence
atgatctacgtgagcacgggagcctggggctgggccggctcttgtttctggcagtggagcttttgtcctcccgcgtgcgttgggtgcatcgaagaacacctgctgtcatggtcccaggcacagggcagctcagaacaggagctgcactatgcaagcttgcagagacttccagtgccgtcatcggagggccctgatctgaggggccgagataagagaggtacgaaagaggacccacgggccgactacgcctgcatcgcagagaacaaaccaacctag

SEQ ID NO: 122420 - DNA, 276 bp, Artificial Sequence
  Description of Artificial Sequence: Synthetic coding sequence
atgatctacgtgtctacaggagcttgggggtgggctggaagttgcttttggcaatggagcttttgtccaccagcctgtgtcggctgtattgaagagcatctgctcagctggtcccaggcacagggctcatctgagcaggagctccactatgcctcgctgcagcgcctgccagtgccttcttccgaaggtccagatctgcgaggacgcgacaaacgcgggacaaaggaagacccccgggctgactacgcctgtatagccgagaacaagcctacatag

SEQ ID NO: 122421 - DNA, 276 bp, Artificial Sequence
  Description of Artificial Sequence: Synthetic coding sequence
atgatttatgtgtccacaggagcctgggggtgggctggatcctgcttctggcagtggtcattctgccctcctgcctgcgtgggctgtatagaggagcatctgttaagctggtctcaggcacaaggatcttccgagcaggaactgcactacgcgagcctccaacgcctcccagtgccaagctcagaagggcctgacctacggggacgcgacaagagaggtacaaaggaggaccctcgagcagactatgcatgcattgccgagaataaacctacctag

SEQ ID NO: 122422 - DNA, 108 bp, Artificial Sequence
  Description of Artificial Sequence: Synthetic coding sequence
atgttatcacgtaacgacgccccctccgtgttagtgcccggccccggccttctcagagctggcactccattatgcatctcagcagaggccgcgagcgcccagcagtag

SEQ ID NO: 122423 - DNA, 276 bp, Artificial Sequence
  Description of Artificial Sequence: Synthetic coding sequence
atgatctatgtgagtacgggggcctggggttgggcaggcagctgtttttggcagtggagcttttgtccacccgcttgcgtgggctgtattgaggaacatctgcttagctggagccaggctcaggggtccagtgaacaggagctccactacgccagtctccagcgtctgccagtccctagctcagagggccctgatttgcgaggccgagataagcggggtaccaaggaagatcccagagctgattatgcttgcatagccgaaaacaaacccacctag

SEQ ID NO: 122424 - DNA, 108 bp, Artificial Sequence
  Description of Artificial Sequence: Synthetic coding sequence
atgttgtcccggaacgacgctccatcagtcctagtcccaggccccgggttgctgcgggccggtactcctctctgtattagtgccgaggccgcctccgctcagcaatag

SEQ ID NO: 122425 - DNA, 108 bp, Artificial Sequence
  Description of Artificial Sequence: Synthetic coding sequence
atgctctcacggaatgacgccccctctgtgctcgtgcctgggcccggcctgttgcgggccggaacacctttatgcatctcagcagaggcggccagcgcacagcagtag

SEQ ID NO: 122426 - DNA, 276 bp, Artificial Sequence
  Description of Artificial Sequence: Synthetic coding sequence
atgatttacgtgagcacaggagcctggggctgggcgggcagttgcttttggcagtggagcttctgtccccccgcgtgtgtcggctgtattgaagaacacttgctgagttggtcacaggcccagggctccagtgagcaggagctgcattacgcttccctgcagagactgccagtcccctcctccgagggaccagacttaagaggccgagataagcggggaaccaaggaagatcctcgagcggactacgcgtgcatagccgagaataagcccacatag

SEQ ID NO: 122427 - DNA, 276 bp, Artificial Sequence
  Description of Artificial Sequence: Synthetic coding sequence
atgatctatgtatcgacaggcgcgtggggctgggctgggtcctgtttctggcagtggagcttctgcccacctgcttgtgtgggctgcattgaggaacatcttttgtcctggagccaggcacagggcagcagcgaacaggagctgcattacgcttctctgcagcggctgcccgtcccgtctagtgagggacccgacttgcgcggacgcgacaagagaggcaccaaagaagatccaagggccgattatgcatgcatcgctgagaataagcctacatag

SEQ ID NO: 122428 - DNA, 108 bp, Artificial Sequence
  Description of Artificial Sequence: Synthetic coding sequence
atgctctctaggaacgacgcccccagtgtcctggtgcccggtcccgggctgctccgagcagggaccccactgtgcatcagtgctgaggcagcatctgcacagcagtag

SEQ ID NO: 122429 - DNA, 108 bp, Artificial Sequence
  Description of Artificial Sequence: Synthetic coding sequence
atgctctctaggaacgacgcaccaagcgttctcgttcctggaccaggccttctgcgggccggcacccccctgtgtataagtgcagaggcagccagtgctcagcagtag

SEQ ID NO: 122430 - DNA, 108 bp, Artificial Sequence
  Description of Artificial Sequence: Synthetic coding sequence
atgttgagcaggaacgacgcaccatcggttttggtgccaggccccggactattgagggcggggacacccttgtgtatcagcgcggaagctgcatctgcccagcagtag

SEQ ID NO: 122431 - DNA, 108 bp, Artificial Sequence
  Description of Artificial Sequence: Synthetic coding sequence
atgctgagcaggaacgatgctccgtcggtcctcgtccctggtcctgggttactgcgcgccggcactcccctttgtatcagtgcggaggctgccagcgcacagcaatag

SEQ ID NO: 122432 - DNA, 276 bp, Artificial Sequence
  Description of Artificial Sequence: Synthetic coding sequence
atgatctatgtgagtaccggcgcatggggctgggctggttcctgtttttggcagtggagcttttgtcctcctgcttgtgtaggatgcatcgaggaacacctgctcagctggtcacaagcacagggcagtagtgagcaggagctgcactacgcctctctacaacgactccctgttccatcttctgagggacctgatttacggggcagagacaagagaggcaccaaggaggaccctcgtgcggattatgcctgcattgccgaaaataagcccacctag

SEQ ID NO: 122433 - DNA, 843 bp, Artificial Sequence
  Description of Artificial Sequence: Synthetic coding sequence
atggaacgtgaaatggtattatgtctggcccagactatccacactcaggaagatcttcccagacccagcatatccgcggagcccggcacagtcatccctctaggatctcacgtgacatttgtgtgtagaggacccgtgggggtccagacatttcgcttggagcgggaaagccgtagtacatacaacgacacagaagacgtttcgcaggcttctcctagtgagagcgaggcaaggttccgaatagacagcgtttctgaggggaatgcaggcccttaccggtgcatctattacaagcccccaaaatggagtgaacaatccgactacctagagctcctggtgaaggagacaagcggtggtccagatagccccgacacagagccaggtagttccgccggaccaactcaacggccctccgataattcacacaacgaacatgctcccgccagccagggccttaaggctgagcacctgtacatcctgatcggtgtatcggtcgtttttttgttctgcctactacttctcgtgttgttttgcctgcaccgccagaatcagattaagcagggacccccgcggagcaaggacgaggaacagaaaccccagcagaggccagacctcgccgtcgacgtcctcgagcgaacggccgataaggctacggtgaacggactccccgaaaaggacagagagacagacacgtccgctttggccgctggcagctcccaggaggttacgtatgcacagctggatcactgggctctgactcagcggactgcacgggctgtttctcctcaatctaccaagccaatggctgaaagtataacatacgccgccgtggctcggcactag

SEQ ID NO: 122434 - DNA, 813 bp, Artificial Sequence
  Description of Artificial Sequence: Synthetic coding sequence
atgagtcctcacccaacagccctgttaggtctagtgctatgcttggcacagacaatccacacacaggaggaggatctcccaagaccgtccatcagtgccgagcctggcacagtgatacctctgggatcccacgtgacttttgtttgtcgcgggcccgtgggggtgcaaaccttccgtctggaacgggagtcacgtagcacttacaacgacactgaagatgtctctcaggcttcaccgagtgaatcggaggctcggtttaggattgatagcgtcagtgagggcaacgccggaccctataggtgtatatattataagccacccaaatggtcagaacagtcagactatttggagctgctcgtcaagggtccaactcagagaccaagcgataattctcacaatgaacatgctcccgccagccagggcttgaaagccgagcacctctacattttgattggcgtgagcgtggtgttcctcttttgtctgctgctcctcgtacttttttgcttgcacaggcaaaaccagataaagcagggccccccccgatctaaagatgaggaacagaagccacagcaacgtccagacttggcagttgacgtgttagaaagaacagcagacaaggctaccgtcaatgggctacctgagaaagatcgtgagaccgatacatccgccctggccgccggaagctcccaggaggttacatatgcgcagttagaccattgggccctgacccaacgtaccgcgcgagctgtttcaccacagtctactaaacctatggctgagagtataacctatgcagcggtggctaggcattag

SEQ ID NO: 122435 - DNA, 864 bp, Artificial Sequence
  Description of Artificial Sequence: Synthetic coding sequence
atgagcccccaccccacagctttgctcggcctggtgctctgcctagcgcaaaccattcatacccaagaagaggacctcccacggccctccatttctgctgagcctggaactgtgattcccctgggcagtcatgtgacattcgtgtgtagaggtcccgtgggcgtgcagacatttaggcttgagagagaaagccgttcaacttacaacgatactgaggatgtgagtcaggcttcccccagcgagtctgaggcgcgattccgtattgacagcgtgagcgagggcaatgcgggaccgtataggtgtatctactacaagcccccaaaatggagcgagcaatcagattacctggagttgcttgtgaaggagaccagcggaggccccgactcaccggacacagagcccggttcatcggctggcccaacacagaggccatccgataactctcataatgagcacgcacccgcgagtcagggcctgaaggctgagcacctctatatattgatcggtgtgtcggtggtctttctgttttgtctcctgttgctggtactcttttgcctacatcgccagaaccagatcaaacagggcccacctcgctctaaagacgaggagcagaagccccagcagcggcctgatttggcggtggacgtactagagcgaaccgccgataaagccacggtgaacgggcttcctgagaaggatcgggagaccgatacaagcgctctcgccgctggttcgtcacaagaggtgacctacgcccagcttgaccattgggcacttacccagaggaccgcccgcgcagtgtccccacagtctactaaaccaatggccgaatccatcacttacgctgccgtggctagacactag

SEQ ID NO: 122436 - DNA, 1545 bp, Artificial Sequence
  Description of Artificial Sequence: Synthetic coding sequence
atgctcacccgcgtgaagagcgcagtggccaattttatgggaggtatcatggctgggtcaagcggaagcgagcatgggggcgggtcctgcggaggtagcgatctgccactgcgattcccctatggtcggccagagttcctgggcttaagccaggatgaagtcgaatgtagcgctgatcatatcgctcgaccgatccttattctaaaagagacaagaagacttccttgggctaccgggtatgctgaagtgataaatgctgggaaatcgacacacaacgaggatcaggcctcttgtgaagtactcaccgtcaagaagaaggcaggcgcggtcacctcaacccccaatagaaactcctccaagaggaggagtagcctaccaaacggtgaaggactccagctcaaggaaaattctgaatccgaaggagtcagctgtcactactggtccctgttcgacggccatgccggctctggagccgctgtggtagcatcgcgcctgttgcaacaccatattacagagcagctacaggacattgtggatatactcaaaaacagtgcagtgttgccaccaacctgcctcggggaagaaccagaaaatacccccgctaactctagaacactgacacgcgctgctagtttgaggggtggagtgggcgcgcccggcagtccctcaacaccaccaacacgcttcttcacagagaagaagataccacacgaatgtcttgtgattggcgcgctggaaagtgccttcaaggagatggacctgcaaattgagagagagcggtcatcctacaatatttctggaggctgcacagccctgatagtgatttgcctccttgggaagctctatgtggcaaacgccggtgacagccgcgcaatcatcatccggaatggggagatcattcccatgtcctccgaatttactccagagaccgaacggcagagactgcaatacctcgcgttcatgcaaccacatctgctgggcaatgaatttactcacttagagttcccacgccgtgtgcagaggaaagagcttggcaagaagatgctgtatcgggacttcaacatgacagggtgggcgtacaagaccattgaagatgaggatctcaagttcccactgatttacggggaggggaaaaaggctcgcgttatggctaccattggagtgacgaggggcttgggtgaccatgaccttaaggttcacgactccaacatttatatcaagcctttcctgtcttctgcgccagaagtgaggatttacgatcttagcaaatatgaccatggttctgatgatgtcctgattctcgctactgatggactatgggatgtgctgagcaatgaggaagtcgctgaggccataactcagttcctacccaattgcgatccagacgaccctcatcgttacacgctggccgcccaagacctcgtgatgagggcccgaggggttctcaaagataggggctggcggatttccaacgaccgcctcggcagtggggatgacatatccgtgtacgtgatacccctgattcacgggaataaactgagctag

SEQ ID NO: 122437 - DNA, 1527 bp, Artificial Sequence
  Description of Artificial Sequence: Synthetic coding sequence
atgttgccgcagcgaaatctgtctaagcgtcaggttcctactatgcatatcccagtaaaaaccaggcgtctgctcgccgcgttaaaagtgcttgacacaaaggatctgacaattgaaaaagtagtcataaatggtcaggaggtgaagtatgctctgggtgagcgccagtcctataagggcagccctatggagattagtctgccaattgccctgagcaagaatcaggagattgtgattgaaatatcattcgagaccagtcccaaatcttccgcgttgcagtggctgaccccagaacagaccagcgggaaggaacatccttatctgttctcccagtgccaagccattcactgtcgcgcaatcctcccctgccaggacacaccatctgtaaaactcacttatactgcggaagtctctgtgccaaaggaattagttgccctcatgagtgctatcagggatggggagacgcctgatccagaggatccatctcgtaagatttataaatttatccagaaggtacctatcccctgctacctgattgccctggtggttggcgctctcgagtctcgacagatcggcccaagaactctggtgtggtccgaaaaagagcaggtggagaagtctgcctatgaattctctgagacggaaagcatgctcaagatagccgaggatctgggcggcccttacgtatggggacagtacgacctcctggtgctccctccctcgttcccctacgggggcatggagaatccatgcctgacattcgtgactcccaccctactggccggagacaagagtctgagtaacgtgatcgcacacgagatcagtcattcctggacgggcaatctggtgacaaataagacatgggatcacttctggctgaatgaagggcacacagtgtatttggagcggcacatatgtgggcgtctgttcggcgaaaagtttcggcattttaacgcgctggggggttggggggagttacagaactctgtgaagacttttggagagacacatccattcacgaagctcgttgtggatctgactgatattgacccagacgtagcctatagtagtgtgccctacgaaaagggtttcgctttgctattttacttggagcagcttctgggcggacctgagatttttctcggcttcctgaaggcatatgtcgaaaaattttcatacaagagtatcacaactgatgactggaaggactttctgtattcttactttaaagacaaagttgatgtgctgaatcaggtggactggaacgcatggctctattcacccgggctgccccctatcaaacccaactacgacatgacccttaccaacgcgtgcatcgccctgtcccagaggtggattactgcaaaagaagatgatctaaatagctttaatgcgacagacctaaaggacctctcatcacaccagctgaatgagtttcttgcccagacactgcagcgtatggctgccgccctgcatagtattcaggtgggggggcggaacagctttggcgccaaggatgggaactag

SEQ ID NO: 122438 - DNA, 1764 bp, Artificial Sequence
  Description of Artificial Sequence: Synthetic coding sequence
atgctcccccagcgcaatcttagcaaaaggcaggtcccaactatgcacattcctgtgaagacgcgacggcttctcgcagctctcaaggtactggacactaaggacctaactatcgagaaggtcgtcatcaatgggcaagaagttaaatacgctttaggcgagcgtcagtcttataagggaagtccgatggagatctcgcttccaattgctttaagcaaaaaccaggaaatcgttattgagatctcatttgagacctcacccaagagcagcgcgctgcagtggctcactccggaacaaaccagcggcaaggagcacccctacctgtttagtcaatgccaagctattcactgcagggccattctgccctgccaggacaccccaagcgttaagctgacttatacagccgaagtgagcgttccaaaagagcttgtggccctgatgagcgccatccgggatggcgagaccccagaccccgaggacccttcaaggaaaatttacaaattcattcagaaagtgcccataccttgctacttgatcgctttagtcgttggagccctcgagtccagacagattggccctaggaccctcgtttggagcgagaaggagcaggtcgagaagtccgcttacgaattctcagaaacagagtccatgctgaaaatcgcggaggacctgggcggcccatacgtgtggggacaatatgatttgctggtgttacccccgagcttcccctatggcggtatggaaaacccctgcctcaccttcgtgactccgacactgttggcaggggacaagagccttagcaacgtgatcgcgcatgagatctcacactcttggactgggaatctcgtgactaacaagacttgggaccatttctggctcaacgaggggcacacagtctatctggagcgccatatttgtggtcggctgttcggggaaaaattccgtcattttaatgcccttggcgggtggggcgaacttcagaattcagtgaaaactttcggggaaacccacccatttaccaagctggtggtggacctgaccgatatcgacccggatgtggcctattcaagcgtcccatatgagaagggttttgccctccttttctatctggaacagctcttgggcggcccagaaattttcctcggttttctaaaagcctatgttgaaaagttctcttataagagcattaccactgatgactggaaggatttcttgtactcatatttcaaggacaaggtggacgtgctaaaccaggtggattggaatgcttggttatacagtccaggattaccgcccattaagcccaattacgatatgactctcaccaacgcctgtatcgccctcagccagaggtggataacagcgaaggaggacgatcttaactccttcaacgccacggacctcaaagatttgtcttcccaccagctcaacgaattcctggcgcagaccctgcagcgggccccgcttcctctggggcatattaaacggatgcaagaggtgtacaattttaatgcaattaataattctgaaattaggtttagatggctgcggctgtgtatccagagcaagtgggaagacgcaatacccctggccctcaagatggctaccgagcaggggaggatgaaattcactagacccctttttaaagatctcgccgcatttgataagagtcacgatcaggccgtccggacgtaccaggaacataaagcatcgatgcaccctgtaaccgctatgctcgtggggaaagacttgaaagtggattag

SEQ ID NO: 122439 - DNA, 1059 bp, Artificial Sequence
  Description of Artificial Sequence: Synthetic coding sequence
atgaatactacatcgagtgctgctccacctagtcttggcgtcgaattcatcagtcttctcgctatcatactcttatccgtagcactggcggttggcttacctggtaattccttcgttgtgtggtcaatcctgaagcgcatgcagaagcggtcagtcaccgcactcatggttttaaacctggccctcgccgatctcgcggttctcctgacagctccattcttccttcatttcttggcgcagggtacttggagctttggtcttgccggatgtagattgtgtcattacgtgtgcggcgtgagtatgtatgctagtgtgttgctgatcaccgctatgagcctcgaccggagcttagctgttgcccgccctttcgtttctcaaaagctgagaactaaggccatggcccggcgggtgctggccggaatctgggttttatcatttttgttggcaacccctgtcctagcctacagaactgtggtgccttggaagactaatatgtccctatgttttcctcggtacccttcagagggccaccgcgccttccatttgatctttgaggccgtcactggattcctgctacccttcctggcggtagtggcatcttactcagatattggcagacgtctgcaagcgagaagatttcgacgaagccgacggaccggacggctggttgtgttgatcatcctcaccttcgctgccttctggctcccttatcacgttgtgaacctagctgaggctggtcgggcattggccggtcaggccgccgggctgggtctggtaggcaagaggctctcattggctagaaatgtgctcattgccctggcctttctgtcctcttcagtgaatcctgtcctgtacgcctgtgctggcggcggcctgctgcgcagcgcaggcgtcggatttgtcgccaaactgctggagggaaccggctcagaagcttcctcaactcgtagaggaggttccctcggccagaccgcacgcagtggtcctgccgctttagaacccggcccaagtgaatctctaaccgcatcatccccactgaagctgaacgaactgaattag

SEQ ID NO: 122440 - DNA, 1059 bp, Artificial Sequence
  Description of Artificial Sequence: Synthetic coding sequence
atgaacaccacatcttcagctgctcccccatcgctgggggtggagttcatcagcctcctggcgataatccttctgtccgttgccctagccgtcggtcttccggggaatagctttgtggtctggtccatccttaagagaatgcagaagagatccgttactgcactaatggtgttgaacctagccttagctgacctggcagtcctcctgaccgcacctttcttcctgcacttcctcgcccaggggacatggtccttcggcctggctggctgcagattgtgccactatgtgtgcggtgtgagcatgtacgccagcgtgctcctgatcactgcaatgtccctcgacaggtctctggccgtcgctaggccatttgtgagtcaaaaactccggactaaggcgatggcacgtagggttctcgccggcatctgggtattatcattcctgttggccactccagtcctggcataccgcaccgtggttccatggaaaaccaatatgtcactctgcttcccccgctatccgtcagagggccaccgcgcttttcacttgatctttgaggcagtaaccggttttctgctcccatttctggctgttgtggcctcatattccgatattgggaggcggcttcaagcaagaaggttccgacggtcccggcgtaccggtcgcctcgtagtcctgatcattctaactttcgccgccttctggctgccatatcacgtcgtgaacctagcagaggcagggcgtgcattggcggggcaggccgccggccttggcctggtggggaaacgccttagtctggcaaggaatgtacttatcgctctggcattcctgagttccagcgtgaacccggtgctatacgcatgcgctggcggggggctcctcaggtctgcaggcgtggggtttgttgctaagctactggaagggacaggcagtgaagcttcttccactagaagagggggtagcctaggccagacagcccggtctggcccagcagctctcgagccggggccttccgaaagtctgaccgcatcgtcaccactcaagctcaacgagctgaactag

SEQ ID NO: 122441 - DNA, 1059 bp, Artificial Sequence
  Description of Artificial Sequence: Synthetic coding sequence
atgaacactacaagctccgcagctcccccatccctgggcgtggaattcattagtttgctagccattatcctgctaagcgtcgcattggccgttggcctgccgggcaattctttcgttgtttggtcaattttgaagagaatgcaaaagcggtccgtgacggcactcatggtcctaaacttagcccttgccgaccttgccgtcctgctcaccgcccccttcttcctgcacttcttggcgcagggtacctggagctttggcttggccggatgtcgcttatgccattatgtgtgcggcgtttccatgtacgcatcagtcttactaatcacagctatgagtctggataggtccttggcagtggcaaggccctttgtttcacagaaactccggacgaaggcaatggctcgccgggtccttgcaggcatctgggtgttatccttcctgttagcgaccccagttctggcctacaggactgtagtcccttggaaaaccaacatgtctttgtgttttccacggtacccctcagagggacatcgtgcctttcatcttattttcgaggccgtcacaggcttcctattacccttcttggctgtggtcgcgagctactccgatattgggcggaggttgcaggcaagacgcttccggagatcacggagaacagggcgcttagtcgtgctgattattctgacattcgctgctttttggctcccatatcacgtggttaatctggccgaagctggtagggctctggccggccaagccgccggactggggcttgtgggcaaacgtctgagccttgcacgtaacgtcttaatcgcactagcattcttgagcagctcggtcaaccccgtgctgtatgcttgtgcaggcggaggactgctacgctctgcaggagtgggcttcgtggcgaagttgctggaaggaacaggcagcgaagccagcagcacaagaagaggtgggagcctcggccaaactgccagatcaggccccgcggccctcgagcccgggccctcggagagccttactgcttccagtccactgaagctgaacgagctgaactag

SEQ ID NO: 122442 - DNA, 309 bp, Artificial Sequence
  Description of Artificial Sequence: Synthetic coding sequence
atgaatactacctctagcgccgcacctccatccctgggggtcgagtttatatcactgctggccatcattctgttatctgtggccctagctgtcggactcccaggcaactccttcgtggtctggagtatcctgaagcgcatgcagaagagatccgtgacagctcttatggttctaaatctcgctttggccgacctagccgtcctcctgacggcaccattctttttacacttcctcgcccagggcacctggtcattcggactggccggttgccgcctctgccattacgtctgcggagtgagcatgtactag

SEQ ID NO: 122443 - DNA, 483 bp, Artificial Sequence
  Description of Artificial Sequence: Synthetic coding sequence
atgtctgtgtgttaccgaccgcccggtaatgagacactcctgagctggaaaaccagcagggccactggaaccgcctttttgcttctggctgcccttctaggccttccaggaaacggctttgtcgtgtggtccctggccgggtggcggccagctcgtgggcgcccactagctgccactctagtcctgcatctggcactcgctgacggcgcagttctgttacttactcccctcttcgtggcctttctaactcggcaagcttggcctcttggacaggccggctgcaaggctgtgtactacgtgtgtgcgctttcaatgtacgcaagcgttctcctcaccgggctcttgtcacttcagaggtgtctggcggtgacccgtccatttctggccccgcggcttcggagtccggcccttgcaaggaggctgctgctggccgtttggttggccgcgttgctcttagccgtcccagcagccgtctacaggtag

SEQ ID NO: 122444 - DNA, 1170 bp, Artificial Sequence
  Description of Artificial Sequence: Synthetic coding sequence
atggccccatcacaccgggcgagccaggtcggcttttgccctacccctgaaaggccactctggaggttgccgcccacttgccgtccacgccgaatgagtgtctgttatagaccaccaggcaacgaaacgctgctgtcttggaagacctcccgtgccacaggtactgcattcctcttgctggccgcactgctgggcctccccggaaacgggtttgtggtgtggagcctggccggttggcgaccagcccgaggcaggccattagctgccactctcgtgttacatctcgccttggctgatggagccgtgctgctgttgacccccctctttgtggcgttccttacgagacaagcctggcccctcggccaggccggatgtaaggcagtgtattatgtttgtgctctgtcaatgtatgcgagcgtactgctcactggattgttatctttgcagcggtgcctggctgtcacacgaccgttcctcgcgccacgtttgaggagccccgccctcgcgcggagacttttactggcagtgtggttggcagcactcctgctggccgttcctgccgcagtataccgtcacttgtggcgcgaccgcgtgtgtcagctctgtcatccaagccccgtgcatgcagccgcccacctgtcactggagacactgaccgcttttgtactgccttttgggttaatgctaggatgctatagcgtcactctcgccagattgcggggtgcaagatggggatcaggtcgtcacggtgccagagtgggtcgcttggtgagcgccatcgtgctcgcatttggactcctgtgggctccttaccacgcagtgaacttgttgcaggccgttgccgctctcgccccccccgagggcgccctggccaagctgggaggggctggacaggctgcaagggctggaacaacagctctcgcctttttcagtagcagcgtgaaccctgtgctgtacgtatttacagccggtgatttgctgcccagagcgggcccccggtttttgactcggctgtttgaagggtccggcgaggctcgcggcggaggtagatcgagggaaggtactatggagcttcgcactactccacaactaaaggtggtaggccaggggcgcgggaacggggacccgggggggggcatggaaaaggacggaccagagtgggatctgtag

SEQ ID NO: 122445 - DNA, 960 bp, Artificial Sequence
  Description of Artificial Sequence: Synthetic coding sequence
atgtctgtgtgctatagaccgcctggcaacgagacccttctgagttggaaaaccagccgcgctacaggtactgcttttctactactcgctgccctactgggtctgcccggcaacggtttcgtggtgtggtctttggccggctggaggcctgccagggggcgccctttggcagccaccctggtgttacacctcgccctggccgatggggcagttctgctgctcaccccactctttgtggcattcctcacaagacaggcttggcctttaggccaggcgggctgcaaggcagtctactatgtgtgcgccctttcaatgtacgcctccgtgctccttactggactgcttagcctccagcgatgcctggcagtcaccaggccattcctggcgccacggttgcggtctccggccttagcccgcaggctgctgctcgccgtctggctagccgctttgcttctcgccgtcccggctgccgtgtatcgacatctgtggagagaccgtgtctgtcagctgtgtcatcctagtccagttcacgcagcagctcatctgagtctcgaaacacttaccgctttcgtgctgccgttcgggctgatgctcggatgctactctgtcacacttgccaggctacgaggagcccgttggggatctggacggcatggtgcgcgtgtaggtagattagttagcgcaattgtgttggctttcggactcttgtgggccccttaccacgctgttaatttgctgcaagccgtggctgctctggctcctcccgaaggggccctggccaagctgggaggggcaggccaggcagcaagagccgggaccaccgccttggcattttttagctcgtccgtgaaccctgtactgtacgtgttcactgcgggggatcttctgcctagggctgggcctaggttcctcacgagactcttcgagggatccggagaggcccgcggcggtggccgctag

SEQ ID NO: 122446 - DNA, 1077 bp, Artificial Sequence
  Description of Artificial Sequence: Synthetic coding sequence
atgtccgtgtgttatcgtcctcccggcaacgagactctgctttcttggaagacatcccgcgcgactgggacagcttttctcctgcttgctgcactgctaggcctgccaggaaacgggtttgtggtttggtctttggccggttggcggcccgcgagaggcaggccgttggccgcaactttggttctgcatctcgctttagccgatggagccgttctgttgttgactcccctgttcgtggcctttctcacccgccaggcctggcccttaggacaggcagggtgcaaagccgtgtattatgtatgtgcactgagcatgtacgcctctgtgctgctgaccggtttgcttagccttcagcggtgtctcgcagttaccaggccgtttctagctcctagattacggagccctgcactcgcccgccggttgttactggctgtctggctcgcagccctgctccttgccgtgccagcagcagtctataggcatctgtggagagaccgggtgtgtcagctttgtcacccatcccctgtgcacgctgccgcccacctgtcattggagacgcttaccgccttcgtcctgccgtttgggttgatgctcgggtgttacagtgtgacactggcccgcttacgcggggctagatggggctccggcaggcatggggcccgcgttgggcgactcgtctctgccattgtgttggcctttggactgctttgggccccataccatgccgtgaatctacttcaggcggtcgctgcactggctcctcccgagggagctctcgcgaagctgggcggtgccggccaagctgcgcgtgccgggaccacagcccttgccttcttcagttcttcggtgaatcccgtgctgtatgtgttcaccgccggggatctcttaccaagggcaggcccaagattcctgactcggctgttcgagggcagcggggaggctcggggtgggggaaggtctcgcgaaggcacaatggagctgaggactacaccacagctcaaggttgttgggcagggacgcggaaacggagatccaggtggtggtatggaaaaagatgggcctgaatgggacctgtag

SEQ ID NO: 122447 - DNA, 1077 bp, Artificial Sequence
  Description of Artificial Sequence: Synthetic coding sequence
atgagcgtctgctatcgtccaccaggaaacgagaccctcctttcctggaaaaccagtcgcgcaactggcaccgctttcttgcttctcgccgcactcctgggcctgccgggaaacggattcgtcgtttggtctctggcgggttggcgacctgctagagggcgcccactggccgctaccctagtcctacatcttgccctcgccgatggggcagtgctgcttttgaccccgttgttcgtagcatttttgaccagacaggcctggccactcggacaggctgggtgcaaagccgtttactatgtttgcgccctctcaatgtacgcttccgtcctgctgaccgggttgctcagcctgcagaggtgcctggccgttacccggccatttttggccccccggcttagatcccccgctctggccaggcgcctgcttttagctgtttggctggctgcactgctcttggccgtgccagccgccgtgtaccgccacctgtggcgggatcgagtatgtcagctttgccatccatcgccagtccatgccgccgcccacctgagcctggagacattgaccgccttcgtactgccattcggcctcatgttagggtgctactctgttacgttggcacgattgcgaggagctcgttggggctctggcaggcacggcgccagagtgggcaggctggtgagcgctattgtgcttgccttcggcctgctatgggccccctatcacgctgtgaacttgttacaagctgtggccgcactggcgcctcccgagggggcactggctaagctgggaggggccgggcaagccgcccgtgcagggactacggcactcgccttcttttcctcctccgtcaatcccgtgctgtatgtatttaccgcgggcgatttactccctcgtgcgggaccccggttcttgaccaggctgttcgagggatccggagaagctcgggggggaggacgttcaagggaaggcactatggagcttcgcactaccccccagttaaaggtagtgggccagggcagggggaacggagaccccggaggaggcatggagaaggacgggccggagtgggatttatag

SEQ ID NO: 122448 - DNA, 453 bp, Artificial Sequence
  Description of Artificial Sequence: Synthetic coding sequence
atgaaggacgaggtagctttgcttgccgcagtaacgctgctcggagtcctactgcaggcctacttcagcctacaggtgattagcgccagacgcgcgttccgagtgagtcccccacttacaaccggccccccagaattcgaacgcgtttatcgagcccaggtgaattgtagcgagtactttccactcttcttggccacactttgggtggccggaatcttcttccatgagggggccgcagcactctgcggcctagtgtatctgtttgcccggctgcgctactttcagggctatgcccggagtgctcagttgcgacttgccccgctgtacgcttcggcgcgcgcactctggcttctggtggccctcgccgccctcgggcttttggcgcatttcctccccgccgccctgagagccgctcttttgggtcggttgagaaccctgctcccatgggcttag

SEQ ID NO: 122449 - DNA, 1161 bp, Artificial Sequence
  Description of Artificial Sequence: Synthetic coding sequence
atggaagagctggatgccctgctggaagaactcgaaaggtctactttacaggatagcgacgaatattctaaccctgcacctctcccgctggatcaacatagccggaaagagacgaacctggacgaaacatctgaaatcctgagcatccaagacaatacctcccccctcccagcccaactggtttacacgacgaatattcaggaattgaatgtgtacagtgaagctcaggaacccaaagaatccccacctccttccaagactagcgccgcagcacagctagatgagctgatggctcatttaactgaaatgcaggcaaaagtggccgttagagccgacgccggaaagaaacacctcccagacaaacaggatcataaagcttcattggattctatgcttggagggctggaacaggaactgcaggatctgggcatcgccactgtgcccaagggacactgtgcaagctgtcagaagcctatagccggaaaagtgattcatgcccttgggcagtcctggcacccggagcacttcgtatgcacccactgcaaggaggagatcggttcatctcctttttttgagaggagtggtctcgcctactgccccaatgattatcaccagttattttccccgaggtgtgcttactgcgcggctcctatactagacaaggtgctgacagctatgaatcagacctggcatcctgagcattttttttgctctcattgtggggaggtgttcggagccgaggggttccatgagaaggacaagaagccctattgtagaaaagacttcctggcaatgtttagtccaaagtgtggagggtgtaatcggcctgttctggaaaattacctctcagctatggacaccgtgtggcaccctgaatgtttcgtttgtggcgactgtttcacatctttttctactgggtcttttttcgaactcgacggcagaccgttctgtgagcttcattaccatcatcgccgagggaccctgtgccatggctgcgggcagccgattacaggccgatgcatttccgccatgggatataagtttcatccagagcactttgtgtgcgcattctgtctgacacagttaagcaaaggcatattcagagagcagaatgataagacctactgtcagccatgtttcaataagctctttccactgtag

SEQ ID NO: 122450 - DNA, 1176 bp, Artificial Sequence
  Description of Artificial Sequence: Synthetic coding sequence
atgtcaaccctccttatttcatcgtctgatgccctgctggaggagctggagagatctacattacaggattccgacgaatactcaaatcccgctcccctccctctggatcagcactcccggaaggagactaatctcgacgagacgtccgagatcctatccattcaggataatacatccccacttcctgcacagcttgtatataccacaaatatccaggagttaaatgtgtattccgaggcgcaagaacctaaagagtctccccctccttccaagacgtcagcggcagctcagcttgacgagcttatggcccacctgacagaaatgcaggctaaagtggccgtacgcgcggatgctggaaaaaaacacctcccggacaagcaggaccataaagcatcgcttgatagcatgctgggcgggctcgagcaggagctgcaagacctgggaatcgccactgtgccgaagggtcactgcgcctcatgccagaagccaatagccggcaaagtgatccacgcactcggccagagctggcacccggagcattttgtgtgcacacactgtaaagaggagatcggttcctctccattttttgagagatctgggctcgcctactgccccaacgattaccaccagttattcagtccaagatgcgcctattgcgcggcgcccattctcgacaaagtcctgactgcaatgaatcagacctggcaccctgaacatttcttttgctcacattgtggcgaggtattcggggcggaaggcttccacgagaaggataaaaagccttactgcaggaaagacttcctggcaatgttttcacctaagtgtggtggatgcaatcggcctgttctggagaactatctatccgccatggacacagtttggcaccctgagtgttttgtctgtggagattgcttcaccagtttcagtacggggtcattctttgagttggatggaagaccattttgtgagttgcattatcaccaccgccgtggaacactatgccacggctgcgggcagcctatcactgggagatgcatttctgctatgggctataaattccatcctgagcactttgtgtgtgctttttgcttgacccagctcagtaagggtatcttccgtgagcagaacgacaaaacatattgccaaccttgttttaataaactctttccactgtag

SEQ ID NO: 122451 - DNA, 1131 bp, Artificial Sequence
  Description of Artificial Sequence: Synthetic coding sequence
atgaactacgaattcgaaagagagattgggttcatcaactcacagccatccttagcggagtgcttgacctcttttccaccagtggcagatacattccaaagctcatcaataaagacctctactctgtctcacagtacccttatcccaccccccttcgagcagacaattccatctctgaaccctgggagccatccaagacacggggccgggggcagacccaaaccaagtccagccggttcgcgggggagtcctgtccccgccggcgccctccagccacctgagtacccttggatgaaagagaagaaagctgcaaagaagacagcccttctgccagcagctgccgccgctgcaacagccgcggctactggacccgcttgccttagtcacaaggagtcactggagatagccgatgggtccgggggcggaagccggagactgagaacagcatatacgaatactcagctgttagaactggagaaagagtttcatttcaataagtatttatgccggccacgaagggtggagatagccgcactcctagatctcactgaacggcaggtgaaggtgtggtttcagaataggagaatgaagcataagcgccaaacccaatgtaaggagaaccaaaattcagagggcaaatgtaaatctttggaagactccgagaaagttgaagaagacgaggaagaaaaaactctgttcgagcaggccttgagcgtgtccggcgcactgctggagcgcgagggatatacgtttcaacaaaatgccctgtcccagcagcaggctcctaatggacataatggggatagccagtctttccctgtttcgccattaacatccaacgagaaaaacctcaagcatttccagcaccagtcgcccaccgtgcccaactgtttgagcaccatggggcagaattgtggggccggtcttaacaacgactcgcctgaggccctggaagtgccaagcctgcaggatttttctgtcttctccacagactcatgtctccagctgtctgatgcagttagccccagtcttcccggatctctggatagccctgtggacatcagtgccgattctttggattttttcaccgacaccctgacgacaatcgacttacagcatcttaactactag

SEQ ID NO: 122452 - DNA, 753 bp, Artificial Sequence
  Description of Artificial Sequence: Synthetic coding sequence
atgacacccggtcgatgttgcctcgcagccgacatccaggttgaaactttcatcttcactgatggggaggacgaggcacttgcccgccacactggaaatgtggttatcaccaactgctcggcggcccattcccgccaggccctcagctgtaaaatggctgtggaatatgacaggtttatcgagtcagggagaaagtggttctgtcacgtggacgacgataactatgttaatcttagagccttgttacgactgctggcatcttatccacacacgagggatgtctatgtagggaaaccctccctggatagacccattcaggccatggagagagtttccgagaacaaagtgagacctgttcacttctggtttgcaactgggggggccggcttctgcatttcacgaggtctggccctgaagatgagtccttgggctagcggcggacacttcatgaatacagctgaacgtattagactgccagatgactgtacaatcggctacatcgtggaggcattgctgggcgtgcccctgatacgaagcgggctctttcatagtcacctggaaaatcttcagcaggtgcccacaagtgagctgcatgaacaagtaactctgagttacggaatgttcgaaaacaaaagaaatgccgtgcatgtcaaagggccattcagtgtggaggccgacccttcgagatttcggagcatacactgtcacttgtatccagacaccccatggtgcccaaggaccgctattttctag

SEQ ID NO: 122453 - DNA, 1086 bp, Artificial Sequence
  Description of Artificial Sequence: Synthetic coding sequence
atgctgaaaaggtgtggaagacgtctgcttctggccctggccggcgcactgctggcatgtttattagttctgacagcggaccccccacctccgcccctcccggcagaaagaggccggcgtgctctaagatcgctggctggtcccgctggggccgctcctgcccctggcctgggcgccgcggcagccgcccccggcgcgcttgttcgggacgtccactctttgtccgaatatttcagtctgctgacaagggctagacgagatgctggaccacctcctggagcagctccaaggcccgctgacggccaccccaggcctctggccgaacccttagcaccaagggatgtgttcattgctgtgaaaaccacaaagaaatttcaccgcgccaggctcgatctgctgctcgagacgtggatcagccgacacaaggagatgactttcattttcacagacggagaggacgaggccctggcaagacacaccggaaatgtggtcattaccaattgttccgctgcgcattcacgccaagcattatcatgcaaaatggcagttgaatacgatcggttcattgagtccggacggaagtggttctgccatgtagatgatgataattatgtgaatttgagggcgctgctaagactgctggcaagctatcctcacacgcgagacgtttatgtggggaaacccagtctggacaggcctatccaggccatggagcgagtctctgagaacaaagttagaccagtgcatttttggtttgccaccggaggagctgggttctgcatctcacgcggtctggcactgaaaatgtcaccttgggcaagcggaggccattttatgaatacggccgaacggattagacttcctgatgattgtacaatcggctacatagtggaagcgctcctgggcgtccccctgatccgctctggactctttcattcacacctcgagaatctccaacaggtgcctacgagcgagttgcatgaacaggtcaccctttcgtacggaatgtttgaaaataaaagaaatgcagtacacgtgaagggcccctttagcgtggaggcagatccgtctcgctggggcaactag

SEQ ID NO: 122454 - DNA, 753 bp, Artificial Sequence
  Description of Artificial Sequence: Synthetic coding sequence
atgaccccaggacgatgttgcctggccgccgacatccaagtggagacattcattttcaccgacggcgaagacgaagccctggcccgacacaccggaaatgtagtgattacaaactgttctgctgctcactccagacaggccttgtcatgcaagatggctgtggagtatgacaggttcatcgaatcgggacggaagtggttctgtcacgtcgacgacgacaactacgttaacctgcgagcactgctgcggctattggcgtcgtacccccatactagagacgtctatgtgggcaaaccctcattggaccgtcctatccaggccatggagcgcgtatccgaaaacaaagtgcgccccgtgcacttttggttcgctacgggaggcgccggcttctgcattagccggggcctggctctgaaaatgtcaccctgggcgtctggaggacatttcatgaacactgctgagaggatccgtcttccagatgattgcaccatcggctacatagtggaagcgctcctaggagtgcccctgatccgatccggactgtttcactcgcaccttgaaaatctacagcaggtccccacctccgagctccatgaacaggtgacacttagttacggcatgttcgaaaataagcgtaatgctgtacatgtcaagggaccgttctccgtggaagcagacccgtctaggttccgttctatccactgtcatctgtatccggacactccgtggtgcccaaggaccgcaattttttag

SEQ ID NO: 122455 - DNA, 927 bp, Artificial Sequence
  Description of Artificial Sequence: Synthetic coding sequence
atggacgaacagaccggaagactgcggctcgatacttactgcatgtctgcaaaacagatttgggcttggtcaaaatgtagtggccgcttgtgggatgagcacatgaaatggatggaggggtggaccgaccgttggactgatgggtggatggacggctggatggatgagtggtctcccacccctgcgttgaggtcttacggcggggggctttcacagcagacttttatttttaccgatggagaagatgaggcactggcaagacatacaggcaatgtggtcattaccaactgtagtgcggcccacagccgacaggcactgagttgtaagatggccgtcgagtatgatcggttcatcgaatccggacgtaaatggttttgccatgttgacgacgacaactacgtgaatttgagagccctcttgcggctgctcgcaagttatccccacacacgagacgtttacgttggcaaaccctctctggaccgaccgatacaagctatggagagagtatcagaaaacaaagtgcgtcccgtgcacttttggtttgccactggcggcgccgggttttgtatctctaggggcctggcattgaagatgtctccctgggcaagtggaggtcattttatgaatacagccgagagaatccggctgccggacgactgcactatcgggtatattgtggaggcactactgggggtgcccctcattcgatccggtctgtttcattcacatctggaaaacctccagcaggtgcccacttccgaattgcacgagcaggttactctttcatacggaatgttcgagaataagcgcaacgcagttcatgtgaaaggaccattcagcgtcgaagccgatccaagtaggttccgctctatacattgccatctgtaccctgataccccgtggtgcccacggaccgccattttttag

SEQ ID NO: 122456 - DNA, 1302 bp, Artificial Sequence
  Description of Artificial Sequence: Synthetic coding sequence
atgcagcgaatgatccagcagtttgccgccgagtacacgtctaagaacagctctacccaggacccatcccaaccaaacagcacaaaaaaccagtcactccctaaggccagtccagttactacctctccaaccgctgcaacaacacaaaaccctgtattatcaaagcttctgatggcagaccaggattctccactggacctcacggtgaggaaatcccagtctgaaccatccgaacaggatggggtgctcgacctgagcacaaagaagagcccgtgtgctgggagcaccagcctgtcacactcacccggctgtagcagtacccaggggaacggacgccccggccgtccttctcagtatcggccagacgggctgcgcagtggagatggagttcccccacgaagtctacaggacggtactcgtgagggatttggtcactctacctccttgaaggtgccccttgccagatcactgcagatcagcgaggaactgctatcaagaaatcagctgtcgaccgcagcttccctaggccctagcgggctgcaaaaccatggtcaacacctcattttgagccgcgaggcctcctgggccaagccccactatgaatttaacctttcccgcatgaagttcaggggaaatggggcgctgagtaatatcagcgacctgccctttctcgccgaaaactcagcttttcccaagatggccttgcaggccaagcaagacggcaagaaagatgtctcccatagctccccagtcgacctcaagatacctcaagtacgaggcatggacctgtcatgggaaagtaggaccggtgaccagtactcttattcttctctcgttatggggtcgcaaacagaaagtgcactctctaagaagttacgcgcaatcctgcccaagcaaagcaggaagtctatgctcgacgctgggcctgattcctggggatcggacgctgagcagagcacttccggacagccttatcccacatccgatcaggagggggatcctgggtcaaaacaacctagaaaaaaaagaggtagatataggcagtacaacagcgaaattctggaagaggctattagtgttgtgatgtcagggaagatgtcagtgtcaaaggcccagtccatttatggaatcccacactccaccttagagtacaaagtgaaagagagactcggcaccctgaagaatcctcctaaaaaaaaaatgaaactgatgcgtagtgaaggccctgacgtctccgtaaaaatcgagctggacccgcaaggtgaggccgcacagtcagcaaatgaaagcaagaacgaatag

SEQ ID NO: 122457 - DNA, 1302 bp, Artificial Sequence
  Description of Artificial Sequence: Synthetic coding sequence
atgcagagaatgattcagcagtttgccgcagaatatacttcaaaaaacagcagcacccaggacccatcccagcctaacagtacaaagaatcagtccttacctaaagcgagtcctgtcaccaccagccctaccgcagccacgactcaaaaccctgtcttgtccaaactattaatggcagaccaggacagcccccttgacctgaccgtgcggaagtcacagtctgaaccgtctgagcaggacggcgttctggacttgtctaccaagaaaagcccttgcgccgggagcactagcctgtcacactcccccggatgtagtagcacacaaggcaatggccgcccaggtaggccctcacagtatagacctgatggactcaggagcggggatggggtcccacccagaagcctgcaggacggtaccagggaaggctttgggcactccacaagcctaaaggtcccgctggcacggtcactgcagatatccgaagaactcctgtccagaaaccagcttagcaccgcagcctctttgggcccctcaggacttcagaatcacggtcagcacctgattctgagccgggaggcatcttgggccaaaccacattacgagttcaatctgagtcgcatgaagtttcgcggaaacggtgctctcagcaacatttcagacttgccatttctggcagagaattccgcttttccaaagatggccttacaagccaaacaagacggcaaaaaagacgtgagccattcctctcccgtggacctgaagatccctcaagttagaggaatggatttgagttgggagagtaggacaggtgatcagtacagttatagttcactcgtcatggggagccagaccgaaagcgctctaagtaaaaagctgcgtgctatattgcccaagcagtcacgcaagtcaatgttggatgccggccccgatagctggggttccgatgcagagcagagtacttccggccagccgtaccccacatcagaccaagaaggagatcctggcagtaaacaacctcggaaaaagcggggccgttaccgacagtacaactccgagatcttggaggaggcgatttcagtggtgatgagcgggaagatgagcgtctcaaaagcccaatccatttacggcatccctcacagcacacttgagtacaaagtgaaggagcggctgggaacgctcaagaacccccctaagaagaagatgaagctgatgcggtcagaaggtcccgacgtcagcgttaaaatcgaattagatccacagggagaggcggctcagtccgccaatgagtccaagaatgagtag

SEQ ID NO: 122458 - DNA, 1302 bp, Artificial Sequence
  Description of Artificial Sequence: Synthetic coding sequence
atgcagagaatgatccaacagtttgctgccgaatatacgtctaagaactcatctactcaagatccctctcagcctaacagtacgaagaatcagtctctgcctaaagcctccccagtaaccaccagcccaacagccgcgacaacgcaaaatccagtcctctctaagctgcttatggctgatcaggactccccgctggacctgaccgtgaggaaatctcagagtgagcccagcgagcaagatggggtgctggatcttagcacaaaaaaatctccatgtgccggatccacgagtctgtcccacagtcccggctgctccagcacacaagggaacgggcgccctggacggccaagtcagtataggcctgatggcctcaggtcaggtgacggggtcccccctaggtccctgcaagacggaactagagagggcttcgggcacagcacgagtctgaaagtaccactggccagaagcctccagatcagtgaggaactgctgtctaggaatcaactgtccaccgccgcaagcctgggcccgtcagggctgcagaatcacgggcagcatctcattctgtcgcgcgaagcatcgtgggccaagccccattacgaattcaatttaagtcgaatgaaattccgtggcaacggcgctttgtctaatatttcagacctcccctttctggcggagaacagtgcatttccgaaaatggcgcttcaggcgaaacaagatggtaaaaaggacgttagccactcatccccagtagatctcaaaatcccccaggttcggggaatggatttgagttgggagtctcgtactggagatcagtacagctatagcagcctggtgatggggagtcagaccgaatctgccctgtctaaaaaactgagggccatcctgcctaagcagtcccgtaagagtatgctggatgccgggccggacagctggggcagcgacgctgaacagagtacttctggtcaaccttatcccaccagcgaccaggagggcgaccccgggtctaagcagcctagaaagaaacggggacgctacagacaatataattctgaaatccttgaggaagccatctcagtagtgatgagtggtaaaatgagcgtctccaaggcccagtccatttacgggataccccacagtacgctggaatacaaagtgaaggagcggctcggaacactcaagaatccaccgaagaaaaagatgaagctcatgcgctcagaagggcctgatgtgagtgtcaaaatcgaattggatccgcagggcgaggcagcacaatctgccaatgaatccaagaacgaatag

SEQ ID NO: 122459 - DNA, 1221 bp, Artificial Sequence
  Description of Artificial Sequence: Synthetic coding sequence
atgcagcgtatgatccagcagtttgcagccgaatacacaagcaaaaacagctccacacaggatccttcccaacctaatagtaccaaaaatcagagtctgccaaaagccagtcctgtcactaccagtccaaccgctgcaaccacacagaatcccgtattgagtaaactcctgatggccgatcaggactcaccactcgacctgactgtgcgcaagagccagagcgaaccatctgagcaggatggcgtcctggacctttcgacaaaaaaatccccatgcgccgggagcacctccctctcacattcgccaggttgttcatcaactcaaggcaatggtcgccccgggcgcccctctcagtaccggcccgacggactccgctccggagacggcgtcccaccgcgaagcctccaggacgggacccgggaagggttcggccacagcacctccttgaaagtgccactggcgagatctcttcagatttccgaggagctgttatctagaaatcagctttcaacagcagcttccttgggaccctcaggcctgcagaatcacggccagcacctaatcttatcccgggaggcctcgtgggcaaagccacattacgaattcaacctctcccgtatgaagttccgggggaatggcgccctcagtaatatttctgacctacctttcctggctgaaaactcagcgtttcctaagatggctctgcaagccaagcaggatgggaagaaggatgtcagccactcctcccccgtcgacctgaaaatccctcaggtgagggggatggatttgtcctgggagagtcgtactggagaccagtactcatattcaagtttagttatgggttcacaaacagaaagtgcattgagcaaaaaactgagagcaattctgccaaaacagagccgaaaaagtatgctggacgccggtcctgatagctggggatccgacgccgagcagagcacctctggccagccctatcccacatcagatcaagagggcgaccccggttccaaacagccccggaaaaagcgaggtcggtacagacagtacaacagtgagatcctcgaagaggcaatctccgtggtgatgtccggcaagatgtctgtttctaaagcccaatcaatatatggtatccctcactctaccctggagtacaaggtgaaggagcgactaggtacattgaaaaacccccccaaaaagaagatgaagctcatgagtggatag

SEQ ID NO: 122460 - DNA, 957 bp, Artificial Sequence
  Description of Artificial Sequence: Synthetic coding sequence
atggataaaggcagagagcgaatggccgccgccgccgccgctgccgcagcggcagcagcggctgcacagtgtcgatctccaagatgtgccgcggaacgccgaggttttcgacgcgagctggattcgtggcggcaccgcttaatgcattgcgtcggttttgaatctatcctcgagggactgtacgggcctcgtctgcggcgggacctgagtctctttgaggactgcgagcctgaggagctcactgattggtcgatggatgaaaagtgttccttttgtaatctccaacgggaagcggtgtctgactgtatccccagtctggatagctcccaaagtacgcctactgaggaattgtcaagccagggccaaagcaatactgataagatcgagtgtcaggccgagaactacttgaacgcactctttagaaaaaaggacttacctcagaactgtgaccctaatattccccttgtggcccaggagttgatgaaaaagatgatcaggcagttcgccattgagtacatcagcaagagtggcaagacgcaagaaaatcgcaatggatccatcggaccttcaatagtgtgtaaatcgattcagatgaaccaggccgaaaatagcctgcaggaggagcaagagggtccattggacttaaccgtcaaccgtatgcaggaacaaaatacccagcagggcgacggcgtcctagatctgtccaccaagaaaacttccatcaagagtgaggaaagttccatctgcgacccctcttccgagaatagtgtagctggcatgttgcaagtgaaaacggatgaaaaactgaatgtatctgatgagaacactgcatcctgtccactgtctccgatcaaaatgtgcctcaaccggccaatcgagtggaatctcaacttgactaccgcatctctgacgtcatgcaccgtgcataaccagaatctcaaaagcgaggagaaatag

SEQ ID NO: 122461 - DNA, 1557 bp, Artificial Sequence
  Description of Artificial Sequence: Synthetic coding sequence
atggacgagaagtgtagcttttgcaatctccagcgcgaggcagtgagtgactgtatcccttcactggatagctcccaaagcacaccaacagaagaactctcatcacaggggcaatccaacaccgataaaatcgagtgccaagccgagaattatctgaacgcacttttccggaaaaaggaccttccacagaactgcgacccaaacattcctttagtcgctcaagaactgatgaagaagatgattagacagtttgcgatcgagtacatctcaaagagtggaaagacccaggagaacagaaacggcagcatcggaccgagcatcgtgtgtaagtcgattcagatgaatcaagctgagaattctctacaggaggaacaagaaggacccctcgatctcacggtaaacagaatgcaggagcagaatactcagcagggggacggggttcttgacctctctaccaaaaagactagcatcaaaagcgaagagagctccatttgcgaccccagctccgaaaattccgtagcagggaggttacatcggaatagagaagactacgtggagagatccgctgagttcgccgacggtctcttgtccaaagccctaaaagacatccaatcgggagccttagacataaataaggcgggcattctatatgggatcccacaaaagaccctgctcttgcatttggaggccctgccggcaggaaagcccgcttcattcaagaacaagactagagacttccacgactcatacagctataaagattcaaaggagacatgtgcggttttacaaaaggtagcgctttgggcccgcgcccaagcagaacgtacggagaaatctaaactgaatctgctagaaacttctgagataaagtttcccacggcatccacctacctgcatcaactcactctgcagaaaatggttacccagtttaaggaaaagaacgaatcactgcagtacgaaacttccaacccaactgtgcagctaaagatcccacagctgcgcgtctcttcagtttctaaaagtcagcccgacggatcaggtctcctggacgtcatgtatcaggtgtccaagaccagctcggtgcttgaaggatccgccctgcagaagctcaagaacatcttgcctaagcagaacaagatcgaatgtagtggacctgtcactcactcctccgttgactcctattttctgcacggcgatcttagtcccctctgcctgaactctaagaatggcactgtggatggtacttcagagaacaccgaagacggtctggacagaaaagattcaaagcagcccagaaaaaaacgtggccgctatcgccagtacgatcacgaaattatggaggaggccatcgccatggtcatgtctggaaagatgtcagtttcaaaagcccaagggatctacggcgttccgcatagtactctggaatacaaagtaaaggagcggagcgggacgctgaagaccccacccaagaagaagctcaggttaccggacaccggcctgtacaatatgaccgatagtggaacaggttcttgcaaaaactcctcaaaacccgtctag

SEQ ID NO: 122462 - DNA, 1809 bp, Artificial Sequence
  Description of Artificial Sequence: Synthetic coding sequence
atggataaagggagagaaagaatggcagccgcagccgcagctgcagctgccgccgctgctgctgcccagtgccgtagccccaggtgtgccgctgagcgaaggggctttagacgcgaactggatagctggcgtcaccggctgatgcattgcgtgggattcgaatctattctggaaggactttatggacccagactgcgcagagacctgagcctctttgaagattgtgagcctgaggaactgacagattggtccatggacgaaaagtgtagtttttgtaatttgcagcgagaggcggtgtctgactgcatcccctcactggatagcagccagtcaacccctacagaggagctgagttcgcaggggcaatcgaatactgacaagatcgagtgtcaagcggagaattacctgaatgccttgttccggaagaaagatttaccgcaaaattgtgaccccaacatccctctcgtggcgcaggaattaatgaagaagatgatcaggcagtttgcaattgaatatatttccaagtctggaaagactcaggaaaaccgcaacgggagtatcggcccgagcattgtttgcaaatccattcagatgaaccaagccgagaactccctgcaggaggagcaggaaggtccactggatctcaccgttaacagaatgcaggagcagaatacccaacaaggggatggggttcttgatctaagtaccaagaagacctctatcaagtcagaagagagctccatttgtgatcctagttctgaaaatagtgtggcggggaggttgcacagaaatagagaggattatgtggagagaagcgccgagttcgccgatgggctactgagtaaagccctaaaggatatccagagtggcgcactcgacatcaataaagcgggaatcctttacggcatcccccagaagaccctactcctacatctagaggcattgccggctggtaaacctgcctccttcaaaaataagactcgcgattttcatgatagttactcctacaaagactctaaggagacctgtgctgttctgcagaaggtggcactgtgggcccgagcccaagctgagcggaccgagaaatccaagttaaaccttttagaaacatctgaaatcaaatttccaactgcttctacatacctccatcagcttaccctgcagaagatggtgacacagtttaaggagaagaacgaaagcttgcagtatgaaaccagtaaccctacagtgcagcttaagataccacagctcagagtgagctcagtttctaaatcccagcccgatggtagtggcctgctcgatgtgatgtaccaggtgtccaaaactagcagtgtgttggagggctccgcactgcagaagctgaagaatatcctgcctaaacaaaacaaaatcgagtgctctggacccgtgacccacagctctgtggattcttactttcttcacggcgatctttctcctctgtgcctaaactctaagaacgggaccgtggatgggacttccgagaataccgaggacgggctagacagaaaggactccaaacagcctaggaagaagcgcgggcggtatcgacaatatgaccatgaaatcatggaggaggccatcgctatggtcatgtccggcaaaatgtctgtgtctaaggctcaaggtatctacggggtcccacacagtaccctggaatacaaggtgaaagaaagatctgggactctaaagacacctcctaagaagaaactgcggcttccggatacaggtctgtacaatatgacggactcaggtactgggtcgtgtaaaaactcgagtaaaccagtgtag

SEQ ID NO: 122463 - DNA, 435 bp, Artificial Sequence
  Description of Artificial Sequence: Synthetic coding sequence
atggatcacggatatgaagaaacttccgtgtatttgaaggactgcattccaagccttgactccagccaatccacaccaacagaagagctgagcagccaggggcagagcaatacagataagatcgaatgccaggccgaaaactacctgaatgcactgttccggaaaaaggatttaccgcagaactgtgacccgaacattccactggtggcccaagaactgatgaagaagatgatcagacagtttgcgattgagtacatctcgaagtctgggaagacccaagagaatcggaatggctcaataggaccaagcattgtatgcaaatcaattcagatgaaccaggcggagaacagtctgcaggaagaacaggagggaccgcttgatctcacagttaaccgtatgcaggaacagaacactcaacaagcctgctataagtag

SEQ ID NO: 122464 - DNA, 2187 bp, Artificial Sequence
  Description of Artificial Sequence: Synthetic coding sequence
atgaaccagcccgagagcgccaatgaccccgagccactgtgtgctgtgtgcggtcaggcccattccctggaagagaatcacttttacagttatcctgaggaggtcgacgacgatttgatttgtcatatctgtctccaagccctcttagatccattggacactccctgtgggcatacatattgtactctgtgcctgactaactttttggtggaaaaggacttttgtcctatggacaggaaacccctcgtcctgcaacattgtaaaaagtcaagcattttggttaacaagctactgaacaaattgttagttacatgccccttccgcgaacactgtacccaggtgctacagcgctgtgaccttgaacaccatttccagacatcctgcaagggcgccagccactacggcctgacaaaagaccggaaaagaagatcgcaggacggctgtccagatggctgtgcctcactcactgcaacagcgcccagtccagaggtgtcagcagctgctacaatctctctgatgaccgacgagcccggcctggacaaccctgcatacgtatcaagcgccgaagatggccaaccggctatatctccagtggacagcgggcgttccaatcgaactagagcaagaccattcgagaggtctacaatcaggtctcgaagttttaagaaaatcaacagggccctttcagtattaagacggactaagagcggctccgcagtcgcaaaccacgccgatcaaggacgcgaaaactctgagaacacaaccgccccggaggttttccccagactgtaccatctaattccagacggagaaataaccagtataaaaataaatagggtggaccctagcgaatcccttagcattcggctcgtaggaggctcagagactccgttggttcacattatcattcagcacatttacagggatggggtaatcgcacgagacggccgcctactccccggcgacattatattaaaggtgaacggaatggatattagcaacgtgccgcacaattacgccgtcaggcttctgagacaaccttgtcaggtgctctggctcacagtcatgcgagagcagaagtttaggagccggaataacggtcaggccccagacgcgtaccgccccagggacgactccttccatgtgattcttaataaatccagcccagaggagcaattgggcatcaagctcgtgcggaaggtggacgagcctggagttttcatctttaatgtgctcgacggtggcgtagcatacaggcatggacagctcgaggaaaatgacagggtgctggccatcaacgggcatgatttgcgctatggttctccagaaagcgcggctcacctgatacaggcttcagagaggcgggtgcacctagttgtgtccaggcaagtccgacagcggagccccgatatatttcaggaggctggatggaactctaatggatcctggtctccaggccccggcgaaagaagcaacacccccaaaccactacatcccaccatcacttgccatgagaaagtggtcaacatccagaaagaccctggcgaatcactgggcatgaccgtggcaggaggcgcgtcacaccgggagtgggaccttcctatttacgtgatcagtgtcgagccgggcggagtaatctcacgagatgggagaatcaagactggcgacatactcctaaatgtggacggtgtggaactaaccgaggtctccaggtctgaggccgtggcactactgaagcggacctcttcatctattgtcttgaaggctttggaagtgaaagagtacgagccgcaggaggactgctcttctcccgccgctctggacagcaaccataacatggctccgccaagtgattggtcaccatcctgggtcatgtggctggaattaccccgttgtctgtataattgtaaggacatagttctccgccgcaacaccgcgggaagcctgggattttgcatcgttggagggtatgaagaatacaacggtaacaaaccattctttatcaagtcgatcgtagagggtaccccggcatacaacgacggtcgcatccgatgcggagatattttactcgcagtgaacggaagatctaccagcggaatgatacacgcctgcttagctagactcctcaaagagctcaaaggccgcataacccttaccattgtttcttggcctgggacctttctgtag

SEQ ID NO: 122465 - DNA, 1899 bp, Artificial Sequence
  Description of Artificial Sequence: Synthetic coding sequence
atgaaagctttgctgctgctcgtgctcccttggctctcacctgctaattacattgataatgtagggaatcttcattttctctactctgagttgtgtaaaggagcctcacattatgggcttaccaaagacaggaaacggcggtcgcaggacggttgccctgatggctgcgcctccctaaccgctacagcccctagtcccgaggttagtgcagctgctaccatatctctgatgactgacgaaccggggctggacaatccggcttacgtctcatcggccgaagacggacagccggccatttcccctgtggattccggtagatccaaccggacgcgcgcacggccgtttgagcgcagcactataaggagcagatcttttaagaagataaaccgcgctttatcggtcctgcgtaggacaaagagtggaagcgccgtagccaaccacgccgaccaggggagagaaaattccgagaataccacagctcccgaagtatttcctcgcttgtatcatctcattcccgacggtgaaattacttccatcaagattaatagggtcgacccctcagaatcattaagcatccgcttggttggcggcagcgaaactccacttgttcacattattatacaacatatctatagggatggagtcatcgctagggatggcagactgctgcctggcgacatcattttaaaggttaatggaatggacatatctaacgtgccccataattacgccgtgagactgctgcggcagccatgccaggtgctgtggttaaccgtcatgcgagagcagaaattccgatctcggaataacggccaggccccagatgcctaccgcccgcgcgatgattccttccatgtcatcctcaataaatccagtccagaagaacagttgggtattaagctggtccgcaaagttgacgaacccggagtcttcatcttcaacgtcctggatggcggggtagcctacagacacggtcagcttgaggagaacgaccgtgtgctggctatcaatggacacgatctgcgatatggttctcccgagagtgccgcacacctcatacaggcctcagaacgcagggttcatttagtggtgtctaggcaggtgagacagcgcagccccgatattttccaagaggccgggtggaattcaaacggctcctggagcccaggcccaggcgagagatctaacaccccaaagcctctgcatcccacaatcacatgtcacgaaaaagttgttaacattcaaaaggacccaggggagagtctgggaatgaccgttgccgggggggcatcacatagagagtgggacctccccatttatgtgattagcgtcgagcctggaggcgtaatcagccgtgatggaaggatcaaaacaggggatatcctactgaacgtagacggggtcgagctcaccgaagtaagtcggtctgaggccgtggcacttctgaagaggacctccagctcaatcgtgctgaaggcgttggaggtgaaagagtacgaaccccaagaggactgttcctctcctgccgctctggactcaaatcacaacatggccccaccctcagattggtccccatcttgggtgatgtggcttgagctccctcgctgtctgtataattgtaaagacattgtgctgagacgtaacactgcagggagcctggggttctgtatagtaggtggatatgaggagtacaacggcaacaagcccttcttcatcaaatctatcgtcgagggaacacccgcctataatgatggccgcattcgctgtggggatattttactcgctgttaacggacgctcgacttctggtatgattcacgcatgtttagcccggctgctgaaggagctcaagggcagaataactctcacaatcgtaagttggcctggaacctttctctag

SEQ ID NO: 122466 - DNA, 21 bp, Artificial Sequence
  Description of Artificial Sequence: Synthetic coding sequence
atgaaccagccagagagctag

SEQ ID NO: 122467 - DNA, 51 bp, Artificial Sequence
  Description of Artificial Sequence: Synthetic coding sequence
atgaatcagccagagtctgctaacgatccagaacccctgtgcgccgtctag

SEQ ID NO: 122468 - DNA, 300 bp, Artificial Sequence
  Description of Artificial Sequence: Synthetic coding sequence
atgaaccaacccgaatcagcaaatgatcctgaacccctttgcgccgtttgcggacaagcccactcactcgaagagaaccatttctactcctatcctgaagaagtggatgacgatctgatatgtcatatctgtctgcaagccttgctggatccactagacaccccatgcggtcatacgtattgtaccctgtgtctcactaattttctcgtggagaaagatttttgcccgatggaccgaaagcccctcgtgctccagcactgcaagaaatcaagcatcctcgtgaacaagctgctcaactag

SEQ ID NO: 122469 - DNA, 273 bp, Artificial Sequence
  Description of Artificial Sequence: Synthetic coding sequence
atgaatcagccagagtccgctaatgatcccgaaccgctctgcgccgtgtgcggtcaggcccacagcctggaggaaaaccacttttattcctacccagaggaggtggacgacgacctaatatgccacatttgtctgcaggccttgttagatccattggataccccatgcggacatacctactgcacactctgcctgacaaacttcctggtcgagaaagacttctgcccgatggaccggaagcccctcgtgctgcagcactgtaagaaatcttag

SEQ ID NO: 122470 - DNA, 381 bp, Artificial Sequence
  Description of Artificial Sequence: Synthetic coding sequence
atgaatcaacccgaatccgctaacgaccccgaacctctgtgtgcagtgtgtggtcaggcccactccctagaggaaaaccatttctactcgtatcccgaagaggtggatgacgacctcatatgtcacatttgtttgcaggctctactggaccccctcgataccccatgcggacatacatattgtactctctgcctcaccaatttcctggtggaaaaggacttttgtccgatggatcgcaagccattggtgcttcagcactgcaagaagtcttccattctggtgaacaagctcctcaataaattgctggtcacatgcccattcagagagcactgtacccaggtactgcaaaggtgcgaccttgagcaccactttcagacctag

SEQ ID NO: 122471 - DNA, 1701 bp, Artificial Sequence
  Description of Artificial Sequence: Synthetic coding sequence
atggcagtgcagacagcagtcagagcctcacagccaagattaccccccctggacaaccctgcctatgtgagctccgcagaggacgggcagcccgccatcagtcctgttgacagtgggcgttccaacagaacgagggctaggcctttcgagaggagtaccatccggagccggtcttttaaaaagatcaatcgtgcactgtcagtgctgaggcgcactaagtcaggtagtgccgtcgcaaatcacgctgaccaaggccgagagaattccgagaacacgacagccccagaagtgttccctagactctaccacttaatccccgacggggagattactagtatcaagatcaaccgggtagaccccagcgagtccctctccattaggcttgtgggcggctccgagacgcccttagtccatataataatccaacacatatacagggacggcgtaatagcccgagatggccggctgcttccaggggacattatactcaaggtgaatggaatggatatctcaaacgtcccacacaactacgcggtcaggctactccgacagccctgccaggtcctttggctgacagtaatgcgtgagcagaagttccgctctcgcaataacggtcaagcccctgacgcgtatcgcccaagggatgacagtttccacgttatccttaataagtcctctccggaagaacagttgggtataaaattggtgcgcaaagtggacgagccgggcgtgtttatcttcaatgtgttggatgggggggttgcctataggcacgggcagctggaagagaatgaccgcgttctggccatcaatggacacgacttaaggtatgggtctcctgagtcagccgctcacctgatccaggccagtgaacgtcgggtccacctggtggtctcccgacaggtaagacagcgctcccccgacatattccaagaggcaggctggaattctaatggatcttggtctcccggtccaggagagcgctcaaatacaccaaaacccctccatcccactattacatgccatgaaaaggtggtgaatatccagaaagaccccggcgagtcccttgggatgaccgtggctggaggagcgtcacaccgcgagtgggacctacctatttacgtgatctcagtcgagccagggggggtcatcagcagagatgggcgaatcaagaccggtgatatcctcctgaatgtagacggagtggagttaactgaggtatctcggtccgaggctgtggcccttctgaagagaacctcttcctcaatcgttctaaaggctctcgaagtgaaagagtatgaacctcaggaggactgttctagccccgctgccctcgactcgaaccacaatatggcccccccaagcgattggagcccttcatgggtcatgtggctggaactgcctcggtgtctgtataattgtaaggatattgtgctgcggaggaatacggcagggagcctcggtttttgtatcgttgggggctatgaggagtataatgggaataagcctttcttcattaagagcatagtggagggcacccctgcgtataacgacggccggatccggtgcggcgatattttacttgcagttaacgggcgcagtacttccggcatgatccatgcctgtctcgctcggttactgaaggagctgaaggggagaatcaccctaaccattgtctcatggcccggaactttcctgtag

SEQ ID NO: 122472 - DNA, 2073 bp, Artificial Sequence
  Description of Artificial Sequence: Synthetic coding sequence
atgggcacaacaagtgatgagatggtttctgtggaacagactagttcctctagtctcaatcctctgtgcttcgaatgcggccagcagcactggacaagagaaaaccatctgtataactaccagaatgaggtggacgatgacctggtgtgccatatctgccttcaaccgttactgcaaccccttgatactccgtgcggccatactttctgctacaagtgccttcgcaatttcctgcaggagaaagacttctgcccactggaccgaaaacgactacactttaaactgtgcaaaaagtcgtcaatccttgtacataaattgctggataaactactggtcttgtgccccttcagcagcgtctgcaaagacgtgatgcaacggtgtgaccttgaggcacacctgaagaacaggtgcccgggagctagccatcgtcgggtggccctcgagcggcggaagacttcccgaacccaggcagaaattgagaacgagaatggacccacactgctggacccggccgggacactttctccggaggcagattgtctcggaaccggagcagtgccagtggagcggcacctaacatccgcttcgctcagtacttggtccgaagaacctggactcgacaatccagcgtttgaggagtctgcaggcgcagacaccactcagcagccgctgtctctgcccgaaggggaaattaccacaattgagatacatagatccaatccttacatccaactcggcatcagcattgtgggtggtaacgaaaccccactgatcaatattgtgatccaggaggtttaccgggacggagtgatcgctcgcgacggacgtttgctggcgggagaccaaattctccaggtgaacaactataacatcagcaatgtatcacataattacgcacgggctgtcctcagccagccctgtaatacgctccatctcacagtgttgcgggagaggcgcttcgggaaccgagcacataaccactccgactctaactccccaagggaggagattttccaagtggctttgcataaacgcgactctggcgagcaactcggcatcaaactggtaaggcgaaccgacgagccaggggttttcatccttgatctcctggagggtggcttggccgcgcaggacggaagactgtcttccaatgacagggtgctcgcaattaacgggcacgatctcaagtatggcaccccggaactggctgcccagattattcaggcctcaggagagcgcgtaaatcttaccatcgcccggccagggaagcctcagccaggtaataccatcagggaggcaggcaatcactccagttctagccagcaccatactccccctccttattactcacgcccttcttcacacaaagatctgactcagtgcgtaacatgtcaggagaagcacatcacggtgaaaaaagagccccacgaatccctaggaatgacagtagccggaggcaggggctcaaaaagtggtgagcttccaatttttgtgacatctgtaccacctcatggctgtctggcgagagacggaaggatcaagcggggtgatgttttactgaatatcaacggaattgacttgaccaacctcagccatagtgaggcagtggcaatgctgaaagcctcagccgcgtccccagccgtcgctctgaaggccctggaagtgcagattgttgaggaggccacacagaatgctgaagaacagccctctacattctccgagaacgaatatgatgcatcttggtccccatcctgggtgatgtggctgggtttaccgagcacattacattcctgccacgacattgtgctccggagaagttacctcgggtcatggggattcagtattgtggggggctacgaggagaaccatacaaaccaacccttcttcatcaaaactattgtgctgggaacacctgcctactacgacggccggctgaagtgcggagatatgattgtggcagtgaacgggctctccactgtggggatgtcacatagcgctctggtgcccatgctcaaggagcagcgaaataaggtgactctcaccgtgatttgctggccaggaagcctggtttag

SEQ ID NO: 122473 - DNA, 2115 bp, Artificial Sequence
  Description of Artificial Sequence: Synthetic coding sequence
atgctgggcatttgtagaggaaggaggaaattcctcgcggcgagcctgagtctcctgtgtatccccgccatcacatggatttacctcttcagtgggtccttcgaggatggcaaacccgtatcactctcccctctagagtctcaggcccattctcccaggtacacagcttcttcccagagggaaagggagagtttggaggtccgaatgcgcgaggtggaagaggagaacagggctctgaggagacaactgtcactcgctcagggccgcgcaccttctcatcgccgtggtaatcattccaaaacttactccatggaagaaggtacgggcgatagcgagaacctgcgggcaggaatcgtcgctggtaactcatcggagtgcggccagcagcccgtggtggaaaaatgtgagaccattcacgtggctattgtctgcgctggctacaatgcctctagggatgttgttacactagttaaaagcgtgcttttccacaggagaaacccactacattttcatctgatagcagatagcatcgccgagcagattctggccaccttgttccaaacctggatggtccccgcagtcagagtggacttttacaatgccgatgagttgaagagcgaagtatcctggattcctaacaagcactatagtgggatttacgggctgatgaagctagtgctaactaagaccctgccagctaatctggaacgggtgatcgtgctggacacggatataactttcgccacagatattgcagaactgtgggctgtttttcataagttcaaaggccagcaggtgctgggcctcgtggagaaccagagtgactggtacctcgggaacttatggaaaaaccaccggccgtggccagctttaggccgcggatataatacaggcgtaatactattattacttgataagctgcgcaaaatgaagtgggaacagatgtggcgcctgactgccgaacgagagctgatgggcatgctttccacatctctggccgaccaggatatttttaacgcagtaatcaagcagaatccgtttctggtctatcagctgccatgtttttggaatgtgcagctctccgatcacacacgcagtgaacagtgttacagggatgtgagcgatcttaagctccagaagcagttatccgaactcgatgaagacgacttgtgctatgagttccgcagagagcgctttaccgtgcatagaacccacctttattttttacactacgaatacgagcctgctgcggatagtaccgacgtgactctggtggcgcagctgtctatggacaggctgcaaatgttggaggccatatgcaaacattgggaaggacccatttcactcgccctgtacctaagtgatgcggaggcccagcagttcctgcgctacgctcaaggcagcgaggtcctcatgagtagacataacgtcgggtatcatattgtttataaagaaggccaattctacccagtaaaccttctgaggaacgttgctatgaagcacattagtactccttatatgtttctcagcgacattgactttctcccaatgtacgggttatacgagtacctccgtaaatccgtaattcagctcgacctcgcaaacacaaagaaggccatgattgtgcctgcgtttgagactcttagatatcgtctttcttttccaaagagcaaagctgagctgctctcaatgttagacatggggactctgttcacattccggtatcacgtgtggacgaaggggcacgctccaaccaatttcgctaagtggcgcactgcaaccacaccctatcgggtagaatgggaggccgactttgagccatacgtggtggtcaggagagactgtccagaatatgaccgaaggttcgtgggattcggctggaataaggtggctcatatcatggagctggatgtgcaggagtatgagtttatcgttctaccgaacgcctacatgatccatatgccgcatgcaccctctttcgatattaccaaatttaggtccaataaacagtaccggatctgcctcaaaactctcaaagaagagttccaacaggatatgagtcgtcggtacggctttgccgcacttaaatatttgactgccgagaacaacagttag

SEQ ID NO: 122474 - DNA, 2271 bp, Artificial Sequence
  Description of Artificial Sequence: Synthetic coding sequence
atgctcgggatatgtcgaggccgacgcaaattcctcgcagcctctctcagcctgctttgtatcccagctattacctggatctacttgttcagcggaagctttgaagatgggaaacccgtgtctctgtctcctctggaatctcaagctcacagccccaggtacactgcatcttctcagcgcgagcgcgaatccctggaagtccggatgagggaagttgaggaggagaatcgcgcactccgccgtcaactgagtctcgcccaaggccgcgcgccttctcacagaagaggcaaccactctaaaacctacagcatggaagaaggaacaggtgactctgaaaacctccgtgcagggattgtcgcaggaaattctagcgagtgtggtcaacagcccgtggttgagaagtgcgagacaatccacgtagccatcgtgtgcgccggttataatgcctcgcgggacgtggtgacgttggtgaagtctgttctgtttcataggagaaatccacttcactttcatcttatcgccgatagcattgccgaacagattctggctacattgtttcaaacatggatggtgcccgctgtccgggtggatttttacaacgccgatgagttaaaatccgaggtatcatggatcccaaacaaacattattccggaatttatggcctcatgaaattagtgctgaccaaaaccctacccgccaacctggagagggtgattgtgcttgatactgacatcactttcgctacagacattgctgaactttgggctgtcttccacaaatttaagggccagcaagtgctcggactggtggagaatcagagcgactggtacctcggcaacttatggaaaaatcaccggccgtggccggcactgggcaggggttacaatacgggggttatcctgttgctgctggacaaactgaggaagatgaagtgggaacagatgtggaggttaacagctgagcgggaactcatgggcatgttgtctacaagcctggctgatcaagatatctttaatgcagtgattaagcaaaacccgttccttgtatatcaactcccctgcttttggaatgtccagttgtccgaccacacacggtcagaacagtgttacagggacgtgtccgatctcaaggtcatccattggaattcgcccaagaaactacgcgttaaaaacaagcacgttgaatttttccgaaatctgtatctcacctttcttgaatacgacggcaatctgctgaggagagagctcttcggatgcccttcagaagcggacgttaacagtgaaaaccttcagaaacagttaagtgaactagatgaagacgatctctgctacgagttccgccgagagcgtttcaccgtccacagaacacacctttacttcctccactacgagtacgagccggctgcagattctacagacgtcacactggtggctcaattaagcatggacaggctccagatgctggaagcaatttgtaaacattgggaagggcccatcagcttagccctatacctgagtgacgctgaggcacagcagttccttcggtacgcacaaggttccgaggtccttatgtcccgccacaatgtcggatatcatattgtctacaaagagggtcagttttaccctgttaacctgctgcggaacgtagccatgaagcacatctccacaccttacatgtttctgtccgacatagattttctacctatgtacggcctgtacgagtacctgagaaagtctgttatacaactggacctggcaaacacgaaaaaggccatgatcgtgccggcttttgagaccctacggtataggctaagctttcctaaaagcaaagcagaactcctgtctatgttggatatggggactctttttacattcaggtatcatgtgtggacaaaaggacatgctcccaccaactttgccaaatggaggacggccactaccccataccgggtggagtgggaagcagactttgaaccgtatgtggtagtcagacgggattgccctgagtacgatagaagattcgtcggtttcggttggaataaggtggctcatattatggagcttgatgtacaagaatatgaattcattgtcttgcctaatgcttacatgatccatatgccacacgcgccctctttcgatattaccaagtttagatccaacaagcaatacagaatatgtctgaaaaccctcaaggaagaatttcagcaggacatgtccagacgctatgggtttgctgcactgaaatacttaacggcagaaaacaactcatag

SEQ ID NO: 122475 - DNA, 2271 bp, Artificial Sequence
  Description of Artificial Sequence: Synthetic coding sequence
atgctgggcatctgcagaggacggcgtaaatttctggccgcctcactatcattgctgtgcatccccgcgataacttggatctacctgtttagtggctcatttgaggatggaaaacctgtatcgctttctcccttagagagtcaggcgcactctcctcgctacacagccagctcgcagagagagagagagtcgctagaggttcgcatgcgggaggtcgaagaagaaaatcgggccctgcgccgccagctatctctcgcccagggacgcgcgccttcgcataggcggggaaaccactcaaagacctactcaatggaggaaggtacaggggacagtgaaaatctgcgcgcagggatcgtggccggaaacagttcagaatgtggccagcagccagtggtggagaagtgcgagacgattcatgtagctattgtatgtgctggttacaatgccagtcgcgacgtggttaccctggtaaagagtgtgctcttccacaggcgtaatcccctacacttccatctgatcgccgacagcattgcggagcaaatcctggcaactttgttccaaacttggatggtccctgcagtgagagtcgacttttataatgccgatgagcttaaaagcgaagtttcttggatccccaacaagcactattctgggatctatggccttatgaaactggtgttaactaaaaccttgcctgcaaatctcgagcgcgtcatcgtgctggatacagatattaccttcgcgacggacattgctgagctctgggccgtgttccataaattcaaaggtcaacaagttctgggcttagtggaaaaccaatcagattggtacttggggaacctgtggaagaaccatcgcccatggccagccctaggtcgggggtacaataccggcgtcattctccttcttcttgacaagctacggaaaatgaagtgggaacaaatgtggcggctcactgcagaaagggaactgatggggatgctgagtactagcctggctgaccaagacatcttcaacgctgttataaaacagaacccttttcttgtctatcagttgccatgcttttggaacgtccagctgagcgatcacactcgatccgagcaatgttatagggatgttagcgacctcaaagtcattcactggaatagtcccaaaaagctgagagtcaagaataagcatgtggaattctttagaaatctgtatctgacctttcttgaatacgatggaaacttactcagaagagagctgttcggatgtccctctgaggccgatgttaatagcgagaatctccaaaaacagttgagtgagctggatgaggacgacctctgctacgaatttaggagggaacgcttcaccgtgcatcggactcacctttactttctgcactatgagtatgagccagccgctgacagcactgacgtaacactggtggcccagctctcaatggatcgactgcagatgctggaggccatatgcaagcactgggaaggaccgatctctctcgccctgtacctgagcgatgccgaggcacaacagttcctaaggtacgctcaggggtccgaagtgctcatgtcacggcacaacgttggataccatattgtgtataaagaggggcagttttatccggtcaatctgctgcggaacgtagccatgaaacacatctcaaccccctatatgtttctaagcgacattgattttctaccaatgtatggcctgtatgagtatctcagaaaaagtgtgatccagcttgatctggccaacaccaagaaggctatgatcgtcccagcctttgagaccctacgctatcgcctttcctttccaaaatcaaaggccgagctgttaagcatgctagatatgggaacgctatttaccttccggtaccacgtgtggactaagggacacgccccaaccaacttcgctaaatggcgcaccgccaccaccccataccgggtggagtgggaagccgacttcgaaccttacgtggtggtgcggcgggactgtcccgagtatgacagacggtttgtcggatttggatggaataaagtggctcacatcatggaactcgatgtacaggagtacgaatttatagtgctgcccaacgcatatatgattcatatgcctcatgcaccctctttcgatattacgaagttcagatcaaacaagcagtatcgcatctgccttaaaacattgaaagaggagttccaacaagatatgagtcgtcggtatggcttcgctgccctcaaataccttaccgcagaaaacaactcatag

SEQ ID NO: 122476 - DNA, 2115 bp, Artificial Sequence
  Description of Artificial Sequence: Synthetic coding sequence
atgctgggtatttgtcgcgggcgacggaagtttttggccgctagtctctccctcctgtgtatcccagcaataacgtggatttatctcttcagcggttctttcgaagatgggaaacctgtctctctgagccctctggagagccaagcgcactcaccacggtatactgcctccagtcagcgggagagggagtccctggaagttcgcatgcgggaagtcgaggaagaaaaccgcgccctgcggagacagctgtctctggctcagggtagagcaccctcccaccggagaggcaatcatagcaaaacctactccatggaggagggcactggggattccgaaaatctccgtgcagggattgttgcaggtaactccagcgagtgcgggcagcagcccgtggtcgaaaaatgcgagacgatacacgtggccattgtttgtgctgggtacaatgcaagccgggacgtggtcaccctcgttaagagcgtgttgttccatcgcagaaacccactgcattttcacctgatagcagatagcatagctgagcaaattcttgcaactctgtttcagacctggatggtaccagccgttagagtggatttctacaacgctgacgagttgaagtctgaggtctcttggatcccaaacaaacattactctggcatctatggactcatgaagctagtgctgaccaagaccctgcctgccaatttagagagggtaattgtgctggacaccgacatcaccttcgctacagacatcgccgaactctgggctgtgttccataagtttaaaggacagcaagtattgggcctggtggagaaccagtcagactggtacctgggtaacctgtggaaaaatcatcgaccttggcctgccctcgggagaggatacaacacgggagtaattctgctgctgctggataaactccgaaagatgaagtgggagcagatgtggcggctgaccgcggaaagggagctgatgggcatgttgagcacctcacttgcagatcaagacatcttcaacgctgtaatcaagcagaaccccttccttgtctaccaacttccatgcttctggaatgtccaactcagcgaccacacccgaagtgagcagtgttatagggacgtgagcgatcttaaactccaaaagcaactctcagaattggacgaagatgacctctgctatgaattcaggcgggaaagatttaccgtgcatcgtactcatctgtattttctgcactacgaatacgagcctgctgccgactccacagatgttaccctggtcgcgcagctgagcatggaccgcttacaaatgctcgaggccatttgcaaacattgggagggccctatatccctcgcactctacctttcagatgccgaggcccagcaatttctgcggtatgctcagggctctgaggtgctgatgtcacggcataatgtgggctaccacattgtctacaaagaggggcagttttatcccgtgaatcttctccgtaacgtggctatgaaacacattagcactccatatatgttcctgtcagatattgattttctccctatgtacgggttgtatgaatatctgcgaaagtccgtaattcagctcgacctggctaacaccaagaaggccatgattgtccccgcgttcgagaccctgcgctatagactgtcctttccaaagtcaaaggccgaactgctttccatgctggatatgggcaccttgtttacttttcgataccacgtgtggactaagggtcacgcccctacaaattttgctaagtggaggacagcaaccactccttatcgggttgaatgggaggctgactttgaaccatatgtagtggtccggcgggattgtcccgaatacgacagaaggttcgttggattcggctggaataaagtggctcacatcatggaactggacgttcaggaatacgaattcatagtcttacctaacgcctatatgatccacatgccgcacgcaccctcttttgatatcaccaaattccggagcaataagcagtaccgaatttgcttgaaaaccttaaaagaggaattccagcaggatatgtcccgccgatacggatttgcagccctgaagtatctcacagcggagaacaactcctag

SEQ ID NO: 122477 - DNA, 408 bp, Artificial Sequence
  Description of Artificial Sequence: Synthetic coding sequence
atgcttggcatctgtaggggtcgccgcaaatttctggctgcaagcctgtctctactgtgcatacctgccattacatggatttacttatttagcggttctttcgaagatggcaaaccagtgtccctctcccccctcgagtcccaagcccacagtccaaggtatacagcaagctcccaacgcgagcgggaaagtctcgaagttcgtatgagagaggttgaggaggagaatagagccctcaggcggcagttgagtctggcacaggggcgagcaccctcacacagaagggggaaccacagtaagacttactcaatggaagaagggacaggtgattcagagaatttaagagctgggattgttgctgggaacagcagcgaatgcggccagcagccagtggtggaaaagtgctag

SEQ ID NO: 122478 - DNA, 144 bp, Artificial Sequence
  Description of Artificial Sequence: Synthetic coding sequence
atgctcggcatctgcagaggaaggcgcaagtttctggcagcttcactgagtctgctttgtattccagctattacatggatttatctgtttagtggctcctttgaagatgggaaaccagttagtctgtctcccctcgaatcctag

SEQ ID NO: 122479 - DNA, 411 bp, Artificial Sequence
  Description of Artificial Sequence: Synthetic coding sequence
atgctcggtatttgtcgcgggcggcgaaaatttcttgccgcctctctgtctctgttgtgcatcccagccattacctggatatacctgttctctgggtcttttgaagatggcaagcccgtgtcattatccccattggagtcccaggcccactcccctcgctataccgcaagctcgcaacgcgaaagagagtccttggaggttcgcatgcgcgaagtggaggaggaaaatagagccctgcgtaggcagttgtcacttgcgcaggggagagcacccagccatcgcagaggcaatcattcaaagacctacagtatggaggagggcaccggagatagtgagaacttgagggcaggtatcgtcgccggaaactcctccgagtgcggacagcaaccggtcgtggaaaagtgcgagtag

SEQ ID NO: 122480 - DNA, 183 bp, Artificial Sequence
  Description of Artificial Sequence: Synthetic coding sequence
atgctgggcatttgtagaggtcggagaaaatttttggccgcaagcctctcactgctctgcatcccagctatcacctggatttatctgttctcgggatctttcgaagatggcaagcccgtgtcactctcacccctcgaatcacaagctcactctccacgctataccgcctctagtcagaggtag

SEQ ID NO: 122481 - DNA, 330 bp, Artificial Sequence
  Description of Artificial Sequence: Synthetic coding sequence
atgctaggcatttgcagaggaagacgaaaattcttagctgcgtctctgagcctgctgtgcattccagcgattacctggatatacttgttcagcggaagcttcgaagacggcaagccagtgagtctgagtcccctggagagccaggcccatagcccaagatacaccgcgtccagtcagcgagaacgagaatctctggaagtaaggatgcgggaagtcgaggaggagaatagggctctcagacgccagcttagccttgcccagggccgagccccctcccatagaaggggaaatcactccaagacctacagcatggaagagggaacgggctag

SEQ ID NO: 122482 - DNA, 2124 bp, Artificial Sequence
  Description of Artificial Sequence: Synthetic coding sequence
atgctaggaatttgccggggtcggcgcaaattccttgctgctagcttatcccttctctgcatcccagccataacctggatctacctattttccggctcattcgaggatggaaaaccggtctcactgtccccactggaatcccaggcacacagtccccggtacaccgctagctcccagcgagagcgcgagtcattggaggtacgcatgcgcgaagttgaggaagagaatagggcactaagacgtcaactgagcttggctcaggggagggcgccttcccaccgtcgcggtaaccatagtaaaacctattcgatggaagaaggaacgggcgactctgaaaacctgcgcgctggaatcgtcgccgggaatagctcagaatgcggccagcagcctgtcgttgaaaaatgcgagactatccacgtggcaatcgtctgtgcaggatataatgcatccagggatgtggtcacccttgtcaaaagcgtgttattccaccgacggaacccgctgcactttcatctgattgccgactccatcgctgagcagatcctggccaccctgtttcagacgtggatggttcctgccgtgagagtcgatttttacaacgccgatgaactgaagtcagaggtgagctggattccgaataaacattattcaggcatctacggactgatgaagctggtgctcaccaagactctcccagcgaacttagagcgcgtgatcgtgctggacaccgatattacctttgccaccgacatcgcagagctgtgggcagtcttccacaagttcaaaggccagcaggtgttgggactagtcgagaatcagagtgactggtacctgggtaacctttggaagaatcaccgtccttggcccgccctgggtcgaggctataataccggagtgatccttcttctcctggataagctgaggaagatgaagtgggaacagatgtggagacttaccgcggagcgtgagctgatgggtatgctgtccaccagtctggcggatcaggacattttcaacgcggtgattaagcagaacccgtttctggtctaccagctgccctgtttttggaacgtccagctcagtgaccatactagatccgaacagtgttacagggacgtgagcgacctcaaagtgattcactggaattcgccgaaaaagttgcgggtgaagaacaaacatgtggagttctttcggaatctctatttgacttttcttgaatatgacggcaatttactgagaagagaacttttcggctgtccctctgaggctgacgtgaattcggagaatttgcagaagcagctgtcggaattggacgaggacgatctgtgttatgaattccggcgcgaaaggttcactgtgcaccgcacccatctctacttccttcactacgaatacgagcccgcagccgactccaccgacgtgaccctggtggcacagctgagtatggacaggctacaaatgttggaggccatctgtaagcattgggaaggacccatctcccttgcactatatctgagcgatgccgaggctcagcagtttctccgctacgcccaaggcagcgaggtcctgatgtcacgccataacgtgggctatcacattgtttacaaagaggggcagttctacccagtgaacctcctgcggaatgtagccatgaagcatatcagcacaccgtacatgtttcttagcgatatagattttctccccatgtacggcctctatgagtaccttagataccatgtatggacaaagggtcacgcccccactaattttgccaaatggagaaccgcaaccactccttaccgggtggaatgggaggcagacttcgagccgtacgtggtagtcagacgtgattgcccagagtacgacaggcgttttgtgggcttcggatggaataaggttgctcatatcatggagcttgatgtgcaggagtatgaattcatcgtcctgcccaacgcttacatgatccacatgcctcacgccccatcgtttgacatcacaaaatttaggagcaacaagcagtatagaatctgcctgaagactttgaaagaggagtttcaacaggacatgagccgcaggtacggcttcgctgcccttaaatacctgactgctgaaaataatagttag

SEQ ID NO: 122483 - DNA, 1668 bp, Artificial Sequence
  Description of Artificial Sequence: Synthetic coding sequence
atgcttatatggagcgaggtatcctggattcccaacaagcactattcgggcatctacggcttgatgaaactggtcttgactaaaacgcttcctgccaacctcgaacgggtgattgtactggatactgacataacctttgcaacggacattgccgagctgtgggccgtttttcacaaattcaagggacagcaagtactcggccttgtggagaatcagagcgattggtaccttggaaatttatggaagaaccaccgaccctggcctgccttagggagaggttataacactggagtgattctacttctgcttgataagctgaggaagatgaaatgggaacagatgtggagattgaccgcagaaagagagctgatgggaatgctttccacatccctggccgatcaggacatctttaatgctgtgattaagcagaacccattccttgtataccagctgccctgcttttggaatgtacagctttcggatcacaccaggagcgagcagtgctatagggacgtctctgatctgaaggtgatccactggaacagccctaagaagcttagggtaaagaacaagcatgtggagttcttcaggaatttgtatttgaccttcctggagtacgatgggaacctactccggcgagaactgtttggatgcccctccgaagcggacgtgaactctgaaaacctgcaaaaacagcttagtgagctcgatgaggacgacttgtgctatgagtttagacgcgagcgcttcactgtgcatagaacgcacctctattttctccactatgagtacgagcccgccgctgattccacagatgtaactttagtagcacaactgagcatggaccgcttgcagatgctcgaggcaatctgtaagcactgggagggtcctatttcattggcactgtatctgtctgacgctgaagcgcagcaattcctgagatacgcccagggcagcgaggtgctcatgtctaggcacaatgtgggttatcatattgtctacaaagagggccagttctaccccgttaatctgttgcggaatgtggccatgaagcacattagcactccatacatgtttctgtccgacatcgactttctgcctatgtacggtctgtatgagtatctgcgaaagtctgtgattcagctagatctggccaacacgaaaaaggcaatgattgtcccagcatttgagacactcaggtacagactatcttttccaaaaagcaaagccgaactgctctctatgttggacatgggcacattattcactttccgataccacgtgtggactaaaggccacgcccctacaaacttcgctaagtggcgcaccgctactaccccctaccgagtagaatgggaagcggactttgaaccgtacgtggtcgtgcgtcgcgactgtcccgagtatgatcgacgcttcgtgggcttcggatggaacaaagtggctcatatcatggaattggatgtccaggaatacgagtttatcgtattgcccaacgcttacatgatccacatgccccatgctccctcttttgacattaccaagttccggtccaacaagcagtaccgcatctgtctcaagacactgaaggaagaattccagcaggatatgtcaaggagatacgggtttgccgcacttaagtacttgacggccgagaacaactcttag

SEQ ID NO: 122484 - DNA, 1098 bp, Artificial Sequence
  Description of Artificial Sequence: Synthetic coding sequence
atggctaaggtcgcaaaagaccttaaccccggggtaaagaaaatgtcattgggacagctgcagtctgctcggggtgtggcctgcctggggtgcaaggggacttgtagcggatttgagccacatagttggcgaaagatctgcaagtcctgcaaatgctcccaggaggatcattgcctcacctcagatctggaggacgatcgtaaaataggtagacttttaatggactccaaatactctactctcactgccagagtcaaaggcggtgacggaatacggatctacaaacgaaacaggatgatcatgaccaaccccattgcaactggtaaagaccctacgttcgacactataacgtacgagtgggcccccccgggggttacacagaagctgggcctgcagtacatggaactcattccaaaagaaaaacagccagtgacggggactgaaggcgcgttttacaggaggcggcagctgatgcatcagctgcctatctacgaccaggacccctcacgctgtagaggccttcttgaaaacgagctgaagttaatggaggagttcgttaagcaatataagagcgaagcgctcggggttggagaggtggctcttccagggcaggggggcctgcctaaggaagaaggtaagcagcaggaaaaacccgaaggggcagaaacaactgcagcaactaccaacggcagcttaagcgatccaagcaaggaagttgagtacgtgtgcgaactgtgtaaaggtgcggcccctccagattccccagttgtatatagcgatcgggccggctacaacaaacagtggcacccaacctgctttgtttgtgccaaatgttcagagcctctcgtggacctgatatatttttggaaggacggcgccccctggtgcggaagacattattgtgaaagcctgaggccaaggtgctccggatgtgatgagataatttttgcagaagattatcagcgagtggaagacttggcttggcaccggaagcacttcgtgtgcgaaggatgcgaacagcttctcagcggtcgggcatacatagtgactaaaggccagttgctgtgtcccacttgctcaaagtccaaacgttcctag

SEQ ID NO: 122485 - DNA, 762 bp, Artificial Sequence
  Description of Artificial Sequence: Synthetic coding sequence
atgttcggtatgcagggagatgtgtttggtctgcgagccacttttatggaaggcctgcagtacatggagttaattccgaaggaaaagcaaccggtgaccggaaccgagggggcgttttaccggcggcggcagctgatgcaccagctgcctatttacgaccaggacccttcaagatgtaggggcctactagaaaatgagctgaaattgatggaagaatttgttaaacagtataagagcgaagctctgggggtgggcgaagtcgctctgccggggcagggcggcctcccaaaggaagagggaaagcaacaagaaaagcccgaaggggctgaaaccacagccgcaacaaccaatgggtccctgtctgatccaagcaaggaggtcgagtacgtttgcgaactttgtaaaggcgcagctccaccggacagtccagtagtgtacagcgatagggccggatacaacaagcaatggcatccgacatgttttgtttgcgcaaaatgtagcgaaccgcttgtggacctcatttacttctggaaggacggtgctccctggtgtgggcgccactactgtgaaagtctccgcccaaggtgtagtggatgcgatgagattatctttgcagaggactatcagagagtcgaggacctcgcttggcacagaaaacacttcgtgtgcgaaggttgcgaacagcttctgagcggtcgcgcgtatattgttactaagggacagctcctctgccccacatgttcaaagagcaagagaagttag

SEQ ID NO: 122486 - DNA, 879 bp, Artificial Sequence
  Description of Artificial Sequence: Synthetic coding sequence
atggattctaagtacagcaccctgaccgctcgcgtcaagggaggggacggaataagaatctacaagcgaaatcggatgatcatgaccaatcctatcgccacaggaaaagatcctaccttcgacacaatcacctacgagtgggcacctccgggggtgacacagaaactggggctgcaatacatggagttaatccccaaggagaaacagcctgtgacaggtacggagggtgccttttacaggcggagacaactgatgcaccagcttcctatttacgatcaggacccaagtagatgtagagggctcctggaaaacgagttaaagctcatggaagagttcgttaagcagtacaaatctgaggctctgggcgtgggcgaggtggccctgccagggcaagggggtcttccaaaggaggaaggaaagcagcaggaaaagcctgaaggtgctgaaaccaccgccgccacaacgaacgggtccctctctgatccctcaaaagaggtggagtacgtgtgtgagctgtgcaagggtgcggctccccctgacagcccagtagtatactcagacagggccggatataacaaacaatggcatcccacttgcttcgtgtgcgccaaatgttccgaacccctggtagatctgatctacttctggaaggacggcgctccctggtgcggtcgccactactgtgaatccctgagacctcgatgctcagggtgcgacgaaattatcttcgccgaagactaccagcgcgtggaagatctggcgtggcacaggaagcattttgtctgtgaaggctgcgaacagctgctctctggtagggcgtatatagttaccaaggggcagctgctgtgtccgacatgcagcaaaagcaaacgaagctag

SEQ ID NO: 122487 - DNA, 744 bp, Artificial Sequence
  Description of Artificial Sequence: Synthetic coding sequence
atggccaaggtagctaaggacctcaaccctggcgtcaaaaagatgagtctcggccaactgcaatccgcaagaggagtagcatgtctgggctgcaaaggaacatgcagcgggtttgagccccatagctggcgtaagatctgtaagtcttgcaagtgctcccaagaggatcactgcctgacctcagacctcgaggatgatcgcaagatcggccggcttctgatggattctaagtacagtacactgactgctagggtgaaaggtggagacgggattcggatatataagagaaataggatgatcatgactaatcctattgctacaggtaaggatcctacattcgatacaataacgtacgagtgggctcccccaggggtcacacagaaactaggtctacagtacatggagctgatacccaaagagaagcagccagtgactggcaccgagggagcattttacagacggcgccaactgatgcaccagttgcctatttacgatcaggaccccagccgttgtagaggactccttgagaacgagttgaagcttatggaggaattcgtgaagcagtacaagtccgaagctctgggcgtaggggaggttgcccttcctgggcagggcgggttgccaaaggaagaaggaaagcagcaagagaagccagagggtgctgaaaccactgcagccaccactaatggaagtttgtccgatccctctaaagaggtggaatataagcctgttcccctcgtttag

SEQ ID NO: 122488 - DNA, 786 bp, Artificial Sequence
  Description of Artificial Sequence: Synthetic coding sequence
atgaatcccaattgtgctcgctgcggtaaaatcgtctatccaactgaaaaggttaactgcttagacaagttctggcacaaagcctgctttcattgtgagacgtgtaaaatgactctgaatatgaaaaattacaaggggtacgagaagaaaccctactgtaatgcccattaccccaaacagagctttactatggtggctgacactcctgagaatctccggctcaagcagcaatcagagctgcagagtcaggtcaggtataaagaggaattcgagaaaaacaaaggaaaaggctttagtgtcgtagcagatacgcccgagctgcagagaatcaagaagacacaggaccagatcagtaacatcaagtatcacgaagaattcgaaaagtccaggatgggaccttctgggggagagggcatggagcctgagaggcgggacagccaggatgggagctcatacagaaggccactggagcaacaacaaccgcatcatataccaaccagcgccccagtttaccagcagccacagcagcaaccagttgcccaaagctacggcggatacaaagaacctgccgcccccgtgagtattcagcggtccgcaccaggcggcgggggaaaaagatatagagccgtgtacgattattctgcagcagatgaggacgaggtgagttttcaggacggggacactattgtgaatgtgcagcagatcgacgacggttggatgtacggaaccgtggaacgcaccggcgacactggtatgctgcctgcgaattatgtggaggcaatctag

SEQ ID NO: 122489 - DNA, 501 bp, Artificial Sequence
  Description of Artificial Sequence: Synthetic coding sequence
atgaccctgaatatgaagaattacaagggctatgaaaaaaagccctactgcaacgctcattatcccaaacaatccttcactatggtagctgatacgccagaaaatctcagattgaagcagcagtcagagctccaatctcaggtccgctataaagaagaattcgagaagaacaaagggaagggtttttctgttgtggccgatactcccgaattgcagagaatcaagaaaacccaagaccagatcagcaacatcaaatatcacgaagaatttgagaaatcaaggatgggccctagtggaggcgaggggatggagcccgaaagaagagactcacaagacgggtcttcctaccgccgaccactcgagcaacagcagccacaccacattccaaccagcgctcccgtgtaccagcagcctcagcagcagcccgtagcccagtcatacggaggatacaaggaacctgcagcccctgtgagcatacagcggagcgcgcctggcggctag

SEQ ID NO: 122490 - DNA, 618 bp, Artificial Sequence
  Description of Artificial Sequence: Synthetic coding sequence
atgctgcccttacgagaccttcaagatgacacagaacacgaggaacttcagggactcagggaggaggcgctcctgcagcgggttcgttataaagaagagttcgagaaaaacaaaggcaagggtttttccgtagtcgcggataccccagaattgcaacgaatcaagaaaacgcaggatcaaatctcgaatataaagtaccacgaagaatttgagaagtctcggatgggcccaagcgggggtgagggaatggaacccgagaggcgggatagtcaggatggatcttcatatcgccgacccctcgaacagcaacagccccatcatatccccacttctgcgcccgtgtatcagcagccccagcagcaacccgtggcccaatcttacggcgggtataaggagcctgctgccccagtaagcattcaacgctcagcccctggcggcgggggaaaaaggtaccgcgcagtctatgattatagtgctgccgacgaagatgaggtttcatttcaggacggcgacacaatcgttaacgtgcagcagattgacgacgggtggatgtacggtaccgtggaacggacgggggatactgggatgctgcctgctaattatgtggaggccatatag

SEQ ID NO: 122491 - DNA, 786 bp, Artificial Sequence
  Description of Artificial Sequence: Synthetic coding sequence
atgaacccaaattgtgcacggtgtggcaagatcgtgtaccccacagagaaggtgaattgtttggacaaattctggcacaaggcatgcttccactgcgaaacctgcaagatgacactcaatatgaagaattacaagggatatgaaaagaaaccctactgcaatgcccattatcccaagcagagctttaccatggtcgccgacacccccgagaatcttagactcaaacagcaaagtgagttacagtcacaggtgcgatacaaggaggagtttgagaaaaacaaggggaaaggtttctccgtagtggcagatacacctgaactacaacgcattaagaagacccaggatcagatatcaaacatcaaataccacgaagaattcgagaagtctagaatggggcccagtggtggcgaggggatggagccagaaaggcgcgatagccaagatggcagctcctaccggagaccactggaacaacagcagcctcaccatatcccaactagcgcgcctgtttatcaacagccacagcaacagcccgtagctcagtcctatggagggtacaaagaacccgcagcacctgttagtattcagcgctcggccccggggggagggggtaagaggtatcgcgcagtgtatgactattccgccgcggacgaggatgaagtatctttccaggatggcgatacgattgtgaacgtccaacagattgatgatggatggatgtatgggaccgtcgagcgcacaggcgatacgggtatgttacccgccaactatgttgaagccatctag

SEQ ID NO: 122492 - DNA, 378 bp, Artificial Sequence
  Description of Artificial Sequence: Synthetic coding sequence
atgaaccccaactgcgcacgttgcgggaagattgtctatccgaccgaaaaagtgaattgtctggacaaattttggcataaagcttgtttccattgcgagacttgcaaaatgacactgaatatgaagaattacaagggttacgagaagaaaccatattgtaatgcacactatccaaagcagtcattcactatggtggctgatactccggaaaaccttcggcttaaacagcagagtgaattgcagagccaggtccgatacaaggaagaatttgagaaaaacaaagggaaaggcttctctgtggtggcagatactcccgagctccagcggtcatcactcggattcctctggaatgaaattcccccttcaccacatctatag

SEQ ID NO: 122493 - DNA, 4050 bp, Artificial Sequence
  Description of Artificial Sequence: Synthetic coding sequence
atgaaaaaaattaggatttgccacatattcacgttctattcatggatgtcttatgatgtgctttttcagcgcaccgaactcggtgctctcgagatctggagacaactcatctgtgcccacgtgtgcatctgcgtgggttggttatacctgagggaccgggtgtgcagcaaaaaggatattatactacgaactgaacagaattcaggacgtactattcttattaaggcagtgaccgagaagaacttcgaaacaaaggacttccgcgcaagccttgaaaatggcgtcctgctgtgtgaccttattaacaaacttaaaccaggcgtcataaaaaagataaatcgtttatcaactccaattgcgggtcttgacaacattaacgtgtttttaaaagcctgcgagcagatcggcctaaaggaagcacagctgtttcatcccggcgacttgcaggatctgagtaaccgcgtgacagtgaaacaggaggagacggacaggcgcgtcaagaatgtgctgatcaccctgtattggctgggccgcaaggcacaaagcaatccctactataacggtccccatctgaatcttaaggccttcgagaacctcctgggacaggcccttactaaagcgctggaggactctagtttcctgaagagaagtgggcgggattctggctacggcgacatctggtgccctgaacgcggtgaattcctcgcaccgccaaggcaccataagcgcgaagacagtttcgagtctctggactcgcttggctctcggagcttgacctcttgctcctcagatattaccctccgggggggaagagaaggctttgagtcagatacggattctgagtttacctttaaaatgcaggactacaacaaggatgacatgagctatcgtaggatctcagctgtagaaccaaagactgcattaccatttaaccgctttcttcctaataaaagtcggcagccttcgtacgttcctgcgcctttaagaaagaagaagcccgacaagcacgaggacaatcgcaggagttgggccagtccagtatacacggaggccgatggcactttcagccgattatttcagaaaatttacggcgaaaacggctctaagtctatgtccgatgtatctgctgaggacgtccagaacttgcgacagctgagatacgaggaaatgcagaagattaagtcacagctgaaagagcaggaccaaaaatggcaggatgacctagctaagtggaaagatcgccgaaagagctatactagcgatttgcaaaaaaagaaagaagagcgagaggagatagagaagcaggcattggagaagtctaaacgcagcagcaaaacattcaaagaaatgttgcaggacagagaatcacagaaccagaagtctaccgttcctagcagacgcagaatgtattcctttgatgatgtgctggaggagggaaaaagacccccgactatgaccgtgagcgaggcctcctatcagagcgagcgcgtcgaggagaaaggcgccacttatccgagcgaaattccgaaggaggactctacaacattcgcaaaaagagaggatcgtgtgactaccgagattcaattaccttcccagagccctgtcgaggagcagagccccgctagcctctctagcctacgctccaggtccacacaaatggagtctaccagggtgagcgccagcttgccacggtcctacagaaagaccgacacggtcagacttacaagcgttgtaacccctcggccgtttggctcacagacacgtgggatcagttcacttccgagatcctacaccatggatgatgcttggaaatacaatggtgatgtggaggatatcaagcggacgcccaacaacgtggtcagcacaccagctccctctcccgacgccagccagctggcaagcagcctgagcagccagaaagaagtggccgccacagaggaggatgtgacgagactgccttcacctacctctcctttcagttctcttagccaggatcaggccgctacctcgaaagccacattgtccagtacatctggactcgacctgatgtccgagtctggcgaaggtgagatctctcctcaacgcgaagtcagtagatcccaagatcagttctctgacatgagaatctccatcaaccagaccccagggaagtcactcgattttggatttacgatcaagtgggatatccctgggattttcgttgctagcgtcgaggcaggcagccctgccgagttcagccagcttcaagttgacgatgaaataatcgccattaataatactaaattcagttacaatgattcaaaagaatgggaagaagctatggctaaggctcaggaaacaggccaccttgtcatggatgtgcggcggtatggaaaagctggaagtccggagaccaaatggatcgacgctacctcaggaatttacaacagcgagaaatcatcaaatctgagcgtgaccactgacttctctgagagccttcagtcgagcaatattgaatcaaaagagataaacggcattcacgatgaatctaatgcattcgaaagcaaagcctccgagtccatttctcttaagaatttaaaacgccgctcacagttctttgaacaaggcagctcagacagcgtggttcctgatcttcccgttccgacaataagtgcccccagccgctgggtgtgggaccaggaggaagagcgcaaacgccaggagcgatggcagaaagagcaagataggttgctccaagagaaataccagcgggagcaagaaaaacttcgcgaggagtggcagcgcgccaagcaggaggctgagcgggaaaactcaaagtatctcgacgaagagctgatggtgttgtcttctaatagcatgtccctgaccactcgggaacctagtcttgccacttgggaagctacttggagtgaaggctctaagtcgagcgatcgcgagggaacccgcgcaggtgaggaggagaggaggcaaccacaggaagaggtggtacatgaagaccaaggaaagaaaccacaagaccaactggttatcgagcgtgagcggaagtgggaacagcagttacaggaggagcaggagcaaaagagactgcaagctgaagccgaagagcaaaagcgccccgctgaagagcagaaaaggcaggctgagatcgaacgtgagacgtcggtgcgtatttaccagtatcgaaggcccgtcgattcgtatgatattcctaagaccgaggaggccagctcaggttttctgccgggagatagaaacaagagtcggtccactacggaactggacgattatagcaccaacaagaatggaaacaataaatacctcgatcagattggcaatatgacttccagccagcggagaagtaagaaggagcaggttcctagtggcgcggagctggaaaggcagcagattctgcaagaaatgagaaagagaaccccactgcacaacgacaacagttggattcgccaaaggagcgcaagtgtgaacaaagagccagtaagtctccctggcataatgcgacgcggtgaatccctcgataacttggatagtccgcgatctaacagctggcgccagcctccatggctcaatcaacccactggattttatgcttcctctagcgtgcaggactttagcagaccccctccccagttagtatccacttctaatagggcctatatgagaaatccctcttcatcagtaccacccccatccgctggatcagttaaaacctccactaccggagtggccactacccagtctcctactccccggtcgcacagcccgtcagcatcccagtctggaagccagctgcgaaatagaagtgtatctggtaaacgcatctgcagctactgcaacaatatactcgggaagggcgccgcaatgatcatcgagagtcttgggttgtgctaccacttgcattgctttaagtgcgtggcatgcgaatgtgatttaggcgggtcgagttccggggctgaggtccgaatcaggaatcatcagctgtactgcaatgactgttatttaaggtttaagagcggccggccgaccgccatgtag

SEQ ID NO: 122494 - DNA, 5013 bp, Artificial Sequence
  Description of Artificial Sequence: Synthetic coding sequence
atgaaaaagatccggatttgccatatcttcacattttacagctggatgtcatacgacgttcttttccaaagaactgagctgggcgcattagaaatctggagacaactgatttgtgcccacgtgtgcatatgtgtaggctggctgtatctgagggatcgtgtgtgttccaaaaaagacatcatcctgagaactgagcagaacagcggccgcactatattaatcaaggcggtaactgagaagaattttgagaccaaggattttcgagcctccctcgaaaatggagtcttgctctgtgacctgatcaacaagctgaagcccggggttatcaagaagataaacaggctgtctacccccattgccggcttggataacattaacgtgttcctgaaagcatgtgaacagattgggctgaaggaggcccaactgtttcaccccggagatcttcaggatttgtctaatagagtcacggtcaagcaggaggagaccgataggagagtaaagaatgttctgattactttatattggctgggcaggaaggctcagagcaatccctactacaatgggccgcacttaaatctgaaagccttcgagaatctgttgggtcaggccctgactaaagcgctggaggactcctcattcctcaagagatccggtcgggatagcggctatggagacatctggtgccctgagagaggcgagttcttagcgccacctaggcaccacaaaagagaggattcatttgagagcttggacagtttgggcagtcgaagtctgacttcgtgcagtagtgatatcactctcagaggtggtcgcgagggatttgagtcggacaccgactcggagtttacctttaagatgcaagactataacaaagacgatatgtcatacagacgcatcagtgccgttgaacccaagacagcgctgccatttaacagattccttcccaacaagagtcggcagccctcttacgtacctgccccacttaggaagaagaagccggacaaacatgaggacaatcgccggtcttgggcatccccggtttataccgaagccgacggcactttctcctcgaatcaacggcgcatttggggcactaatgttgaaaactggccaacagtccaggggacatccaaaagcagttgttacttggaggaggagaaagcaaagactcgcagcattcctaacatagtaaaggacgatctgtacgtgcgcaagctatcccccgtaatgccaaaccccggcaacgcctttgatcaatttcttccgaagtgttggacacctgaggatgtaaactggaaacgtatcaagcgggaaacttataaaccatggtataaggagtttcaaggtttttctcagttcctcctgctgcaggcacttcaaacctacagtgatgacatactgtcctctgagactcatacaaagatcgatcctacgagcgggccgcgactgattacgcgccgcaaaaacctgtcttacgcccccggctaccgccgtgatgacctggagatggccgctcttgacccagacctggagaacgacgatttcttcgtacgtaaaaccggggccttccacgccaacccctacgtgcttagggcgttcgaagattttaggaaattctcagaacaggacgactctgttgagcgggatatcatcctccagtgccgggaaggagagctcgtactgcccgatctcgagaaagacgatatgatcgtgagacgcattccagcacagaaaaaggaggtccccttgtccggggcacccgacaggtaccaccctgtgccctttccggagccctggaccctgccacccgaaatccaggctaaattcctgtgtgtgctggaaaggacgtgtccttccaaggaaaaatccaactcttgtaggattctggttccatcctacagacagaagaaggatgacatgcttacccggaagatacaatcctggaagctgggcaccactgtgccccccatttcttttacgcccggtccctgctctgaagctgatctcaagagatgggaggctatacgcgaggcaagtaggctgcgccataagaagcgactgatggtggagcgcctgtttcagaagatttacggcgagaatggctccaagtccatgagtgatgtctcagccgaagatgtccagaatctgaggcaactgcgctatgaggaaatgcagaagatcaaatcccaactaaaggaacaggatcagaaatggcaggatgatttggctaaatggaaggatcgtcgaaagagttatacatccgatcttcaaaagaagaaggaagaacgagaagagatcgaaaaacaagcattagaaaagagcaagaggagctccaaaacctttaaagaaatgctgcaggaccgagaaagtcagaaccagaagagcaccgttcccagcagacgcaggatgtattcctttgatgacgtccttgaggaagggaaacggccgcctacaatgactgtgagcgaagcctcatatcagagcgaaagggtggaggaaaaaggcgccacttacccctccgaaatccctaaggaggacagtacgaccttcgcgaagcgcgaagaccgtgtgacaaccgaaatccagcttccctcccaaagtccagtcgaggagcaatcaccagcaagtctttctagcctgaggtctcgcagcacgcagatggagtctaccagggtgagcgccagcctgccgcgttcctaccggaagaccgacacggtccgcctaaccagcgtggtaacccctagaccctttggctcgcagactagaggcatctcgtcacttcccagatcctacactatggacgatgcatggaaatataatggcgacgttgaggatatcaaacgaacacctaacaacgtcgtgagtacacctgcccccagccctgacgccagtcagctggcaagctcattatcgtcacagaaggaggtcgcggctactgaggaggatgtgactcgtctcccatcccctacatcccccttctccagcctcagccaggatcaggctgccacaagtaaggcaacgctctcatctacctccggcctggatttgatgagtgagtctggcgagggtgaaatcagcccacagcgtgaggtcagccgaagccaagatcagttctctgatatgaggatttctattaaccagacccccggaaagagtttggactttggattcaccataaagtgggacatccccggaattttcgttgcctcagtggaggcgggtagtcctgcagagtttagccagctgcaagttgacgacgaaatcatcgccatcaacaacacgaagttttcctataacgattcaaaggagtgggaggaggctatggccaaggcccaagagaccggccacctggtgatggacgtgcgccgatacggcaaggcgggatcccctgagaccaagtggattgacgccacctcggggatatacaattcggagaaatcctctaatctgtccgttaccacagacttctctgagtccctgcaaagctcaaacattgagagtaaggaaattaatgggatccatgacgaatctaacgccttcgaaagtaaggcctctgagtcaatctcactcaagaatctcaaacgccggagtcaattttttgagcagggcagcagcgacagcgtcgttccagacttgccagttcctaccatcagtgcgccttcgcgatgggtgtgggaccaggaagaggaacgcaagagacaagagcggtggcagaaggaacaggacagactgctccaggagaaatatcagcgtgagcaagaaaagctcagggaggagtggcagagagctaagcaggaagcggagcgcgaaaattcaaaatacctcgacgaggaactcatggtcctgtccagtaattccatgtcactgacaactagggaacccagcctggcgacatgggaagccacctggtcagagggctcgaaaagctctgaccgggagggtactagagcgggggaggaagagcggaggcaaccccaagaggaggtcgtgcatgaggatcagggaaagaagccacaggatcaacttgtgattgaaagagagcgcaagtgggagcagcagctgcaagaagagcaggagcagaagcgcctgcaggcagaggccgaggaacagaagcgcccagccgaagagcaaaaacggcaggcagaaatagagcgagagacctcagtgcggatataccaatacaggcgccccgtggacagctatgacatccctaagactgaggaagccagcagcggttttctgcccggcgatcgaaataagtcccggtctacaacagagcttgacgactacagcaccaataagaacggaaacaacaaatacctggatcaaattggtaacatgacttctagtcagcgtaggagcaaaaaggaacaggtgccgagcggtgccgaattagaaagacagcaaatccttcaggaaatgaggaaaagaacaccactgcacaatgacaactcctggattagacagcgcagtgccagcgtgaacaaggaaccggtgtcactgcctggaataatgcgccggggagaatcactcgataatctcgatagtccacgctccaacagctggcgccagcccccttggctgaatcagccaacaggcttttacgcttcttcatccgtgcaggatttctcgcggcccccgccccagttggtgtccacctccaacagggcctatatgagaaacccttccagcagcgtacccccacccagcgcgggtagcgtgaagacctcaaccactggagtagccaccacccagagtccaactcccaggagtcatagtccttcggcctctcaatcgggctcccagcttcgaaattccgttctgccagtgagcgttacttctgaagcccttccacaggagctcaaatcagggtctgaaacaactaactgtaccgctactacagccattagcgactccaacctcgacggccagccaccatgtgatgtgagccttcacaccaaagcactgcttcagatcgaagaggaggtggtggctgctcacgtcgacctgtag

SEQ ID NO: 122495 - DNA, 4845 bp, Artificial Sequence
  Description of Artificial Sequence: Synthetic coding sequence
atgaagaagatccgaatatgccatatatttaccttttatagctggatgagctatgacgtactgtttcagaggactgagcttggagcactcgagatttggagacagctgatctgtgcccacgtttgtatttgcgtcggctggctgtacctccgagatcgagtttgttctaaaaaggatatcatccttaggacggaacaaaattctggccggacaattctgatcaaagccgtgaccgagaagaactttgagacaaaggactttagggcatctttggaaaacggcgttctgctgtgtgacctcattaacaagctgaaaccgggggttatcaagaaaattaaccggctgagtacacctatcgccgggctcgacaacattaacgtgttcctgaaagcctgtgaacagattggcctgaaagaagcccagctgttccatccaggggatctgcaggacctcagcaacagggttacagtgaaacaggaggaaacagaccgtcgagtgaaaaacgtcttaattacgctttattggctgggtcgcaaggcccagtctaatccatattacaacgggccgcacttgaacctcaaggcatttgagaacctgctcggccaggctttgaccaaagccctggaagactcatcatttctcaagcggagcgggcgtgatagtgggtatggggatatctggtgccctgagcgcggggagtttttggcccctccccgtcaccacaagcgggaggattcattcgagtctttggattccctcggctcacggagcctcacaagctgttcttccgacataacgctcagaggaggacgtgaaggattcgagtcagacacggacagcgaattcacatttaagatgcaggactacaataaggacgatatgtcctatcgccgcatttcagccgtcgaacctaagaccgcactgccatttaataggtttctccctaataagtctcgccagccttcttatgtgcctgccccactgcgcaagaaaaaacctgataaacatgaggacaatcgaaggtcgtgggccagtcccgtctacactgaggctgatgggacttttagtagtaatcagagaaggatttggggaaccaacgtggagaattggcccacagttcaggggaccagcaaatcttcttgctacctcgaagaagagaaggcaaagacccgttccatcccaaacattgtgaaagatgatctttacgtccgcaaactgtctccagtgatgcctaatccaggaaacgcattcgatcagttcctgccgaagtgctggacgccagaggatgtcaactggaaaaggatcaagcgagagacttacaaaccatggtacaaagagtttcagggattttcccagttcctgttactgcaggccctgcaaacctatagcgacgacatcttatcctccgagacacatacaaaaattgatcctacctctggaccccgtctaatcaccagaaggaaaaatttaagttacgcccctggctaccgccgagatgacctcgaaatggctgcactggatcctgacctggaaaatgatgatttctttgtgcgcaagaccggtgcttttcacgccaacccttatgtcctcagagcatttgaagactttcgcaagttctccgagcaggatgacagcgtagagcgtgatatcatcctccagtgcagggagggagaactggtattaccagacctggagaaagatgacatgattgtgcgacgtattcccgcacagaagaaggaggtgccgcttagtggcgctcccgatagataccaccctgtgcctttccccgagccatggacccttcccccagaaatacaggccaagttcctgtgtgtgcttgagcgcacctgtccctctaaagaaaaatccaatagctgtagaatactcgtccccagctacagacagaaaaaagatgacatgctaactagaaaaattcagagttggaagctcggtaccacagtgccccccatttcattcaccccaggaccctgttctgaggccgacctgaagcgctgggaagccatcagagaggcatcccggctgcgccacaagaagagactcatggtcgagcgattattccagaagatatatggtgagaacgggtcaaagtcaatgtctgacgtgagcgccgaagatgtgcagaacttacgtcagctacgctatgaggagatgcagaagattaagagtcagcttaaagaacaggatcaaaagtggcaggacgatctagccaagtggaaggaccgccgtaaatcttatacctcggacctacagaagaaaaaagaagagagagaggaaatcgaaaagcaggccctggagaagagcaaaaggtcctctaagacctttaaggaaatgctgcaggatagggagtctcaaaatcagaaatcaacggtcccttcccggcgccgcatgtattccttcgacgacgttctcgaggaggggaagcgtccgcctactatgacagtcagtgaggccagctaccagagcgaaagagtcgaggagaaaggagcaacatacccttccgaaattcccaaagaggactccaccacctttgcaaagcgcgaagaccgggtgacaacggagattcagctgccttctcagagccccgtcgaggagcagtcgccagccagcctgtctagtctcaggtcaagaagtacacagatggaatctaccagggtttccgctagtctccctaggagttatcgcaaaaccgatactgtaaggctgacaagtgtcgtgacacctcgaccatttggcagtcagaccagagggatcagctctctgccaagatcctacactatggatgatgcatggaaatacaatggagacgtggaggacatcaagcgtacacccaacaacgtagtaagtactcccgccccatcacccgatgccagtcagctagcatcgtctctgagctcccagaaggaggtcgccgccactgaagaggacgtaactcggctcccttccccgacctccccattctcttcactgagtcaggatcaggctgctacgtccaaggcgactttatctagtacaagcgggctggatcttatgagcgagtccggcgagggtgaaattagcccacagagagaagtctctagatcccaggaccagttcagtgatatgaggatctcgatcaaccagacaccgggtaagtcactcgatttcgggtttacaatcaagtgggacatcccagggatcttcgtggctagcgttgaagccgggagccccgccgagttttctcaactccaggttgacgatgaaatcatcgcaatcaacaacacaaaattcagctataatgacagcaaggagtgggaagaggccatggccaaggcccaggagaccggtcatctggtgatggacgtcagacgttacggcaaggccggctcaccggagacaaagtggatcgatgcgacgtctggtatctacaattcggaaaaaagctctaacctgagcgtcacaaccgatttttcggaaagtctacagtccagcaacatcgaatcgaaggaaatcaatggtattcatgatgagtccaatgccttcgagtctaaggcatcagagtcaatttctctgaaaaatttaaagaggcggagccagttcttcgaacagggctcttccgactcagtggtacctgatttgcctgtgcccacgatcagcgccccctctcggtgggtgtgggatcaggaagaggagcgaaaaagacaggaacgctggcagaaagagcaagatagactccttcaggaaaaataccagcgagaacaagaaaagctgagagaggaatggcagcgagccaagcaagaagccgaacgtgaaaacagtaaatacctggacgaagagctaatggtgctgtcctccaactctatgagcttgaccacacgggaacctagcctggcaacctgggaagctacatggagtgaggggtccaagtcaagtgacagagaaggaaccagagctggtgaggaggaacgccggcagccccaggaggaagtcgttcacgaagaccagggcaaaaagcctcaggatcagctcgtgatcgagagggaacgtaaatgggagcagcagctgcaggaagagcaggaacagaaacggttacaagcagaagcggaggaacagaagcggccagcagaggagcagaagcggcaggccgagattgagcgagagacctcagtacgaatctaccagtaccgcaggcccgtcgatagctacgatatccctaagaccgaagaagcatcatccgggtttctgcccggcgacaggaataagtctaggagcaccaccgagctggatgactactcaactaacaaaaacggaaacaacaagtatcttgaccagatcggcaatatgacatcatctcagagacgttcaaagaaggagcaggtgccgtctggagcagagctggagaggcagcagattctccaggagatgagaaagagaacacccttacataacgacaacagttggatcagacaacgcagcgcgtctgtaaacaaggaaccagtctcactcccggggatcatgcgccgcggtgaaagcttagataacctggattctccacgctccaactcttggcggcaacccccttggttaaaccagccaactggattctacgcaagttcttcggtgcaggattttagcaggccgccccctcagctggtcagtacttcaaatagagcctacatgcggaacccctctagcagcgtcccccccccgtcagcaggaagtgtgaaaacaagtactacaggggtagctactacgcagagcccaacacctcgctcccactcaccgtcagcctctcaaagcgggagtcagctaaggaattcctggaccgcgaatagacacgtcatgtag

SEQ ID NO: 122496 - DNA, 4158 bp, Artificial Sequence
  Description of Artificial Sequence: Synthetic coding sequence
atgcaagattacaataaagatgatatgtcttaccgccgcatcagtgcagtcgagcctaagacagctctgcccttcaatcgcttcctgcccaacaagagtcgccaaccatcctatgtgcctgctccccttcgcaaaaagaagcctgataaacatgaagacaataggaggagttgggcttctcccgtatatacagaggcagatggaacatttagcagtaaccagagacgcatttggggcactaatgtagagaattggcctacggtgcagggaacaagtaaatcgtcctgctacctcgaggaggagaaggcaaaaacacggtccatcccaaacatagtcaaggatgacctctatgtaaggaagctgagcccggtgatgccgaaccccggtaacgcgttcgaccagttcctgccaaagtgctggacacccgaggatgtcaattggaagagaattaagagagaaacctataagccttggtacaaggaatttcagggattttcccagttcctgctcttgcaagccctgcagacctatagcgacgacatcctgagcagcgaaacgcacactaaaattgaccccacctcaggccccaggctcataacacggcgaaagaacctgtcttacgcacctggctaccgtcgggatgacttagagatggccgcgctggaccctgaccttgagaatgatgatttctttgtcaggaagaccggcgcgtttcatgccaatccctacgtcctgcgagcctttgaggatttccgaaagttcagcgagcaagatgactccgtcgaaagagacataatcttacagtgtagagaaggcgagttagtgctcccagatttggaaaaagatgatatgattgtgcgccgaattcccgcacaaaaaaaggaggtaccgttgtccggagcccctgaccgttatcaccctgttcccttcccagagccgtggacgctgccacccgagatccaggctaagttcctttgtgtgctcgaacggacctgcccaagtaaggagaagtccaactcatgtagaattctggtgccaagttaccggcaaaagaaggacgatatgcttacccgtaagatacagtcatggaagctagggacgacagtcccgccaattagctttactcctggcccctgtagtgaggccgatctgaaacgctgggaagccattcgggaggcttcccggctgcggcacaagaagcggcttatggttgaacgcctgttccagaagatatatggcgaaaatggttccaagagcatgtctgatgtgtccgctgaagatgtgcaaaatctgcggcagctacgttatgaggagatgcagaaaatcaagtcccaactgaaggaacaagatcagaaatggcaggatgacctcgcaaagtggaaagatagacgcaaatcttacacttcagacctgcaaaagaaaaaagaggagcgggaggagatcgagaagcaggcacttgaaaaatctaaacgaagcagcaagacctttaaagaaatgcttcaggacagagaatcgcaaaatcaaaagtccacggttccaagtagaagacggatgtattcattcgacgatgtcctggaggagggaaaacgtcccccgaccatgacggttagcgaagcttcttatcagtcagaaagggtggaggagaagggggccacatatccgtctgagatacccaaggaggactcaaccacattcgcaaagcgcgaagatcgtgtaactacagagatccagttgccgagccaatcaccagtcgaggaacagtctcccgcgagcctttccagtttgagaagcaggagtacgcaaatggagtcaactagggtgagcgcctctttgccacggagttacagaaagactgataccgtgcgcctgactagcgtggtcaccccacgcccatttggaagccagactcgaggcatcagctcactccccaggtcttatactatggatgatgcttggaagtacaacggggacgtcgaagatataaaaagaaccccgaacaacgttgtgtcgactcctgctcccagccccgacgcctcgcagctggcttcctccctgtcgagccagaaagaggtggcagcaaccgaagaagacgtgacaaggttgccaagtccaacttcaccatttagtagcctctcacaggaccaggccgccacctccaaagccactctcagctccacgagcgggctggatctgatgagcgaatcaggagaaggggagatctcccctcagagggaagtgtcccgctcacaggatcagttctctgacatgcggatttctattaatcaaactccaggtaaatctttagacttcggcttcacaattaaatgggatatcccaggaatttttgtcgcctcagtggaagctgggagcccagccgaattttcgcagctacaggtggacgacgaaattatcgcaataaataatacgaagtttagctacaatgattcaaaggaatgggaggaagctatggcgaaagctcaagaaaccggacacctcgtcatggacgtcagacgttacggcaaagccggttcgccggaaaccaagtggatcgacgcaacctccggaatatataacagtgagaaatccagcaatctctccgtgacaacagacttctcagagagtcttcagtcctccaatatcgagtcaaaggagatcaatggaatccacgacgagtccaatgccttcgagagcaaagccagcgagtctatttccctcaaaaacctgaagagacgcagccagttctttgagcagggctcctctgacagtgtagtgcctgacctgcctgtcccaacgatcagcgccccatccaggtgggtttgggaccaggaggaggaaagaaaacgccaggagcgctggcaaaaggaacaggataggttgctacaagagaagtaccaaagggagcaggagaagttgcgcgaggagtggcaaagagctaaacaagaagccgaaagggagaattctaagtatctggacgaggagcttatggtattaagctccaactctatgagtttaacgactagagaacctagccttgctacatgggaagccacctggagtgagggatcaaagtcatctgaccgagagggcacgcgagcaggtgaggaagagcgtcggcagcctcaggaggaggtcgtccacgaagatcagggcaagaagccgcaggaccagctcgtgatcgaacgcgaacgaaagtgggaacagcaactgcaggaggaacaggagcaaaaacggttacaagcagaagctgaggagcagaaaaggcctgctgaggagcagaagcggcaagctgagatcgaaagagagacctccgtgcgcatctatcagtaccgcagaccggtggactcatacgatatcccgaaaaccgaagaagcctctagtgggtttctcccgggagatagaaataagagtcgtagcactaccgagttagatgactatagtacaaacaaaaacggcaacaacaagtacctggatcagatcggtaatatgacatcaagtcagcgaaggtctaaaaaggagcaggtgccatctggtgcagagctcgaaaggcagcagatcctgcaggagatgaggaaaagaacccctttgcataatgataactcctggatccggcaacggtcagcatcagtgaacaaggaacccgtttcgctacccgggattatgcggcggggagagtccctggataacctggactctccccgaagcaatagttggcggcagccgccctggctgaatcaacccacaggcttttatgcatcttctagcgtgcaggatttcagtcggcccccacctcagcttgtgagcacgagcaatagagcttatatgcgtaaccccagctcttctgttccgcctccatctgcaggctctgtcaagactagtactaccggagtcgctactacccaatcccccactccacggtctcacagtccgtctgctagccagtctgggtcacagctgagaaattccgtccttcccgtctctgtgacgtcagaagctctgccacaggagcttaaatccggatcagaaacgacaaactgtacagcaactacagccattagcgatagcaacctcgatggccaacccccgtgcgacgtgtccttacatacgaaggcactgctgcaaatagaggaagaggttgtcgcagcgcacgtagacctgtag

SEQ ID NO: 122497 - DNA, 2280 bp, Artificial Sequence
  Description of Artificial Sequence: Synthetic coding sequence
atggaaagctctcccttcaaccgccgccagtggaccagcctgtctctccgcgtcaccgccaaggagctttcactggttaacaagaacaaatcttccgctatcgtggaaattttttccaaatatcaaaaggcagccgaagaaaccaatatggagaagaaacggtctaacacagaaaatctgtcccagcacttcagaaaaggaactttaaccgtgcttaagaagaaatgggaaaacccgggcctgggtgcagagagccatacagacagccttagaaatagtagcacagaaatccgacatcgtgccgatcacccgcccgcagaggttacctcccatgccgccagcggtgcaaaagcagaccaggaagagcagatccacccaagatcgagattaagatctccacctgaagcactcgtgcagggaaggtacccccacatcaaagatggtgaagatctcaaagatcattctactgagtcgaagaagatggaaaactgcctcggggagtcaagacacgaggtagaaaagtcggagatctccgagaacactgatgcctccggcaagatagaaaaatacaacgtcccacttaacaggcttaagatgatgtttgaaaagggtgaaccaactcagacaaagatcctgagggcacaatccaggtccgccagcggtaggaaaataagcgagaactcctattcccttgacgacctggaaattggccccggtcagctgtcttcgagtaccttcgacagcgaaaagaatgaaagcaggaggaacctggagctcccaagattgagtgagaccagcataaaagatcgcatggctaagtatcaagccgctgtgtccaaacagtcctcttccactaattacacgaacgagctaaaagccagtggcggcgagattaagatacataagatggagcagaaggagaacgtcccccctggccccgaagtgtgtatcacccatcaagaaggcgagaagatttccgccaatgaaaacagcctcgctgtgagaagcactcctgccgaagacgatagccgcgacagtcaggtgaagtcagaagttcagcagcctgtgcacccaaagccgctgtcacccgacagccgcgccagctcgctgagcgaatctagccccccaaaagctatgaagaaatttcaggccccagctcgggagacatgtgtggagtgccagaaaactgtgtatcccatggagaggttgctcgctaatcagcaggtgttccatatcagctgtttccggtgcagctattgtaacaataagctttccttgggtacatacgcctctctccatgggcgcatctattgtaagccgcactttaatcagctgtttaaatccaagggcaattatgatgagggcttcgggcatagacctcataaggacctgtgggcatccaaaaacgagaatgaagaaatattggagcgtcccgcccaactggccaacgccagagaaacaccgcactctccgggagtggaagacgcccccattgcaaaggtgggcgtattggccgcatctatggaggccaaagcctcttcacagcaagagaaagaagacaaacctgccgagacaaagaagctgagaatcgcttggccccctcccacagaactcggcagctccgggtctgctctcgaagagggaattaagatgtccaagcccaagtggcctcctgaggatgaaataagcaagcccgaggtcccagaggacgtagacctggatctgaagaaactacgaagatcttcttctctgaaagagcggagtagaccctttacagtagcggcatcttttcagtccaccagcgtgaaaagtccgaaaacggtgagcccacctatccgtaagggctggagcatgtctgagcagagtgaagaatccgtcggggggagagttgctgaacgaaagcaggtcgaaaacgccaaagcttctaagaagaacgggaacgtgggaaagaccacgtggcaaaacaaagaatctaaaggcgagacaggcaagcggtcaaaggagggccactccttagaaatggagaatgaaaacttggtggaaaacggagctgattctgacgaggatgataatagcttcttaaagcagcaatctccgcaagaacccaaatctttaaactggtcttcctttgtggataacaccttcgctgaagagtttacaactcagaatcagaaaagccaggatgttgaactgtgggagggtgaagtggtcaaagagctcagcgttgaagaacagattaagcggaatcggtactatgacgaggatgaggacgaagagtag

SEQ ID NO: 122498 - DNA, 2283 bp, Artificial Sequence
  Description of Artificial Sequence: Synthetic coding sequence
atggagtccagcccatttaataggagacagtggacatctttatcccttagggtgacagcgaaagagctgtccttagtgaataaaaacaagagttctgcaatcgtggaaatttttagtaagtaccaaaaagctgctgaggaaaccaacatggaaaaaaagcgcagcaatacggagaacctgagccaacacttccggaagggcaccctgacagtccttaagaagaagtgggagaatccaggcctgggggctgagtctcacacagactctttgagaaactcctcgaccgagatccggcacagggcagaccatcctcccgcagaggtcacctcccacgctgccagcggcgctaaagccgatcaagaagaacaaattcaccccagatcgcggctgcgcagcccaccggaagctttagtacagggtcgttatccacacataaaggatggcgaagatctgaaggaccattccactgaaagcaaaaaaatggagaattgcttgggcgagagtaggcatgaagtggaaaagagcgagatctctgaaaatacagatgccagtggcaaaattgagaagtacaacgtccctctgaaccggttaaaaatgatgtttgagaagggcgaacccacgcagacgaagattttgcgtgcccaaagccgttccgcaagtggaagaaaaatttctgaaaacagttacagcttagacgatctggagatcggtcctgggcaactgagctcctccaccttcgattcagagaaaaatgaaagccgaaggaatctagagctcccacgcctgtcagagaccagtataaaagataggatggccaaataccaggcggctgtcagtaaacagtcttcaagcacgaattatactaacgagctgaaggcctctggaggagagatcaagatccacaagatggaacagaaagagaatgttccccccgggcctgaggtgtgcattacacatcaggagggagagaagatttccgccaatgaaaacagtctggcagtacgcagtacacccgctgaggatgacagtcctggcgactcccaggtcaaaagtgaagtgcagcaaccagtccacccgaagcctctctcccctgattcaagggccagttctctctcggagagttctccccctaaggctatgaagaagtttcaggcaccagccagagaaacctgcgtcgaatgtcagaagacagtctacccaatggaacgattgcttgcaaaccagcaagtgttccatattagttgcttcagatgctcatactgtaacaacaaattgagtcttggcacctatgcttccctgcatggccgcatttactgtaagccacactttaatcagctgttcaaatcaaaagggaactacgacgaggggttcggacaccgtccgcacaaagatttgtgggcttccaagaatgaaaatgaggaaatactggagcggcctgcccagctggccaacgccagagaaaccccccactcgcccggcgtggaggacgcgcctatcgccaaggttggggtactggctgcctctatggaggccaaagcatcctcccaacaagagaaggaagataaacctgccgagaccaagaaactgagaatagcatggccaccccccactgagctgggctctagcggcagcgccctcgaagaaggaatcaagatgtcaaagccaaagtggccccctgaagacgagatatccaaacccgaggtgccagaagatgtcgatctggacttaaagaagttgcggcgctcgtctagtctcaaggaacgctccagaccctttacggtggcggcttcttttcagtccacatccgtgaagtcacccaaaacagtcagtccaccaataaggaaaggctggtcaatgtccgagcaaagcgaagaatctgtgggtgggagagtcgctgagagaaaacaggtcgagaatgccaaggccagtaaaaagaacgggaatgtgggcaagactacttggcagaacaaagaatctaagggagagactggcaagcggagtaaggaaggccacagcctagagatggagaatgagaatctggtcgagaatggtgctgattcagacgaggacgataacagtttcctcaagcagcagtcgccgcaagagccgaagagtcttaattggagcagcttcgttgataacacgttcgccgaagagtttactacccagaaccagaagagccaagatgttgagttgtgggaaggagaggtagtgaaggagctctctgtggaggaacagatcaagcggaatagatactacgacgaagacgaggacgaagagtag

SEQ ID NO: 122499 - DNA, 2037 bp, Artificial Sequence
  Description of Artificial Sequence: Synthetic coding sequence
atgtggcagggatgcaattgcagccagctctccgagactgcagtggaccaagagcagctgggtgtgctgacttttattctgcaaaggaccacttgtctcaatgttagcgcagatcaggaggagcagatccacccaagatcgcgactcagatcccccccggaagcgctagtgcagggacgctacccccatataaaagatggcgaggacttgaaagaccacagcactgagtctaaaaaaatggaaaattgtctcggcgaatctcgccatgaagtagagaaaagcgaaatctcagagaatactgacgcaagcggaaaaattgaaaagtacaatgtccccctgaaccgcctgaagatgatgttcgagaagggggaacctactcaaactaaaattctgagagcgcagtctcgcagcgccagtgggcggaagatctccgagaactcttactcacttgacgatttggaaataggccccggccagctctccagcagcacttttgattcagagaaaaatgaaagcaggcgcaacttggaactgcctagactttccgagacctctattaaggatcggatggcgaaataccaggctgctgtcagtaagcagagttcttcaactaactacactaatgagctaaaagctagcggtggggaaatcaagatccacaagatggagcaaaaagagaacgttcccccgggccccgaggtgtgtatcacccatcaggaaggcgaaaagattagcgcgaacgagaattccctggccgtgcgtagcacccctgccgaggacgattctagggactctcaggtgaaatctgaagtgcaacaaccagtacacccaaagcctctctcgccagactcaagggcctccagtctgtcagagtcatcgccacccaaggctatgaaaaagttccaggcaccagcccgcgaaacgtgtgtggaatgccagaaaaccgtctaccccatggaaaggcttttagcaaatcagcaggttttccatataagctgctttagatgtagttattgtaacaataagttatccctcggaacttacgcctcacttcatgggaggatatactgtaaaccacatttcaaccagttgttcaagtcgaaggggaactatgacgaggggttcggacacaggccccacaaggacctctgggcaagcaagaatgagaacgaagaaattttggaacggccagcacagctggccaatgcccgcgagacccctcactctcccggggttgaagacgccccgatcgccaaggttggggtcctcgctgctagcatggaagccaaggctagctcccagcaagaaaaagaggacaagcctgcggagaccaagaaattgaggatcgcctggccccctcccaccgagctgggcagcagtggcagtgctttggaagaagggatcaagatgagcaagcccaagtggccaccggaagatgagatctctaaacccgaggtccctgaggacgtcgatctagaccttaaaaaactgaggagatcttcctcactgaaagagcgctcaaggcctttcaccgtggcggcatcgttccagtcaacatcagtgaagtcccccaaaaccgtctccccacctatccgaaaaggttggtcaatgtctgagcagtcagaagagtccgtgggagggcgggtggcggaaaggaaacaagtcgagaacgcgaaggcttcaaaaaagaatggtaacgtcgggaaaaccacatggcagaataaagagtcaaaaggagaaaccgggaagcggtcaaaggaggggcactccctggaaatggagaacgaaaatctcgtggaaaacggagcagattcagatgaggacgataacagctttcttaagcagcagtcaccgcaagaacctaagtccttaaactggagttcgtttgtggataataccttcgccgaggaattcacaactcagaaccagaagagccaggatgtggagctctgggaaggggaggtagtgaaggaactctccgtagaagagcaaatcaagaggaatcggtattacgacgaagacgaagacgaggaatag

SEQ ID NO: 122500 - DNA, 1374 bp, Artificial Sequence
  Description of Artificial Sequence: Synthetic coding sequence
atggagcagaaagaaaatgtgccaccagggcctgaagtgtgcatcacccaccaggagggggaaaagatcagcgcaaatgaaaactcattggcggtgagaagcactcccgccgaagatgactctcgcgactctcaagtcaagtctgaggtccagcaacctgtgcaccctaaacctctcagcccagacagtcgggccagcagtttgtctgagtctagcccccccaaagccatgaagaaattccaggcccccgcccgcgaaacttgtgtcgagtgtcagaagactgtatatccgatggagcgcctgctcgctaatcagcaggtctttcacatctcttgttttcgttgcagctactgcaataacaaactgagtttgggcacttacgcatcactgcacggccggatctattgcaaaccacacttcaaccagctgtttaaatccaaaggtaactacgacgaggggttcgggcatagaccccataaggatctctgggctagcaaaaatgaaaatgaggaaattctggagcggccagcccaattagccaacgctcgagaaacaccccattccccaggcgtagaagacgctccaattgccaaggtgggggtgctggccgcctcaatggaggctaaggctagtagccaacaagaaaaagaggataagcccgcagagaccaagaaactgcgtatcgcatggcccccccctacagaattaggatcctcgggctcagccctagaggaggggattaaaatgtccaaacctaagtggcccccagaagacgagattagtaaacctgaagtaccagaggacgtagatttggatcttaagaaattacgaagatctagttccttgaaggagaggagccgtccattcaccgtagctgcgtcattccaatccacctctgtgaagtctcccaaaacagtgtccccacccattcgcaagggttggtctatgtcagaacaaagcgaggagtccgtcggggggagagttgctgagcgtaaacaagtggagaacgcaaaggccagtaagaagaatggcaatgtggggaagaccacttggcaaaacaaggaatctaaaggcgaaacgggcaagcgttccaaggaaggacactctctggagatggaaaacgagaatctggttgagaatggtgcagactccgatgaagatgacaattctttcctaaaacaacagtccccacaggagccaaaatccctgaactggtcatctttcgtcgacaatacattcgctgaagagttcactacacagaaccagaagagtcaggacgtggaactgtgggagggcgaggttgttaaggagctcagtgtagaggagcagattaagaggaatcgatactatgatgaggacgaggacgaggagtag

SEQ ID NO: 122501 - DNA, 336 bp, Artificial Sequence
  Description of Artificial Sequence: Synthetic coding sequence
atggaaagctcaccatttaataggcgccaatggacatcgctgtccctacgggtaacggctaaagagctctcattagtaaacaaaaataaatcctcagcaatcgtggagattttctccaaataccagaaagccgccgaggagacaaatatggagaagaaaaggagcaataccgaaaacctctctcagcacttccggaaggggacgctcactgtgttgaagaaaaagtgggagaatccagggctcggcgcggagtcacacaccgactccctgcggaattcatctacagaaatacgccatcgcgccgaccatcctcctgcagaggtgacgtctcactag

SEQ ID NO: 122502 - DNA, 393 bp, Artificial Sequence
  Description of Artificial Sequence: Synthetic coding sequence
atggaatcttcaccctttaatcgccgacagtggactagcctgagcttgcgggtaacagctaaggaactgagcctggttaataagaacaaaagctcagccatcgttgagatattcagtaagtatcagaaggccgcagaggaaacaaacatggaaaaaaagaggtctaatactgagaatctgagtcagcattttcggaaaggtactctcaccgtcctgaagaaaaagtgggagaaccccggtctcggggccgaaagtcacacagattctttaagaaatagctctacagaaattcgacacagggccgaccatccacccgctgaggtgacttcacacgctgcaagcggcgccaaggctgaccaggaggaacagatccacccgaggtcgaggttgtag

SEQ ID NO: 122503 - DNA, 1371 bp, Artificial Sequence
  Description of Artificial Sequence: Synthetic coding sequence
atggaacaaaaggagaacgtgcctcccggacctgaggtgtgcatcacgcaccaggaaggtgagaagatttccgctaacgaaaatagtcttgccgtgaggtctacacctgccgaggatgactcgagggacagccaggttaaaagtgaggttcaacagccagtccatcctaagcctctcagccccgacagtcgggcttcatccttgagcgaatcatcccctcctaaagcaatgaaattccaggccccagcgcgagagacttgtgtggaatgtcaaaagaccgtgtaccccatggagaggctgctagcgaatcagcaggtgttccatatatcttgttttcgttgtagttactgtaataacaaactgtccctggggacatacgctagcttacacgggcgcatatactgtaaaccacatttcaaccagctgttcaagagcaaagggaactatgatgagggatttggtcacaggccgcataaggacctgtgggcaagcaagaacgagaatgaagagattcttgaacgtcctgcacagctggccaacgcacgcgagaccccgcattctccgggagtagaggacgcacctatagccaaggttggggttttggctgcctccatggaagcgaaggcatcctctcagcaggagaaagaagataagcctgccgaaactaaaaagttgcgcatcgcctggccccctccaactgagctggggtccagtggcagcgctctggaggaaggaataaaaatgagcaaacccaaatggccacctgaggacgagatttcaaaacccgaggtacccgaggatgtggacctggatttgaaaaagcttcgacggagcagtagcttaaaagaaagaagccgtccattcaccgtcgctgccagctttcagtctacaagcgtgaagagccccaagaccgtcagccccccaattaggaagggatggagtatgagcgagcagtctgaagaatccgtgggagggagagtggccgagagaaagcaggtggagaatgctaaagcatccaagaagaatgggaacgtcggaaagaccacttggcagaacaaggagtccaagggtgagacaggtaaacggtccaaggagggacacagcctcgagatggagaacgaaaatctggtcgagaacggagctgactcggatgaagatgataacagtttccttaagcagcagtcacctcaggaaccaaagagcctgaactggagttctttcgtagacaacactttcgcggaggaatttacgactcaaaatcaaaaatctcaggacgtcgagctgtgggagggcgaggtcgtcaaggagttaagcgtggaggagcagatcaaacggaatcggtactacgatgaggacgaagacgaggagtag

SEQ ID NO: 122504 - DNA, 1803 bp, Artificial Sequence
  Description of Artificial Sequence: Synthetic coding sequence
atggaaaattgcctcggtgagagtcgtcatgaggtcgagaaatctgagatttctgaaaacaccgatgccagtggcaagatcgagaaatacaatgtccccctaaatcgccttaagatgatgtttgaaaagggggaacccacccagaccaagatccttagagctcagagcaggtccgcctccggaagaaaaatcagtgaaaactcatattccctggatgatctggaaattggtccaggacaactctcctcgagcacattcgattccgaaaagaacgaatcaagaaggaacttggagctgccaagactgtccgaaacgtctataaaggaccggatggctaaatatcaggccgccgtatctaagcagtctagcagcacgaattacactaatgagcttaaagcgtccgggggtgagattaagattcacaagatggagcaaaaagagaacgtgccgccgggacccgaggtgtgtattacacaccaggaaggtgagaaaatttctgctaacgaaaactcattggccgtcagaagcactcctgccgaggatgacagccctggtgactcccaggtcaaaagtgaagtgcagcagcctgtgcaccctaaacctctgtcacctgactcccgcgcctctagtctgtcggagtcatcacctcccaaggccatgaaaaaattccaggcaccagccagggaaacctgcgtcgaatgccagaaaacggtttaccctatggagcggctcctggcaaatcagcaagtgttccacatctcatgttttagatgttcatattgcaataataaactatctctcggaacctatgccagtctgcacggcagaatttactgtaagcctcattttaatcagctgttcaagtcgaaaggtaactacgatgaaggatttggccataggccacataaagatctttgggcatccaagaatgagaatgaggaaatactcgagaggcccgcacagcttgctaatgcacgcgagactcctcacagtcccggagtcgaggatgcccctatcgcgaaagtgggggtacttgcagcatctatggaagcgaaggcttctagtcagcaggaaaaggaagataaacctgcggaaacaaagaaattgcggatcgcctggcctccgccaaccgagttgggcagttcgggttctgccttagaagagggcatcaagatgagtaagccaaaatggccacctgaagacgaaatctccaagccagaggttcctgaagatgtggatctggacctgaagaagctgcgacgaagtagtagcttgaaggagcgctcccgcccatttaccgtagccgcctccttccaaagcacttcggttaagtcgccaaaaacagtatccccaccaatcaggaaaggctggtccatgtccgaacaatctgaggagagtgttggcggacgagtggccgaaaggaagcaggtggaaaacgctaaagctagtaagaaaaacggtaacgtcggcaagacaacctggcagaataaggaaagtaagggggagacgggcaaaagatcaaaggaaggccatagtctcgagatggagaacgagaacttagtggagaacggtgcagatagtgacgaggacgacaactcttttctaaagcagcagagcccacaggagcctaaaagccttaactggtcaagttttgtggataacacattcgcagaagagtttaccacacagaatcagaagtcccaggatgtggagctgtgggaaggcgaagtggtgaaggagctcagcgtcgaagagcagatcaagcggaaccgatattacgacgaggacgaggatgaagagtag

SEQ ID NO: 122505 - DNA, 1800 bp, Artificial Sequence
  Description of Artificial Sequence: Synthetic coding sequence
atggagaattgtctcggtgaatctaggcacgaagtggagaagagtgagatctcagagaacactgatgcttctggcaaaatcgagaaatataacgtgcctctcaaccgactcaaaatgatgttcgaaaagggcgagccaacacaaacaaaaatccttcgggcccagtcccgaagtgccagcggcaggaaaatctccgagaacagttactctctggacgacctcgagatcggacccgggcaactaagttcaagcaccttcgacagcgagaaaaacgagtcccgacgcaacctcgaacttccccggctctcagagacctcgatcaaagacagaatggcaaagtatcaagcggctgtgtctaaacagtccagtagcactaactatacaaatgagctcaaagcttctggaggagagatcaagattcataagatggagcagaaagagaatgtcccccccggacctgaagtgtgtataactcaccaggaaggtgaaaaaatcagtgccaacgagaacagcctggcagtgagaagtacacctgccgaggatgatagccgcgattctcaggtgaagtcggaggtgcagcagccagtgcacccaaagccgctcagcccggactctcgagccagttcgctgtctgaatcatcaccccccaaggccatgaagaaatttcaggcccctgctcgcgagacttgcgttgagtgccagaagacagtgtaccctatggagcgattactagccaatcagcaggtctttcacattagttgctttcgctgtagctattgtaacaacaagctgtccttgggaacctacgcgagcctccatggtcgcatatactgtaaaccccattttaatcaactgtttaagtctaagggtaattacgatgagggatttggtcaccgcccacacaaggatctttgggcctcaaagaacgagaacgaggagattctggaacgccccgcccaattggccaacgcccgggagactccacattcaccaggtgtagaggacgctcctattgccaaggtgggagtgctagctgcaagtatggaggccaaggcctctagccagcaggagaaggaggacaaacctgccgagacaaaaaaactgcgtatcgcttggccgcctcccaccgaactgggctcctccgggtccgctctggaggagggtatcaaaatgagtaagccgaaatggcctcctgaagacgagattagcaagccggaagttcctgaagacgtcgaccttgacctaaaaaagctgagaagaagcagttctttaaaagagagatcacgcccgtttacagttgcggcatccttccagagcacctccgtcaaatcccctaagaccgtctctccccccatccgcaaggggtggagtatgagcgaacaaagtgaggaatcagtgggtggacgcgtcgcagaaagaaagcaggtggaaaatgcaaaggcaagcaaaaaaaatggcaacgttggaaaaacaacttggcagaacaaggagtctaaaggcgagaccggtaaacgttcaaaggaaggacactctctggagatggagaatgagaatctggtcgaaaacggcgccgactcggatgaagatgacaactcgttcctgaagcagcagtcaccccaggagcccaagtcacttaattggagctccttcgttgacaatacatttgcagaagaattcacgacacagaatcagaaatctcaggacgtcgagctgtgggagggagaagtggtgaaagagctgtccgtagaagagcagattaaacggaataggtattatgatgaagatgaggacgaagagtag

SEQ ID NO: 122506 - DNA, 1128 bp, Artificial Sequence
  Description of Artificial Sequence: Synthetic coding sequence
atgctggacagggacgtaggtcccacacctatgtacccccccacttacctggagcctggaattggtaggcatactccgtatggaaatcaaaccgactataggatatttgagctcaacaaaaggctccaaaactggaccgaagagtgtgataacctctggtgggacgcatttacaacagaatttttcgaggacgacgcaatgcttacaatcacattctgcctcgaagacggcccgaagcgttacaccatagggcgcacgctgataccccgatattttagatcaatttttgagggaggggcgaccgagttatactacgtactgaagcaccccaaggaagcgttccattctaactttgtgtctctggactgtgatcagggcagtatggtgacccagcacgggaagccaatgtttacgcaggtgtgtgtagaaggcaggctgtatttagagtttatgtttgacgacatgatgagaatcaagacttggcacttcagcatcagacagcatcgcgaactcatccctcggtctatactcgcaatgcatgcccaggatccccagatgctcgatcaactctcaaagaacatcactagatgcggccttagcaacagcaccctcaattatctcagactgtgtgtgattctggaacctatgcaggagctgatgtctagacacaagacgtactcgctctccccaagggactgcctcaaaacctgtctgtttcagaagtggcagagaatggtagcccctcccgcagagcctacacgacagcagccttcaaaacgccggaaacgaaagatgagcggaggctcaaccatgtcctcgggtggcggcaatacaaataattctaattctaaaaagaagtcccccgcgtcaacattcgccctctcgtcacaggtccccgatgtgatggtggtaggagaaccgactctgatgggcggggaattcggagatgaggatgaaaggttaattactaggctggagaacacccagtttgatgctgccaacggaattgacgatgaggactcattcaacaattccccagccttgggcgcaaacagcccgtggaactccaaaccacctagtagccaagaaagcaaatcagagaatccgactagccaggcttcccaatag

SEQ ID NO: 122507 - DNA, 1236 bp, Artificial Sequence
  Description of Artificial Sequence: Synthetic coding sequence
atgtccgtgggctgcgcctgtcccgggtgtagctctaagtctttcaaactgtattcccccaaggaacctcctaacgggaacgcctttcctccattccaccccggtacaatgcttgatagggacgtcgggccgacccctatgtaccccccaacctatctcgaacctgggattggaaggcatacaccttacggcaaccaaacagactataggatcttcgagctgaataagcgcctgcagaactggacagaagaatgcgacaatttgtggtgggacgcttttacaacggaattttttgaagacgatgcaatgctcacaataacattctgtctcgaggatggccccaagcgatataccattggccggaccctgattcccaggtactttagaagcatcttcgagggcggagccacagaactttattacgtgctaaaacacccaaaagaggctttccacagtaacttcgtaagcctggactgcgaccagggaagcatggtcacacagcacggcaaaccaatgttcactcaagtgtgcgtggaggggaggctgtacctggagtttatgttcgacgacatgatgcgcatcaaaacttggcactttagcattagacaacatcgggaactgattccgaggagcattttagcaatgcacgctcaagacccacaaatgcttgatcaacttagtaaaaacatcaccaggtgcggcttgtccaactctacgctgaactacttgaggttgtgcgttattctcgaacctatgcaggagctgatgagcaggcacaagacctattccttatccccacgagactgtctgaaaacgtgcctgttccagaaatggcagagaatggtggccccccccgctgagccgacaagacaacaacccagcaaacgtcgcaagcgaaaaatgagcggtggtagcacaatgtccagcggcgggggcaatactaacaatagtaactccaagaagaaatctcccgcttcgacattcgccctttcatcccaggtgcccgatgtgatggtcgttggcgaaccgacgttgatgggcggggagttcggcgatgaagacgagaggctgatcacaagattggagaacacacagttcgacgccgccaatggcattgacgacgaagatagcttcaataactccccagcgctgggggcaaactctccctggaatagcaaaccgccgtcttctcaggagtctaagtccgaaaacccaacgtcacaggctagccaatag

SEQ ID NO: 122508 - DNA, 1122 bp, Artificial Sequence
  Description of Artificial Sequence: Synthetic coding sequence
atgtccagcactccccacgatccattctactcttctcccttcggccccttctatcgtcgccacacaccttacatggtgcagccagaatatcggatctatgagatgaataaaaggctgcagtctcgcacagaggacagtgataacctgtggtgggacgcctttgctacagagttttttgaggatgacgctacactgacactgtcattctgtctcgaggacggccccaagaggtacactatagggcgaaccctcatcccccgttacttttcgaccgtgttcgaaggtggagtgactgacctgtattacattttgaagcatagcaaggagtcatatcacaacagttcgatcactgtggattgtgaccagtgcacaatggtgactcagcacgggaagcccatgttcacaaaagtttgtactgaggggcggctgatcctggaatttacctttgacgacttaatgcggatcaaaacctggcattttactatccgccaatatagggagctggtccctcggagcattctagcaatgcacgctcaggatccacaggtcctagatcagttaagcaagaatatcactagaatgggattaactaatttcaccctcaattatctgagactttgcgtcatcctggaaccaatgcaggaacttatgagcagacacaagacatataacctgtcaccacgcgactgtctgaaaacatgccttttccaaaaatggcagcgcatggtcgctcctcccgccgagccaacccgccagcctactacaaaaaggagaaagcggaaaaactcaacctctagcacgtcaaatagcagcgctggtaataacgccaactccaccggctcaaagaaaaagaccactgcagccaacctaagcctgtcctcccaggtgccggatgtgatggtggtcggagagcctacgctgatgggtggggagtttggagacgaggacgaaagattgattacgcggcttgagaacacgcaatacgatgctgcaaatggaatggatgatgaagaggatttcaataattcaccggctctcgggaataattcaccttggaacagcaagcccccagccacccaagaaaccaagagcgagaacccaccacctcaggcgagccagtag

SEQ ID NO: 122509 - DNA, 996 bp, Artificial Sequence
  Description of Artificial Sequence: Synthetic coding sequence
atgtccagtacgccccacgaccctttctattcttctcctttcggacctttttaccggagacacaccccctacatggtccagcccgagtacaggatctatgaaatgaacaagcgcctgcaaagtagaaccgaggatagtgataatctttggtgggacgcatttgcgactgagtttttcgaagatgatgccactctcacactgagtttttgcctggaagatggcccaaaacgttacacgataggacgaaccctgattcctcggtactttagtaccgtgttcgagggtggtgtaaccgatttatactacatccttaagcattccaaagagagctaccataattcctccatcaccgtggattgcgaccagtgtactatggtcacacagcacggtaaaccaatgtttaccaaggtatgcacagaggggcgcctaatcttagagtttacattcgatgatctgatgaggataaagacatggcacttcacaatccggcagtatcgggagctggtcccccgttcaatactggctatgcacgctcaagatccccaggttctggatcagctctcaaagaacatcacacgcatgggactcaccaactttacattgaattacctgagattgtgtgtgattctggaacccatgcaagagcttatgagccgacataaaacttacaatctcagtccgcgcgattgtctgaagacatgtttattccagaagtggcagagaatggtggccccacctgccgaaccgacacgccagcctacaacaaagcgccgcaaaagaaagaactcaaccagttcgacttctaacagctccgccggcaacaatgccaactccactggctctaaaaaaaagactaccgccgctaatctgtcgctgtctagccaggtacccggtctcggcgccatcccgaactgttccctgaacccaggtcgcgatggggacctctgtcacagcacagcagtgaccccatccgggcaatttaaggagaaacactag

SEQ ID NO: 122510 - DNA, 942 bp, Artificial Sequence
  Description of Artificial Sequence: Synthetic coding sequence
atgagttctaccccacacgacccattctattcttcccctttcggccctttttatcgacgacacacgccatatatggtacaaccagagtatcgcatttatgaaatgaataaacgattacagagcagaactgaggactccgataatctctggtgggatgcgttcgcaactgagttttttgaagacgacgccaccctcactctgtctttctgtcttgaggatggacccaaaagatacactatcggtcggacgctaatccccaggtatttcagtactgtctttgaaggcggcgttaccgatctgtactacattcttaaacacagtaaagagagctatcataattcctccataacagtagattgtgatcaatgtaccatggtcacacaacatggcaaaccaatgttcacaaaagtctgcaccgagggcaggctgatcctggagtttacattcgacgacctgatgcgaataaagacttggcatttcactatccggcagtatagagaattagtccctcgcagcatcttggctatgcatgctcaggaccctcaggtgctcgaccagctgtcgaaaaatatcaccaggatgggcctgacaaatttcaccctgaattacctccgattatgcgtgattctggagcccatgcaggaactcatgtctagacacaagacctacaacttgagtccgcgagattgtttgaaaacttgtctgttccaaaaatggcagcgtatggtcgcaccccccgccgaacctaccaggcagccgacaacgaaaagaagaaagcgaaagaactctacttccagtacctctaacagctcagcaggcaacaatgcaaatagtacaggcagcaaaaaaaagaccaccgcagccaacctgagcctgtctagccaagtgccaatcgcaagcattgcccggagccccgtgtcgggatgtgctctccgaacttag

SEQ ID NO: 122511 - DNA, 570 bp, Artificial Sequence
  Description of Artificial Sequence: Synthetic coding sequence
atggtcacccagcatggaaaacctatgttcactaaagtttgtacggagggccgcctgatccttgagttcactttcgacgacctaatgcgtatcaagacttggcacttcacaattcgtcaatatagagagttggttcctaggtccatcctcgccatgcacgcccaggacccacaggtactggaccagttaagtaaaaatataactcgcatgggcctcacaaacttcaccctgaactatctgcgactgtgcgtgattctggagccaatgcaggagttgatgagcagacacaaaacatacaatctttcacctcgagactgtctgaagacatgcttattccaaaagtggcaaagaatggtggccccacccgcagagccaactcggcagccaaccaccaagcggcggaaacgcaaaaattccacctcctctacttccaatagctcggccggcaataacgcaaattccaccggcagtaaaaaaaagaccacggccgccaacctgagtctttcgtcccaggtgccaatcgcctctatcgctcgctctccagtctccggctgtgctctcaggacttag

SEQ ID NO: 122512 - DNA, 495 bp, Artificial Sequence
  Description of Artificial Sequence: Synthetic coding sequence
atggtgcagcccgagtatagaatatatgaaatgaataagcggctccaatcacgaaccgaagacagtgacaacctctggtgggacgctttcgcaactgaattcttcgaagatgacgctaccttaactttatctttttgcctggaggacggaccgaagcgatatacgattggtagaacactgatcccccgctacttttccaccgtgttcgaaggcggagttaccgatctgtattatatactgaaacactccaaagaatcataccataactctagcattacagtggactgcgatcagtgcacaatggttacacaacacgggaagcctatgtttacgaaggtttgtaccgagggacgactgatcctggagtttacgtttgatgatctgatgagaattaagacgtggcatttcaccatcagacaataccgcgagttggtccctagatcaatcctggccatgcatgctcaggacccccaagtactcgatcagctatcctag

SEQ ID NO: 122513 - DNA, 333 bp, Artificial Sequence
  Description of Artificial Sequence: Synthetic coding sequence
atgtcatccacacctcatgaccccttctattccagtccattcggccccttttacagacgacacacaccttacatggtacagccggaataccgcatttacgagatgaacaaacgactccagtccagaacggaggactccgacaacttatggtgggacgcctttgccaccgagttttttgaggacgacgcaaccctcaccctttccttctgtttggaagatggcccgaagcgatacatagtccacagcgccgctgatgcacgggggaactgcaaccagctgggggactccgaaccggacgcctgcgatggcttgctccagttccctatcatgtag

SEQ ID NO: 122514 - DNA, 321 bp, Artificial Sequence
  Description of Artificial Sequence: Synthetic coding sequence
atgtcctctacccctcacgatccattttattcgtctccgtttggaccattctatcggcgccataccccatacatggtgcagcctgaatacagaatttatgaaatgaataagagactgcaaagtcggacagaagattccgacaacttatggtgggacgcatttgcgactgagttttttgaggacgacgccacacttaccctgtctttttgtctcgaagacggtcctaagcgctaccgcaccaaaaatctgcgacccatcggcgaaaagatgaatattaatggcaagtgctaccgtcaggacccacatccccccctcctgtag

SEQ ID NO: 122515 - DNA, 1116 bp, Artificial Sequence
  Description of Artificial Sequence: Synthetic coding sequence
atgtcctcaacacctcatgaccccttctactcttccccctttgggcccttttaccggcgacatacgccttacatggtacaacccgaataccggatatacgagatgaacaagaggctgcaatcacggacggaagattccgacaacctctggtgggacgccttcgccactgagttttttgaggatgacgctaccctgacattgtccttctgtctggaggacggcccaaaacgatacactatcgggaggacactgattccacgctatttcagcaccgttttcgaagggggagtgaccgatctgtattacatactgaagcatagcaaggaaagctatcataattcttcaatcacagtggactgtgaccagtgcaccatggttacccaacacggcaagcccatgtttacgaaagtgtgcactgagggaaggctcatcttggagtttacgttcgatgacctgatgcgaataaaaacctggcacttcaccatccgacaatatcgggagctggtgccccggtctatcctggctatgcatgctcaggatccccaggtcctggatcagctaagcaaaaacatcactaggatggggctcactaatttcactctgaattacctgcggctctgcgtgatcttggagcccatgcaggagttgatgtctagacacaaaacctacaacctgtctcccagagactgccttaagacatgtctgttccaaaagtggcagaggatggtggctccaccggccgaacccaccaggcagcccaccacaaaaaggaggaagcgcaagaactccacatcatccaccagtaatagttcagcaggtaacaacgctaactctactggtagcaagaagaaaactactgccgctaacctttccctgagctcacaggatgtaatggtcgtgggggaacctacactgatgggaggtgaattcggggacgaagatgagaggctgattacaagactggaaaatacgcaatacgatgctgcaaatggaatggacgatgaagaggattttaacaactccccagctctcgggaacaacagtccatggaattccaagccccctgctactcaagagaccaagagtgaaaatccgcccccccaggcctcacagtag

SEQ ID NO: 122516 - DNA, 1854 bp, Artificial Sequence
  Description of Artificial Sequence: Synthetic coding sequence
atgtcttattccgtgactctcaccggcccgggcccttgggggttccggctccagggcggaaaggatttcaatatgcccctcaccatctcccggataacgcccggttcaaaggcagcccaatcacagctgtcacaaggtgacctcgtggtcgctatagacggggttaacacagatacaatgacccatcttgaagcgcaaaataagataaagagtgcctcctacaatctctccctcactctccagaagtctaagagacccatacccatcagcaccactgccccgcctgttcagactccacttcccgtaataccccatcagaaggttgtggtgaacagccccgccaacgcagattaccaggagaggtttaacccatccgctctaaaagatagtgccctgagcacgcacaaacctattgaggtgaaagggctggggggcaaagccaccataatccacgcccaatacaacacccccatttcaatgtacagccaggatgccattatggatgctattgccggtcaggcacaggcgcagggcagcgacttctccgggagtctgcccataaaggatttagcagttgactctgctagccccgtgtaccaggccgtgattaagagccagaacaagcccgaggacgaggccgatgagtgggcgcgaaggagttctaatctccagtcacggagtttccgaattctggctcagatgacaggcaccgaattcatgcaggaccccgacgaggaggccttaaggagatcaaggcctcaggcctccagttacagccctgctgtcgcagcatccagtgcacctgcgactcacacatcatatagtgaggggcccgcagctccagcaccaaagccaagagtggtgactactgccagcattcggccttcagtctatcaacccgtgccagcgagcacttattcgcccagcccaggcgccaactattccccaacaccttatacccccagtcctgctcccgcttacacacccagccctgctccagcctatacaccgtctcctgtgcccacgtacacgcccagcccagctccggcttacacgccttctcctgctcctaactacaatccagctcctagtgtagcctacagcggaggacccgcagagcccgcatctcgaccaccctgggtgacagacgacagcttctcccaaaagttcgctccggggaaaagcaccacgagcatatccaaacaaacactacctcgagggggcccagcttacaccccggctgggcctcaggtgccaccgctggcaagaggtacggtgcagcgggccgagcgcttcccagccagtagcagaacccccctgtgtggacactgcaacaatgtaattaggggtccgttcctggttgcaatgggtagatcctggcaccccgaagaattcacgtgtgcctactgcaaaacttctctcgcggatgtgtgcttcgtcgaagagcagaacaacgtgtactgcgagcgatgctatgaacaatttttcgccccactctgtgcaaaatgtaacaccaagatcatgggtgaagttatgcacgctctcaggcagacctggcatactacatgcttcgtgtgcgccgcatgcaaaaagccatttggtaacagcttattccatatggaagacggcgagccctattgtgaaaaggactacatcaaccttttttctacgaagtgccacggttgcgattttccggtagaagcgggagataaatttattgaagccttaggccatacgtggcacgatacgtgctttatctgcgccgtgtgccatgttaacctggaaggtcagcctttttattctaagaaagacagacctctgtgtaagaagcatgcccacaccatcaacctttag

SEQ ID NO: 122517 - DNA, 993 bp, Artificial Sequence
  Description of Artificial Sequence: Synthetic coding sequence
atgagctattctgtcacccttacaggtccaggcccatgggggtttcgtcttcagggaggcaaagactttaacatgcctttaactatttctagaatcaccccggggagcaaagctgcccagagtcagctgtcacagggggacctggtagttgcaatagatggggtgaacaccgacactatgacccaccttgaggcccaaaataagatcaaaagtgccagctacaacttgagcttgacactgcagaaaagcaagagacccatccccatctccacaactgctccccccgttcagacccccttgcccgtcattccgcatcaaaaggacccggccctggataccaacggcagcctggttgccccctcaccgagtccagaggcaagagcttctcctggcacccccggaacccccgaactcagaccaacatttagtcccgccttctcacgccctagtgccttttcctcccttgccgaggcctccgacccaggtcctccgcgggctagtctacgggctaaaacctccccagaaggagctagagacttactgggtcctaaggctctccccggctccagtcagcccaggcaatataacaatcctatcgggctttacagcgccgaaacgctccgggaaatggcccagatgtatcagatgtctctcagaggaaaggcgtccggcgtggggctgcccggtggaagtctcccaatcaaggatctggccgtggattcggctagtcccgtctaccaagcggtcattaaaagtcaaaataaaccggaggacgaggctgatgagtgggcccgccggtcttctaatctgcagagcaggtcatttagaatcttagcccagatgactggcaccgaattcatgcaggaccccgacgaggaagccctgcgtcggtctcgcgagagatttgaaaccgagagaaattctccacggttcgccaagctgcgcaactggcaccatggcctgagtgctcaaatcctcaatgtgaagtcatag

SEQ ID NO: 122518 - DNA, 1413 bp, Artificial Sequence
  Description of Artificial Sequence: Synthetic coding sequence
atgtcctacagcgttaccctgaccggtcccggtccgtggggtttcaggctacaaggaggcaaggactttaatatgccattgactatctcaaggatcacgccaggatcaaaggctgctcagtcacagttgagccaaggtgacctcgtcgttgcaatcgacggagtgaacacagatacgatgacacacctcgaggctcagaacaagattaaatcagctagctataacctttccttgaccctgcagaaatctaaaaggccaatccccatcagtaccaccgcgccccccgtgcaaacacccctccccgtcattccacaccagaaggcttcatcatactcaccagccgttgccgctagttctgctcctgcgacccataccagttactccgaaggccccgcggctccagcccccaagccgcgtgtggtgacaactgccagtatccgtcccagcgtttaccagcccgtccctgcctcaacttacagccccagcccaggagccaactacagccctacaccctatacaccctctccagcccccgcttatactccctcccccgctccagcctatacaccctccccggtcccaacatacacacccagtcctgccccagcgtataccccaagccccgctcccaattacaatcccgctccatccgtagcctacagcggaggtcccgccgaaccagcatcacgcccgccatgggtgactgacgattccttttctcagaagttcgcgcccgggaagagcaccaccagcatatccaaacagaccctgcctcggggggggcccgcatatactccagccggcccccaggtgccgcctcttgctcgggggaccgtgcagcgagctgaaaggttcccagccagttctaggactccactgtgcggtcattgcaacaacgtcatcagggggccctttctcgtagcaatggggaggagctggcatcctgaagagttcacatgtgcatactgcaaaacatcactggcggacgtgtgcttcgtagaagagcagaacaatgtttattgcgaaagatgttacgaacagttctttgcaccactgtgcgccaagtgtaatacaaagattatgggagaggtcatgcatgcgctgcggcagacgtggcatacgacttgtttcgtctgcgccgcttgcaagaagccttttggaaattcgctctttcacatggaagatggagaaccctattgcgagaaggactatattaatctgttcagcaccaaatgccatggctgtgacttccccgtagaagctggtgacaaattcatcgaagcgctggggcacacctggcacgatacctgcttcatctgtgctgtctgtcatgtgaacctggagggacagcctttctatagtaaaaaggacagaccactgtgcaaaaaacatgcgcatacgattaatttgtag

SEQ ID NO: 122519 - DNA, 2184 bp, Artificial Sequence
  Description of Artificial Sequence: Synthetic coding sequence
atgtcctattccgtcactctgacaggacccggaccttggggattccggttgcagggaggaaaagatttcaacatgcccctaactatttcccgcattaccccaggaagcaaagccgctcaatcccaactgtcccagggtgatttagtggtcgccatcgatggtgtgaacactgatactatgacacacctcgaggcccaaaacaagataaagtcagcctcctataatctatcactgactttgcagaagagcaaaagaccaattcccattagtacaactgctcccccagttcagacgcccttacccgttatcccacaccaaaaggatccagccttggacacaaacggcagccttgtcgccccatcaccatctccggaggccagggcttcacctggaacccccggtacccccgagctgagaccgacctttagtccagctttctcaagaccaagcgcgttctccagcctcgccgaggcctcggacccaggccccccacgggccagtctgcgcgcaaagaccagtcctgagggtgcccgtgatttgctagggccaaaagcgctgcccgggtcgtcccagccccgtcagtacaataatcccatcggactctattccgccgaaacgctgcgcgaaatggctcagatgtaccagatgtccttacgaggcaaggcatctggcgttggccttccaggcggcagcctgcctattaaggacctggctgttgatagcgcctcccctgtttaccaagcagtcataaagtctcagaacaaacccgaagatgaagccgacgagtgggctcggcgaagctccaatctgcaaagccgatcatttcggattctggcccaaatgactggaacggagtttatgcaggacccagacgaggaagctttgcggaggagctccacaccaattgaacatgccccagtctgcaccagccaggctacaacccctttgttaccagcaagtgctcagccccccgccgctgcaagtcccagtgctgcaagccctcccttagcaacagctgccgcccacacagcgattgctagcgcctccacgaccgccccggctagcagcccagctgacagccctaggccacaggccagtagttactctcccgcagtggctgcctctagtgcacccgcaacccatacaagttattccgagggcccagccgccccggctccaaagcctagggtggtaaccactgcttctattagaccctcagtctaccagcctgtgcccgcctccacatattcaccctcacccggggccaactatagcccaactccatatactccaagtcccgctcccgcttacaccccttcccctgcccccgcttacacaccatcgcctgttcctacctacactccttctccagcacccgcctacactccatctcccgctcctaattataatcctgctccctctgtggcgtacagcggcggtcccgccgaacctgcatcgcgccccccctgggtgactgatgattcctttagtcagaagtttgcgcccggcaaatccaccacaagtatctccaagcagactttaccacgggggggcccagcgtatactcccgcaggcccacaggtcccccccctggcccgcggaaccgttcaacgcgctgagagattccctgcctccagccggacgcctctgtgtggccattgtaacaacgtgattagaggcccattcctggttgccatgggcaggtcctggcatcccgaggagttcacatgcgcctactgcaaaacaagcctggcggatgtgtgctttgttgaggagcagaataatgtatattgtgagcggtgttacgaacaattcttcgcacccctgtgcgcgaagtgtaacaccaagataatgggggaggttatgcacgccctgcgccagacctggcatactacctgttttgtctgcgctgcatgtaaaaaaccgtttggtaactctctctttcatatggaagacggggagccatactgcgagaaggactatataaatttgttttccacaaagtgccacggctgcgatttccctgtggaagcaggcgacaagtttatcgaagcccttggccatacttggcatgacacatgctttatttgcgcggtctgccatgtgaatctcgagggacagcctttttactcaaaaaaggatcgcccactgtgtaagaagcatgcacacactattaacttatag

SEQ ID NO: 122520 - DNA, 1197 bp, Artificial Sequence
  Description of Artificial Sequence: Synthetic coding sequence
atgtcatactctgtgacattgacaggacccggaccttggggattccgtctccaaggagggaaagactttaatatgcccctcacaatctcccggatcaccccagggtctaaagccgcccagagccaactatcacaaggcgatttagtggtcgctatagacggtgtgaacacagacacaatgacccacttagaggcccagaataagatcaagtcagctagctataacttgtctctgacccttcagaaaagtaagaggccaatccccatcagtaccactgcaccacccgtccaaactccactcccagtgatcccccaccagaaagatcccgccctggataccaatggtagtttagtggctccgtcgccgagccctgaagcccgagcaagcccaggtacgcccggcactccagagctgaggccaacctttagtcccgcgttctcccggccaagcgcattctccagccttgcagaggcctctgacccaggccctccacgggcaagcctcagagctaagacatcgcccgaaggagcgagggatctgttgggaccaaaggctcttcctggctcgtctcaaccacggcagtacaataaccctatcgggctgtacagtgctgaaacgctgagagagatggcacagatgtatcagatgagtctccgcggcaaagcctccggggtaggccttcctggcggtgctgattaccaggaacgttttaatccttcagccttgaaagactccgccctgtcaacacataagccaatcgaagtgaagggcttagggggcaaggctactattatccatgctcagtataatacaccaataagcatgtattcccaggatgcaatcatggacgccatagcagggcaggctcaggcgcaggggtcagactttagcggtagtcttcccatcaaggacctcgctgtggacagtgcatctccggtttaccaggcagtgatcaagagccagaacaaaccagaggacgaagctgatgagtgggcacggaggagctccaacttgcaatctcggagctttaggatccttgcacagatgaccgggaccgaattcatgcaggatcccgacgaggaggccctgcgacgcagtcgcgagaggtttgaaactgagcgcaacagtccgcgattcgccaaattacgcaactggcaccatggactgagcgctcagattctcaatgttaagtcctag

SEQ ID NO: 122521 - DNA, 852 bp, Artificial Sequence
  Description of Artificial Sequence: Synthetic coding sequence
atgtcctatagcgtcacactcaccggccccgggccctggggctttcggctgcagggtggtaaagatttcaatatgccactcacaatttcaaggatcacccctggcagcaaagccgcacagtctcagctctcccaaggagaccttgtggttgcaattgatggggtgaacactgatacaatgacccacctcgaggctcagaataagatcaagagcgccagctacaatctcagcctgaccctgcaaaagtctaagagacctataccaatctccaccacggccccccctgtccaaacaccgcttcccgtcattcctcatcaaaaggtagtcgtcaactcccccgccaatgcagattatcaagagcgctttaatccttctgcactcaaagattcggctttgagcacacataagcccattgaggttaaaggactcgggggcaaggcaaccatcatccacgcccagtataacaccccgattagcatgtattcccaggatgctatcatggacgccatagccgggcaggcccaggcccaagggtctgattttagtggcagcctaccaatcaaggacctggctgtggattcagcctctccggtctaccaagctgtcatcaaaagtcaaaataagcccgaagacgaagcagacgagtgggcccggagatcttctaatctgcagtctagaagttttaggattttagcccagatgacaggaacggaattcatgcaggatccagacgaagaagcactacggcgaagtcgtgagcgtttcgaaactgagaggaattcgccccgatttgccaaactgcgaaactggcaccatggcctgtcagcccagattctcaatgtcaagtcctag

SEQ ID NO: 122522 - DNA, 2199 bp, Artificial Sequence
  Description of Artificial Sequence: Synthetic coding sequence
atgtcttacagtgtcacactgacaggccctggcccatggggttttaggctgcagggaggcaaggatttcaacatgcccctcacaatctcacgcatcaccccggggagcaaggcggctcagagccaactcagtcaaggcgacttggtggtggcaatcgatggggtaaataccgacactatgacacacctagaggctcagaacaaaattaaaagtgcttcatacaacttgtccctgacattgcagaagagtaaacgccctattccgattagtaccactgcccccccggtgcagacccctttacctgtcattccgcaccagaaggaccccgccctggacacgaatggttctctggtggcaccatcaccgtctccagaggcacgggcgagcccagggacgccaggaacacctgagctgcgacccactttctcaccagcttttagtcgccctagtgccttctcttccctagccgaagcttcggatccaggtcccccaagagcaagtctgagggcaaagactagcccagagggggcccgcgaccttctgggccctaaagccttacccggcagtagtcagccaagacagtacaataaccccataggcctgtactcagccgagactttgcgcgagatggctcagatgtaccagatgagcctgagaggaaaggcctccggtgtaggcctacctggaggcgcagattaccaggaacgatttaacccgtcagcactcaaagattccgctctgtcaacacacaagccaatcgaggtgaaagggctaggaggaaaagctacaatcatccacgctcagtataataccccaatctccatgtacagtcaggatgctatcatggatgccatcgcgggccaggcccaagcacagggttcggacttttccggatcgctgccgataaaggacctcgccgtagacagcgctagtcctgtgtatcaggcggtgatcaagagccagaacaagcccgaagacgaagctgatgagtgggccaggaggtcttccaacctgcagtcacgctccttccggattcttgcacagatgaccggaacggagttcatgcaagatccagacgaagaggcacttcgcaggtcccgaccccaagcctctagctactcaccagcggtcgccgcttcgtctgctcctgcaacacataccagctatagcgagggacccgccgccccagctcccaaaccccgggtggttaccaccgcgagcattcgcccttccgtttaccaacccgtgcccgcatctacctacagccccagccctggtgctaattacagccctactccttatacgccctcacccgcccctgcttacaccccatctcctgcacccgcctacaccccctcacctgtgcccacatatacacccagtccggcccccgcttacactcccagccctgcgcccaactataatcctgctcctagtgtcgcttactctggcggacctgccgaacctgccagtcgaccgccttgggtcactgacgacagcttcagtcagaagtttgcacccggaaagtccaccaccagcattagtaagcaaactctgccgcggggtgggccggcttataccccagctggtccccaagttcccccccttgcccggggcacagtgcagcgggcagaaagatttcctgcttccagtaggaccccactctgcggccactgtaacaacgtgattcgggggccgttcctagtggccatgggtagaagctggcaccccgaggagttcacctgtgcgtactgtaagaccagtctggccgatgtatgcttcgtagaagagcagaacaatgtttactgtgaaagatgttatgaacagttctttgcgcccctgtgtgctaagtgcaatactaagattatgggagaagttatgcacgctctccggcagacttggcatacaacatgctttgtatgtgccgcttgcaagaaaccttttggaaactctctcttccacatggaagatggcgagccctattgcgaaaaagactatatcaacctcttctcaactaaatgtcatggctgtgacttccctgtcgaagcaggagataagtttatagaggcattgggccacacctggcatgacacctgcttcatctgtgccgtatgtcacgtgaatttagaaggtcagccattttattctaaaaaagataggccactgtgcaagaagcatgcgcatactatcaatctttag

SEQ ID NO: 122523 - DNA, 1854 bp, Artificial Sequence
  Description of Artificial Sequence: Synthetic coding sequence
atgagctattcagtgacgctgaccggtcctggaccctggggcttccgcttgcagggtggaaaggacttcaatatgcctttaaccatctctagaatcacaccaggtagcaaggccgcccagagtcagcttagtcagggggacctggtcgtggctatcgacggcgtgaataccgatactatgactcatctggaggctcagaacaagatcaagtcagcttcctacaaccttagtttgactctgcagaaatccaaacggcccatacccatctccaccaccgcaccacctgtgcagacaccgctgcctgttattcctcatcagaaggtggtggttaactccccagctaacgccgattaccaggagcgtttcaacccctctgccctgaaggactctgctctttcgacacataaacccatagaggtcaaaggcctcggagggaaagcaaccatcattcacgcccagtacaatactccaatcagtatgtactcccaggatgccataatggacgctattgctgggcaagcccaggcacaagggtctgactttagcggctccctccctattaaggatcttgcggttgatagtgcctctcctgtctatcaagcagtcattaagtctcagaacaagccagaagacgaggccgacgaatgggcccgacgatcttccaatctgcaatcgagatccttcaggattctggctcagatgactgggacagaattcatgcaggaccctgacgaggaggcattgcggaggtcacggccccaagcgtctagctactccccagcagtggctgccagcagtgcccccgctacacacacatcttactccgagggacccgcggccccagcaccaaaaccaagggtggtcacaactgcgagcattaggccttcagtgtatcagcccgtgcccgcctccacatatagtccctcacctggcgctaactacagccccaccccctacaccccctccccagccccagcatataccccaagtcccgcccctgcctataccccctcgcctgtcccgacctacaccccatctccggctcctgcttacacaccttcgcctgcgcctaactacaacccagctccatctgtggcatactcgggcgggccggcggaaccagccagtagacctccctgggtgaccgacgatagtttctctcagaagtttgcccccggtaaaagcacgacatcaattagtaagcaaactctgccacgaggaggacctgcatatacacccgcaggcccacaggtccccccactcgcccgcggtactgtgcagcgtgcagaacgattccctgcttcttctagaactcccctgtgtggtcactgtaataacgtgattcgggggcctttcctggtggcaatgggccgctcatggcacccggaagaatttacttgcgcctactgcaaaacttccttagctgacgtttgcttcgttgaagagcagaacaacgtgtactgcgaacggtgctatgagcaattcttcgccccactctgcgctaaatgcaataccaagataatgggagaggtcatgcatgccctgaggcaaacgtggcacaccacatgcttcgtgtgcgccgcatgcaaaaaacctttcggcaatagtctatttcacatggaagacggggaaccctactgcgagaaggattatatcaatctgttctccaccaagtgccacggatgtgacttccctgttgaggcaggagataaatttattgaggccttggggcatacatggcatgacacctgcttcatctgtgctgtgtgccatgtgaatctcgagggccagcccttttactccaagaaggataggccgctgtgcaagaaacacgcccacacaatcaatctatag

SEQ ID NO: 122524 - DNA, 1947 bp, Artificial Sequence
  Description of Artificial Sequence: Synthetic coding sequence
atgtcctacagcgttaccctcaccgggcctggcccctggggattcagacttcagggtgggaaagattttaacatgcccttgactatatcaagaatcacacccggcagcaaagccgctcagagtcagctgtcccagggcgatctggtcgtggctatagacggggtgaacactgacacgatgactcatcttgaggcccagaataaaattaaaagtgcctcttataacctttcattgaccttgcagaagagcaaaagaccaatccccattagtaccaccgcccctcctgtccagactcccttaccagtgattccacaccagaaggaccccgcactcgatacaaatggatctctggtcgcccccagtccaagccctgaagcccgagcctccccagggacacccggcactccggaactacgccccaccttctccccagccttctcccgcccaagcgctttctccagtcttgctgaggcttccgaccctggtcctccacgggctagtctgagagccaagactagcccagaaggagcacgagacctgcttggtcccaaggctctgcccggttcaagtcaacctaggcagtacaacaaccccatcggactatatagcgcagagacactgcgtgagatggcccagatgtaccagatgtccctcagaggcaaggcctctggagtgggtttgccggggggatcgttacccattaaggatcttgccgtggattccgcgagtccagtctaccaggccgtgattaagagtcagaataagcctgaggacgaagccgacgagtgggctagaaggtcaagcaatttgcagtcaagatctttcagaattttggcccaaatgactggtaccgagtttatgcaggatccggacgaagaagctcttagacggtcaagaccacaagcctcctcttattctcccgctgtagctgcctcatctgcgcccgccactcacacgtcttactctgaggggccagccgcacccgcccccaagccacgcgtcgtgaccacagctagcattcgtcccagcgtttatcaacccgtacccgctagcacttacagtcctagcccaggtgcaaattattcaccaaccccatatactccgagccctgtccccacttacaccccttctccggccccggcgtatactccctctccagcacctaattataaccctgcaccttcagtggcctacagcggtggccccgctgaacccgctagtcgccctccctgggtgaccgatgactcgttttctcagaagttcgctccggggaagagcacaacctcgatatctaaacagacgcttcctaggggcgggcctgcctacacgcccgccggtccgcaggtcccgcctcttgctcgcggtaccgtccaaagggccgagcgctttcccgcctcatcccggacgccactgtgcggccactgtaacaacgtcatcaggggaccgtttctggtcgcaatgggcagatcctggcacccagaggagtttacctgtgcgtactgcaagactagtcttgcggacgtctgcttcgtcgaagaacagaataatgtgtattgtgagcgttgttacgagcagttctttgctcccctatgcgccaagtgtaacacaaagatcatgggagaggtgatgcatgcactgcggcagacttggcatacaacttgtttcgtgtgtgcagcttgtaagaagcctttcggcaactcactgttccacatggaggacggggaaccttattgcgagaaggactatatcaaccttttttccactaaatgccacggctgtgactttccagtcgaggccggggacaaatttattgaggccctcggtcatacttggcatgacacctgcttcatttgtgctgtgtgccatgttaatctcgaggggcagcccttctacagcaagaaggatagacctctgtgcaagaagcacgctcacacaattaatctctag

SEQ ID NO: 122525 - DNA, 696 bp, Artificial Sequence
  Description of Artificial Sequence: Synthetic coding sequence
atgtcttactctgtgacactcactggtcccgggccctggggatttcgcctccaagggggaaaggattttaacatgcccctgaccatcagccgaatcacgcccggctcaaaggcagcacagtcgcagttatcccagggtgatctcgttgttgcaatcgacggggtgaatacggataccatgacccaccttgaggctcagaataaaatcaaatcagctagctataatctctctctgactctgcagaagagtaaacgcccaatacccatcagtactaccgccccacccgtccagactccactgccggtgatcccccaccagaaagatcccgcactggacacgaatggatctctcgtggcgccttccccatccccagaagctagagcctcaccaggtactccggggactccggagctgagacctactttctcacccgcgttcagccggccgagtgcgttttctagtctggctgaggcctcagatcccggccctccgcgcgcttcactccgggctaagactagcccggaaggcgctcgcgacttgctgggcccaaaggccctgccaggatcctctcagcctaggcagtacaacaatcctatcggcttgtacagcgcagaaacgctccgggagatggcacaaatgtatcagatgagtttaaggggcaaagcctccggcgtggggcttccaggcggatggtag

SEQ ID NO: 122526 - DNA, 1839 bp, Artificial Sequence
  Description of Artificial Sequence: Synthetic coding sequence
atgagtcacccatcttggctaccccccaaatccactggggaacccctggggcacgttcccgctcgtatggaaaccacacatagctttggaaatcctagcatttcggtctctacgcagcagcctcccaagaagttcgcccccgtggtagctcccaagcctaagtataatccttataagcagcccgggggggagggagatttcctccctccaccacccccccctttagacgatagctcagcgctcccaagcatctctgggaacttccccccccctcctccgctcgacgaggaggcattcaaggttcagggtaaccctggcggcaaaaccctggaagagaggagatcaagcctagacgcggagatcgatagtttgacctcaattcttgccgatctggagtgttcaagtccgtacaagccccgccctccccagtcttctacaggatccacggccagcccacccgtgagtacgcctgtgacaggccataagcgtatggtcatacctaatcagcctccactgacggccactaagaagtctacccttaaaccccagcctgctcctcaggctgggcctatacccgtggcccctatcgggaccctcaagcctcagccccagccagtcccggcatcttacacaacagcatcaacaagctctagaccaacttttaatgtccaggtgaagagcgctcagccgtcccctcactatatggccgccccatccagcggacagatttacggctccggaccccagggctataacacacagcccgtgcctgtatcgggccagtgtccccctcctagcacaaggggaggaatggattatgcttacatcccaccacccgggctgcagcccgaaccgggttacggctacgctccgaatcagggaagatattacgagggttattacgctgcaggcccaggctacggtgggaggaatgattctgatccaacctatgggcagcaaggccacccgaatacttggaagagggagccaggctacactcctcctggcgctggaaaccagaacccccctggaatgtaccccgtgacaggccctaagaaaacttacattactgaccctgttagcgccccgtgcgcgcctcccttacagccaaaaggcggccattctggacagctgggtccttcttcggttgcaccttctttcaggccggaagacgagctggagcatttaactaagaagatgctgtatgatatggagaatccaccggcagatgaatactttggcagatgtgcaagatgtggagaaaatgtggtaggggagggcaccggctgtaccgccatggaccaggtgttccacgtggattgcttcacctgtatcatttgcaataataagctcagaggccagcctttttatgccgttgagaagaaggcgtactgtgaaccatgctatattaatacgctcgagcagtgtaacgtttgctctaagcctatcatggagagaatactgcgggctacaggcaaggcctaccacccacattgtttcacctgcgtcatgtgtcacaggtccctagacggcattccattcaccgttgatgcagggggattaattcattgtattgaggactttcacaaaaagttcgcacctcgttgcagcgtctgcaaggaaccaatcatgccagccccaggccaggaggagactgtgaggatcgtggccttggatagggactttcacgtgcattgttaccgatgcgaggactgcggaggcttgctgtccgaaggggataaccaaggctgctatccactcgacggccacattttgtgcaagacgtgcaatagcgctagaataagagtgctcaccgcgaaggccagtaccgatttatag

SEQ ID NO: 122527 - DNA, 282 bp, Artificial Sequence
  Description of Artificial Sequence: Synthetic coding sequence
atgagccaccctagttggttgccacctaaatccaccggagaacccctcgggcatgtgcccgctcgcatggaaactacgcatagcttcggcaaccccagcatctccgtatcaacccaacagccccccaaaaaatttgccccagtggtggccccaaagcctaaatacaatccatacaaacagccgggcggtgaaggagacttcctgccccctccacctccacccttggatgactcttccgcattgccctcaatcagcgggaactttcccccacctccgccatag

SEQ ID NO: 122528 - DNA, 456 bp, Artificial Sequence
  Description of Artificial Sequence: Synthetic coding sequence
atgtcccacccgagctggctgcctccaaaatctaccggcgaacccttgggccatgttcccgcccgcatggaaactactcattcatttggaaatccatccataagtgtctcaacccagcagcctcccaaaaagttcgccccagtagtggcacccaaacccaagtataatccatacaaacagccggggggcgaaggtgattttctgcccccaccgccacctcctctggatgattcgagcgcccttccgtctatatccggtaacttcccacccccaccccctctcgacgaggaggcttttaaggttcagggaaatcccgggggaaaaacgctcgaggagagaaggtcttctttagacgcagaaattgatagcctgacgtctatcttagcggacctggagtgctcctctccgtacaagccgcggcccccacagtcaagcaccggctccacagcttcttag

SEQ ID NO: 122529 - DNA, 336 bp, Artificial Sequence
  Description of Artificial Sequence: Synthetic coding sequence
atgagtcatcccagctggctcccgcccaagtccacaggtgagccactggggcacgtgcccgcccggatggaaaccacccactcctttgggaacccatcgattagcgtgagcactcaacaaccacccaagaagttcgcgcccgtcgtggcccctaagccaaagtataatccatataagcagccaggaggagagggggacttcctacctcccccaccccccccactggacgacagtagtgctctcccatcaatcagtgggaactttcctccacctcctccactggatgaggaagccttcaaagtccagggcaatccaggaggtaagactctagaatag

SEQ ID NO: 122530 - DNA, 201 bp, Artificial Sequence
  Description of Artificial Sequence: Synthetic coding sequence
atgagccatccaagctggcttcctccgaagagcaccggcgagcctctgggccacgtcccagcccggatggagaccacccacagctttgggaacccgagtatttcagtgtctacacaacagccaccgaagaagtttgcccctgtggtggcgccaaagccaaaatataacccctataagcagcctggcggcgagggagactag

SEQ ID NO: 122531 - DNA, 162 bp, Artificial Sequence
  Description of Artificial Sequence: Synthetic coding sequence
atgagccaccctagctggttgccgcccaaatccactggcgaacccctggggcatgtgccagcaaggatggaaacaactcacagcttcgggaacccatccatctctgtcagtacccagcaaccaccaaaaaaattcgctcccgtcgtggcacctaaaccctag

SEQ ID NO: 122532 - DNA, 144 bp, Artificial Sequence
  Description of Artificial Sequence: Synthetic coding sequence
atgtcccatccgtcatggctcccccccaaaagtactggggagccgctgggtcatgttcctgcgcggatggagaccacccactcctttggaaacccttctatttcagtgtcaactcagcaaccccccaagaaatttgccccatag

SEQ ID NO: 122533 - DNA, 1287 bp, Artificial Sequence
  Description of Artificial Sequence: Synthetic coding sequence
atgtctcacccatcctggctgccccccaaatcaactggcgaaccgctagggcatgtcccagcacgcatggaaacgacgcactcatttggaaacccaagtatatccgtaagcactcagcagccacctaaaaaattcgcacccgtggtggctccaaagcccaagtataacccctataagcagccagggggggagggagactttttgccaccccccccgccccccctggacgattccagcgctttacctagtatttcgggcaactttccgccgcctccccctctcgacgaggaggccttcaaggtccagggcaaccctggtggaaagacccttgaggaaagaaggtctagcctggatgctgagattgactccctgacgagcattttggccgatttggagtgcagctcaccgtacaaacctcggccgccacagtccagcactggcagcacggcctcaccgccagtaagcactcccgtcacaggccacaagcgcatggtgatccccaaccaacctccgctgacagctaccaaaaaaagcacacttaagcctcagcccgccccgcaggcaggtccgatacccgtggctcccatcggaacgctcaagccacagcctcaaccagttccggcctcctatacaaccgccagcacatcctcccgccccactttcaacgtgcaagtaaagtccgcccagccgtcacctcattacatggctgcccctagctccggacagatctatggctctgggccacaaggctacaatacacagccggtgccggtaagcggccaatgccctcccccgtccacgcgaggcgggatggactatgcatacattccaccgcccggtctccagccagagccaggctacggctacgcccctaatcaaggacgatactacgaaggatactatgcagctgggcctggctatgggggccgaaacgatagtgatccaacctacggccagcagggccatccaaacacgtggaagcgcgagccaggatataccccccctggtgcgggaaatcagaatcctcccggcatgtacccagtgaccgggcctaaaaaaacctatattaccgatccggtgtcagcgccttgtgcgccgccactccaacctaagggtggccacagtggccagctcggtccctcttctgttgccccaagctttcgcccagaggatgaactggagcatctgacgaaaaaaatgctgtacgacatggagaacccaccagcggacgaatatttcggcgagtgggggttggagctgactagtgaagtcactatactactgtag

SEQ ID NO: 122534 - DNA, 198 bp, Artificial Sequence
  Description of Artificial Sequence: Synthetic coding sequence
atgagccatccgtcatggttgcctccaaagagcacaggagaaccactcggacacgtccccgctagaatggagacgacacactccttcggcaacccttccatttccgtctctacacagcagccgcccaaaaaatttgcccctgtcgtggctccaaaaccaaaatataacccgtataagcagccaggcggcgaaggttag

SEQ ID NO: 122535 - DNA, 174 bp, Artificial Sequence
  Description of Artificial Sequence: Synthetic coding sequence
atgtctcatccctcttggctcccacctaagtccacgggtgaacctctcggacatgtacctgctcgcatggaaacaacacacagtttcggcaatcctagcatcagcgtgtctacccaacagcctcccaaaaagtttgctcctgtggtcgccccaaaacccaagtataacccttag

SEQ ID NO: 122536 - DNA, 1839 bp, Artificial Sequence
  Description of Artificial Sequence: Synthetic coding sequence
atgagtcatccttcttggcttccgccaaagtcgaccggggaaccactaggacatgtgcctgctcgtatggaaacgacgcacagcttcgggaacccaagcatttctgtatccacacagcagcctccaaaaaagtttgctcctgtggttgcccccaagcctaagtacaacccttataagcaaccaggaggagaaggcgatttcttacccccaccacccccccccctggatgattcatccgccttaccttccatttctggtaatttccctcccccgcctcctttagatgaagaggccttcaaagtccaaggaaacccaggcggtaagactctggaggagcgtcgatcttcgctcgatgcagaaatcgattcactgacaagcatactagcggatttagagtgctcctcaccatacaaacctaggcccccacagtcctcaactggatcgactgcctccccccctgtgtctactcccgtgaccgggcataaacgcatggtgatacccaatcaaccgccccttaccgctaccaaaaaatccactctgaagccacagccagcaccccaagctggacctatccctgtggcccctattggaaccctgaagcctcagcctcagcctgtgcctgcctcctatactacagcatctactagctcgcggccaacgttcaatgtacaggtcaaatccgcccagcccagcccccattacatggctgccccaagctctggccagatttacggctctggtccccagggctacaacacccagccagtaccagtgagcgggcagtgtcccccaccctcgacccggggcggaatggactacgcatacattccaccacccgggctccagcctgagcctggttatgggtacgcacctaatcagggccgatactatgaaggctactacgctgccggcccaggctacgggggaagaaacgactccgatcctacctatgggcagcaaggccaccctaacacatggaaaagagaaccaggatacacccccccaggagctgggaatcaaaatccacccgggatgtaccctgtgactgggccaaagaaaacctacattacggatcctgtcagtgcaccctgcgccccgcccctgcaaccaaagggaggccacagcggccagctaggaccatcaagtgtcgccccatccttcaggccagaagatgagcttgagcatctgactaaaaaaatgttatatgacatggaaaacccccctgctgacgaatatttcggccggtgtgcgaggtgcggagaaaacgtcgtgggcgaaggcacgggatgcaccgccatggaccaagtgtttcatgtcgactgcttcacctgcattatttgcaacaacaagctccgtggacagccattctatgccgtggaaaaaaaggcctactgcgagccttgttatattaatacgctagaacagtgcaacgtgtgttcgaaaccaatcatggaacgcattctgcgggcgacaggcaaggcctaccatccccattgttttacttgcgtgatgtgtcaccgctcactggacggaattccattcaccgtcgatgctggagggctgatccattgtatcgaggattttcacaaaaaatttgccccgcgctgttccgtgtgcaaagagcctataatgcctgcacccggtcaagaggaaaccgtgcgaatagttgctctggacagagactttcacgttcactgttaccgatgcgaggattgtgggggattgctcagcgagggggacaaccagggttgttaccccctcgacggccatattctgtgtaaaacttgtaacagcgcgaggatcagagttctcacagccaaggcctccaccgatctctag

SEQ ID NO: 122537 - DNA, 471 bp, Artificial Sequence
  Description of Artificial Sequence: Synthetic coding sequence
atgcagaagaaagaaaagtcttttggcatccagatgttaagtgtccagcctgataccaaaccaaaagggtgcgcgggatgtaacaggaaaataaaagaccggtatctcctgaaggccctggacaagtactggcatgaggattgtctcaagtgcgcctgctgcgattgtcgcctgggagaggtgggtagtaccctttatacaaaagccaatctcatcctatgtcggcgcgactatctaagattgtttggcgtgactggaaactgcgctgcctgctctaagctgattccagcgttcgagatggtgatgagggctaaggacaatgtgtatcatttggactgttttgcctgtcagttgtgtaatcagcggttctgcgttggcgacaagtttttcttgaaaaataacatgatcctctgccagactgactacgaggagggtctgatgaaagaggggtacgctccacaagttcgctag

SEQ ID NO: 122538 - DNA, 438 bp, Artificial Sequence
  Description of Artificial Sequence: Synthetic coding sequence
atgttgagcgtgcagcccgataccaagccaaaagggtgtgccgggtgcaatcgcaagatcaaggatcgctatctgctgaaggcgctcgacaagtactggcatgaggactgtctgaagtgtgcttgctgcgattgtagattaggtgaagtcgggagcaccctctatacgaaagccaacctaatcttatgcaggagagactatctgcggctgttcggggtcactggcaactgcgctgcttgttctaagctcatcccggccttcgagatggttatgagagccaaagataacgtttatcaccttgattgcttcgcatgccagctgtgtaaccagcgattctgcgttggggacaagttcttcctgaagaacaatatgattctctgccagactgactacgaagaggggctgatgaaagagggctatgccccgcaggttaggtag

SEQ ID NO: 122539 - DNA, 438 bp, Artificial Sequence
  Description of Artificial Sequence: Synthetic coding sequence
atgctgtcggtgcagcctgacaccaaacccaagggctgcgccggctgcaatcgcaagattaaggatcgctacctgctcaaggctctggataagtactggcatgaggactgtctgaaatgcgcatgctgcgattgccggctgggggaggtgggctccaccctgtataccaaagctaatctcatcttatgccggagagattacttgagactgttcggcgtcacaggcaactgcgccgcatgctcaaagctaatacccgcgttcgaaatggtcatgcgcgctaaggataatgtctaccatctggattgtttcgcatgccagctgtgcaaccagagattctgcgtcggagacaagttcttcctgaagaacaatatgattctatgccagaccgactatgaagaaggtttgatgaaagaagggtacgccccacaggtacgttag

SEQ ID NO: 122540 - DNA, 438 bp, Artificial Sequence
  Description of Artificial Sequence: Synthetic coding sequence
atgctcagcgttcagccggacactaagccgaaaggctgtgctggctgcaatcgtaagataaaagaccgctacctactcaaggccttggataaatattggcacgaagactgccttaagtgtgcgtgctgcgattgcaggctgggtgaggtcgggtcaacactgtataccaaagccaatctgatcctctgcagaagagactatctgcgcctgttcggagtgactggaaattgcgctgcctgttctaagctcatacctgccttcgagatggtgatgagggccaaagacaatgtatatcatctggattgcttcgcctgccagctgtgtaatcagaggttttgcgtgggcgacaagttcttcctgaaaaacaacatgatcctgtgccagaccgactatgaggaggggctaatgaaggaaggatatgccccccaagtaagatag

SEQ ID NO: 122541 - DNA, 438 bp, Artificial Sequence
  Description of Artificial Sequence: Synthetic coding sequence
atgttatccgtgcagcctgacaccaagcccaagggctgcgctggctgcaaccgtaagattaaggatcgttatctgttaaaagctctggataagtattggcacgaggattgcctgaaatgtgcctgttgcgattgcaggctgggtgaggtaggaagtaccttatatactaaagctaacctaattctgtgcagaagggactatctgcgcctgttcggtgtgactggcaactgcgccgcgtgtagtaagctgataccggcctttgagatggtgatgagggccaaggacaacgtgtatcatcttgattgctttgcttgccagctgtgtaaccaacgcttctgcgtaggggacaagttcttcctgaagaacaatatgatcctctgtcagactgactatgaggaggggctgatgaaggaaggttacgccccgcaggtgcggtag

SEQ ID NO: 122542 - DNA, 438 bp, Artificial Sequence
  Description of Artificial Sequence: Synthetic coding sequence
atgttatccgtccagcccgacacgaaacccaaagggtgtgcaggttgcaaccgcaaaataaaggaccggtatctcctgaaggccttggacaaatattggcacgaagattgtctgaagtgcgcttgctgtgattgtcgcttaggagaggtcggatcaacactgtacactaaggccaatttaatattgtgtcggagggattacctgcggctgttcggcgtcacagggaattgcgcagcctgctctaaactaatacccgcgtttgaaatggttatgcgagccaaggacaatgtgtatcatctcgactgctttgcctgccaactgtgtaaccagagattctgtgtaggggataaattcttcttgaaaaacaatatgatactgtgtcagacggattacgaggaggggctgatgaaagagggctacgcaccacaggtaaggtag

SEQ ID NO: 122543 - DNA, 438 bp, Artificial Sequence
  Description of Artificial Sequence: Synthetic coding sequence
atgttgtctgtgcagccggacactaaacccaagggatgcgcaggttgtaatagaaagatcaaagaccgctatctgctgaaggcattggataagtactggcacgaggactgcctgaaatgcgcatgctgcgattgtagacttggcgaggtgggttcgaccctctataccaaagccaatctgattctgtgcagacgcgactaccttcggctcttcggggtgacaggtaactgcgccgcttgcagtaaactgatccctgcatttgagatggtgatgcgcgcaaaggataacgtgtaccatctcgattgcttcgcctgccagctgtgcaaccagcggttttgcgtgggcgacaaatttttcctgaaaaacaacatgattctgtgccagactgactacgaggaaggactgatgaaggaggggtacgctccccaggtcaggtag

SEQ ID NO: 122544 - DNA, 438 bp, Artificial Sequence
  Description of Artificial Sequence: Synthetic coding sequence
atgctctccgtccagcctgacaccaagccgaaggggtgcgctggctgcaatcgcaaaatcaaagacagatatctgctcaaggcactcgataagtattggcacgaggattgtctgaagtgtgcatgctgcgattgccgcctgggagaagtcggatctaccctgtatacaaaagcaaacttgatcttatgccgtagggattatttgcgtctgttcggggtcaccggcaattgtgcggcatgctcgaaactgattcccgcatttgagatggtgatgcgcgccaaggacaacgtttatcatctcgactgcttcgcctgccaactgtgcaaccagcgcttttgcgtaggcgataagtttttcttgaagaacaatatgatcctctgtcagactgattatgaagagggactgatgaaagagggctatgctcctcaggtgcgttag

SEQ ID NO: 122545 - DNA, 357 bp, Artificial Sequence
  Description of Artificial Sequence: Synthetic coding sequence
atgctctccgtccagcctgatactaagcccaaagggtgcgctggatgcaatcgcaagatcaaggacaggtatctgttgaaggcgttggacaaatactggcacgaggactgccttaaatgcgcctgctgtgactgcaggctaggggaggtgggcagcacgttgtataccaaagccaacctgattctgtgcaggagggattacctgagactcttcggcgtgacaggaaactgcgcagcctgctccaagctgatccctgccttcgaaatggttatgagagccaaggacaacgtttatcacttggactgctttgcatgccagttgtgtaaccagcgcttctgcgtgggtgataagttttag

SEQ ID NO: 122546 - DNA, 177 bp, Artificial Sequence
  Description of Artificial Sequence: Synthetic coding sequence
atgctttcagtgcagcccgataccaagccaaaggggtgtgccgggtgtaatcgaaaaatcaaagatcgctacctacttaaagctctggataaatattggcatgaagactgcttgaagtgtgcatgttgtgactgtagactcggggaggtcggctcaacactttatactaaagcttag

SEQ ID NO: 122547 - DNA, 294 bp, Artificial Sequence
  Description of Artificial Sequence: Synthetic coding sequence
atgctgtctgttcagcctgacaccaagccaaagggttgtgctggctgcaacaggaaaattaaagaccgctatctcctgaaggctctggataaatattggcatgaagactgcctgaaatgtgcatgctgtgactgtcgccttggagaggtgggatccactctgtatacgaaggccaatctgattctctgccgccgtgactacctgcgcctgtttggagtgaccggcaattgtgcagcgtgcagtaagctgattccagcattcgaaatggtgatgcgtgcaaaggacaatgtctag

SEQ ID NO: 122548 - DNA, 357 bp, Artificial Sequence
  Description of Artificial Sequence: Synthetic coding sequence
atgttgagcgttcagccagatacaaagcctaagggttgcgcaggttgtaaccgcaagatcaaagaccgctatctcctgaaggccctggataagtactggcacgaagattgcctgaaatgcgcctgctgtgactgtcgccttggtgaggtaggttcaaccttatataccaaagcgaacctgattctgtgtaggagggactatctaagattatttggagtgacaggcaactgcgcggcctgctccaaactcatcccggcctttgaaatggttatgagggcgaaagataacgtctatcacttagattgtttcgcgtgtcagctttgtaatcagcgcttttgcgttggagacaaattctag

SEQ ID NO: 122549 - DNA, 255 bp, Artificial Sequence
  Description of Artificial Sequence: Synthetic coding sequence
atgctgagtgttcagcctgacaccaaacccaaaggatgcgcaggctgtaaccgcaagattaaagatcgctatctgctcaaggctctggataaatactggcacgaggactgcctaaagtgcgcatgttgcgattgccgcctgggtgaggttggcagtactctgtatacaaaagccaacctgattctttgtaggcgcgattaccttcgcctctttggggttaccgggaattgcgcggcctgttcaaagctgatctag

SEQ ID NO: 122550 - DNA, 438 bp, Artificial Sequence
  Description of Artificial Sequence: Synthetic coding sequence
atgctgtcagtgcagcccgatacaaaacccaaggggtgcgccggctgtaacaggaaaataaaagaccggtacctgctgaaggccctcgataaatactggcatgaagactgcctgaagtgcgcgtgttgcgactgccggctcggggaagtggggtccacactttacaccaaggccaatttaattttatgcaggcgggattacctgcgtctctttggtgtgactggtaattgtgccgcttgctcaaagttgatcccagcatttgagatggttatgcgcgcgaaagacaatgtatatcacctggactgtttcgcttgtcaactgtgcaaccaaaggttttgtgtcggggacaagtttttcttgaaaaataatatgattctgtgtcagactgactatgaagaaggtctgatgaaggagggatatgctccacaggtgcgctag

SEQ ID NO: 122551 - DNA, 492 bp, Artificial Sequence
  Description of Artificial Sequence: Synthetic coding sequence
atgctcatggaaggcggaagagcagccgcagcccgcaatgtgagctccattcagatgctgagtgtgcagccagacactaagcctaagggttgtgccggctgcaatagaaaaatcaaggatcgctacctcctgaaagcactcgataagtactggcacgaggactgccttaagtgcgcctgttgtgactgtcgcctgggcgaagttggatcaactttgtacactaaggcaaatctgattctctgccgcagagactatctgcggcttttcggtgtcactgggaattgtgcggcctgctcaaagctgatccccgccttcgagatggtgatgcgcgccaaggacaatgtttaccacttagactgttttgcctgtcagctctgcaaccagagattctgcgtgggagacaaattcttcctgaagaacaacatgatcctttgtcagaccgactacgaagagggactaatgaaggagggctacgccccccaggtccgatag

SEQ ID NO: 122552 - DNA, 438 bp, Artificial Sequence
  Description of Artificial Sequence: Synthetic coding sequence
atgctctcagtgcaacctgacacaaagcccaaaggttgtgccggatgtaacagaaaaatcaaggacagatatctcttgaaagccttagacaagtattggcacgaggattgcctaaaatgtgcatgctgcgactgtcgattaggggaggtgggctctacactttacactaaagccaacctgatcctttgtcgtagagactacctgcggttgttcggcgttaccgggaactgtgccgcatgctctaaattgattccagcctttgagatggtaatgagggctaaagataacgtctatcacctagactgttttgcatgtcagctttgcaatcaaagattctgtgtgggagataagttctttctcaaaaacaacatgattctgtgtcagactgactacgaagagggcctgatgaaggaaggatacgctccccaggtccgctag

SEQ ID NO: 122553 - DNA, 378 bp, Artificial Sequence
  Description of Artificial Sequence: Synthetic coding sequence
atgctctccgtccagcctgacactaaacccaaaggatgcgccgggtgtaatcgcaagattaaagatcggtacctgcttaaggcacttgacaaatattggcatgaggattgcctcaaatgcgcatgctgcgattgtcgctgggagagactgtttggcgtgaccggcaattgcgcggcctgtagcaagctgattcccgcttttgagatggtgatgagggccaaagacaatgtgtatcatctggattgttttgcgtgccagctctgtaaccaaagattctgcgtgggcgacaaatttttcctcaaaaacaatatgatcctttgccagaccgactatgaggaggggctcatgaaggaagggtacgccccacaagtaagatag

SEQ ID NO: 122554 - DNA, 267 bp, Artificial Sequence
  Description of Artificial Sequence: Synthetic coding sequence
atgctgtcagtacaaccagacactaaacccaaagggtgtgccggatgtaatcgcaagatcaaggaccgctatctcctgaaggcgctggacaaatattggcacgaagactgcttaaaatgcgcgtgctgtgactgtcgcttgggagaggtgggctcaactctttacacgaaggccaatctgattctatgccggagagactaccttcgactctttggcgtaaccggaaactgtgctgcctgctcaaaactcatccccgcatttgagtag

SEQ ID NO: 122555 - DNA, 333 bp, Artificial Sequence
  Description of Artificial Sequence: Synthetic coding sequence
atgctgtccgttcagccggacaccaaacccaaggggtgtgctgggtgcaatcggaagattaaggatcgctacctgctgaaagcattggacaagtattggcatgaggattgtctgaaatgtgcttgctgcgactgccggttgggcgaagtgggtagcaccctatataccaaagccaatctgattctttgtcgccgggattatctcagactgttcggggtcaccggaaattgcgccgcctgttccaagcttattccagcgtttgagatggtgatgagggcaaaggacaacgtgtaccacctagactgcttcgcctgtcagctgtgcaaccagtag

SEQ ID NO: 122556 - DNA, 357 bp, Artificial Sequence
  Description of Artificial Sequence: Synthetic coding sequence
atgctgtcggtgcagccagatacaaagcctaaaggctgcgctggctgcaatcggaagattaaagatcgctatctcctgaaggctttagataaatactggcacgaggactgcctgaagtgcgcctgttgtgactgccgcctcggtgaggtgggatccaccttatacactaaagctaacctgatcctgtgccgtagggattacctaaggctgttcggagtgacaggcaattgtgcggcctgctctaaactcattcccgcatttgaaatggtaatgcgggccaaagacaatgtgtaccatcttgactgctttgcatgccagctctgtaaccagagattttgtgtcggcgataaattctag

SEQ ID NO: 122557 - DNA, 498 bp, Artificial Sequence
  Description of Artificial Sequence: Synthetic coding sequence
atggtgaacccagggagctcaagtcagcctccaccagtgacagctggctctcttagttggaaaaggtgtgccggttgcggaggcaaaattgctgataggttcttgctgtatgcaatggactcatattggcattcccggtgtctgaaatgctcgtgttgccaggcccagcttggggatatagggacatcctgttacaccaaatctgggatgatcctgtgccggaacgactacatacgattattcgggaacagcggcgcctgttctgcctgtggacagtccatacccgcttccgaattggtcatgagggcacagggaaacgtttaccacctgaagtgtttcacctgcagtacttgcagaaacagactagtgcccggcgatcgatttcattacatcaatggttcgctgttttgtgagcatgaccgccctacagctctgattaacgggcatctgaattccctgcagtccaatcccctcctgcccgatcagaaagtgtgctag

SEQ ID NO: 122558 - DNA, 498 bp, Artificial Sequence
  Description of Artificial Sequence: Synthetic coding sequence
atggtcaatcccggctcatcttctcagccccctcctgtgacagcaggctccctttcatggaaacgttgcgccggatgcggcgggaagatcgctgaccgctttctactctatgccatggactcatactggcacagtaggtgcctaaaatgcagctgctgccaagcccagctgggggacataggtaccagctgctacaccaaatctggcatgatattgtgtaggaatgattatattaggctttttggcaattccggggcctgctcagcctgcgggcagtctatccccgccagcgagttggttatgcgggcacaaggaaatgtctaccatctgaagtgtttcacatgttcaacttgtcgcaacagactggtccccggtgatcgattccactatattaatggatcgcttttttgtgagcatgaccgacccactgctttgattaatggtcatctgaattccctacagagtaacccactgctgccagaccagaaggtttgctag

SEQ ID NO: 122559 - DNA, 2031 bp, Artificial Sequence
  Description of Artificial Sequence: Synthetic coding sequence
atggataaatatgacgatctgggtctagaagcctccaaatttattgaggacttgaatatgtacgaggcatctaaagacggacttttccgcgttgataagggcgcaggaaataacccagagtttgaggaaacacgccgggttttcgccacgaaaatggccaaaattcacctccagcagcagcagcagcaactcctgcaggaagagacattaccaagggggagtcggggccctgtgaatggaggaggcagacttgggccccaagctaggtgggaggtggttggctcgaaactgacagtggatggcgccgccaaaccacctcttgctgcttctacgggagcacctggtgcagttactacactcgccgctggccagcctccctatccaccgcaagagcaaagatctagaccttacctacacggcaccaggcacggcagtcaggactgcggatccagggagtcactggccacctccgaaatgtctgcattccaccagcccggcccatgtgaggacccatcgtgcctcacccatggagattactatgataatctcagtttagcatcccccaagtggggggacaaacccggggttagcccctccattggtctgtcagtgggctccggctggccttccagccctggcagcgacccccctctgcccaaaccatgcggcgaccaccccctcaaccataggcagctgagtctcagctcctctcgcagtagcgaggggtccttgggtggccagaattcaggaattggtggacgaagttcagagaaacccacagggctgtggtccactgctagctcacagagggtgtctcccgggttgccttctcccaacctggaaaatggagctccagctgtgggccctgtgcagcctcgtactccctctgtgtcagcccccctggccctcagttgtccgcgacagggcggtctaccccgctccaattccggcctgggaggcgaggtgagcggggtgatgtcgaaacctaatgtggatccccaaccatggtttcaggacggcccgaaaagctacctcagctcgtcggcaccaagtagcagcccagccgggctggacggaagtcaacaaggcgccgtgccggggttgggccctaagcctggctgtactgacctgggtacaggacctaagttgtccccgacttccctggtccatccggttatgagcacactaccagaactgtcctgtaaggaaggtccattgggctggagctctgacggctcactcggtagcgttctcctcgacagtccatcctcccctagagtgaggctcccctgtcaacccctagttcctggccctgagcttcgcccttcggccgcggaattgaaattggaagccctgactcaacgcctggagcgcgagatggacgctcatcccaaggccgactacttcggggcatgtgtcaagtgctccaagggcgtgtttggagctgggcaggcttgccaagctatggggaacctataccatgacacctgctttacctgcgccgcgtgttcccgcaagctgagaggtaaggcattctacttcgtcaatggaaaagtcttttgcgaggaagactttttgtacagtggcttccagcagagcgccgatcgatgtttcctctgtggtcacctgataatggatatgattttacaggccctgggaaagtcttaccatcctggctgtttccgttgcgttatctgtaatgaatgtttagatggagtgccctttactgtggactctgaaaataagatctattgcgtaagggattatcataaagtcctggcgcccaaatgtgcggcttgtggccttcccattctgcccccagaaggctcagatgaaaccattcgggtcgtgtcaatggaccgcgactaccacgttgaatgctatcattgcgaagattgcggcctggaactgaatgacgaggacggccacaggtgttaccctctcgaggatcacctgttttgccacagctgtcatgtaaagagactcgaaaagaggcctagctccacagccctacaccagcatcatttctag

SEQ ID NO: 122560 - DNA, 1221 bp, Artificial Sequence
  Description of Artificial Sequence: Synthetic coding sequence
atggtgcactgtgccgggtgtaagcggcccatcctcgatcggttccttttaaacgttcttgacagggcgtggcacgtcaagtgtgtgcaatgttgtgagtgcaaatgtaacctgactgagaagtgtttctctagggagggcaagctctactgcaaaaatgatttttttaggtgcttcgggaccaaatgtgcaggctgcgctcaggggatcagtcccagcgatcttgtgcgccgggctcggtccaaggtctttcaccttaactgcttcacatgtatgatgtgtaacaagcaactgtcgacaggcgaggaactctacatcattgacgaaaacaaattcgtctgcaaggaggattacctgagcaacagctccgtggctaaggagaacagcctccactctgcaaccaccggaagcgacccctccctgagcccggatagccaggacccgtcccaggatgatgctaaggactccgagtccgctaatgtatctgacaaagaagcgggctcaaatgaaaatgacgatcagaatctaggtgctaagcggcgagggcctagaacgaccatcaaagctaaacagttagaaacacttaaggccgctttcgcagctacccccaagcctacaagacacattcgcgagcagctggcacaagagacgggtctcaacatgcgcgtgatccaagtttggtttcagaatcgtcgctcgaaggaaaggcggatgaagcagctgtcggctctgggagctaggcggcatgcttttttcagaagtcctcgacgaatgagaccccttgtcgacaggttagagccaggagagctgattcccaacgggcctttctcattttacggcgattatcagtccgagtattacgggcccggcgggaactacgacttcttccctcagggccctccaagcagtcaggcgcaaacccccgtggatttgccattcgtccctagcagtggaccctctggaactccccttggcggattggaacaccccttacctggccatcatccttcaagcgaggcccagcggtttacagacatcctggcccaccctccaggagacagtccatcacctgagccttccctgcctggacctctgcactcgatgtcagctgaggtgtttggccccagccctccgttctcttctctgtcagttaatggtggcgcttcttacggaaaccacctcagtcacccccccgagatgaatgaagctgccgtttggtag

SEQ ID NO: 122561 - DNA, 1221 bp, Artificial Sequence
  Description of Artificial Sequence: Synthetic coding sequence
atgcttttccattctctgagcggccctgaggtccatggagtgatagatgaaatggataggcgtgccaaaagcgaagcaccagcaatcagcagcgctatcgatcgtggggacactgaaacgaccatgcccagcatttcttcagatagagcagcactttgtgctggctgcggaggtaaaattagtgataggtactacctcctggctgtggacaagcaatggcacatgcggtgtctgaagtgttgcgagtgcaaactgaatctggagagtgagttgacctgcttttccaaggacgggtccatttattgtaaagaggattattaccggaggttttctgtacaaagatgtgctcgatgccatctcgggatatcagcaagtgagatggttatgagggcccgcgatctggtgtaccacctcaattgtttcacatgtacgacatgcaataaaatgctgaccacaggagaccacttcggcatgaaggactctctggtttattgcaggttacacttcgaagctctcctccaaggagaataccctgcccactttaaccacgccgatgtcgctgccgccgcagccgccgccgcggcagcaaaaagtgccggactgggcgcagcaggggccaatccattggggctgccatattacaatggagtgggcacggttcagaaaggccggcccagaaaaaggaaatctccaggcccgggagccgaccttgctgcttacaacgctgccctcagttgtaacgaaaatgacgccgagcatctggaccgcgatcagccctatccatcatcgcagaaaacaaagcggatgagaacgagcttcaaacaccaccagctgaggacaatgaaatcctacttcgccataaatcataacccagacgccaaggatctaaaacagctcgcccagaagaccggcctaaccaagcgcgtgctgcaagtttggtttcagaacgcccgggcgaaattcagacgcaatctgctgcgtcaggaaaacacgggggtggataagagcactgacgcggccctccagaccggaactccatccgggcctgcatcagaactttcaaacgctagcctctcgccatcgtccactcctaccaccttgaccgacctgacctctcctacactcccgacagtgacctctgtactgacgagcgtgcctggaaacttggaagggcacgagccacacagccctagccagacaacactgacgaacctgttctag

SEQ ID NO: 122562 - DNA, 1194 bp, Artificial Sequence
  Description of Artificial Sequence: Synthetic coding sequence
atggaagctaggggcgagctgggacctgcccgcgaatccgccgggggagatcttctcctggcgctgttagctcggcgggcagacttgcgacgggaaatacctttgtgcgctggctgcgaccagcatatactcgatcggttcattttgaaggcaaccgccacggggactgcaagtgtttctagcgcagcgacagccacccccctcgctgaaaggtgcttctctcggggagagtccgtgtactgcaaggatgacttctttaaacgattcggaaccaagtgcgccgcttgtcaactgggtatcccccccactcaggtggtgaggagggcacaggacttcgtgtatcacctacattgcttcgcttgcgtggtgtgcaagaggcagctagcaaccggagacgaattctacttgatggaggatagccgtcttgtttgcaaagcagactacgagaccgcgaaacaaagggaggcagaagccacggccaaaagacccagaactactataactgctaagcaattggaaaccctgaagtcagcctacaacacatccccgaagccagcccggcacgttagagaacaactttcatccgaaaccggactcgatatgagggttgtccaggtttggttccaaaaccgccgggccaaagagaaaaggttgaagaaagatgccggtcgacaacgatggggccagtactttcgcaacatgaaacggagcaggggtggcagcaaatctgacaaggactctgtgcaagagggccaggatagtgatgctgaagtatcctttcccgtctcactgccctggcgcaagtgggctcgcccgatggcctccacgggagcctggggccatccaggtttggggcccgcgctgggatcacccgggcaactcctgcctggggcctggagaccagggaggcctcgcgctgtccccagggccgcttccagacagccactgcgctgcccacctatcccaaggagaccagcggagccgccctggccccctttattgagcagcctcgtgtaccccgacactagcctaggtctggtaccaagtggggcacccggaggaccccccccaatgcgagttctcgccggaaatgggccgagctccgatttgtcaactggttcatctggagggtaccctgacttccctgcaagccccgctagttggcttgatgaagtggatcatgcacagttctag

SEQ ID NO: 122563 - DNA, 1209 bp, Artificial Sequence
  Description of Artificial Sequence: Synthetic coding sequence
atggaggcacggggtgaactcggaccggctcgcgagtcagcaggaggcgacctgctcctggccctgctggccagacgggccgatctccgaagggaaattcctctctgcgctggctgcgaccagcatatcctggacaggttcattctcaaagcactagatcgccactggcattcaaaatgtctgaagtgtagcgactgccacaccccattagcagaacgctgtttctccagaggcgaatctgtctactgtaaagatgacttttttaaaaggttcggtactaaatgtgcggcgtgtcagttgggcatccctccaacacaggtcgtccggcgggctcaagacttcgtgtaccatctccactgcttcgcctgcgtagtatgcaagagacagctggcgactggcgacgagttttacctgatggaagatagccgtctggtgtgcaaagcagactacgagaccgccaaacagcgagaagccgaagcaactgctaaacgacctagaaccacaattacggctaagcagttagaaaccctgaagagcgcctataacacgtcgcccaagcccgcgcgacatgtgagagagcaactctcaagcgagactgggttagatatgagagtcgtgcaggtttggttccagaatagacgcgctaaggaaaaaagattgaagaaggacgccggtaggcagcgctggggccagtacttccgtaacatgaagagatcccgcggaggatctaagagcgataaggacagtgtccaggagggccaggattccgatgcagaagtaagctttccagacgagccaagcctggctgaaatggggccagccaatggcctctatggcagcctgggcgagcctacacaggctctgggaaggcccagtggagcgctggggaacttctcgctcgagcacggcggcctcgctgggccagaacagtacagagaactccgccctggcagtccatacggagtaccgccttcaccggcagccccgcagtctttgccaggcccgcagccgctgctatcatcactggtttacccagatacctcgttagggctggtgccgtccggcgctcccggtgggccacctcccatgcgagtgctggctgggaatgggccaagcagcgacctgtccacaggaagtagcggaggctaccctgactttccggcctcccccgcaagctggctcgatgaggtggaccatgcacagttctag

SEQ ID NO: 122564 - DNA, 1194 bp, Artificial Sequence
  Description of Artificial Sequence: Synthetic coding sequence
atgctcctcgagacaggcctggaacgcgatcgggcccggccgggcgcagccgccgtgtgtaccctaggcggcactcgggagattccgctgtgcgccggatgcgatcaacatatactcgaccgcttcatactgaaggccctcgatcgccattggcacagcaagtgtctaaagtgttcggattgccacacccccctagctgaaagatgcttttctcggggcgaaagcgtgtactgtaaggacgatttcttcaagcggtttggcacaaaatgcgccgcatgccaattaggaatcccccctacacaagtagtgcgcagggctcaggatttcgtgtaccatctgcactgcttcgcctgtgtagtgtgcaaaaggcaactcgccaccggcgatgaattctaccttatggaggattctaggcttgtgtgtaaggccgactatgagaccgctaagcaaagagaagccgaggctacagcaaagcgtcctcgcactacgattaccgccaagcaacttgagaccctgaagagtgcctataacacctccccaaaacctgcacggcatgtgcgagaacagctgtcatctgagactggactagacatgcgtgtcgtgcaagtgtggttccagaatcggcgggcaaaagaaaagcgcttaaagaaggatgctggaaggcagcggtgggggcaatacttcagaaatatgaaaagatctagaggaggttctaagtccgataaagacagcgttcaggaggggcaggattcagatgcggaggtaagcttccccgatgagcctagcttggctgaaatggggcctgccaatggactgtacggttccttgggggaaccaacccaggcactggggaggccctctggagccctaggcaacttttctctcgagcatggggggctcgcaggaccggagcaataccgcgagctacggcctggaagtccttacggagtgcccccatctccagcagcccctcaatccctgcctggaccacagcccctgttgtcatccttggtttatccagacacgtctctcggattggtccctagtggggcccctggcggtccaccgcccatgagagttctggccgggaatgggccctcttctgacctctccaccgggagttcaggtgggtatccagacttccccgcttcgcccgcctcttggctggatgaggtggatcacgcacagttttag

SEQ ID NO: 122565 - DNA, 1173 bp, Artificial Sequence
  Description of Artificial Sequence: Synthetic coding sequence
atgatgcagagtgcaaccgttcccgctgagggagctgttaaaggcttgcctgagatgctgggcgtacctatgcagcagatccctcagtgcgccggctgcaaccagcacatattggataaattcattttgaaagtgctggacaggcattggcatagttcatgcctgaagtgtgccgattgtcaaatgcagcttgccgatcgatgcttttccagggcaggcagtgtttactgtaaagaagacttttttaagagatttgggaccaaatgtaccgcctgtcagcaggggatcccccccacccaggtggtgcggaaggcgcaggatttcgtctaccatctacactgctttgcttgcataatttgtaatcgccagcttgctacaggcgatgaattctacctcatggaggacgggcggttggtgtgcaaagaggactacgagactgccaaacagaacgatgatagtgaggccggcgctaagcgccctaggactaccatcacagcaaagcagcttgaaactctgaagaatgcatataaaaattcacccaagccagctaggcatgtgcgtgaacagctgtcatccgagaccggcctggacatgagagttgttcaggtatggttccagaatcggagagccaaagaaaaaaggttgaaaaaggatgccgggcgtcatcgttggggccagttctataaatctgtgaagcgatcaaggggatctagcaaacaggaaaaggagagctctgccgaagattgcggtgtttctgatagcgaactgagcttccgcgaagatcaaattttgtccgaactgggacatacaaacaggatttatgggaacgttggagatgtcactggaggccaactaatgaacggcagtttttccatggatgggaccgggcagtcctatcaggacttacgggacggctcaccctacggaatcccccagtcaccctcttcaataagtagcctgccctcccatgccccgctactgaacgggcttgattacactgtagacagcaacttgggcattatcgctcacgccggccagggcgtatctcagactcttagggccatggccggcggccccacaagcgacatcagcacaggatcttctgtggggtatccggatttccccacaagccccggctcttggctggacgaaatggatcatccgccattctag

SEQ ID NO: 122566 - DNA, 1209 bp, Artificial Sequence
  Description of Artificial Sequence: Synthetic coding sequence
atgatggtgcattgcgccggatgtgaacggcctattttggatagattcctcttgaatgtactggatcgcgcctggcacattaagtgtgtgcagtgttgtgagtgcaaaacgaacttaagtgagaagtgcttcagccgcgagggcaaactctactgcaaaaatgatttctttagacgatttggaaccaagtgtgctggctgtgcgcaaggcatttcgcccagtgacctcgtccggaaagcgcgctcgaaggtgttccacttgaattgcttcacttgcatggtgtgtaacaaacagttaagtactggcgaggaactatacgttatcgacgagaataagttcgtctgtaaggacgactacctgagcagctcttccctgaaggaaggctctctgaacagcgttagctcctgcactgacaggagcttgtctcctgacctgcaggacgctctgcaggatgaccctaaggagactgacaatagtacctcgagcgacaaagagaccgcgaacaatgagaacgaagaacagaactcggggacaaagcggagaggaccacgcacgaccatcaaagccaagcagctcgagacactgaaagccgctttcgcagctacccctaagcccacacggcatatccgtgagcagttggcccaggaaactgggctgaatatgagggtcattcaggtctggttccagaataggagaagcaaggagcgccgcatgaagcagctgagcgccctcggagccaggcggcatgccttcttccggtccccccgtcggatgagacccctcggcggtcggctcgatgaaagtgaaatgctgggctcaaccccttacacatactatggcgactatcaaggcgattattacgcccctgggtcaaattacgatttcttcgcccatggcccgcctagtcaagctcagagtccagccgactcctcgtttctggcggcgtcaggtcccggctcaacccctttgggagccctggaaccacctcttgctggcccacacgctgctgacaacccaagattcactgatatgatcagccacccagacacgcctagccccgaaccaggcctacctggcactttgcatcccatgcccggcgaggtcttctcaggaggcccttccccacccttccccatgagtggaacttctggctattccgggccgctctcccatcccaaccccgaactcaacgaggccgcagtgtggtag

SEQ ID NO: 122567 - DNA, 1071 bp, Artificial Sequence
  Description of Artificial Sequence: Synthetic coding sequence
atgcagattctcagcagatgccaggggctgatgagcgaggagtgtggccggacaactgctttggcggcgggacgcaccaggaagggtgccggagaggaaggactggtgagccctgagggcgcaggcgacgaggactcctgctctagttctgctcccctgtctcctagcagtagtccgcgatcaatggcctctggatccggatgcccacctgggaaatgcgtctgcaatagttgcggattagaaatagtcgacaagtatttactgaaggtgaatgatctctgctggcacgtgcgatgcctctcctgcagtgtttgccgcacctccctcggcaggcacacgtcatgctacatcaaagataaggatatcttctgtaaactggactatttccgacggtacggcacccggtgttcaagatgtgggcggcatatccactctacggattgggtccgaagagccaaaggcaatgtgtatcatcttgcctgtttcgcctgcttctcctgtaaacgtcagctttcaactggtgaagaatttgccctggttgaggagaaggttctttgtcgagtgcattacgactgcatgctggataatctgaaaagagaagtggagaacgggaatgggattagcgtagaaggggcgttgttaacagaacaagacgtgaatcaccccaaacccgcgaagagagctcggacctcattcactgcagatcagttacaggtgatgcaagcacagtttgcccaggacaacaacccggatgcacagactctccagaaactcgccgagaggaccggtctctcaagaagggtcatccaggtgtggttccagaattgtagagcgcggcacaagaaacacgtcagccccaaccacagcagcagcactcctgttactgccgtccctccctccaggctcagccccccaatgctggaagaaatggcctactcagcttacgttccacaggacgggacaatgctaaccgctctgcatagctatatggatgctcatagccccaccactctcgggcttcagccactacttccacatagtatgacacaattaccgatatcgcatacttag

SEQ ID NO: 122568 - DNA, 1041 bp, Artificial Sequence
  Description of Artificial Sequence: Synthetic coding sequence
atgtcagaagaatgtggccgaacaaccgcgctggccgccggtcgaactagaaagggtgcaggcgaggaagggttggtgtcacccgaaggggctggggacgaggactcctgcagctcctctgcacctttatccccaagctccagcccacgaagtatggcctctggaagcggctgccctcccggaaagtgtgtttgcaattcctgtggattagagatagtcgataagtacctactgaaagtcaacgatctgtgttggcacgtgagatgtttgagctgcagcgtatgccgcacttccctcgggagacacactagttgttacataaaggataaggacatcttttgcaagttagactacttccggcgatacggcactcgatgtagtcgctgcggccgccacattcacagcaccgactgggtgaggagggctaaagggaatgtgtaccacttggcctgcttcgcctgtttctcttgcaaacgtcagcttagcaccggcgaagaatttgctttggtcgaagagaaagtcttatgtagagtccactatgactgtatgctggacaacttgaagcgagaggtggagaatggaaacgggatctctgtggagggagccctgctcacagagcaggacgttaaccaccccaaacctgccaagcgagcccggacctcgtttacagcagaccaactccaggtaatgcaagcccaatttgcacaggataacaaccccgatgcccaaacactacagaaactggctgagagaacaggactgtccaggagggtaatacaggtgtggtttcagaactgcagagctaggcataaaaagcacgtgtcccctaatcattcctcatccaccccagtgacagccgttcccccatcccggttatccccccccatgttagaggagatggcatattcagcctatgtgccacaggacggcaccatgctgactgccctgcactcatatatggacgcccattctcccaccacactcggactccagccactgttaccacattccatgacgcagctaccaatttctcatacttag

SEQ ID NO: 122569 - DNA, 1194 bp, Artificial Sequence
  Description of Artificial Sequence: Synthetic coding sequence
atggagattgtgggctgtcgagccgaagataacagttgtccttttcgcccacctgcaatgttgtttcacggaatctcgggtgggcatatccaaggcataatggaggaaatggagcggcgctctaagacagaggccagattggccaagggtgctcagctaaatggaagggacgccggaatgccccctctcagccctgagaaacccgccctgtgcgccggttgtggcggaaaaatctcggataggtactatctcctggccgtggataaacagtggcacttgagatgcttaaagtgttgtgagtgcaaactcgccctcgaatccgagctgacatgtttcgccaaggacggctcaatttattgcaaggaggattattaccggcggtttagtgtccagagatgcgcaaggtgtcatttgggcattagcgcctctgagatggtcatgcgagcaagggattcagtgtaccacctaagctgcttcacctgcagtacatgtaataaaacgttaactaccggggatcacttcggtatgaaggatagtctagtttattgccgcgcacacttcgaaactctgttacagggcgaatacccacctcagctcagttacacggaattagcggcaaagtcaggagggctggccttgccgtatttcaatgggaccggaaccgtccaaaaaggccgacctaggaagcgaaaatcaccggccctgggcgttgatattgtaaactacaactccggctgcaacgagaacgaagctgaccatttggacagggatcagcagccataccctccttcccagaagacaaaaaggatgcggacctcatttaagcatcaccaattacgcacaatgaaaagttattttgctatcaatcacaatccagacgctaaagatctgaagcagttggcacaaaaaacgggactaacaaaaagagtccttcaggtgtggttccagaacgctagggccaaattcaggagaaacctcctccggcaggagaatggtggcgtggacaaggcagacggcacgtctttaccagctcctccttccgccgatagcggggctcttaccccccctggtactgccactacacttactgatcttacgaatccaaccattactgtggtgacatccgtgacctctaacatggattcccatgagtctgggtcgccttctcaaaccactcttacgaacctgttttag

SEQ ID NO: 122570 - DNA, 1167 bp, Artificial Sequence
  Description of Artificial Sequence: Synthetic coding sequence
atgctgaatggaactacccttgaggccgcaatgctgtttcacgggatcagtggaggccacatccagggcattatggaagagatggaacgacgatccaaaacggaggccaggcttgccaagggggcccagttgaacgggcgtgacgccggtatgcctcccctaagtcccgagaaaccagccctttgtgcagggtgtgggggcaaaatttcagacagatattacctgctggctgtagacaaacaatggcatctgaggtgcctgaagtgctgtgagtgcaagctcgccctggaatccgaactgacctgcttcgcaaaggacggaagtatctactgtaaggaagattattatcgtcggttcagtgttcaacggtgtgcccggtgtcacctgggtatatcagcctctgagatggttatgcgggcacgtgattccgtttatcatctgagctgcttcacgtgttccacttgtaataagaccctaacaacgggggaccacttcggtatgaaggactccctggtctactgccgtgcccattttgagacactcctgcagggagaataccctccacagctatcctataccgaactggcagctaagtcgggcggactggccctgccttacttcaatgggaccggcaccgtgcagaaaggacgacccaggaagcgcaaatccccggcactgggtgtagacatcgtgaactacaattcaggatgtaatgagaacgaggccgatcatctagatagagaccagcaaccttatccgccctcccagaaaaccaaacgaatgaggacttcgttcaaacatcatcagcttaggacgatgaagtcttactttgctattaatcataatccagatgcaaaagatctcaagcagcttgcccaaaagactggcctaaccaagagagtgctacaggtgtggtttcagaacgctcgggctaagtttcgaaggaacctgttaagacaggaaaatggaggcgtggataaagccgacggtactagtctgccagctccaccatctgcagactccggcgccttgacacctcccgggaccgcgacaaccctgaccgacctcactaacccgacaattaccgtcgtaacttccgtgactagtaacatggattctcacgaatctgggtctcccagccagaccactctgaccaatctgttttag

SEQ ID NO: 122571 - DNA, 1149 bp, Artificial Sequence
  Description of Artificial Sequence: Synthetic coding sequence
atgctcgacggattgaagatggaggaaaacttccaatccgccatcgacacctctgccagtttcagctcactcctggggagggcagtgtcccccaaatcagtttgcgaaggctgtcagagagtgattctcgacagatttctgttgcggctgaacgattccttctggcacgagcagtgcgtgcagtgcgcttcatgtaaagagccgctcgaaacaacttgcttttatagagataagaagctgtactgcaagtacgactacgagaagttgttcgcagtcaaatgcggtgggtgcttcgaggcaattgcccctaatgagttcgtaatgcgggcacagaaaagcgtctaccacctgagctgtttttgctgttgcgtgtgtgagcgccagctccagaagggggatgagtttgtacttaaggagggccaattgctctgtaaaggtgactatgagaaagagcgggagctgctgagcctggtcagcccagccgccagtgactcgggcaaatccgatgacgaagagtcactgtgtaaatctgcccacggtgcaggcaagggcactgcagaagaaggaaaggatcacaaacgtcccaagcggcctaggacgatccttacaactcagcagagaagggcttttaaggcctcttttgaggtgtctagcaaaccctgcaggaaggtgagggagaccctggctgctgagacgggactctccgtgagagtggtacaggtgtggttccagaatcaacgtgctaaaatgaagaaattggcccgccggcagcagcaacagcaacaggatcaacagaatactcaacggctgagcagtgcgcagaccaacggcggtgggagcgcaggaatggagggaatcatgaatccatatacagcacttcccactccacagcagctgctggctatcgaacagtcagtgtattcctctgatcctttccgccagggtcttacaccgccacagatgcctggcgatcacatgcacccttatggagctgaaccgttgtttcacgatttggactctgacgatactagcttgtcaaatcttggagactgctttttggcgacctctgaagcagggcctctgcaatcgcgcgtgggaaatccaatcgaccatttgtacagtatgcagaacagctatttcacttcatag

SEQ ID NO: 122572 - DNA, 1149 bp, Artificial Sequence
  Description of Artificial Sequence: Synthetic coding sequence
atgttggacggcttaaagatggaagagaatttccagtcggctatcgacacgtcggcgagctttagtagcctcctgggccgcgccgtgtcccccaagtcagtctgtgagggatgccagcgtgtgatccttgaccggttccttctgagactgaatgattcattctggcacgagcagtgcgtgcagtgtgcctcttgcaaggagcctctagaaacgacttgtttctatcgagataagaagctgtactgcaaatatgactatgagaaactctttgccgttaaatgcggtgggtgctttgaagcaatagccccaaacgagtttgtgatgcgagctcagaagtctgtgtatcacctgagctgtttttgctgttgtgtatgcgagaggcagctccagaaaggggacgagtttgtcctgaaagagggacagttgctgtgcaaaggggactacgagaaagagagagagctactgtcactggttagtcccgccgccagcgacagtggtaaatcagatgacgaggaaagcctgtgcaagtctgcgcacggcgccggaaagggcaccgcagaagagggcaaagaccacaaaagacctaaaaggccccgcactatattgaccacacaacaacgccgggcctttaaagcttcctttgaagtctcatcaaagccatgtcgcaaggtccgggagactctggccgccgagacaggcctctccgtgcgcgtcgtgcaggtgtggttccagaaccagcgggcaaagatgaaaaagcttgcgaggagacagcaacagcagcaacaggatcagcaaaatacccaaaggctatcaagcgcacaaaccaatggtgggggcagcgctgggatggaagggataatgaatccttatacagctcttccaacacctcagcagctcctcgcaatcgaacagtccgtgtattcttctgacccattcaggcagggcctgacgccaccccagatgcccggcgaccacatgcatccatatggcgcagagcctttattccacgacctcgattcggacgatacctctttaagtaatcttggagattgctttttagcaactagcgaagccgggccattgcagtccagagtgggcaatccaatagaccatctgtattccatgcaaaactcttactttacgtcctag

SEQ ID NO: 122573 - DNA, 1149 bp, Artificial Sequence
  Description of Artificial Sequence: Synthetic coding sequence
atgttggacggtctcaaaatggaagaaaatttccagagcgcaatagatacctcagcttcctttagcagcctcctcggccgagccgttagccccaagtctgtgtgcgagggatgtcagcgagtaatcctggatcgctttttactgcggttgaacgattccttttggcatgaacagtgcgtacagtgcgcctcatgcaaggagcctttggagaccacatgcttttacagggataagaaattgtattgcaaatacgattatgagaagctcttcgccgtcaaatgtgggggatgctttgaggccatagctcccaacgagtttgttatgcgggcccagaagagcgtgtaccatctctcctgtttctgctgttgtgtctgcgagagacagctgcaaaagggcgacgaattcgtgctcaaggaaggtcagctcctgtgcaagggggactatgaaaaggaaagagaacttctatctctggtgagcccggcagcctctgattccggtaagtcagacgacgaagagtcattatgtaagtcagcccatggggccggaaagggcacagccgaagagggcaaggatcacaaaagacctaaacggccacgtacaattttaacaacacagcagcgtagagcattcaaggcttctttcgaggtttcctctaagccatgccggaaggtgagagagaccttggcggcagaaactggactttccgtccgcgtcgtccaggtctggtttcaaaaccaacgggctaagatgaagaagctggcccgccgtcagcagcaacagcagcaggaccagcagaacacacagagactttctagtgcccagactaatgggggtggcagcgccggaatggagggcattatgaacccctacacagccctgccaacaccccagcagttgttggcaatcgaacagtccgtatacagttccgacccgtttaggcagggtctgacacctccccagatgccgggtgaccacatgcacccatatggagctgaacccctgttccacgatttggattccgacgacaccagcctgtctaacctaggcgactgctttctagctacctcggaggctggacctctccagagtcgggttgggaaccccatcgatcacctttacagtatgcagaactcctatttcacgagctag

SEQ ID NO: 122574 - DNA, 1221 bp, Artificial Sequence
  Description of Artificial Sequence: Synthetic coding sequence
atggacatcgccactgggccagagtccttggaacggtgctttccaagaggccagacagattgcgctaaaatgttggatggcatcaagatggaagaacatgccctgcgacctggccccgctacactcggggtgttgcttggcagcgattgtccacatccagcagtgtgcgaggggtgtcagagacccatatctgaccgctttcttatgcgcgtcaacgaatctagttggcacgaagaatgcctacagtgcgcggcatgccagcaagctctgacaacttcttgctacttccgcgatagaaaactttactgcaaacaggactaccagcaactgttcgcagccaagtgctccggctgcatggagaagatcgcccccacagagtttgtgatgcgggctctagagtgtgtttatcacctcggctgtttttgctgttgcgtctgtgagcgccagctgcggaaaggcgatgagtttgttctgaaggagggacaacttctgtgcaaaggtgattatgagaaagaaaaggatcttctttcgtcggtgtcccccgatgagagtgactctgtgaagtctgaggatgaagacggtgacatgaagcctgccaaagggcaaggatcccaatccaaggggagcggtgacgacggtaaagatcctaggaggcccaaaagacccaggaccatactgacgactcagcagaggcgcgcttttaaagcatccttcgaagtctcttcaaagccttgccggaaggtgcgtgaaactctagctgcagaaaccgggctgtctgtaagagtggttcaagtgtggttccaaaaccagagagccaagatgaaaaagctggcacggaggcaccaacagcagcaagaacaacaaaattcacagcggctgggtcagggcgaaccgggccctgggcagggattgggacaggaggtgctatcatcgcgaatggaaggtatgatggcttcgtatacaccattagctcctccccagcagcagatagttgccatggaacagtccccttacggctcttcagacccgtttcagcagggcttaacaccacctcagatgcctggcaacgattctatttttcacgatattgacagcgacacctccttgaccagcctgtccgactgctttctcggaagctccgatgtcggttctttgcaggcaagggtcggtaatcctattgacaggctgtatagtatgcagtcgtcctacttcgcctcatag

SEQ ID NO: 122575 - DNA, 1209 bp, Artificial Sequence
  Description of Artificial Sequence: Synthetic coding sequence
atggatatcgcaacaggacccgaaagcctcgaaagatgcttcccaagaggccagaccgattgcgctaagatgctggacggcataaagatggaagagcatgccctgcgtcctggaccagcaacattaggcgttctgctgggcagcgactgtccccacccagcagtctgcgaaggctgtcagcggcccatctcagaccgctttctgatgagggtgaacgagtcaagctggcatgaagaatgtcttcaatgcgcggcctgccagcaggctctgaccacctcctgctatttcagagaccggaaactttactgcaagcaggattaccagcagctattcgcagccaagtgtagcggctgcatggagaaaatagctccaacagaattcgtcatgagagcactcgagtgcgtctatcacttgggatgtttctgttgctgtgtgtgtgagcgacagcttcgcaagggcgacgagttcgttctgaaggagggtcagctcctttgcaaaggcgactatgaaaaggagaaggatcttctgtccagtgtgtcccctgatgagagcgacagtgtaaagtccgaggatgaagacggcgatatgaaaccagcaaagggccagggaagccagtcaaaagggtctggagacgatggaaaggatccaagaaggcccaaaagaccaagaaccattctgactacccagcagaggcgcgcattcaaggctagtttcgaggttagcagcaagccttgccggaaagtgcgtgaaacgctggctgcagaaactggtctgtcagtccgggtagtccaggtgtggttccagaaccagcgggctaaaatgaagaaactagctcgacgccaccagcagcagcaggaacagcagaactcccagcggcttggacaggaggttctctcatcacgcatggagggaatgatggcaagttataccccgcttgctcctccgcagcagcaaatcgtcgcaatggaacagagtccttacggatcgtccgacccatttcaacaaggcctgacccccccccagatgcctggggaccacatgaatccgtatgggaacgactcaatctttcatgacattgattccgataccagtttaaccagcttatccgattgctttttgggaagctcagatgtcggctcactgcaggccagagtgggcaaccctatcgacaggctatacagcatgcagtcatcgtatttcgcgagctag

SEQ ID NO: 122576 - DNA, 1119 bp, Artificial Sequence
  Description of Artificial Sequence: Synthetic coding sequence
atgctggacgggatcaaaatggaggagcatgcgttgcgaccagggcctgctactttaggggtgttgctagggagcgactgcccgcaccccgcagtctgcgagggctgtcagaggcctatctctgatcgattcctcatgagagtcaatgagtcttcctggcatgaggagtgccttcagtgcgccgcctgtcagcaggcgctcaccaccagctgttactttagggatcggaaactgtattgtaagcaggactaccagcagttattcgccgccaagtgtagcggctgtatggagaagatcgcgcctacagagtttgtcatgagggctctggaatgtgtgtatcacctgggctgtttctgctgttgcgtatgcgagagacaacttcgcaagggcgacgagttcgtacttaaagagggacagctactctgtaaaggagattacgagaaggagaaggatctactaagttccgtgtctcccgatgaatctgactcggtcaaatcggaggacgaagacggcgatatgaagcctgctaagggccaaggctctcagtccaaaggctccggtgatgacggcaaggacccgagacgacctaagcgcccacgaacgattcttacaactcagcagcgaagagccttcaaggcttcttttgaagtcagttcgaagccttgcaggaaggtccgggagaccctggccgccgagactgggctgtctgtgcgggtcgtccaggtgtggtttcagaaccagcgggcgaaaatgaagaaattagctagacgtcatcagcagcagcaagaacagcagaattctcagcgtctcggccaagaggtcctgtcctcacgcatggaaggaatgatggcctcttacacccctctcgcacccccccagcagcagatagtagcaatggagcagagcccatacggctcctccgatcctttccagcagggactcacacccccccagatgccaggcaatgactctatctttcatgatattgattcagacaccagccttacgtccctgtctgactgctttttggggtcttctgacgtgggtagcctgcaggccagggtaggcaaccccattgaccgtctttacagtatgcagtcctcttacttcgccagctag

SEQ ID NO: 122577 - DNA, 1188 bp, Artificial Sequence
  Description of Artificial Sequence: Synthetic coding sequence
atggacatcgccaccggacctgagagtctggaaagatgtttcccacgtggacagaccgattgtgcgaaaatgctcgacggaattaaaatggaagagcatgctttgaggccaggacctgccaccttgggagttctgttaggcagtgactgtccacatccggcagtctgcgagggctgtcaaaggccaatctcagatcgcttcctgatgagggtcaacgagtcctcctggcacgaagagtgtttgcagtgtgctgcctgccagcaggctctgactactagctgctatttccgcgaccgcaaattatattgcaagcaggactaccagcagctgtttgcagccaagtgctccgggtgtatggaaaaaattgccccaaccgaatttgttatgagagcgctcgagtgtgtgtatcatctgggatgtttttgctgctgcgtttgtgagcgccaactccggaagggcgacgagtttgttctgaaagagggccagctgctctgcaaaggagactacgagaaggagaaggatctgttgtcctccgtcagccctgatgagtccgactctgttaagagcgaggatgaggatggggatatgaagccggcgaaggggcaggggtcccagtcgaagggttctggagacgacgggaaggatcctcgacgacctaaaagacctaggaccattttgacgacccagcagcgtcgagccttcaaagccagtttcgaggtttcctccaagccttgcagaaaggtgcgcgaaacactggcggccgagactggattgagcgtgcgagtggtgcaggtttggtttcaaaatcagagggctaagatgaaaaagctcgcaagaaggcaccaacagcagcaggagcaacagaacagtcagcgactcggacaggaagtattgtctagccgcatggaaggaatgatggcaagttacacccccctggcgcccccccaacaacaaattgtggcaatggaacagtcgccttacgggtcaagtgatccttttcaacagggtctgacccctccacagatgccaggcaatgacagtatatttcatgacatagattctgacacttcactaacttctctatcagactgtttcttaggttctagtgatgtgggaagtcttcaggccagagttgggaaccccatcgacagattgtactctatgcaatccagctactttgcatcctag

SEQ ID NO: 122578 - DNA, 318 bp, Artificial Sequence
  Description of Artificial Sequence: Synthetic coding sequence
atgtctatctatttccctatccactgtcccgattatctcaggtcggccaaaatgaccgaggttatgatgaacacccaaccgatggaggagatcggactgagcccaaggaaagacggactctcctatcaaattttcccggatccatccgacttcgaccgatgctgcaagctcaaggaccggttgcctagtatcgtagtagagcctaccgagggggaagtggaaagcggagagcttcgctggcctccagaggaatttctcgtgcaggaggatgagcaggataattgtgaggaaactgcaaaagagaacaaagagcagtag

SEQ ID NO: 122579 - DNA, 264 bp, Artificial Sequence
  Description of Artificial Sequence: Synthetic coding sequence
atggtgtcctctgtggtgggcttctatagtctgaggtttttcgggaacttcacgcctaagaaagatgataccacgatgaccaagatcatcgggaattgcgtttccattttggtcctatctagcgcacttcctgttatgtccagaactctggggttgcataaattacatctccctaacactagtagagactccgagactgcaagcgttatgacaagctctgctcgcgatacagggtttcatcacctgcaggcattaatgtgttag

SEQ ID NO: 122580 - DNA, 687 bp, Artificial Sequence
  Description of Artificial Sequence: Synthetic coding sequence
atggaggggcaggatgaagtctccgcaagggagcagcacttccacagtcaggttcgtgagtctaccatttgtttcctgctcttcgcaatattgtatgtggtaagctattttatcatcactcgatacaaacggaagtcggacgagcaagaagatgaggacgcaatcgtcaacagaatatcactgttcctgtccactttcacactggctgtctccgctggtgctgtgctccttctgccgtttagtattatctctaatgaaattctgctctcgttcccccagaactattatattcagtggcttaacggctccctgatacacggtctgtggaacctcgcctctttgttctctaatttgtgcttgttcgttcttatgccattcgccttcttttttctcgagagcgaaggatttgctggcctgaagaagggaatcagagccaggatacttgaaaccctcgtcatgcttctgctcctcgccctgctgatcctgggaatcgtctgggtggcttcagcactgatcgacaacgatgcagccagcatggagtcactgtacgacctgtgggaattctacttaccttatctgtattcttgtataagcctcatgggttgccttctgctgcatttgcctaatacgagcagagacagcgaaacggctaagccgagtgtcaatgggcatcaaaaggccctgtag

SEQ ID NO: 122581 - DNA, 1473 bp, Artificial Sequence
  Description of Artificial Sequence: Synthetic coding sequence
atggagggtcaagacgaggtgtccgctagggagcaacactttcacagtcaggttcgcgaaagcacaatatgcttcctgctgttcgccatcctctatgtggtgagttatttcatcataacacggtacaaacggaagtcggacgagcaggaagacgaagacgcgatcgttaatagaatctctttgtttctatcgacattcacactggcggtctccgcgggagccgtcttgctactccccttttccatcatctcgaacgagatcctgctcagcttcccccagaattactatatacaatggctcaacggcagccttattcacggtctctggaatctcgcatccttgttttcgaatctctgtctcttcgtcttgatgccctttgccttcttcttcctcgaatccgaggggttcgctgggctaaagaaaggcatacgtgcacgaattttggaaaccctggtgatgctgctcctcctagcgctgctgatcttgggcattgtgtgggtggcttcggcactgatagacaacgatgcggcttctatggagagtctctatgacctttgggagttttacctcccctacttgtacagctgcatatctctgatgggctgtcttctcctgctgctgtgcaccccagtgggtctaagccgcatgttcactgtgatgggccagctgctcgtgaagcccacaattctggaggatctggatgaacagatttatattatcaccctagaggaggaagccctccagagaaggctgaatgggctttcatctagcgtagagtacaatattatggagctcgaacaagaactcgaaaatgtcaaaacactgaaaaccaagcttgaaaggaggaaaaaggcatcggcttgggagcgtaacctcgtgtacccagccgtaatggtgctcctactgattgagaccagtataagtgtactccttgtagcctgcaacatactgtgtctgctcgtggacgagactgccatgccgaaaggtacccgggggccaggaatcgggaatgcctctctttccacgtttggcttcgtcggcgccgccctagagatcatcttgatcttttacctcatggtgagctcagttgtggggttttactccctgcgcttttttgggaattttacgccaaagaaagacgacacaaccatgacaaaaattatcgggaactgcgtctctatattggtcctctcttctgccctgcccgttatgagccgcactctggggatcacacgcttcgacctccttggggattttggccgatttaactggctgggaaatttctacatagtactctcttacaatctgttgttcgccattgtcactacactttgtctggtccgtaaattcacatccgccgtccgtgaggagttatttaaggccctaggactgcataagcttcatctgccaaacacttcccgcgacagcgaaaccgctaaacccagtgtgaatggtcaccagaaagccctgtag

SEQ ID NO: 122582 - DNA, 1596 bp, Artificial Sequence
  Description of Artificial Sequence: Synthetic coding sequence
atggagggccaggatgaggtcagtgcacgcgagcagcacttccactctcaggttagggaatccactatctgcttcctgctgttcgccatcttgtatgtggtatcttatttcataattactcgctataaaagaaaatccgatgagcaggaggacgaggacgctattgttaataggatatctctgtttttgagcactttcacccttgccgtatctgccggggctgtgctcttacttccgttctctatcatttccaatgagatcctgctctcgttcccccagaattactacattcagtggttgaacggaagccttattcatggcctgtggaacctggcgtccctgttctctaacctatgtctgtttgtcctgatgccctttgccttttttttcttagagagcgagggattcgctggactcaaaaagggaatccgcgcccgcatccttgagaccctcgtaatgttactgctgcttgccctcctaattctggggatcgtctgggtggcctctgctctcatcgacaacgacgctgcgtcaatggagagcctgtacgacctgtgggaattttacttgccatatctgtacagctgcatttctttgatgggctgcttgttgttactcctgtgtacccccgtgggactgtctaggatgttcacagtgatgggacagctgctggtgaagccaaccatcctggaggacctcgacgagcagatctacattattacactggaagaggaagcactgcagcgacgtctgaacgtcgggatgctgtgtgccggcaatcccgaggtcgccaccggcaggcaggtccccgaagaacaagctggccagctccttctcggaaagtggatccaagaaggaggagacatgatagccaatcctagactgtccagttctgtcgaatacaacatcatggagctcgaacaggaactggaaaacgtaaagacactcaaaaccaagcttgaacgacgaaaaaaggccagcgcttgggagaggaatcttgtttatccagcagtgatggtcctccttttgattgaaacaagtataagcgtcttgctcgtggcctgcaatatattgtgcctgttggtggacgagactgctatgccgaaggggaccagaggacctgggatcggtaacgcctccctctccaccttcggcttcgtgggtgcagctctggaaataattctgattttttatttgatggtatcttctgtagtgggtttttattctcttcgctttttcgggaattttacacctaaaaaggacgacactacgatgactaagatcatcggcaactgcgtgagcattctggtacttagctccgctttaccagtgatgtccagaactttgggtattaccagatttgatctgctgggcgactttgggaggttcaattggttaggaaacttctatatagtgctgtcatataacctcctgttcgccatcgtcactaccctctgcctcgtgcgcaaattcacgtccgccgtgcgcgaggagctattcaaagcgctggggctgcacaagctgcatctgcccaatacatctcgcgatagtgagacagcgaagcccagcgtgaacggccaccagaaggccctgtag

SEQ ID NO: 122583 - DNA, 855 bp, Artificial Sequence
  Description of Artificial Sequence: Synthetic coding sequence
atgctactgctgctcgcgctactgatcctggggatcgtttgggtggcctcggccttaatagacaacgacgcagcgagcatggagagcctgtatgatttgtgggagttctacttgccatatctgtattcctgtatcagcctgatgggctgtctgctgcttttgctctgcactccagttggcttgtcccgaatgtttactgttatgggtcaattgctggttaaaccaacgatcctcgaagatctggatgaacagatctatatcattacactggaggaagaggccctgcagcgacgcctcaacgggttaagctcgtctgtcgaatataatattatggagttagagcaggaactagagaacgtaaagaccctaaagacaaaactggaacgcaggaagaaggcctctgcctgggagagaaatctcgtgtatccagcagtgatggtgctgctgctcatcgagacatctatttccgtcttgctggttgcatgcaatattctgtgtctgcttgtggatgagaccgccatgcccaagggaactcgaggccctggcataggtaatgcctcgctttctactttcgggtttgtgggagctgctctggaaattattctgatcttctacctgatggtgtcttcagttgttggcttctatagtctgcgcttcttcggaaatttcacacctaaaaaggacgacacgaccatgaccaaaatcattggaaattgcgtaagcatcctggtgttgtccagtgcactacctgtaatgtctagaactctcggactgcataaactccacctaccaaatacttcaagggacagtgagacagctaagccatctgtaaacggtcaccaaaaagccctgtag

SEQ ID NO: 122584 - DNA, 1590 bp, Artificial Sequence
  Description of Artificial Sequence: Synthetic coding sequence
ggccaggatgaggttagcgccagagagcagcacttccactctcaggtgagagagtctaccatctgcttcctgctcttcgctatactttacgttgttagttattttatcatcaccaggtacaaacgcaagagcgatgagcaggaggatgaggacgctattgtgaatagaattagtttattcctctctaccttcactttggccgtcagtgccggggccgtcttactgctgccatttagtataattagcaatgagattctgttatcattccctcagaactattacattcagtggctgaatgggtcactgattcacggcctttggaatctggctagcctcttctcgaatctgtgtcttttcgtgctaatgccattcgctttctttttcctcgagtctgaaggcttcgccggcctcaagaaaggcattagagcccggatattggaaactctggtgatgctgttacttctcgccctgctgattctgggaatcgtgtgggtggccagtgcacttattgataatgatgcagccagtatggaatctctatacgacctttgggagttttatctgccatatctgtatagctgtatctccctgatgggctgtctgttgctgctgctgtgcaccccagtgggcctgagtcgcatgtttaccgttatgggacaattgctggtcaaacctacaatccttgaagaccttgatgagcagatttatatcattactctcgaagaggaggcgcttcagaggcggctgaacgtcgggatgttgtgtgccgggaacccggaggtggctaccggccgccaggtccccgaggaacaagctggccagttactacttgggaagtggatccaggagggaggcgacatgatcgcaaaccccagactgtcaagcagtgtggagtacaacattatggagttagaacaagaacttgagaatgttaagacactgaagaccaagttagagcggagaaagaaagcatcagcatgggagagaaacttagtgtaccctgctgtgatggtgctgctactcatagaaacatcaatatccgtcttgctggtggcttgtaatattctttgtctgctcgtcgacgaaacagctatgcccaagggcactaggggtcccggcattggaaacgccagcctgagcacctttggtttcgtcggggctgcactggaaatcatcttgatcttttacctgatggtgtcgtccgtggtgggcttctattctctacgattttttggtaactttacccctaaaaaagacgatactactatgactaaaattatcggtaattgcgttagtatattggtcctttcttctgccttgccagttatgtcaaggaccctcgggatcacacggttcgacctgctgggcgacttcggtcgatttaattggctgggcaacttctacatagtcctttcctataatctgctctttgcaatcgtgactactctatgtctggtgcgtaagttcactagcgccgttcgggaggaactgtttaaggccctcgggttacataaactacacctgcctaacacaagccgagattctgagaccgctaaaccatccgtgaatgggcaccagaaggcactctag

SEQ ID NO: 122585 - DNA, 1248 bp, Artificial Sequence
  Description of Artificial Sequence: Synthetic coding sequence
atgaaggaagatggccgggctgggcgcggtgttggggccggggctgctttaccacagccgtccgccggagtgcacgacgaacaggaagacgaggatgctatagtgaaccggatctctctctttttatcaacatttaccctcgcagtcagcgccggagctgtgctcctactgccattttcgataatttccaatgagatcctcctgagctttccccagaactactacatccaatggctcaacgggagcttgatccacggcctgtggaatttagcctcgttgttcagcaacctgtgcctgttcgtgctgatgcctttcgcattcttttttctagagtcagaagggtttgccggactcaagaaggggattagagcaaggattttggaaacacttgtcatgttactgctgctcgcactcctgattttgggaattgtctgggtggcaagcgctttaattgataacgatgccgctagcatggagtccttatatgatttatgggagttttacctcccctacctctattcttgtatctcactcatgggctgtttgctgctgttgctttgcactccggtgggcttgtcgcgcatgttcacggtgatgggtcagctactggttaagcccacaatcttagaggaccttgacgaacaaatctatatcataactctggaagaggaggccctgcaaagacgcctcaatggcctttcctcatcagtcgagtataacatcatggaactcgagcaggaactcgagaacgtaaagactctgaagactaagctggagaggaggaagaaagcctccgcctgggagcgcaatctggtttaccctgccgtgatggttctcctgcttattgagacatccatttcagtccttcttgtggcttgtaatattctttgcttgctagtggacgagacagccatgccaaaagggaccagaggccctggcattggaaatgcgagcctttcaacattcggatttgtcggcgccgccctcgagattatcctgattttttacctgatggtatccagtgtcgtgggattttatagtcttaggttctttggaaactttacccccaagaaagatgacacaactatgacaaagataatcggaaactgtgtgtccattctggtgctcagctctgcactccccgtgatgtcgcgaactctggggctgcacaagctccatcttcccaacacaagccgggacagtgaaaccgcgaagccctctgtcaacggccatcagaaggcactctag

SEQ ID NO: 122586 - DNA, 1470 bp, Artificial Sequence
  Description of Artificial Sequence: Synthetic coding sequence
atggaggcaccagactatgaagtgctgtcagtccgggagcagcttttccacgagagaattagagaatgcatcatctcgaccctgctctttgccaccctctatatcctctgccatattttcttgactcgttttaaaaagcctgccgagttcaccacagtggatgacgaagacgccactgtcaataaaattgcgcttgaattatgtactttcactcttgctatagcactcggagccgtgctgctgcttccattttccatcatttctaacgaggtgctgctgtctctgcccagaaactattatatacagtggttgaatgggtcattgattcacggcctctggaaccttgttttcctgttttcgaatctgtctctgatcttcctgatgccgtttgcttacttttttactgagagcgagggtttcgccggtagccgcaagggggtgctcgggcgggtctatgaaacggttgtcatgcttatgctgctgacccttctcgtactgggaatggtttgggtagcgtccgccatagtcgataagaataaagcaaatcgagaaagtctttacgatttttgggagtactatctgccatatctatacagctgtatctccttcctgggcgtactcctcctacttgtctgtacccctcttggtcttgcccggatgtttagcgtgacggggaaattgctagtgaaacccaggcttctcgaagacctcgaagagcagctttactgttccgccttcgaagaggctgcactgaccagacgcatctgcaatccaacctcctgctggttgccgttggatatggaattattacataggcaagtcctagcacttcagactcagagagtgctgctcgagaagagacggaaggcatccgcctggcagcgaaacttaggataccccctggccatgttgtgtctcttagtgcttaccggcctatccgtccttatcgtcgcaatccatattctggagctgctgattgacgaggccgccatgccgaggggaatgcagggcacctcgcttggccaggtgtctttttctaaactcggcagcttcggcgccgtgattcaggtggtactgattttctatctcatggtctcctccgttgtgggcttttactcctctcccctattccgaagcttgcggccccgatggcacgacactgctatgacccagattattggtaattgcgtgtgtttgctcgtcctcagctccgctctacccgtattcagtaggacactcgggctaacccgttttgacctcctgggagatttcggtaggtttaattggctaggcaatttctacatcgttttcttgtacaatgcagcctttgccggattgacaacactttgccttgtgaaaaccttcacagccgctgttcgcgccgagttgataagggcctttggcctagaccggctgcccctccctgttagtggattcccacaagcatccagaaaaacacagcaccagtag

SEQ ID NO: 122587 - DNA, 1455 bp, Artificial Sequence
  Description of Artificial Sequence: Synthetic coding sequence
atggtgaacgtgaaggccctgtgcgagccggaggtttcaaattgctggatgaatgttataaccggcactggctcggtgtcctcgcctcttctcgttctgcctcaacccggtccagagacgtcactcatgacaggcgagccggttgacgatgaggacgcaacagtcaataagattgcccttgagctgtgtacatttactctggctattgctttgggcgccgttttgctgctacctttctctataattagcaatgaggtgctgctatccttgccgcgaaactactatatccagtggctgaatggcagcttaattcatgggttgtggaacttggtgttcctcttcagcaacctgtccctaattttcctgatgccgttcgcctatttctttaccgaatctgaggggtttgcggggtcaaggaaaggggtcttagggcgggtttacgaaaccgtggtcatgttgatgttactgacactcctcgttcttggtatggtgtgggtcgcaagcgcgatcgtggataagaataaggcgaaccgggaatcactatacgacttctgggaatattatcttccttacctgtatagctgcatcagctttctaggcgtgctgcttctcttggtctgcacccccctggggttggccaggatgttcagcgtgaccggcaagctcttggttaagccccgtctgctggaggatctggaggagcagctgtactgtagcgctttcgaggaagctgcgctcactcggcgcatttgcaatccaacaagttgctggctacccctggatatggagttactgcacaggcaagtgctggcgctccagacacaacgcgtgttactagagaagcgtcgaaaggcgtctgcctggcagcggaatttggggtatcctctggcgatgttgtgcctcctggtgttaacgggtctcagcgtactgatcgtcgccatccatatcctggagctgttgattgatgaagctgcaatgcctcgcggcatgcaagggacatctctcggtcaagtgtcttttagcaagttgggctcttttggcgctgtcattcaggtcgtgctgatattttatctcatggtaagctcagtggttggtttctattccagcccactattccggtcactccgcccaaggtggcacgacacggctatgacgcagatcattggtaattgcgtgtgcctgctggtgctgtcgtccgccctccctgttttctctcgcactttgggccttacacgatttgacctgctgggtgacttcggtcgctttaattggttgggaaacttttacatcgtttttctctacaatgccgcattcgcaggcttaaccaccctttgcttggtgaagacgtttaccgcggctgtgcgtgctgagctgatccgcgccttcggcctggatcgattaccactaccagtgagcggctttccccaggcctctcgtaaaacccagcaccagtag

SEQ ID NO: 122588 - DNA, 1410 bp, Artificial Sequence
  Description of Artificial Sequence: Synthetic coding sequence
atggaggctcctgactacgaagtcttatctgtgcgggaacagttatttcacgagcgaatacgagaatgtataataagcaccctgctgtttgctaccctgtacatcctgtgccacatctttcttacacgattcaagaagcccgctgaattcacaacggtcgatgacgaagacgccaccgttaacaagatcgccttggagctatgtactttcacgcttgccatcgcactgggtgcggttcttctgctgcccttttctataatatccaacgaggtgctactgtcattgccacgcaattattacattcaatggctgaatggctccctgatacacgggctatggaaccttgtctttttgtttagcaatttgtccctcatcttcttgatgccctttgcctatttttttaccgaaagtgaaggctttgctggcagtaggaagggggtgctcggaagagtatacgagaccgtcgtaatgcttatgttgctgacccttttggtcctcggcatggtttgggttgcctctgcaatagtggataagaacaaggcaaacagggaatccctctacgacttttgggagtattacctcccctacctgtattcctgtatctccttcctgggggtgctgctgctgcttgtgtgcaccccactaggactcgccagaatgttcagtgtgactgggaagctacttgtgaagccacgcttgctggaagacctggaagagcagttgtactgctccgcgtttgaggaagcggccctgaccagacgcatttgcaaccctacatcctgctggctgccgctggatatggagttgctgcacaggcaagtcttggccctccagacgcaaagagtgctgcttgaaaagcggaggaaagcttctgcttggcagaggaatttaggatatcctttagccatgttgtgtctacttgtgctgaccggactcagcgtgctgatagtggcaattcatatccttgagctcctgatcgacgaggctgccatgcctagagggatgcaagttgtactcatattctatctgatggtctctagcgtagtaggcttctacagcagccccctgtttagaagtctacgccctagatggcatgacaccgcaatgacccagatcataggcaactgtgtgtgcctgttggttctgtctagcgccctcccagtcttctcccggactctcggactgactcggttcgatctcttgggcgatttcggaagattcaactggttgggaaacttctatattgtgtttttgtacaacgcagccttcgcgggcctgaccaccctgtgtctggtgaaaacctttaccgctgctgtgagagctgagcttattcgggcattcgggctcgatcgattgccgttacccgtgagtgggtttccccaggccagtcgaaaaacccaacatcagtag

SEQ ID NO: 122589 - DNA, 384 bp, Artificial Sequence
  Description of Artificial Sequence: Synthetic coding sequence
atggaggcacccgattatgaggtcctaagcgtgcgtgagcagctattccatgagcggattcgcgaatgtatcatcagtactctgttattcgccacactctatattctttgtcatatctttctgactagatttaagaagccagccgagtttacgacggtcgacgatgaagacgcaacggtaaacaaaatagcactggagctgtgtaccttcacactagcaatcgcgttaggagctgtcttgctgctacccttttccataattagcaatgaggtgcttctctccctacctcggaactactacatccagtggcttaatggctccctaattcatgggctttggaatctggtatttctgttctcaaacctgagtctgatcttcctctag

SEQ ID NO: 122590 - DNA, 1017 bp, Artificial Sequence
  Description of Artificial Sequence: Synthetic coding sequence
atggttcgccgcgtgcagccggatcggaaacagcttcccctggtactcctgagattgctctgcctgctcccaaccggtctgccggttaggagcgtggatttcaacagggggacagacaatattactgtcaggcagggggacacggctattcttcgatgcgtcgtagaagataagaattcgaaagttgcctggctgaatcggtcaggaataattttcgcgggacacgataaatggtcccttgacccaagagtcgaattggagaaacggcacagcttagagtattcactgcgcattcagaaggtggatgtgtatgacgagggctcctatacatgttctgtccagactcaacatgagcccaaaacaagtcaagtctacctgattgtccaggtgcccccaaagattagcaacatctcctcagatgtcactgtaaatgaggggtcaaatgtgacactcgtttgcatggcgaatggccgccccgaaccagtcatcacgtggcggcatctgaccccaactggaagggagtttgaaggggaggaagagtacctggagatcctcggcatcacaagggagcagtccggaaaatatgaatgcaaggccgctaacgaggtgagttccgctgatgtcaagcaggttaaggttacagtcaattaccccccgaccatcaccgaatctaaaagcaacgaagcaacaacagggagacaagccagcttgaagtgcgaagcatccgctgtgcctgctcctgatttcgagtggtacagagacgacacacgcattaattccgcgaatggactggagatcaaatccacggaaggtcaatcctctctgactgtgacgaacgtcacggaggagcactacgggaactacacctgcgtcgccgcaaataaacttggagtgacgaatgcctctttggttctgtttaggcccggctctgtgcggggaataaacgggtcaatctcattagcagtccctctttggctgttagcagcctccctcctgtgtctactctccaaatgttag

SEQ ID NO: 122591 - DNA, 1077 bp, Artificial Sequence
  Description of Artificial Sequence: Synthetic coding sequence
atgagaacctactggcttcattcggtgtgggtactgggatttttcctttcgcttttttcactgcagggacttccggtgcggtctgtggactttaacagagggacagataacattaccgttagacagggggacacagcaattctgcgctgcgtggtagaagacaagaactctaaggtggcatggctgaacaggtcagggattattttcgctggccacgacaagtggagtctggatcctcgcgtggaactcgaaaagcggcactccctagagtactccctacgcatccagaaggtggatgtgtacgatgaggggtcctacacgtgttccgtgcagacccagcacgagcccaaaacttcacaagtctacttgatcgtgcaggtcccacctaagatttcaaacatttcaagtgatgtgaccgtgaacgagggctccaatgtgactttggtgtgtatggccaacggcaggcccgaacctgtgattacatggagacacctgacacctactggccgagaattcgagggggaagaggaatatctggaaattctgggtatcactcgcgagcagagtggtaagtacgaatgcaaagccgctaacgaagtcagcagcgctgatgtcaaacaggtgaaggtgacagtcaactatccaccaacgatcaccgagagcaagagtaacgaagctacaactgggcggcaagcatcattgaagtgcgaggcatcggcagtgcctgcccctgactttgaatggtatagagacgatacaaggatcaacagcgccaacggactggagattaagagcacggagggtcagtcatctctcactgtgacgaacgtgacggaggaacattacggcaattatacttgcgtggctgcgaacaaactcggcgttaccaatgcatctctggttctgtttaaacgtgttctgcctactattcctcaccccatccaggaaataggtactaccgtccattttaaacagaagggtccgggcagcgtgcgtggtatcaacggaagcatcagccttgccgtaccattgtggctgcttgctgcatctttattatgcctcctctctaagtgctag

SEQ ID NO: 122592 - DNA, 753 bp, Artificial Sequence
  Description of Artificial Sequence: Synthetic coding sequence
atggctgaaggcggtgccagcaagggagggggtgaagagccgggcaagctccctgaacctgctgaggaagagagtcaggtgttgagagggacaggacactgtaaatggtttaacgttaggatgggatttggatttatctccatgattaatagagagggcagtccccttgatatcccagttgacgtctttgtccaccagagtaaactgtttatggaaggtttcaggagccttaaggaaggcgagccggtggagttcaccttcaagaagtcaagcaaggggctagagtcaatccgggtgacggggcctgggggtagcccatgtttgggaagtgaaagacgcccaaaagggaagactctgcagaagaggaaaccaaaaggcgatcgttgttacaactgcgggggcctggaccaccatgcaaaagaatgttctcttccgcctcagccaaaaaagtgtcattactgccagtccatcatgcatatggtggctaattgtccccacaaaaacgtggctcagcctccggcgtcctctcaaggccggcaggaggccgagtctcagccttgcacatctaccttaccccgagaggtgggcggtgggcacggttgcacatccccaccgttcccccaagaagcgcgtgccgagatctcagaacgaagtggacggagccctcaggaggcttctagcaccaagagcagcatagcacccgaagagcagtctaaaaaagggccatctgtacagaaacgcaaaaagacctag

SEQ ID NO: 122593 - DNA, 2250 bp, Artificial Sequence
  Description of Artificial Sequence: Synthetic coding sequence
atggaagtcgtgccggctgaggtcaactcactgctgcccgaggaaataatggatactgggataaccttagtggacgatgattctatagaagcagtgattgtttcatcgccaatcccaatggagacagagttggaggagatcgtgaacattaacagcacaggcgactctacagcgactccaatttctaccgagcccatcactgtctactcaaaccatactaaccaagttgctgttaacactactattacaaaagcagatagtaacacaaccgtaaaaccagcctttcccagtggattgcagaagttaggggcccagacaccggtcacaatctctgctaatcaaattatactcaacaaggtgagtcagacctctgatctcaagctcgggaatcagactctgaaaccggacggccaaaaactgattctgactacactcggaaaaagcggcagccccatcgtgctagcccttcctcattctcagctgccacaggctcagaaagtaacgacccaagcccagtctggggatgccaagctgcccccacagcagataaaagtcgtgaccatcggcggacgccctgaagtgaagcctgtgattggtgtctcagctctgactccaggttctcaattgattaacaccacaacacagccatctgtcctgcaaacacagcagctcaagacagttcagatcgccaaaaaacctagaacacccacatccgggcccgtcatcacaaagctgatttttgctaagcctatcaactccaaggcagtgacaggccaaaccacccaagtgagtcctccggttatagctggacgggttctgtctcagagcaccccgggaaccccctccaagactatcacaattagcgagtccggagtcattggctccaccttgaactcgactacccagactcccaacaagattgcgatatcaccactgaagagtccaaataaagcggtaaagtcaactgtacaaacaataactgtggggggcgtcagtactagccaatttaagaccatcattcccctggctacggctcctaatgttcagcagatccaggtgccagggtcaaaattccactatgtccggctcgtgactgcaacgtcagcaagttcatccacacagcctgtctctcagaacccatccacgaatacacagcctcttcagcaggcaaagcctgtcgtggttaatacgacacctgttaggatgtccgtgcctattgtgagcgctcaggcagtgaaacaggtagtgccaaaacctatcaacccaacctcacaaatcgtgaccacctcccagccccagcagcgcctcatcatgccagcgacccccctcccgcagattcaacccaacctcaccaacctgcctcctggaacagtgctcgccccggcccccggcacagggaacgtcggttacgccgtcctgccagctcagtacgtcacgcagcttcaacaaagttcctatgtgtccatcgctagtaatagcacttttaccggcactagcgggattcaaactcaggccaggctgccattcaacggaatcatccccagcgaatccgcatcgaggccaagaaagccctgtaactgcacaaagtccctctgtctgaaactgtactgcgattgctttgcaaatggggaattctgcaataactgtaactgtacaaattgctataacaaccttgaacacgagaatgagcgacaaaaggccatcaaggcctgcctggaccgtaaccccgaagcctttaaacccaagatcggcaaaggtaaggaaggagagtcagaccgcagacacagtaagggttgcaattgcaaaaggagtggctgccttaaaaactattgtgagtgctatgaagccaaaattatgtgttcatccatttgcaagtgcatagggtgcaagaattttgaagaaagtccggagagaaaaaccctgatgcatctggcagatgcagctgaagtgcgggttcagcagcagacagccgccaagaccaagctttcctctcaaatctctgacctgcttactaggccaacacctgcattgaactccggcggaggcaaactccctttcacatttgttactaaagaggtcgctgaggctacctgcaattgcctgctcgcccaggccgagcaggccgacaagaagggaaaaagcaaggctgcggccgaaagaatgatccttgaggaatttgggaggtgcttaatgtccgtgattaactctgccgggaaagccaagtctgacccctgtgctatgaattgttag

SEQ ID NO: 122594 - DNA, 732 bp, Artificial Sequence
  Description of Artificial Sequence: Synthetic coding sequence
atggaagtggtgcctgccgaagtgaacagcttgttacctgaggaaataatggacaccgggatcacactcgtcgatgatgacagtattgaggctgtgatcgtgagtagtcccatccccatggaaacagaactggaggagatcgtgaacatcaactcaaccggggattcaactgctacccctatctccaccgagccaatcaccgtctattccaatcataccaatcaagtcgctgtgaataccaccataactaaagccgacagtaacaccacagtcaaaccggcattccccagtggccttcagaagctgggggcacaaacccctgttaccatcagcgccaatcagatcattctgaacaaagtatcccagacttctgacctgaaactcggcaatcagactttgaaacctgacggtcagaaactgatactgaccactctcggtaagtcgggcagccctatcgtgcttgcgcttccccatagtcagttaccgcaagcccagaaagtgaccacacaagcacaatcaggggatgccaagctgccacctcagcagatcaaggtagtcaccattgggggccgaccagaagtgaagcccgttattggagtttctgctcttactcccggatctcaattaatcaataccacgactcagccatcagttctccagacccagcagctgaaaaccgtgcaggtgggcttcttccactcacttctgccagagttgcaccagaggccctag

SEQ ID NO: 122595 - DNA, 1983 bp, Artificial Sequence
  Description of Artificial Sequence: Synthetic coding sequence
atggaggtggttccggccgaggtaaatagccttctgcccgaagagatcatggacacgggtattaccttggtggatgatgacagcattgaagcggtgattgtgagcagccccatccctatggaaacggaactcgaggaaattgtgaacataaactccactggagactctaccgcaactccaataagtactgaacccattaccgtctactccaaccatacaaatcaggtggccgtcaatacaactatcaccaaagccgattctaatactaccgtcaaaccagccttcccaagcggccttcagaagttgggcgcccagactccagtgaccatctccgctaaccagattatcttgaataaagtaagtcaaacctccgatctcaaattaggcaatcaaaccctgaagcctgatggacagaaactgattctgacaaccttggggaagtctgggtcacccatcgtcctcgctttgccccattctcagttgccacaggcacagaaggtgacaacccaagcgcagtccggtgacgctaaattgcccccacagcagattaaagttgttacaatcggcggacgacccgaggttaagcccgtgattggcgtgagcgccctgaccccaggcagccagttaatcaacacaacgacacaaccctccgtattacagacacaacaactgaagactgtccaggcggtcaagagcacagttcaaaccattactgtgggtggagtgagcacgagccaatttaagactattattcccttagccactgccccaaacgtgcagcagatccaggtccccggcagtaagttccattacgtgagactggtcacagcaacctcagcctcttcctcaacccagcccgtctcacagaacccctcaaccaacacgcagccgctccagcaggccaagccggttgtagtgaacacgacccccgtgaggatgtccgttcctattgtgagcgcccaggctgtgaagcaggttgtcccaaaaccaattaatccaacctcgcaaattgtgactacatcccagcctcaacagcggctgatcatgcctgcaacccccctgccacagatccagcctaatctcacaaacctgccacccggcacagttctagccccggcacccggaaccggcaacgtaggctatgccgtgctccccgcccaatatgtgactcagctccagcagtccagctatgtgtccattgcctccaattcaacctttaccgggacaagcggtatccagacccaggccagactgcctttcaacggcatcattccttctgagtctgcttctcgcccgcgcaaaccctgcaactgtaccaaatccctctgcctgaagctttattgcgattgtttcgcaaacggcgagttttgtaataactgtaactgtaccaattgttacaataaccttgaacatgagaatgagcggcagaaagcaatcaaagcctgtttggacagaaatcccgaagcgttcaagcccaaaattggcaaggggaaggaaggggaaagcgataggagacacagcaagggatgtaactgcaaaagaagtggatgtttgaaaaactactgcgagtgttatgaagccaagatcatgtgttctagcatatgcaagtgcattggttgtaagaactttgaggagtcacccgagcggaagaccctgatgcatttagccgacgcggccgaggtcagagtgcagcagcaaacagctgcgaaaactaaactttctagccagattagcgacctgctgacacggccaacgccggcactcaattccggaggcggcaagctgccattcaccttcgtgacaaaagaggtcgcagaagccacgtgtaactgccttctggcccaggctgaacaggctgacaagaagggcaagtctaaagcggccgccgagaggatgatcctcgaagagttcggcagatgcctcatgtccgtcatcaatagtgcgggaaaggctaaaagcgatccatgtgccatgaactgctag

SEQ ID NO: 122596 - DNA, 1587 bp, Artificial Sequence
  Description of Artificial Sequence: Synthetic coding sequence
atggaagtcgtcccagctgaaattgcgaaaaagccccggaccccaacttcaggtcctgtgatcaccaaactgatattcgccaaacccattaattccaaagctgtgaccggacaaaccactcaggtcagcccacccgtgatagctggccgagtgctaagtcagagcactccaggcactccaagtaagacaattacgatatcagagtcaggcgtcattggttcaacactcaacagcacgacccagactccgaataagattgctataagcccgctgaaatcaccaaataaagcggtcaagagtaccgtacaaaccataaccgtgggcggagtctcaacctctcagttcaagacgatcatccctctcgctaccgccccaaatgtccagcaaattcaagtgcccggcagcaaattccattatgtgcgcttggtaacagccacatctgccagcagttccacacagcccgtgtcccaaaacccaagcactaacacacaacctctgcagcaggccaaaccagtggtagtgaacacaacccctgtacgaatgagcgtgcctattgtctctgctcaggccgtgaagcaggtggtccctaagcccatcaacccaaccagccagatcgtcacaacttcacagccacagcagcggcttattatgcctgccacaccgctgccacaaattcagcctaacttgacaaatctccccccgggaaccgtgttagcccccgcccctggaactggaaatgtcgggtatgctgtgctgccagcacagtacgtcacacagcttcagcagagctcatacgtgtctattgcaagcaattcaacctttactgggacgagcgggattcaaacacaggcccggttacccttcaacggcatcattccaagcgagtccgccagcaggcctaggaagccctgtaactgtacaaagagcctatgcctcaaattatactgcgattgttttgccaatggcgaattctgtaacaactgcaactgtacaaactgttacaataacttagaacatgaaaacgagagacagaaagccataaaggcctgcctcgatagaaatccagaagcgttcaagcccaagatcggcaaggggaaagagggggagagcgacaggcgccattctaaaggatgcaactgcaaaaggtccgggtgcttaaagaactactgtgagtgctatgaagccaagattatgtgtagcagcatctgtaagtgcatcggctgtaaaaacttcgaagaaagccccgagaggaagactctgatgcatctggcagatgccgctgaagttagagtccagcagcaaactgctgcaaaaactaaactgtcttcacaaattagtgacctgctgactcgccccactcccgccctcaactcagggggcgggaagctgccatttacttttgtgacaaaggaagtggccgaagccacatgcaattgcttgctggcacaggctgagcaagcagataagaaaggtaaatctaaggccgcagctgagaggatgatactggaggaatttgggcggtgcctgatgtcagtgatcaacagcgcaggtaaagcgaaaagcgatccatgtgccatgaactgctag

SEQ ID NO: 122597 - DNA, 1587 bp, Artificial Sequence
  Description of Artificial Sequence: Synthetic coding sequence
atggaggtggtccccgccgagatcgccaaaaaaccccggaccccaacttcaggaccagtgatcacgaagttgatcttcgcaaagcccatcaattctaaagctgtcaccggacagacaacacaggtctcaccacctgttattgccggaagggtcctgtcacagagcaccccgggtactccctctaagaccattaccatatcggaaagcggggtgatcgggtccacactgaattccactacgcagaccccaaacaagatcgccatctctcccctgaagtcgcccaacaaagccgtgaaaagcactgtacagactataacagtgggcggtgtgtctacctcgcagtttaaaaccattatccctttggcaaccgccccgaatgtacagcagatccaggtgcctggatcaaaatttcactacgtgcggctcgtgacggccaccagcgctagtagctccacgcagccagtttctcaaaaccccagtacaaatacgcagcccctccagcaggcaaaaccggtggtcgtcaatactacccctgttcgaatgtcagtgcccatagtgagtgcccaggcagttaaacaggttgttcctaagcctatcaacccgacatcccagatcgttactacaagtcagccacaacagagattgattatgcccgccacaccactaccccagattcagccaaatctgactaacttgccgcccggcactgttctagcccctgctcccggcaccggtaacgtgggttacgcagtactacctgcccagtacgttacccagctgcaacaatccagctatgtgagcatcgcttccaattccacattcactggaacaagtgggatacaaacacaagcccggttacctttcaacggtattataccttctgagagcgccagcagaccaaggaaaccatgtaactgtaccaaatccctctgtcttaagctctattgtgattgctttgccaacggcgaattctgcaacaattgtaactgtacaaactgttataataatctcgagcacgagaatgagaggcaaaaagccataaaagcgtgcctggatcgcaacccagaggcatttaaacctaaaatcggcaaagggaaggaaggcgaatcagatcggaggcattccaaggggtgtaattgcaagcgatcgggctgcttgaaaaattattgtgagtgttacgaagctaagatcatgtgctcctctatctgcaagtgcatcggatgtaaaaactttgaggagtcacctgagcgcaaaaccctcatgcacttagccgacgctgccgaggttagagtgcagcagcagaccgcagcaaaaaccaaactctcctcacaaatcagcgatctcctgacccgccccacgcccgcactgaattccggaggaggtaaacttccatttacatttgtgaccaaggaagtggccgaagctacctgcaattgtctcctggcccaggcagagcaggccgataaaaaggggaaaagtaaggccgctgcagagaggatgattctggaggagttcggtcggtgcttgatgtccgtgatcaactctgctggaaaagctaaatctgatccctgtgccatgaattgttag

SEQ ID NO: 122598 - DNA, 2250 bp, Artificial Sequence
  Description of Artificial Sequence: Synthetic coding sequence
atggaggtggtacccgcggaggtgaattctcttttaccagaagagattatggataccggcatcactctggtcgatgacgacagtatcgaggccgtcattgtcagtagccccatccccatggagacagaacttgaggaaatcgtgaatattaattctaccggtgattccactgcgaccccgatatccaccgagcccatcactgtgtatagtaaccataccaatcaggtcgccgtaaataccactataacaaaagctgattccaacacaacggtgaagccagcgtttccatctggcctccaaaagctgggggcccagactcctgtaaccatctcagccaatcaaatcattttgaataaggtttcacaaacatcagaccttaagctgggcaaccaaactctgaagccagatggccagaagctaattctcaccactcttggtaaaagtggatcccctatagtactagcactaccacacagtcagcttcctcaggcccagaaagtcacaacccaagcgcagtctggggacgctaagctgcctccacagcagatcaaggtagttacaataggaggccgcccagaagtgaaacctgtgattggggtcagcgctttgacaccggggtcgcagctcatcaacacaaccacccagccctccgtgctacaaactcaacagctgaaaacagttcagattgccaagaagccccgcacgcctacaagcggcccggtaatcactaaactcatatttgctaagccgataaactctaaggcggtcactggacagacaacccaggtaagcccccctgtgatcgcaggtagagtcctctcccagtctacccctggaaccccaagtaagacaatcaccatcagtgaaagcggagtgattggctcgaccttaaattcaacgactcaaacgccaaacaagattgcaatctccccactcaagtctcctaacaaggctgttaagagtacagtacagacaattactgtaggaggggtgagtacatcgcagttcaagacaataataccacttgctacagcacctaatgtacagcagatccaagttccgggttcaaaatttcactatgttaggctggttacagccacctccgcaagctcctccacgcagcctgtgagccagaatccttccaccaacacacagccattgcagcaggcaaaaccagttgtggtcaacactacgccagttagaatgtctgtgcctatcgtgagcgcccaagccgttaagcaagtggtgcccaagccaattaaccctacaagccagatcgttaccaccagccaaccccagcaacggctgatcatgcctgcaactccactcccccagattcagcctaacctcactaacctgcccccggggactgtcctagcacccgcgcctggaactggcaacgttgggtatgccgtactccctgcccagtatgtgacgcagctacaacagtcttcctacgtgtctattgctagtaacagcacatttactggcacgtccggaatccagactcaggccagactgccctttaacggtatcatcccctcggaatccgcctctcgtcccaggaaaccctgcaactgcacgaaatctctgtgcttgaagctgtattgcgactgctttgcgaatggtgagttctgtaacaactgtaattgtacaaattgttataataatctggaacacgagaacgagcggcaaaaagccattaaggcctgtttagaccggaacccagaggctttcaagccgaagataggcaagggcaaagaaggagagtcagaccggaggcactcgaagggttgcaattgcaagcgatcggggtgtctgaaaaactactgcgagtgctatgaggcaaagatcatgtgtagttccatttgtaaatgcatcgggtgtaagaatttcgaggaatcacccgagagaaagaccttgatgcacctggccgatgccgcagaggtccgtgtgcaacagcagactgccgcaaaaaccaagctctcctctcaaatttccgacttactgacccgaccaacccccgctctgaattccggcggtggaaagctgccgtttacgtttgtcaccaaagaggtggcggaagcaacatgtaattgcttgttggcccaggcagagcaggctgacaagaaggggaaaagtaaggctgccgctgagcgaatgatcctggaagagtttggaagatgcctgatgtccgtgattaactccgcaggcaaggccaaaagcgacccttgtgcaatgaattgctag

SEQ ID NO: 122599 - DNA, 1587 bp, Artificial Sequence
  Description of Artificial Sequence: Synthetic coding sequence
atggaggtggtcccagccgaaattgccaaaaagccaaggacccccacttccggccccgtcatcacaaaattaatcttcgcaaaacctatcaactccaaagccgtgactggacagaccacacaggttagcccaccagtgattgctggccgggtactgtcacagtctacacccggtactccctcaaaaaccattaccatctcagagtctggcgtcattggaagtaccttgaattcgaccacccagactcctaataagatcgctatttcccccctcaaatctcccaacaaagccgtgaaaagcactgtgcagacaatcactgtgggtggcgtgtcaacctcccagtttaagactattataccacttgccaccgcccccaatgttcagcaaatccaagttcctggcagcaagttccactatgttaggctggtgaccgccacaagcgccagctcctcaacacagccagtctctcagaacccatcaacaaacactcagcccctccagcaggccaagcccgtggttgttaacacaactccagtgcggatgtcggttcctatagtgagtgctcaagcggttaagcaggtggtccctaaacccataaaccccacaagtcagatcgtgaccacctctcagcctcagcagcgtctcatcatgccagcaacgcctctgccccagattcagcctaacctcaccaaccttcctccaggaacagtcttggctcccgcccccggaaccggtaatgtcggatatgctgtcctcccggcccagtacgttacacaactacagcagtcaagttatgttagcatagctagcaatagtactttcacagggacaagcggcatccagacacaagctcggctaccctttaatggtatcatccccagcgagagcgcatcccggccacggaagccctgtaactgtactaagagcctgtgtctgaagctgtattgcgactgcttcgctaacggagaattctgtaacaactgcaattgcactaactgttacaataatctagaacacgagaatgaacggcaaaaagcgatcaaagcatgtcttgatcggaatccagaagcgttcaaacccaagataggcaaaggcaaagaaggggagagtgataggaggcactctaaaggctgcaattgcaagcgttccggttgtttgaagaattactgtgagtgctacgaagccaaaatcatgtgttccagcatctgtaaatgtattgggtgcaaaaacttcgaagagagccctgagagaaagacgctcatgcaccttgccgatgccgctgaggtgagggtccaacaacagacagcggctaagactaaattgagctcgcagatctccgatctattaacccggcccactcccgccttgaacagcgggggaggtaaattgccattcacctttgtcacgaaagaggtcgcagaagcaacttgtaactgtctactggcccaggccgagcaggccgataagaagggcaagtccaaggcagccgccgagcgcatgatcctcgaagagttcggacgatgtttgatgagtgtgatcaattccgccggtaaggcaaaatcagacccttgcgccatgaactgctag

SEQ ID NO: 122600 - DNA, 2025 bp, Artificial Sequence
  Description of Artificial Sequence: Synthetic coding sequence
atgtggcatgaagctcgcaaacatgaaaggaagttacgaggaatgatggtggactataagaagcgggctgaaagacggcgcgaatattacgaaaagattaaaaaggatccggcccaattccttcaagtgcacggtagagcatgtaaggtccacctggacagcgcggtggctttagcagccgaatctccagtcaacatgatgccttggcagggtgataccaataatatgatcgatcgcttcgacgtacgggctcacctggaccatattcccgactacactccccccttactcactacgattagtcctgagcaagaatctgacgaaaggaagtgcaattacgagaggtacaggggcctggtgcagaatgatttcgctggaatctctgaagagcagtgcctctaccagatttacattgacgaactgtacgggggcctgcagcgaccaagtgaagatgagaagaaaaagctcgctgaaaagaaggcatcaatcggctatacatacgaggattccacagtagccaaggttgagaaagcagccgagaagcctgaggaggaggagtcagccgccgaggaagaatccaacagcgatgaagacgaggtcattcccgacatcgacgtggaagtcgacgtagatgagctcaaccaggaacaggtagcagacctcaacaaacaagccaccacatacgggatggcagacggcgactttgtcagaatgttgcggaaagacaaggaggaggcagaagccatcaagcacgccaaagctctagaagaggagaaggcgatgtattccggcagaaggagcagaagacagcggcgggaattcagggagaaaaggctcagggggcggaagattagccctccatcttacgcgcgcagggattctcccacctacgatccgtacaagcgtagcccatcggaatcatcttctgaaagccgaagcagaagtaggtcacccactccaggacgcgaggagaaaattacattcattacatcctttggcgggagcgacgaggaggctgcagcggccgctgccgcagcagccgcctcaggtgtgaccacaggcaaacccccagctcccccgcagcctggaggacctgctccaggacggaacgcatctgctagacggcgctcatcctcctcctcttctagttcctcagcctccaggaccagcagcagtaggtcttcaagcaggtctagcagtagaagccgcagaggcggaggctattatagaagtggtagacacgcacggtcacgctctagatcttggtcccgcagccggtcacgcagtagacggtattctcgcagtcggtctagggggagacgacactctggagggggtagtcgggacggacacagatactcgcgctctcccgcccggcgcgggggctatggacccagaaggcgcagtagatcccgctcccacagcggcgatcgttaccgtcggggggggcgagggctacgccaccattccagttccagaagccggagctcctggtcccttagtcccagccggtctcgatccttaacgagatcccggagccatagcccttctccttctcagagtcgctcgaggtctaggagcaggagtcagtctccaagcccttcccccgctcgggagaaacttacaagacctgctgcatcccctgctgtcggcgagaaactaaagaagaccgaacccgccgctggcaaagagacgggggctgctaagccaaagttaactccacaggaaaaattaaagctgcgcatgcagaaggccctgaaccgccagtttaaagcggacaagaaagccgcccaggaaaaaatgatccagcaggagcacgagagacaggagcgcgaagacgagctgcgcgccatggctcggaagattaggatgaaagagcgcgagcggcgcgaaaaggaacgggaagaatgggagcggcagtacagtcgacagagccgatcacccagtccaaggtatagccgggaatactcatcctctaggaggagaagtagatcaagatctcggagtcctcattatagacactag

SEQ ID NO: 122601 - DNA, 594 bp, Artificial Sequence
  Description of Artificial Sequence: Synthetic coding sequence
atggctgcattaggcgaacctgtgaggctcgaacgggacatttgccgcgccatcgagctgcttgagaaactccagaggagcggtgaggttcctccccagaagcttcaggcattacagcgagtccttcaaagcgagttttgcaacgccgtacgggaagtctatgagcatgtctatgagactgttgatatttcatccagtcctgaggtgcgtgccaacgccacagccaaggcaacagtggccgcgtttgcagcgtctgaagggcattcccacccccgggtggtggagcttccaaaaaccgaggaaggcctcggatttaacattatgggagggaaagaacagaattctccaatctacatctcacggatcatacctggcggcatcgctgataggcatgggggactgaagagaggtgatcagctcctgtctgtgaacggggtgtctgtcgaaggtgaacatcatgagaaagccgtcgagttgttaaaagccgctcaaggaaaagtcaagctggtggtcagatatactccgaaggtgctggaggagatggagtcacgtttcgagaaaatgagaagcgctaagagacggcagcaaacatag

SEQ ID NO: 122602 - DNA, 759 bp, Artificial Sequence
  Description of Artificial Sequence: Synthetic coding sequence
atggaagaggccattctggttccttgtgttctcggtcttctgctgctgcccatactggcaatgctaatggctctttgtgttcattgccataggcttcctgggagctatgactcgacgtcctccgattctctctatccccgcgggatacaatttaagcgcccacatacagttgctccatggcccccggcttatccaccagtgacctcctatccacccttaagtcagccagacctcctgccaatcccacggtctccccagccccgcagagactcagatggcgcaaattccgtcgcctcttatgagaatgaaggagcctctgggatacggggtgcccaagctggttggggagtttgggggccctcgtggacccgattgacacctgttagcttgcctccggagccggcctgcgaagatgcagacgaagatgaagacgactaccacaatccaggatatttagtagttctgcctgattcaacaccagcaacaagtaccgctgccccttccgctcctgctctgtcaactcccggcattagagactccgcatttagcatggagtctatcgacgattatgtgaacgtcccagagtcgggagaatctgcagaagccagccttgatggaagccgggagtatgtcaatgtaagccaagagcttcatccgggagcagccaaaaccgagcccgccgcattaagttctcaggaggccgaggaagtcgaggaagagggcgctcccgactacgagaacctacaggagctgaactag

SEQ ID NO: 122603 - DNA, 789 bp, Artificial Sequence
  Description of Artificial Sequence: Synthetic coding sequence
atggaggaggcaatcctcgttccttgtgtgcttggcctgctgttattgcctattcttgccatgctgatggcgttgtgcgtgcactgccataggctgcccggctcttatgactctacttccagtgattcgttgtacccgcgcggaatccagtttaagaggcctcacacggtggctccctggcctccagcttatcctcccgtgacatcttacccaccgctgagccagcccgacctgttacctattccaaggagcccgcagcctctggggggcagtcacagaacaccaagtagcaggcgggactctgacggggccaattctgtggcaagttatgagaacgagggggcttctggcatccggggtgcccaggctggttggggcgtgtggggtcctagttggacccggctgacgcctgtatcccttccacccgaaccagcctgcgaagacgcagacgaggacgaggacgattatcacaacccgggctacctagtggttctgccagatagcacaccagcaaccagtactgcagcccctagcgcgccagccctgagtaccccaggcatcagggatagcgccttctccatggagtccatcgacgactatgtcaacgtcccagagtcgggggagagtgccgaagcctcgttagatggaagccgagagtatgtcaacgtgtcccaagagctgcatccgggtgccgcgaagactgagcccgcagcgctcagcagtcaggaggctgaggaagtggaagaggagggtgcccctgattacgagaacctccaggaacttaactag

SEQ ID NO: 122604 - DNA, 702 bp, Artificial Sequence
  Description of Artificial Sequence: Synthetic coding sequence
atggaagaagcaatcctggtaccttgcgttctgggactcttgcttctgcccatcttggccatgctgatggcattgtgcgtgcactgccatcgtcttcctggatcatacgacagcacgtcctccgatagtctgtatcctaggggaatccagttcaagcgaccccacactgtcgccccttggccaccagcatatcctccggtgactagctacccacccctttctcaaccagacctgctgcccatcccaaggtccccacagcccctgggaggaagccatagaaccccttccagccggagggactctgatggtgcaaattcagtggctagctacgaaaacgaggagccagcctgtgaagatgcagacgaagatgaggacgattatcataatccaggctacctcgtcgtcctccccgatagtaccccagccacttccactgccgcccctagtgcccccgcattaagcacaccagggatcagagactccgcgttctcaatggaaagcatagacgactatgtcaatgtgccagagagcggtgagtcggcagaagccagcctggacggatctagagagtacgtgaacgtgtcccaggaactgcaccctggagcagctaagacggagcctgccgcacttagctcacaggaggcggaagaggtggaggaggaaggagctcctgattacgagaatcttcaagagctgaattag

SEQ ID NO: 122605 - DNA, 810 bp, Artificial Sequence
  Description of Artificial Sequence: Synthetic coding sequence
atggaagctaccgctgcgagctggcaggtggcagtacctgtactgggaggggcctcaaggcccctgggcccacggggcgctgcttcactgttgagggcccccttacagatggaagaggccatcctggtgccttgcgtcctcgggttgcttctactacccattttggcgatgctgatggccttgtgcgtacattgtcatcgcctccccgggtcatatgactccacgtcatccgattcattataccccagggggattcaattcaagagaccacacacagtcgccccttggcccccggcgtatcctcccgtcacctcataccccccactgagtcagccagacctcctgcccattccacgctcacctcagcccttagggggttctcacaggacaccaagcagcagaagggattctgatggggcaaattccgtggcctcttacgaaaatgaggaacccgcctgtgaagatgcggatgaagatgaggacgattaccataatccaggctatttagtggttctgcctgactctacacctgctacctccactgcggccccaagcgcacccgccctgtcaaccccgggtataagggattctgccttctctatggagagcatcgatgactacgtcaacgtgcctgaaagtggggagagcgccgaagcgagcctggatgggagccgggaatatgtgaacgtgtcccaggagctacatccgggcgccgcaaagacagagccggccgccctcagcagccaggaggctgaggaggttgaggaggaaggcgccccagattacgagaatttacaggaactcaattag

SEQ ID NO: 122606 - DNA, 699 bp, Artificial Sequence
  Description of Artificial Sequence: Synthetic coding sequence
atggaggaagcgatactcgtaccctgtgtgctcggcctccttctgctgcctatcctcgccatgttgatggcactctgcgttcactgtcacaggttgcctggttcctatgatagtacttcctccgactcactctatccaagaggaattcagttcaaacggccgcacactgttgcgccctggcctcctgcctacccccctgttacttcctaccctccactgtctcagcctgatctgttgccaatcccaagccctcaaccgctgggtgggagccaccggacacccagcagcagacgagactcagacggagcgaactccgttgcctcctatgagaacgaagagcctgcctgcgaggacgccgacgaggacgaggatgactatcacaatcctggctacctagtcgtactgcctgattccacaccagctacttctactgccgccccctcagcacccgctctttctacaccaggtattcgcgacagtgcctttagcatggagtccatcgacgattatgttaatgtgcccgagagcggtgaaagtgctgaggcctccctggatggcagccgggagtatgtcaatgtgtcccaggagctgcaccctggcgccgcaaagacagagccagcagccctaagttcacaagaggctgaagaagtggaggaggagggagcccctgactatgaaaacctccaggaactcaattag

SEQ ID NO: 122607 - DNA, 732 bp, Artificial Sequence
  Description of Artificial Sequence: Synthetic coding sequence
atgagctccgggacagaattactgtggcccggagctgctctgctggtactgctcggcgtggcagcctcactctgtgttaggtgctccagacctggcgcgaagagatccgaaaaaatataccaacagcggtccctgagggaagaccaacagtcctttacgggatcccgaacctactcactagtggggcaggcttggcccggacctctcgcagatatggccccaacacggaaggacaagctcctccagttctacccctcattagaggatcccgcttcctctcggtaccaaaatttcagcaaggggtctaggcatgggagcgaagaagcttacatcgacccaatcgccatggaatactacaactgggggcgatttagcaagcctcctgaagatgatgatgctaacagctacgaaaatgtgctgatatgtaagcaaaagacaacagagacaggcgctcagcaggaaggtatcggtggcctgtgcagaggggacctcagtctcagtctcgcactgaaaactggccccacatccggcctctgcccatctgctagtccggaggaagacgaggaaagcgaagattaccagaatagtgcgtcgatccatcagtggagggagagcagaaaagtcatgggccagcttcaaagggaggcctcacctggtcctgttggtagcccggatgaggaggacggagagcctgactatgtaaacggcgaagtggctgccaccgaggcctag

SEQ ID NO: 122608 - DNA, 732 bp, Artificial Sequence
  Description of Artificial Sequence: Synthetic coding sequence
atgtcctccggaaccgagttgttgtggccaggtgctgctctgctggtgttgctgggcgtggctgcttccctttgcgtcaggtgctccagaccaggagccaagagatctgagaaaatttaccagcagaggtcactgcgggaggatcagcagagctttacaggaagccgtacttacagcttggtggggcaggcatggccaggcccgcttgcagacatggcgcctacaaggaaagataagctgttgcagttctacccgtctctagaggacccagcttcctcgagataccagaacttttccaaagggtcccggcatggctcagaagaggcgtatatcgatcctattgcaatggaatactataattgggggcgatttagcaagcccccggaagacgacgacgcgaactcttacgagaatgtgctgatttgtaaacaaaagacaacagaaaccggcgcacagcaagaaggaatcggcggtctctgccgaggtgacctgagtttgtctttggctttgaagactggccctaccagcggcttatgccccagcgcttcaccggaggaggacgaagaatctgaagactaccagaattctgcctcaatccaccagtggagggagtcaagaaaggtgatgggacagctgcagcgcgaggcttctcctggacccgtggggtcccccgacgaggaagacggggagcccgattacgttaatggcgaggtcgccgccacggaagcatag

SEQ ID NO: 122609 - DNA, 195 bp, Artificial Sequence
  Description of Artificial Sequence: Synthetic coding sequence
atgtccagcgggaccgaactgctgtggccgggtgccgcgttgctcgtgctgctgggcgtcgctgcatccctttgcgtgagatgctctagaccgggtgctaagagatccgagaaaatataccagcagaggagtttgagagaggatcaacaaagcttcacgggctctcggacatactccctggtagggcaggcttag

SEQ ID NO: 122610 - DNA, 732 bp, Artificial Sequence
  Description of Artificial Sequence: Synthetic coding sequence
atgagctcagggactgagctcttgtggcccggagcggccctcttggtgcttctgggtgtggccgcaagcctctgcgttaggtgttctcggccaggtgccaagaggagtgaaaaaatctatcagcaaagatcactgcgagaggaccagcagagcttcaccgggtctagaacctattctctagtgggccaggcctggcctggacctctcgccgacatggcgcctaccaggaaggataaactcctgcagttttacccgagtctggaggatcccgccagttctagatatcagaatttcagcaagggaagtaggcatggtagcgaggaagcctatatagacccaatcgctatggaatactataattggggcagattcagtaagccccctgaagatgacgatgcaaactcctatgaaaatgtcctgatctgcaagcagaagaccaccgaaacaggggctcaacaggaaggcatcggtgggctttgtagaggtgatcttagcttgagcctcgctctgaaaactgggcccaccagtggcctttgtccatccgcctcgcccgaagaagacgaggagtccgaggattaccagaactctgcaagcatccatcagtggcgggagtctcggaaggtcatgggccagctccagcgagaggcctctcccggccccgtgggcagccccgacgaagaggatggggagccagattatgttaatggagaagtggcagctactgaggcgtag

SEQ ID NO: 122611 - DNA, 732 bp, Artificial Sequence
  Description of Artificial Sequence: Synthetic coding sequence
atgtcatccggtactgagctcctctggcctggggcggcacttctcgtcctgctgggggtcgctgcttccctgtgtgtccgctgttcgagacccggtgccaagcgcagtgaaaaaatctaccagcaacggagcctgcgagaggaccaacaaagtttcacaggaagtcgcacctattctcttgtggggcaagcttggccaggccccttagccgacatggctcctactaggaaagacaagcttctccagttttatccgtccctcgaggaccccgccagtagcaggtaccaaaacttctccaaaggctccagacatgggtccgaggaggcgtacatagatccaatcgccatggagtactacaattggggtcggttctcgaagcctcctgaggacgacgacgccaacagctatgagaacgtgctcatatgcaaacaaaagactacagagacaggcgcccagcaagaaggcattggcggcctgtgtcgcggggatctctcattatctctcgcccttaagaccggccccaccagtggcctatgccctagcgcgtcccccgaggaagacgaggagtctgaggactatcagaattctgctagtattcaccagtggagggagagccgaaaagttatgggccaactccagagggaggcgtcacctgggcccgtcggtagtccggacgaagaggacggagagcctgattatgtgaatggtgaggtcgccgccactgaggcctag

SEQ ID NO: 122612 - DNA, 177 bp, Artificial Sequence
  Description of Artificial Sequence: Synthetic coding sequence
atgtcctcgggcactgagctgctttggcccggggcagccttgctggtgctgcttggcgtggcagccagcttgtgtgtccgttgttcaaggcctggcgccaaaagaagtgagaagatttaccagcaaaggtcacttcgcgaagaccagcaaagttttaccggaagtagaacatactag

SEQ ID NO: 122613 - DNA, 303 bp, Artificial Sequence
  Description of Artificial Sequence: Synthetic coding sequence
atgtcctccggaacagaattgctttggccgggggccgctctgctggtactgctgggcgtcgctgccagtctttgcgtgaggtgtagcagacctggcgctaagaggagcgagaaaatctaccagcagcgctccttgcgggaagaccagcagagcttcaccggttctagaacatattccctggtgggccaggcatggcccggacccctggccgacatggctcccacaagaaaggataagctcttgcaattctacccctctctggaggacccagcttcttcacgataccaaaacttctccaaatag

SEQ ID NO: 122614 - DNA, 1704 bp, Artificial Sequence
  Description of Artificial Sequence: Synthetic coding sequence
atgaggccagatagtccaaccatggccgcgcctgcggagtcccttagaagacgcaagactggctactccgacccagagccagaaagtcctcctgctccgggtcgcgggccagcaggttcccccgcccacctgcatactgggaccttttggctcacccggattgtgttacttaaagccctggctttcgtatatttcgttgccttcttggtggcctttcaccaaaacaaacagctaattggcgatagaggcctgctgccttgtagggtttttctgaaaaattttcagcaatacttccaggacagaacaagctgggaagtgttctcctacatgcccactattctctggctgatggattggtcagatatgaattccaatctcgatctgttagctctgcttggcctggggatctccagcttcgtgctgattaccggatgcgccaacatgctgctcatggccgctctgtggggactgtacatgtccttggtcaatgttggccacgtttggtacagcttcggctgggagagccaactcctcgagaccgggtttcttggcatatttctttgccccctatggactctgtcccgactaccgcagcacaccccaacctctcgcatcgtgttgtgggggttcaggtggctgatattccggattatgttgggcgccgggttaatcaaaatcaggggcgacaggtgctggcgcgatctgacctgcatggacttccactatgaaacacagcccatgcccaaccccgttgcctattacttgcaccattccccctggtggttccatagattcgaaaccctctcaaatcatttcatcgaactgttggtcccttttttcttgttcctgggacgcagagcatgtattatccacggtgtcttgcagatcctttttcaagccgtgttgatagtgtccggaaacctttcttttctgaactggcttacaatggtgccgagtctcgcgtgcttcgacgatgcgactcttggattcctcttccctagcggtcccgggtcactcaaggaccgagtgctgcagatgcagagggacatccgaggcgctcgcccagagcccaggttcggcagcgtcgtaagaagggccgccaacgtcagcctcggcgtgctcttggcttggctgagcgtgccggtcgttctgaaccttctgtccagccgccaagtgatgaacactcattttaattctctgcatatcgttaacacttatggcgcttttggcagcataactaaggaacgcgccgaggtcattctacaggggacagctagcagcaatgcctctgcccccgacgccatgtgggaagactatgagttcaaatgcaagcctggagacccttccagaagaccctgcctgatcagtccctatcactataggctggattggctgatgtggttcgccgcatttcagacttacgaacataacgactggatcatccacctcgccggcaagcttctggctagcgacgcagaagctctctctcttctggcgcacaacccatttgccggaagaccacccccccggtgggtcaggggcgagcattacagatataaattttctagaccagggggcaggcacgccgccgagggtaaatggtgggtcaggaaaaggattggtgcctactttccaccattatctctggaggaacttagaccatattttagggaccgggggtggccattacccgggccgctctag

SEQ ID NO: 122615 - DNA, 1704 bp, Artificial Sequence
  Description of Artificial Sequence: Synthetic coding sequence
atgcggccagattcaccgacaatggcagctcccgccgaatccttgcgccgccgaaaaactggctattctgatcctgagcctgagagtccgccagcacccggccgtggtcctgctgggtccccagcacatctccacactggaaccttttggctgacaaggattgttcttctcaaggccctcgcttttgtctattttgttgctttcctggtggctttccaccagaacaaacagttgatcggagatagaggtttactgccatgtagggtgtttctcaaaaactttcagcagtattttcaggataggacatcgtgggaagtatttagttacatgcccacaattttatggctcatggactggagcgatatgaattccaaccttgatttgctcgccttgttggggcttggaattagcagctttgttctgattaccggctgtgccaacatgctgctcatggccgctctctggggcctgtacatgtccctggtgaacgttggtcacgtatggtactcctttcgatgggagagccaacttctcgaaacgggttttctcggcatcttcctgtgtcccctgtggaccctgtccagactcccccagcatacccctactagccgtattgtattgtggggctttcgctggcttattttccggatcatgctgggcgctggcctgatcaaaattaggggagaccgatgttggcgcgacctcacatgtatggatttccattatgagactcagcctatgcccaacccagtcgcttactatctgcaccattctccctggtggttccatcgttttgaaactttgagcaaccattttatcgagcttctagtgcccttcttccttttcctgggacgtcgcgcctgcattattcatggagtcctgcagatccttttccaggccgtccttattgtctccggcaatctctcttttctgaattggctgactatggtgccgagcctcgcatgcttcgacgatgccacccttgggttcctgttccctagcggtcccggcagtctaaaagatagggttctgcagatgcagcgggatatcaggggggcacgacctgagccgcgattcgggtcggtcgtgaggcgtgccgcaaacgtctctcttggcgttcttctggcctggttgagcgttccagtggttctcaacctgctatctagcaggcaagtcatgaatacccattttaattctttacacattgtgaacacatacggagcctttggaagcatcaccaaggagcgcgccgaggtaatcttgcagggtacagcatcatctaatgcctccgcgcccgatgcaatgtgggaagattacgagttcaagtgcaagccaggtgatccttctcggcgaccatgtctgatttcaccttatcactaccgccttgattggctgatgtggttcgctgccttccaaacttatgagcataatgattggattattcacctggctggcaagcttttagcatctgacgccgaggctctctccctgttggcccataacccctttgcaggccgtccgcccccacggtgggtcaggggtgaacactatcgctacaagttttctcggccagggggccgccatgccgctgaaggaaagtggtgggtccgcaaaagaatcggcgcctattttcccccacttagcctggaagaactgcggccatattttagggacagagggtggccgctacctggaccactctag

SEQ ID NO: 122616 - DNA, 558 bp, Artificial Sequence
  Description of Artificial Sequence: Synthetic coding sequence
atgagaccggactctcccaccatggctgccccagccgaatctctgcgaagaaggaagacagggtacagcgaccctgagcctgagtcccccccagcacccggtaggggccctgcagggtcacctgcccacttacacacgggtactttctggctgaccaggattgtgctactgaaggctctggcattcgtttattttgtagcttttctcgtcgccttccaccagaacaaacaacttattggtgatcgcggtctgcttccatgtcgggtgtttctcaaaaacttccagcaatattttcaggatcgcacctcttgggaggtcttcagctacatgccaactattctgtggctcatggattggagcgatatgaatagcaacctggacctgctggctctgttgggactcggaatctccagttttgtgcttatcaccgggtgtgctaacatgttgttgatggcggcactgtggggcttgtatatgagtttggtgaacgttgggcacgtgtggtgtccaagcctggctagtgctatatccctcccgagcatgcacgggggccagtag

SEQ ID NO: 122617 - DNA, 501 bp, Artificial Sequence
  Description of Artificial Sequence: Synthetic coding sequence
atggcagcacccgcagagagtctacgcagaaggaagaccgggtactcagacccagagccagagtcgcctccggccccaggccgaggccctgcgggtagccccgcccacctacacaccggcactttttggctcacaaggatcgtgctcctcaaggctcttgcctttgtatactttgtggcttttctcgtcgcctttcaccagaataaacagctgattggagacagagggctgttgccatgtcgggtgtttctgaagaattttcaacagtattttcaggatcggacatcatgggaagtgttctcctacatgcctacaattttgtggctcatggactggtccgacatgaattccaatctggacctgttagctctgctcgggctcggcatcagtagcttcgtcctaataacagggtgtgcaaatatgttgctgatggcagcactgtggggcttgtacatgtctttggtgaatgtaggtcacgtctggtatagctttggcaagtag

SEQ ID NO: 122618 - DNA, 1053 bp, Artificial Sequence
  Description of Artificial Sequence: Synthetic coding sequence
atgagaggcgctgggttaatcaagatcagaggcgacagatgttggagagacctgacttgtatggacttccactacgaaacccagccaatgcccaacccagtggcatattatcttcatcatagcccatggtggtttcaccgcttcgaaaccttgagcaatcactttatagaattactcgtgccatttttcttatttctcgggcggagggcctgtataatccacggtgtgctgcagattttattccaggccgtccttatcgtgtccggcaatctgagcttccttaactggttgacgatggtaccctctttagcatgttttgacgacgcaactctgggcttcctgttcccaagtggaccaggcagcttgaaagaccgcgtgcttcaaatgcaacgggacatacgaggggccagacctgaaccaagatttggctccgtggtgaggagggctgctaacgtgtcgctgggtgtacttcttgcttggctgtccgtgccagttgtactaaatctgttgtcctcccggcaggtgatgaacactcatttcaattctctacacatcgtgaatacctacggagcttttggcagtattactaaagagcgagctgaggttattctgcagggcacagcctcatctaatgcctccgcacctgacgccatgtgggaagactatgaattcaaatgcaaacccggggaccctagccgcagaccttgtctcattagcccatatcactatcgtctggactggctaatgtggtttgccgcatttcagacctatgagcacaacgactggattatacatctggccggaaaacttctggcatctgatgctgaggcactgagcttacttgcacacaacccgttcgccgggagaccaccgcctcgctgggtccgtggagagcattaccgatacaagtttagtaggcccggcggccgccacgctgccgagggcaagtggtgggtgcgcaagcgaattggcgcctatttccccccactatcacttgaggagttacgaccctattttagggatcgaggatggccactgcccggcccattgtag

SEQ ID NO: 122619 - DNA, 993 bp, Artificial Sequence
  Description of Artificial Sequence: Synthetic coding sequence
atggacttccactacgaaacccagcccatgccgaacccagtggcatactatttgcaccactctccatggtggtttcatcgttttgaaaccctgtcaaaccactttatcgagctcctggttccattcttccttttcctcggaaggagggcctgtattatacatggcgtgctgcagatcttgtttcaggcagtgcttatcgtcagtggcaacctgtcatttcttaactggcttacaatggtccctagcctggcttgcttcgatgatgcaacgttgggctttctgttcccttcaggcccagggtcattaaaagaccgggtgcttcagatgcagcgggacattcggggcgcacgcccagagccacgattcggttcagtggtaaggcgggccgccaacgtatctttaggtgtcttgttggcctggttgagtgtccccgtggtactgaaccttctttcaagccgtcaggtgatgaacacacatttcaactctttacacatcgtcaacacatacggggcttttggatccatcactaaagagagagccgaggtgatcttgcagggaaccgcgtccagtaatgcaagcgcacccgatgctatgtgggaggattacgagttcaagtgcaaacccggcgatccctccaggagaccttgcttaatttcaccgtaccattacaggcttgattggctgatgtggtttgcagctttccagacttatgagcacaacgactggatcatccatcttgctgggaagctgctcgcatccgatgcggaagcgttatctctgcttgctcataacccgtttgctgggcgtcctccaccccggtgggtgcgaggtgaacactaccgctataaattctctagacctggcgggcgccacgccgctgaaggcaagtggtgggtccggaaacggatcggagcttacttcccgccactctccctagaggaattacgcccttactttagggaccgcggctggcctctgcctggcccgctctag

SEQ ID NO: 122620 - DNA, 792 bp, Artificial Sequence
  Description of Artificial Sequence: Synthetic coding sequence
atgcctaatcccgtcgcatattatctacatcatagcccctggtggttccaccgattcgaaactctgtcaaaccactttattgagctgctggtgcctttttttctgttcctgggacgccgggcatgtataatccatggcgtgctgcaaatactgttccaggccgtcttgattgtgtctgggaacctgtcttttctgaattggttgaccatggtcccttctttggcttgttttgacgatgcgactcttggcttcctgtttcctagcggtccaggttctctcaaagatcgcgtcctccagatgcaaagggacatacggggcgcgcgacctgaaccccgctttggttcggtggtgaggcgcgctgccaatgtgtccttgggtgtgctgcttgcgtggcttagcgttcccgttgttctcaacctgctctctagtcggcaggtgatgaatactcacttcaatagcttgcacatcgtgaatacttacggcgccttcggctctatcacaaaggaacgggcagaggtgatcttgcagggaaccgcaagctctaatgcgtctgctcccgatgccatgtgggaggattacgagtttaagtgcaaaccaggggatccttcccgacggccatgtttaatctccccgtatcattaccgcctggattggctgatgtggtttgccgctttccaaacctatgagcacaacgattggataatccacctggctgggaaactactggcatcagatgctgaggctctaagtctcctggcccacaacccatttgctgggaggccacctccatag

SEQ ID NO: 122621 - DNA, 1503 bp, Artificial Sequence
  Description of Artificial Sequence: Synthetic coding sequence
atgagcaactcggtgccattgctttgcttttggtccctctgttattgttttgctgccggctcccccgtcccattcggacctgagggacggttggaggataagctccataaacctaaagctacccagacagaagtgaaacctagcgttcgttttaatttgcggacctccaaagacccggaacacgagggttgctacctctcagtggggcacagccagccactcgaagactgtagttttaatatgactgctaagacattcttcatcattcatggttggaccatgagcgggatcttcgaaaactggcttcataagctggttagcgcacttcatacgcgggaaaaggacgcgaacgtggtggtcgtcgactggttaccacttgcgcatcagctctacaccgacgctgtcaacaatacaagagtggtgggccatagcatcgctcggatgctggattggctccaggagaaggacgatttctcactcggtaacgtccacctgatcggttattcactgggcgctcatgtggccggttacgcagggaacttcgtaaaggggaccgttgggcgcattacgggacttgatccagccggaccaatgttcgagggggccgatatacataagaggttaagccctgatgatgcagacttcgttgacgtattgcacacctacacccggagtttcggattaagcataggaatccagatgcctgtggggcatatcgacatttacccgaacggtggagacttccagcccggttgtggacttaacgacgtcctcggcagcattgcctacggtaccatcaccgaggtcgtaaaatgtgaacacgagagagcagtgcatctgttcgtagatagtttggtgaatcaagataagcctagttttgcgttccagtgcaccgattcaaacaggttcaagaaagggatatgtctgagttgtaggaaaaatcgctgcaactccattggctacaatgctaagaagatgcgcaacaagaggaacagcaagatgtatctgaagactagagctggtatgccatttcgtgtgtaccactatcagatgaaaatccacgtgttcagctacaaaaacatgggtgagattgagcccacattctatgtgacactgtacgggacgaacgccgatagtcagacactgccactggagattgtcgagcgcattgagcagaacgctacaaatacctttctcgtgtacactgaggaagacctcggggatctcctgaaaattcagctgacatgggaaggcgcgtcccagtcatggtataacctgtggaaggagtttcgatcctacctctcgcagccacgaaaccccggtcgtgagcttaatatacgccgcattcgcgttaaatctggggagacccagcgaaaactcaccttttgcaccgaagaccccgagaacacctccatctctcccggaagggaattgtggttccgcaagtgcagggatggatggcgaatgaagaacgaaacctcacctacagtggagctgccttag

SEQ ID NO: 122622 - DNA, 1281 bp, Artificial Sequence
  Description of Artificial Sequence: Synthetic coding sequence
atgtcaaactcagtccccctcctctgtttctggagtttgtgttactgtttcgcagccggcagccctgtcccattcggccccgagggaaggctcgaagacaagctccacaagcccaaagccacccaaaccgaggtgaagcctagcgtaagattcaacctgagaacgtcaaaagaccccgagcacgagggatgctatttgtccgttggtcacagccagccactggaagactgttcttttaacatgacagcgaaaactttttttatcatccacggatggacaatgtctggcatatttgagaactggctccacaagctggtatcagcattacatactagggagaaagatgcaaatgtcgtcgtcgtcgattggctgcccctggcacatcaattgtataccgacgccgtgaacaacacgagagtcgtggggcactctattgccagaatgctggactggttgcaggagaaagacgacttcagcctgggtaatgtgcacctcataggatattcacttggtgcccatgtcgccggttacgccggtaatttcgtgaagggaacagtgggccgaatcacagcaattaccgaggtggtgaagtgcgagcatgaaagagccgtccatctcttcgtagactccttggtgaaccaagacaaaccttccttcgcttttcagtgtactgattcaaatcgttttaagaagggcatctgtctgtcttgcagaaagaacagatgcaattcaattggatacaacgccaagaagatgaggaataagcggaactctaaaatgtacctaaagactagggcaggcatgcctttccgtgtttatcactatcagatgaaaatccatgtcttctcatataagaacatgggcgagatagagccaactttctacgtgaccctctacggaaccaatgcagatagccaaactttgcctctggaaattgtcgagcgaattgagcagaacgccacaaacacttttctcgtctacacagaggaagaccttggtgatctgctcaaaattcagctgacctgggagggagcttcccaatcgtggtacaacctgtggaaagagtttcggtcttatcttagccaaccccgcaatccaggcagggagctgaatatccgccgcattcgcgttaaatccggcgaaacccaacggaagttgacgttttgtaccgaggatcctgaaaatacgtccatatctcctggtagggagttgtggttccgtaagtgtcgagacggctggcgcatgaagaacgagacctctccaactgttgagctcccttag

SEQ ID NO: 122623 - DNA, 1101 bp, Artificial Sequence
  Description of Artificial Sequence: Synthetic coding sequence
atgaacatttcacagatcatatcttactgggggtatcctgacgaagagtacgatatagtgacagaagatggatatattctggggctgtaccggatcccttattggcgcactgataacaataaaaatctcgcccagcgggtggtcgtatacctccagcacgggctcctgacttccgcctcctcgtggattagtaatctccccaataactctctgggctttatcttagcggacgcaggatacgatgtgtggatgggcaacagtcgcggcaatacctggagccgcaaacacctgtacctggaaacctcctcgaaagagttttgggcctttagcttcgatgaaatggccaagtatgatctgccagcttcaatcgactttaccgtcaagcaaacgaggcaagaagaaattttctacgtcggacattctcaaggtacaacgatcggtttcatcacatttagtaccatcagtaagatcgccgagcgtatcaagatcttcttcgcgctagccccagtgttctctacaaaatacctgaagtccccccttattaggatgacatacaaatggaagagcatcgttatggcgttctctggaaataaagactttttacccaagacctctttcaagaaatttatcggttctaagctgtgtcctttgcagattttcgacaaaatttgtctgaatattctctttatgatgtttggatacgatcctaagaatctgaatatgagccgtctcgacgtctatttctcccataatcccgcagggacctccgtgcaaaatatgctccactggtctcagctgcttaactctacacatctcaaggcttatgactggggatcaccagatctaaacctggttcactacaaccaaaccacctctcccctctacaacatgacaaacatgaacgtcgcaaccgcaatctggaacggcaaatctgatcttcttgccgaccctgaagacgtgaatatactccacagtgagattacgaaccacatctattataagacaatctcctactataatcacatcgactctctgtttggattagatgtctatgaccaggtttaccatgaaatcattgatatcatccaggacaatctctag

SEQ ID NO: 122624 - DNA, 1200 bp, Artificial Sequence
  Description of Artificial Sequence: Synthetic coding sequence
atgtggcaattgctggcagcggcctgttggatgttactgctggggtctatgtatggctatgataaaaaaggaaataacgccaaccccgaagccaacatgaatattagccagatcattagctactggggctacccatatgaggagtacgacgtgaccacaaaggacgggtacatcctcggtatctaccggatccctcacggccgggggtgtcctggacgcactgcaccaaagccggcagtctacctccagcacgggctcattgcctctgccagtaattggatttgtaaccttccaaataactctctggccttcctgctggccgacagcggctacgacgtttggctcgggaactcgagaggaaatacttggagcaggaagcacctcaaactctcaccaaaatcccccgagtattgggcattcagcctagatgagatggccaaatatgatcttcccgccacaattaactttataatcgaaaaaactgggcagaagagattgtactacgtcggtcattcacagggaactactattgcctttatagctttttccactaatcctgagctggccaagaagatcaagatcttctttgccttggccccggtcgtcacggtgaaatatacccagagccccatgaaaaagctgacaaccctttcaagacgagtggtaaaagttttgttcggggataaaatgtttcaccctcatactctcttcgaccaatttatcgcaacaaaagtgtgcaatcgtaagctgttccggcgtatttgcagcaattttctcttcaccctgagcggattcgacccacagaatttgaacatgtctcgcctcgacgtgtatctgagccataatccagctggcacaagtgttcagaatatgctccactgggcccaggctgtcaattctggccagctccaggcctttgactggggcaacagcgatcagaatatgatgcatttccatcagctgacacctcccctctacaacattacgaagatggaggtccctaccgcaatctggaatggaggccaggatatcgtcgccgaccccaaggacgttgagaacctcctcccccagatcgccaatctgatctactacaaactcattcctcattacaatcatgtcgatttttatctcggggaggacgcacctcaggaaatctaccaggacctgatcatcctgatggaggagtatctgcagaactag

SEQ ID NO: 122625 - DNA, 1272 bp, Artificial Sequence
  Description of Artificial Sequence: Synthetic coding sequence
atgctggagactttaagcaggcagtggatagtttcccatcgaatggaaatgtggctgttgattctggtggcctatatgttccaacggaatgtcaatagcgtacacatgcccaccaaagccgtcgatcccgaggcctttatgaacattagtgaaattatacagcaccaagggtacccgtgtgaagagtacgaggtggctaccgaagacggttacatactgagcgtcaacagaatccccaggggcctggtccagcccaaaaaaaccggatcccgcccagtggtgctgctgcagcacggacttgtggggggggcatcgaattggatcagcaacctgcccaacaacagtttgggcttcatactggccgacgcaggcttcgacgtttggatgggaaatagtcgtggtaacgcttggagtcggaagcataaaacactgagtatcgaccaagatgaattctgggcattctcttacgacgagatggctcggttcgacctgccagccgtgatcaactttatcttgcaaaaaaccgggcaggaaaagatctactatgtggggtattcgcaagggacaacaatgggctttatcgcgtttagtacaatgccggagctagctcagaagatcaagatgtacttcgctctggctcccatcgctacagtcaaacacgcgaagagtcctggcacaaagtttctacttctgcctgatatgatgattaagggcttattcggaaaaaaagagtttctgtaccagacacgctttctccgacagctggtcatttatctgtgcgggcaggtcatcctggatcagatttgttcgaacatcatgttgctgctcgggggctttaacaccaataatatgaacatgagccgggcaagcgtttatgccgcccatactcttgcagggaccagcgtccagaacattctgcattggtcccaagctgtgaattctggcgaactgcgcgctttcgactgggggtctgaaaccaagaatctggaaaagtgcaaccagcctaccccggttcgttatcgcgtgagggacatgaccgttccgacagctatgtggacaggtggacaggactggctaagtaaccccgaggacgtaaaaatgctgttaagcgaagtgacaaatctgatttaccacaagaatattcctgagtgggctcacgtggattttatatgggggcttgatgctccccacaggatgtacaatgaaattatccacctgatgcagcaagaggaaacgaacctgagtcagggcaggtgcgaggctgtcctgtag

SEQ ID NO: 122626 - DNA, 1152 bp, Artificial Sequence
  Description of Artificial Sequence: Synthetic coding sequence
atgacccgaccgctggaccgcaagcagtctgagatcatccagcaccagggatacccttgcgaggagtacgaggtcgcaacagaagatggatacattcttagtgttaaccggatccccaggggtcttgtccagccaaagaagaccggctcccgccctgtggtgctgctacagcacggtctagtcggaggcgcgagtaactggatttcaaacctaccaaataactcgctcggttttattctggctgatgcaggcttcgatgtgtggatgggcaatagccgtggcaacgcctggtcaagaaagcacaagacactctccatcgaccaggatgaattttgggcctttagttacgatgagatggctcgattcgatttacccgctgtgatcaattttatattgcagaagacaggtcaagagaagatctactacgttgggtacagccagggtacgactatgggcttcatcgccttctccaccatgcctgaattagcacagaagattaagatgtatttcgcgctggcccccatagctaccgtaaaacatgcgaagtccccaggcaccaaattcctcctgcttccagatatgatgattaaagggttatttggaaaaaaggaatttctataccagacccgatttctgaggcagctggtgatttacctgtgcggccaggttattctggaccagatatgttccaacattatgctgctgctcggcggctttaacaccaacaatatgaatatgtctagagccagtgtttacgcggcccacacccttgctgggaccagtgttcaaaatatcctgcattggagccaggccgtcaatagtggcgagttacgagcctttgattggggctccgagaccaaaaatcttgaaaagtgcaatcagccgacccccgtgagataccgcgtgcgagacatgaccgtcccaacagcaatgtggacaggcggccaggactggctgagtaaccccgaggatgttaaaatgcttcttagcgaggtcacaaacctgatatatcataaaaacattcccgaatgggcccacgtggattttatatggggcttagacgctcctcaccggatgtacaatgaaatcattcatcttatgcagcaggaggagacaaacctcagccagggacgctgcgaggccgtcctttag

SEQ ID NO: 122627 - DNA, 1197 bp, Artificial Sequence
  Description of Artificial Sequence: Synthetic coding sequence
atgatgtggcttctgctcacaactacctgtctgatttgcgggaccctcaatgcagggggcttccttgacctggagaacgaggtgaatcctgaggtgtggatgaatacctccgagattataatctacaacggctatccctcggaagagtacgaggtaacaacggaggacgggtatatcctgcttgtaaacagaataccatatggtagaacccatgccagatcgaccggacctagaccagttgtgtatatgcagcacgcactctttgccgacaacgcttattggctggagaactacgccaacgggagcttgggttttctgttggcagatgctggctacgatgtctggatggggaactcccgcgggaatacctggtctcggcggcacaagacccttagtgagaccgatgagaaattttgggcctttagcttcgacgaaatggccaagtatgaccttcctggtgttattgactttatcgtgaataagaccggccaggaaaagctctactttatcggacatagtttgggaacgacgattgggtttgtagcctttagtacgatgccagaactggcccagcgcatcaagatgaactttgccctgggtcctaccattagctttaagtatcccacgggtattttcaccaggttcttcttgctgcccaatagcataatcaaagccgtcttcgggacgaaagggtttttcctggaggacaaaaaaacaaaaatagcaagcacaaagatttgtaacaacaagattctgtggctgatttgtagcgagttcatgagtctgtgggctggatctaacaagaaaaatatgaatcagtccaggatggacgtttatatgtctcatgcaccaaccggatcaagtgtccacaacattcttcatatcaagcagctataccactcagatgagttccgggcctatgattggggaaatgatgcagataacatgaaacattacaaccagagccatccacctatctacgacctgacagcaatgaaggtgcccacagctatctgggccggcgggcacgacgtgttggttacacctcaggacgtcgcacggattctgcctcagattaagtcccttcattacttcaagcttctccccgactggaatcacttcgattttgtgtggggcctcgatgctccccaaaggatgtacagcgagattatcgctctaatgaaggcttattcctag

SEQ ID NO: 122628 - DNA, 1500 bp, Artificial Sequence
  Description of Artificial Sequence: Synthetic coding sequence
atggatactagtccactgtgctttagtattctgttggtcttgtgtattttcatccagtcaagtgccctcggacagagtctgaagccagaaccttttggacgcagggcccaggctgtcgagacaaacaaaacactgcatgagatgaagacaaggttcctgctgttcggggaaacaaaccaggggtgccagatccgtatcaaccacccagatacacttcaggagtgcgggttcaatagtagccttcctctggtaatgatcattcacggctggagtgttgatggggtgcttgagaattggatttggcaaatggtggccgccctgaagtctcagcctgctcagcccgtgaatgtgggccttgtcgattggatcacccttgctcatgatcactataccatcgctgtgaggaatacccgcctggtaggtaaagaggtagccgctctgctgaggtggctggaggaaagcgtccagctgagcaggtcacatgttcatctcataggctactctttgggagcccatgtctctggcttcgcaggcagctcaatcgggggcacacacaagatcgggcgcattaccggactggacgctgccggtcccctgttcgaaggctccgcccctagtaatcgcctctcgccagacgacgcaaattttgttgatgctatccacaccttcaccagggagcatatgggactctcagtgggaataaagcagcctatcggtcactacgacttttatcccaacggaggttcattccagccaggttgccacttcctggagctttaccggcatattgcccaacacggcttcaatgctatcacacaaactatcaagtgtagtcacgagagatccgtgcacttgtttattgacagtctcctgcatgctggaacccagagcatggcatacccatgtggcgacatgaacagtttttcacagggtctatgcctgtcctgtaagaaggggcgatgcaatacactggggtaccatgtcagacaagagcccagaagcaaatcaaaacgtctcttcttggtaactcgtgctcaatcacccttcaaggtctaccactaccaatttaagatacagtttatcaaccagacagagacccctatccagacaacctttacaatgtcattgctcggaacaaaggaaaagatgcaaaagattcccattacactaggcaagggcattgcctctaacaagacctacagctttttaattacactggatgtggacatcggagagctgatcatgatcaagtttaagtgggaaaattccgctgtgtgggcgaatgtctgggatacagtgcaaacaataatcccttggagcacaggtcctcgacactcaggactcgttctgaagacaatccgtgtaaaagctggcgagacccagcagcgtatgactttctgtagcgagaataccgatgacctgcttctcaggcctacccaagagaagattttcgtgaaatgcgagataaaatccaaaaccagcaagagaaaaatccgatag

SEQ ID NO: 122629 - DNA, 1500 bp, Artificial Sequence
  Description of Artificial Sequence: Synthetic coding sequence
atggatacaagccccctatgcttctcaatcctgttagttctgtgtattttcattcagagctctgcccttggccaatctctaaaaccagagccattcggtcgtagagctcaggccgtcgaaacgaataagactctccatgaaatgaagactcgatttctgctctttggggagaccaatcaaggctgccaaatcaggattaaccacccagatacacttcaggaatgcgggttcaattctagtttgcccctggttatgatcattcatggctggagtgtggatggcgtgctggaaaactggatatggcagatggttgctgcccttaagtcccagcccgcccagcccgtcaatgtaggtctggtcgactggattacgctcgctcatgatcactatacaatagcagtgagaaatacccggctcgtaggcaaggaggtagcggcactgctccgctggctggaggaatctgtgcagttatctagaagtcatgtccatctaataggatactctttaggggcacacgtgagtggctttgccggctccagtatcggtggaacccacaagatcggcaggatcactgggctagatgctgcgggtcctcttttcgagggctccgcacccagcaatcgtctgtcccccgatgatgcaaatttcgtggacgctattcatactttcactcgcgagcacatgggactgagcgtcgggatcaagcagcccattggccactatgatttttacccgaacggaggttctttccagcctggatgtcacttcttggagctgtaccggcacattgctcaacatgggtttaatgccattactcagaccattaagtgctcacatgagcggtcagtgcatctgttcatcgactcactgctccacgctggtactcagtccatggcctacccatgcggcgacatgaactctttcagccagggtttatgcttatcttgtaagaaaggtcgatgcaatactctgggctatcacgtgaggcaggagccacgttcaaagtcaaaacgcttgttcctggtgacccgtgcacagtccccattcaaggtgtatcattatcagtttaaaattcagtttatcaatcaaacagaaacgcccatccagacaacattcacgatgtcactgctgggaaccaaagagaagatgcagaagattccgattacactgggcaaggggattgcatctaataaaacatattcctttctgattaccctggacgtggacatcggggagctcattatgataaagttcaaatgggaaaatagcgcagtgtgggcgaatgtgtgggataccgtgcaaaccattattccatggtctacaggacctcgtcactccggcctggtactgaagaccattagggtcaaggcaggagagacacagcagcgcatgaccttctgctccgagaacaccgacgacttgctgctgcgccccacccaggagaagatttttgtgaagtgtgaaattaaaagtaagacttcgaaaagaaaaatccgctag

SEQ ID NO: 122630 - DNA, 3231 bp, Artificial Sequence
  Description of Artificial Sequence: Synthetic coding sequence
atggaaccagggagcaaaagtgtttcacgttctgactggcaaccagagcctcaccagcggccgatcacacccctggagcctggtcccgagaagactcccattgcacagccagaatctaagaccttgcagggctctaacactcagcagaagcctgcttctaatcaaaggccccttacccagcaggaaacacccgctcagcacgacgcagaatcccaaaaagagcctagggctcagcagaagagtgcgtcccaggaagagttcctggccccccagaagcccgcgcctcagcagtcaccctacattcagcgggtacttttaacgcaacaagaagccgcaagtcagcaaggccccgggctcgggaaagagagcataactcaacaggagcccgcactacgacagcggcatgtcgcccagcctggacccgggcctggggagcccccccctgctcaacaagaagccgagagcacaccagccgctcaggccaagcctggggctaaacgcgagccaagtgcacctacagaatcaacatcccaggagacccccgagcaatcagacaaacagaccactcctgtgcagggagcaaagtcaaaacagggctccctgacagaacttggctttttaaccaaactccaggagcttagcatccagcggagcgcactggagtggaaggcactttccgagtgggtcaccgatagcgagtctgaatctgatgtggggagcagtagcgatacagactccccagccactatggggggaatggtcgctcaaggcgtgaagctggggttcaaaggcaaaagtggctataaagtcatgagtggttactcaggaacatctccccatgagaagaccagcgcccgaaatcaccgacattaccaagacactgccagcagattgatccacaatatggatttacgaaccatgactcagagcctggtgacactggcggaggacaatatcgccttcttcagtagtcaaggcccaggggaaacagctcagcgtttgtccggcgtgttcgccggcgttcgcgaacaagcgcttgggctggagccagctctgggcaggctactcggggtggcccacctgtttgacctggatccagagacccccgctaacggctaccgcagcctcgtgcacacagctagatgttgcctggctcacctgctccacaagagccgatacgttgctagcaaccggagatccatcttttttaggacttcacataacttggccgagctggaagcctacctcgctgcacttacacagctccgggctttggtgtattatgcccaacgcctgttagttacaaatcggcctggcgtgctgttctttgaaggcgatgaaggtttgacggccgactttctgcgcgaatacgtgacactgcacaaaggatgcttttatgggcgctgtcttgggttccaatttactcccgcaattcggcctttcttgcagactataagtataggtcttgtcagttttggcgagcattacaagagaaatgagacaggcctgtccgttgccgcttccagcctgtttacttctggaaggttcgccatcgatccagagttgcgcggagccgaattcgagcgcataacacaaaatctcgacgtacacttttggaaagcattctggaacattactgagatggaggtgttgtcgtcccttgcaaacatggcctccgctaccgtccgagtgtctagactcttatctcttccaccggaggcattcgagatgcctctcacagctgacccaaccctcaccgtcacgatctccccacctctggctcacactgggccaggcccagtgctcgtccggttaattagttatgatttgagggaaggacaggactccgaagaactgagcagcctcattaagtctaatggccaaaggtccctggagctgtggccccgtccacaacaggcccccagatctagaagcctgattgtccattttcatggaggtggatttgttgcccaaacttctcgaagccacgagccataccttaaatcctgggcccaagaactcggagctccgatcatctctatcgattactccttggcgccggaggcacctttcccacgggcactcgaagagtgttttttcgcctattgttgggctattaagcactgcgctcttctcggttccacaggcgagcggatctgcctcgccggcgatagcgccggcggcaacctctgtttcactgtggcattgagggcggccgcatatggcgttagggtccccgatggaatcatggccgcctaccccgcaaccatgctgcagccagcagcttcaccgtcacgattactctccctaatggacccacttctccccctatctgttctgagtaagtgtgtgtcagcctacgccggagccaaaaccgaggaccactcaaacagcgaccagaaggcacttggcatgatgggactcgttcggagggacactgccctcctgctccgcgacttcagacttggagcaagtagttggttgaatagttttctggaactgtctggtcgtaagtcccagaagatgtctgagcctatcgctgaacccatgaggcgcagcgtgtcagaggcagcgttagcccagcctcagggcccattggggaccgacagtctgaaaaaccttaccttacgagacctgagcctgcgaggcaacagcgagacgagtagtgatacccccgagatgagtctgagtgccgaaaccttgtccccctccacacccagcgatgtaaatttccttctccctcccgaggatgccggcgaggaggccgaggctaaaaatgagttgagccccatggaccgcggactcggcgtgcgcgcagcttttccagaaggttttcacccaagacgttcaagccagggggccactcagatgcccctttactccagcccgatcgtgaagaaccctttcatgtccccgctcctggcaccagactcaatgctgaagagtctccccccggtgcatatagttgcttgtgcgttggaccccatgttagatgactcagtcatgctcgcaagacggctgcgcaacctcgggcagcccgtgaccttgcgagtggtggaagacctgccccacggtttccttactctcgctgcgttatgccgggaaacacgtcaggcagctgagctctgtgttgagaggattagactggtcttaacaccgcctgctggcgcagggccttccggtgaaacaggggcagcaggtgtcgatggagggtgtggaggacgccactag

SEQ ID NO: 122631 - DNA, 1356 bp, Artificial Sequence
  Description of Artificial Sequence: Synthetic coding sequence
atgctgcgcttctacctcttcatatccctgctgtgcctgagccggtccgatgccgaggagacttgtccctctttcacacgcctctcttttcacagcgccgtggtggggaccggactcaatgtgaggttaatgctgtacactcggaagaacctcacttgtgcgcagacaatcaatagcagtgcatttgggaatctcaatgtgacgaagaagaccacgtttattgtgcacgggtttagaccaacaggctctcctcccgtctggatggatgatctagtgaaaggtctactctcagtcgaggatatgaatgtcgtggttgtcgactggaatagaggggctaccacactcatctatacgcatgccagcagcaagactcgaaaggtggccatggttctcaaggagttcattgatcaaatgcttgcagagggagcctctctggacgacatctacatgattggtgtgagtctgggggcccatatttcaggctttgtgggagaaatgtacgatggttggctaggcagaataaccggacttgaccctgcaggacctctcttcaatgggaaaccacatcaggacagactggacccctctgacgcccagttcgtggacgtcattcattccgacacagacgctctgggatacaaggagccgcttggcaacatcgacttttaccccaatggaggcctggaccagcccggctgtcccaagaccatcctgggcggattccagtacttcaagtgtgaccatcagcggtccgtttatctatatctgagctcactgagagagtcttgtactatcaccgcttatccctgcgactcctaccaggactacagaaacggcaagtgcgttagctgcggcactagccagaaggagtcatgtccccttttgggctactacgccgacaattggaaagatcacctgcggggcaaggatcccccgatgactaaagcgttctttgacaccgctgaagaatctcccttctgcatgtaccattacttcgtggacatcattacgtggaacaagaatgttcgaaggggcgatataacaataaagctcagggacaaggcgggtaataccacggagtcaaaaattaaccatgaacctacaaccttccagaaataccatcaagtgagtctgttggctcgctttaaccaggatctggataaggttgcagccatctccttgatgtttagcacagggtccttgatcggaccacgctacaagcttcgaatcttgaggatgaagctacggagcctagcccaccctgaaaggccccagctctgtcggtatgatttagtcctaatggagaacgtggaaactgttttccagcccatcctctgccctgagctccagctctag

SEQ ID NO: 122632 - DNA, 1446 bp, Artificial Sequence
  Description of Artificial Sequence: Synthetic coding sequence
atgcttctgaagtgtttgcacaataatttatgccagaagtattcagcacacgcctttcaattctccccgagaaacgtgctgtggctgctggtggtatgccttcgcagcgataacaagagaccttgtctagaattctcacagttatccgtgaaggattccttccgcgatctattcattcccaggattgagactattctgatgatgtacacaaggaataacctgaattgcgcggagcccctctttgaacagaacaatagcctaaacgtcaatttcaacacgcagaaaaagaccgtctggttaatacacggataccgtccagtgggctctattcccctgtggctgcagaacttcgttaggattctgctcaacgaagaagacatgaacgtcatcgtcgtggattggtcacgaggcgcgaccacttttatctacaaccgggctgtgaaaaacacccgaaaggtggccgttagtttgagcgtacacattaaaaacttgctaaaacacggcgcctccctggacaattttcacttcatcggtgtttcattgggggcccatatttccggctttgtagggaagatattccatggccagcttggacggatcaccggcttggaccctgccggaccccgattctcaaggaaacctccttactcccgactggactatacagacgctaaatttgtagacgtgatacattcggacagcaacggactcggaattcaagagccattagggcacatagatttctatcccaacggagggaacaagcagcccggctgtccaaagagcattttttcaggaattcagttcatcaaatgcaaccaccaaagggctgtgcacctctttatggcctccttagagaccaactgcaactttatctcctttccatgccggtcttacaaggactataagactagcctctgcgttgactgcgactgttttaaagaaaagtcgtgtccccgattggggtaccaggcaaagctgttcaaaggggtgctgaaagaacggatggaagggcggcccctgaggaccaccgtcttcctggacacatcagggacgtaccctttctgcacgtattatttcgttctctcgattatagtgccagacaaaacaatgatggatggctcttttagcttcaaactgttgaatcagctggggatgatcgaggaacctagactctacgaaaagaacaagcccttctacaaacttcaagaagtaaaaatcctcgcccaattctacaatgactttgtcaatataagttctatcgggctgacttatttccaatcttccaatttgcagtgtagcacgtgtacctataagattcaaagactgatgcttaagtctttgacttatcccgaacgacccccgctgtgcagatataatatcgtgttgaaagaccgggaagaagtcttccttaatcccaatacctgcactccaaaaaatacatag

SEQ ID NO: 122633 - DNA, 471 bp, Artificial Sequence
  Description of Artificial Sequence: Synthetic coding sequence
atgaacgtgatcgttgtggattggagtcggggagccaccacattcatctataaccgtgcggttaagaacactagaaaagtcgccgtcagtctttccgttcacatcaagaatcttttgaaacacggcgcctccctggacaacttccacttcatcggggtcagtctgggagcccatataagcgggttcgttggtaaaatctttcatgggcaacttggtagaataactggtctggacccggcaggcccacgattctcccgaaaaccaccctattcccgactcgattacacagatgccaagtttgtggacgtcatccacagcgacagtaacggaattcagtttataaagtgcaatcaccagagagccgtacacctcttcatggcctcactcgaaacaaactgcaatttcattagctttccgtgtcgttcgtataaagactacaaaacttctctgtgcgtagactgcgactgttag

SEQ ID NO: 122634 - DNA, 426 bp, Artificial Sequence
  Description of Artificial Sequence: Synthetic coding sequence
tagtacaaccgcgcggttaagaacacgcggaaggtagctgtgtccctctccgtgcatattaaaaacctgctgaagcacggcgcttcactcgataactttcatttcatcggcgtctccttgggggcccacattagtggcttcgtcgggaagattttccatggccagctcgggagaatcacaggactggatcccgcaggacctcgcttttcccgcaagcccccatactccagattggattacactgatgcaaagttcgtggatgttatccatagcgatagcaacgggatacagttcatcaaatgtaaccaccagcgagccgtacacctttttatggccagcctggaaaccaactgcaattttatttcattcccttgcagatcatacaaggactataagacatctctgtgcgtggactgtgattgttag

SEQ ID NO: 122635 - DNA, 1383 bp, Artificial Sequence
  Description of Artificial Sequence: Synthetic coding sequence
atgcgcgtgtacatcttcctgtgcctgatgtgttgggtgcgctctgataataaaagaccgtgcttagagttcagccagttgtcagtgaaagattcctttagggacctcttcatcccgagaatcgaaaccatactgatgatgtatactcggaacaatcttaattgcgccgaaccccttttcgagcaaaataattctcttaacgtgaactttaacactcagaaaaaaacggtctggctgatccatggatacaggcccgttgggtcaattcccctctggttacagaatttcgtaaggatcctacttaacgaggaggacatgaatgtcatcgtggtggactggagtagaggggcaaccacattcatttacaacagggccgtgaagaacacgaggaaggtagccgtctccttgtccgtccacattaaaaatcttctgaaacacggtgcctcgttggataacttccacttcattggggtctccttgggcgcacacatttcggggttcgttggcaagatcttccatggccagctgggccgaatcacgggtctggaccctgctgggcctcgcttctctcgcaaacccccgtattcgagactagactatacggatgccaaatttgttgacgtcatccactccgattctaatgggctgggcatccaggagcccctgggtcacatcgacttctacccaaacggtggaaacaaacagcccggatgccctaagtcgattttttcaggcatccagtttattaagtgtaaccaccagagggctgtgcacttattcatggcctccttggaaacgaactgtaacttcatcagcttcccgtgccgctcatacaaggattataagacctccctctgtgtcgactgcgactgcttcaaagagaaatcttgcccacggctgggttaccaagcgaaactgtttaagggcgtcctgaaggagagaatggaaggtagaccattgcgcacaacagtttttttggatacctcaggcacctaccctttttgcacctactatttcgtcctttctataatcgtacctgacaagacaatgatggatggctcgttcagcttcaaactgctgaaccagttaggcatgatcgaggaacctaggttatacgaaaaaaataagcccttttataagctgcaggaggtgaagatactcgctcaattctataatgattttgtaaacattagctctattggtctcacatacttccagtccagcaaccttcagtgcagcacatgtacctacaaaatccaaagactaatgctgaagagcctcacctacccagagaggcctcccctttgtcgatacaatatcgtgctgaaggatagagaagaggtttttctgaatcctaatacttgcactccgaagaatacttag

SEQ ID NO: 122636 - DNA, 2673 bp, Artificial Sequence
  Description of Artificial Sequence: Synthetic coding sequence
atgaactacgtgggacaactggcaggtcaggtttttgtgaccgtcaaggaactgtataagggattgaaccccgcgaccctctccgggtgtattgatatcatagtaattaggcagccgaacggtaacctgcagtgttcaccattccatgtgagattcggaaagatgggggtgctccgctcccgggaaaaggtggttgacattgagattaacggcgagagcgtggacctgcatatgaagttgggcgacaacggggaagcattcttcgtacaggaaaccgacaacgaccaggaggtgatccctatgcacctggcgacctccccaatcctgtcagaaggagctagccggatggagtgccagctaaaacggggaagtgtggatcggatgcggggcctcgatcctagtactccagctcaagtaatagccccgtctgaaaccccgtcctcatccagcgtcgtaaagaaaagacgaaagagaagaaggaagtctcaattggactctcttaaacgagacgacaacatgaacacctcagaggatgaggatatgtttccaatcgaaatgagcagcgacgaagcaatggaattgctggagagctcccgtaccctgccaaatgatatccccccctttcaggacgacatccctgaagagaacctgagcttggccgtgatctacccccaatcagccagctatcctaacagcgatcgagagtggtctccaactccaagcccaagtggttcacgcccatcaacgcccaagtccgattccgaactggtatcaaaaagcaccgagagaacaggccagaaaaatcccgagatgctgtggctctggggcgagttaccccaagcggccaaatctagtagtcctcataaaatgaaagagagctcaccactgtcctccaggaagatctgtgataaatcacacttccaagctattcactccgagagtagcgatacattctcagatcagtcaccaactttggtcgggggcgccttgttagaccagaataagccccagacagaaatgcagtttgttaatgaagaagacctggaaaccttgggcgccgctgccccattgctgccaatgattgaggagctgaaacccccttcggccagtgtggtgcagacagccaataagaccgatagtccctccagaaaaagggacaagaggtctcggcatttaggggctgatggtgtgtatttagacgaccttacagacatggaccctgaagtggctgcgctctatttcccgaagaatggcgacccttccggtctggccaaacacgcctctgataatggtgcccgtagcgccaatcagtctccccagtcggtcggctcttcaggggtggactctggcgtggagagcacttcggacgggcttagagatctgccctccatcgcaatctcattgtgcggagggcttagtgaccatcgcgaaataaccaaagacgccttcctggagcaggcagtgtcctatcagcaatttgtggataaccctgcaataattgacgacccaaaccttgtggtaaaaattgggtcaaagtactataactggactacagctgcccccctgcttctcgctatgcaggcattccaaaaaccattgcccaaagctaccgtggagagtattatgagagataaaatgcctaagaagggagggagatggtggttctcttggcgcggtagaaacaccacaatcaaggaagagtctaagcccgagcaatgtctggcaggtaaagcccatagcactggcgagcagccaccacaactgtctctagccactcgggtcaaacatgagtctagtagtagtgatgaggagagggctgcagccaagccaagtaacgccggccatctgcctctcctgcctaacgtatcctataaaaagacccttcgcctgacgagcgagcagctgaagtctctcaagttgaagaacggaccgaatgacgtggtctttagcgtgacaacccagtatcaaggaacatgccggtgtgagggcaccatctacctttggaactgggacgacaaggttattattagcgacatcgacggaactattacacgaagtgatactctcggccacattttgcctaccctggggaaagactggacacaccagggcatcgcaaagctttatcacaaagtgtcgcagaacggctataaattcctttattgttctgctagggcaattggaatggcagatatgacacggggatatctgcactgggtcaacgaaagaggtaccgtgctcccgcagggtcctctgctgttgtcaccaagttcattattttcagctttacaccgggaagtgatcgagaagaaacccgaaaaatttaaagttcagtgcctcacagatatcaagaacctgttcttccctaataccgaacccttttatgcagcatttgggaaccggcccgcagacgtttacagctacaaacaggtgggtgtgtcactcaacagaatttttacggtcaatcctaaaggcgagctggtgcaagaacacgccaagactaatatttcttcttacgtgagactctgcgaggtggtggaccatgtgtttcccctgctcaaaagatcccactcgagtgacttcccatgcagcgacacattcagcaatttcacattttggagagagcccctgccaccttttgagaatcaagacattcattccgcatccgcctag

SEQ ID NO: 122637 - DNA, 1863 bp, Artificial Sequence
  Description of Artificial Sequence: Synthetic coding sequence
atgctctggctgtggggcgaactaccccaggccgctaagtcctccagcccccataaaatgaaagaaagttctcccctgtcgtctcgtaaaatctgcgacaagagccacttccaagcgatacatagtgaatcttccgacacttttagcgatcagtcccccactcttgtcggcggagctcttttggatcagaataagccacaaaccgagatgcagtttgtgaacgaagaagacctggagactctcggcgctgctgccccgctgctgcccatgatagaggaattaaaacccccctcagctagcgttgttcagacagccaataaaaccgatagcccatctcgcaagcgcgacaaacgatcccgccacctgggagccgatggcgtatacctggatgatctcaccgatatggacccagaggtcgcagcactctactttcccaaaaacggggatccatccggcctcgctaagcacgcttccgacaacggggcgcggagcgcaaaccagtctccccaaagcgtggggagcagtggtgtggattcgggggtagagtcgacaagtgatggacttcgcgatttgcccagcatagctatcagcttatgtggcggcctgtccgaccatcgagagattacaaaagatgctttcctcgagcaggccgtgtcataccagcagttcgttgataaccctgcaattatcgacgaccccaaccttgtcgtaaagatcggatcgaagtactataattggactacagctgccccccttctgctggccatgcaggcctttcagaaaccattgcccaaagcaaccgtggaatccatcatgcgcgataagatgccaaagaagggcgggcggtggtggttcagttggcgcgggcggaacacgaccataaaggaggaaagcaagcctgagcagtgcctggccggcaaagctcacagcacaggagaacagccaccacagctgtctctggcaaccagagtcaaacacgagagctcgtctagcgatgaagagagagctgctgctaaaccctccaatgccgggcacctgcccttactccccaacgtatcctataagaaaacattacggctgacctctgagcagctaaagtccttgaaactgaagaacggccccaatgacgtggtctttagcgtgacgacccagtatcagggaacctgtcgttgcgagggcactatatacctgtggaactgggatgacaaggtgattatctctgatatcgatggcaccatcacacgaagtgatacactggggcacatattgcccaccttagggaaagattggacacaccagggcatcgctaaattgtatcacaaagtcagtcaaaacggctataagttcttatactgcagcgcgcgcgcaatcggaatggcagatatgacccggggttacctgcactgggttaacgaacgaggaactgtgctcccacagggcccacttctgctgtccccctcatctctgttctccgcgctgcatagggaagttatcgagaaaaaaccagaaaagttcaaggtccagtgtctaacagacatcaagaaccttttcttcccaaatacagaacctttttacgcagccttcggaaaccgcccagcagacgtctacagctacaagcaagtaggcgttagcctcaaccggatctttaccgttaatcccaagggcgagctggtacaagagcacgccaaaacaaacattagtagctacgttcggctgtgtgaggtcgttgatcacgtgttccctttacttaagcggagccatagctccgatttcccatgttccgataccttctcgaattttactttttggcgggagcccctgccaccttttgagaaccaggatatacactccgcctcagcctag

SEQ ID NO: 122638 - DNA, 2799 bp, Artificial Sequence
  Description of Artificial Sequence: Synthetic coding sequence
atgtctagggtgcagactatgaactacgttggacaactggctggccaagtctttgtgactgtcaaggagttatataaggggctgaaccccgcgaccctgagtgggtgtatcgacatcatcgttatacgacagccaaacggcaacttgcagtgctcacctttccatgttcgattcggcaagatgggagtcctacggagccgcgagaaagtcgttgatatagaaatcaatggagaaagtgtcgatttgcatatgaaactgggagataacggcgaagccttttttgtgcaggagacagacaatgaccaggaggttataccaatgcacctcgctacaagtccaatccttagcgagggcgccagtcggatggaatgccagctgaaacgagggtcggtcgatcgaatgcgcggcctggatccgtctacacccgcacaagtgattgccccttcggaaacaccatccagttcttccgtcgttaagaaacgccggaaacgccggaggaagtcccagctggactccctgaagagggacgataatatgaacaccagtgaagatgaagatatgtttcccattgagatgtcctcagatgaggccatggaactactggagtcgagccgcacgctgcctaatgacatcccgccgtttcaggatgatatacccgaggagaatctatcactagccgtgatttacccacagagcgcaagctaccctaattccgacagagagtggagccccactccttcttccctagtggactgtaaacgtactgccccacacctggccgttgcggcggagggcggcctgtcctcttcatgccctccccaatcatcactgttccacccatcagaatcacctagcggcagtcgtccttccactccaaagtcagacagtgaactggtcagcaagtcgactgagcgtaccggacagaaaaatccagagatgctgtggttgtggggtgaactaccccaagccgccaagagttcatccccacataagatgaaagagagttctccactgtcatctaggaagatatgcgataagtctcatttccaagccattcattccgaaagctcggataccttctctgaccaatctcctaccctcgtgggtggagctctgttagatcagaataagccccagacagaaatgcaatttgtcaacgaagaggatctggaaactttgggtgctgctgcacccctcttgccaatgatcgaggaactgaagccccctagcgctagcgtcgtgcagacagcgaacaaaaccgatagcccttcccggaaacgagacaaaaggtcaagacacctgggggctgacggcgtataccttgacgacttaactgacatggacccagaagtggctgccctctactttccaaagaatggagatcctagtggcctggctaaacacgctagcgacaacggcgcgcgaagcgccaatcagtccccccaatctgtcggttccagcggtgtcgacagtggcgtagaaagtacaagtgacgggctgcgcgatctgccgtctatcgccatttctctctgcggcggactgagcgaccaccgcgaaattacgaaggatgcgtttctcgaacaggccgtgtcataccaacaatttgtcgacaatcctgcaataattgacgatcctaatctcgtggttaagattggtagcaagtactataactggaccacagcggcccctctgctgttggccatgcaagcctttcagaagcccctgcccaaggccactgtggagtcaataatgagggacaaaatgcctaagaaagggggaaggtggtggttctcctggagagggagaaacaccacaatcaaagaggagtccaagcccgaacagtgtctcgcaggcaaggcacactcaactggcgaacagcccccccaactcagtctggccactcgtgtgaagcacgagtccagttcaagtgacgaggaaagagccgctgctaaaccttcaaacgccgggcacctccccttacttccgaacgtgtcctacaagaaaactctgcggcttacgtctgaacagctcaagtccttgaagctgaaaaacgggcccaatgacgtcgtttttagcgtgactacacagtaccagggaacatgcagatgcgaaggaactatttacctctggaattgggacgacaaggttatcatttcagacatcgatggcacaatcactcgtagcgacaccctaggccacattctgcccacattaggcaaggactggactcaccagggaatagctaagctgtaccacaaagtgtctcaaaatgggtacaaattcctgtattgctctgcgagggctatcggtatggccgatatgaccagaggatacctgcattgggtcaacgaacgggggacagtgctgccccagggtcctctgctcctgagtcctagcagtctgttcagcgctctgcacagagaagtgattgagaagaagcctgaaaagtttaaagtccaatgcctcactgatattaaaaacttattctttccgaacacggagcccttttacgctgcattcggcaataggcccgctgacgtctatagttacaaacaggtgggggtctccttgaacaggattttcacggtcaatcccaaaggggagcttgtccaagaacatgccaaaactaacatctcttcttacgtcaggctctgtgaggtagtggaccatgtgtttcctctgctgaaacgttcgcactcttcagattttccctgctcggacaccttttcgaacttcacattctggcgggaacctctgcctccttttgaaaatcaagatatccactcggcatccgcctag

SEQ ID NO: 122639 - DNA, 1176 bp, Artificial Sequence
  Description of Artificial Sequence: Synthetic coding sequence
atgcaggccttccagaaacctttaccgaaaagctcctgtttgagctacttacatgtgatactcgacgccatcaggttttgcttctccaagattttcaacgcgcagatcgcaaccgtcgagagcataatgagagacaaaatgccgaaaaagggcggccgatggtggtttagttggcgtggcaggaataccaccatcaaggaagaatctaagcctgaacagtgtctggctggcaaggctcattctactggagaacaacctccccagcttagcctggccaccagagtcaagcatgaatcatcatcttcagacgaagaaagagcagcagccaagccctctaacgcagggcacctgcctctgctgcccaatgtgagctacaaaaaaaccttaagactgaccagtgaacagctaaagtctctaaagctgaaaaatggccctaacgacgtggttttcagcgtgaccacccaatatcagggaacctgtaggtgcgaagggaccatatatctttggaattgggacgacaaggtcattataagtgacatcgatggcactattacgcgaagcgatacgctgggtcatattctgcctactttgggaaaggactggacccaccaggggatagcgaaattgtaccacaaagttagtcagaacgggtacaagttcctgtactgctctgccagagcaattggtatggcagacatgacacggggatatctgcactgggtaaacgagcggggcaccgtattgccccagggacctcttttactgagtccctccagtttgttctccgctcttcatcgagaggtcatcgaaaagaagcccgagaagttcaaggtccagtgcctgaccgacatcaagaacctgttctttccgaataccgagccattctacgctgccttcggcaacaggcccgcggatgtttactcatacaaacaggtgggcgttagtttgaataggattttcacagtcaaccccaagggtgaactggtccaggagcacgccaagacaaatatctcttcatacgtccggctttgcgaagtggtggaccacgtgtttcctttgctcaaaagatctcactcctcggacttcccatgtagcgataccttctccaacttcacattttggcgggagccacttccgcccttcgagaaccaggacattcactctgcctcggcatag

SEQ ID NO: 122640 - DNA, 87 bp, Artificial Sequence
  Description of Artificial Sequence: Synthetic coding sequence
atgaactatgtggggcagctggccggccaagtgtttgtcaccgtcaaggagctatacaaaggcttgaacccggcaactctatcatag

SEQ ID NO: 122641 - DNA, 2691 bp, Artificial Sequence
  Description of Artificial Sequence: Synthetic coding sequence
atgtcgagagtccagacaatgaattacgtcgggcagctggctggtcaggtttttgtgacagttaaagagctgtacaagggcctgaatcctgctactctctccggatgcattgatatcatcgtgattaggcagccaaatggcaaccttcaatgttctccattccatgtccggttcgggaaaatgggtgttctgcggtcacgcgaaaaggttgtcgacatcgagattaatggagaaagcgtcgatctgcatatgaaattaggggacaacggagaagcgttctttgtgcaagagacagataatgaccaagaggttattcctatgcatctggcgacaagccccatcctgtcagagggggcatctaggatggagtgtcagttgaagcgcgggtcagtggaccggatgaggggtctggacccttctactcccgcacaggtgatcgcgcccagtgagactccttccagcagctccgtcgtgaaaaagcgaaggaaacggagaagaaaaagtcagctcgattccctgaagcgcgacgataacatgaataccagcgaggacgaggatatgtttcctattgagatgagttcagacgaggcaatggaactgctggaaagttcccgcacgcttcctaatgacattccacccttccaggatgacataccagaagagaacctgagtttggcagttatttaccctcagtccgcctcttacccaaattctgatcgggagtggtcccccacaccgtcccccagcggtagccgacccagcactcccaaaagcgactcagaactggtgagtaagtctaccgagcgcacaggccagaagaaccccgaaatgctgtggctgtggggggagttaccccaggctgccaagtccagtagcccacataagatgaaggaatcttcacctctctctagcagaaagatatgcgacaaatctcattttcaggcgatacattctgaatcctcagacacttttagtgaccagtctcccactctggtgggtggagcgttgctagatcagaataaaccccagactgaaatgcaattcgttaacgaggaagacctggagactttgggggcagctgccccccttttgcctatgatcgaagagctgaaacctccaagcgcgagtgtcgtgcagacggctaataaaacagactccccctctcgcaagagggataagagatccaggcatctgggggccgatggagtgtaccttgatgacctgactgatatggacccagaggtcgctgcactgtattttcccaaaaacggggatccctctggactggctaaacatgcttccgataacggcgccagatcggccaatcagagcccgcaatccgtaggcagctcaggcgtggactccggcgttgaatcaaccagtgacggactgcgggaccttccttctatagcaattagcctctgcgggggcttgtcggatcacagagaaatcactaaagatgcattcttagaacaagccgtttcctaccagcagttcgtggacaacccggcgattattgacgaccccaaccttgtggtcaagatcggctccaagtactacaactggacaaccgcagcccccctgctgctggcaatgcaggcctttcagaagcctttgcccaaggccaccgtggagtccatcatgagagataagatgcccaagaaggggggcagatggtggtttagctggcggggacgcaacaccacaataaaggaagagtctaaaccggagcagtgcctcgcaggcaaagcccacagcaccggggaacagccaccacagcttagccttgccaccagggtcaagcacgagagtagctcctccgacgaggaaagagcggcggcaaaaccatcaaatgcaggacacttaccattattgccaaacgtgtcctacaagaaaacactacgcctgacttctgagcagcttaaaagcctgaagttgaaaaacggacccaacgacgtggtctttagcgtcacaacgcagtaccaaggaacctgccgatgcgagggaacaatctatttgtggaattgggacgacaaagtgatcatttctgacatcgatggaacaattaccaggtctgacaccctgggccacatcctgcctacattagggaaagattggactcatcagggcattgctaagctttatcataaagtgtcacaaaacggatataagtttctatactgtagtgcacgagcaattggcatggccgacatgacccgcggatatttgcactgggttaacgagaggggcaccgttctcccccaaggcccgcttttactctctccttcatcgttgttttcagctttacatagggaagttatcgagaagaaacctgagaagtttaaagtccaatgccttaccgacatcaaaaacctcttctttcccaatacagaacccttctacgctgcattcggcaacaggcccgcagacgtgtacagctacaagcaggttggagtttctctaaacagaatctttaccgtaaatccaaagggtgagctcgtgcaggaacacgcaaaaaccaatattagctcttacgttcgcctgtgtgaggtggtggatcatgtgttccctcttctgaaacggtctcattccagtgatttcccttgttcagatactttttcaaactttactttctggagagagccactgcctccattcgaaaatcaggacatccacagtgcctccgcttag

SEQ ID NO: 122642 - DNA, 291 bp, Artificial Sequence
  Description of Artificial Sequence: Synthetic coding sequence
atgaattacgtagggcagctcgccgggcaggtgtttgtgaccgtcaaagagctttataaaggccttaaccccgccaccctgagcgggtgcatcgatatcatcgtaattaggcaacctaatggaaacctacaatgttccccattccatgtgaggttcggaaagatgggagtacttcgttcacgagagaaggtcgttgacattgagattaatggagaatctgttgacctccacatgaagttgggcgacaacggagaagccttcttcgtccaagaaactgacaacgatcagtag

SEQ ID NO: 122643 - DNA, 2928 bp, Artificial Sequence
  Description of Artificial Sequence: Synthetic coding sequence
atgggagaacaggatggtattcgttcttcatcatgggagaccagccaggggaagtcctctccagactctgcctggtcttggattcccataatgcgggatcccggttggatacgcaacgtctggtcatcaaatattaacgtgcagacaatgaactatgtcggacagctggctggacaagtctttgtgacggtaaaagagctatacaagggcctgaatcccgcaacactgagtggatgcatcgatatcatcgtcattaggcaacccaacggcaatcttcagtgctcgcctttccacgtcaggtttggcaagatgggagtcctccgtagcagggagaaagtggttgatattgaaattaatggcgagagtgtggacttacacatgaaactaggtgacaacggagaagccttcttcgtgcaggaaaccgataacgatcaagaggtaatcccaatgcacttggctacaagccccatcttgagtgagggagcctccagaatggagtgccagttaaagcgcggttcagtcgaccgaatgcggggattggatccttccaccccagcccaggtcattgctccgagcgaaactccttctagctccagcgttgtgaagaagcggcggaagaggaggagaaagagccagctcgactcattaaaacgcgacgataacatgaacacaagtgaggacgaagacatgttcccaatcgagatgtctagtgacgaagccatggaactgctggaaagcagcaggactctgcccaatgatattccaccattccaggacgacatccccgaggagaacctttctctagcagtcatttatccacagagcgcatcgtatcccaacagcgaccgcgagtggtcccccactccatcgtctctggtggactgcaagagaactgctccccatttggctgttgccgctgaaggaggtctgtctagctcatgtcccccccagagttcccttttccacccatcggagagcccctccggatctaggccttccactccaaaaagcgatagcgagctggtatctaaaagtacggagagaactgggcagaagaatcctgagatgctctggctttggggcgaactgcctcaggcggcgaagtcgagctccccccacaagatgaaggaaagcagccctctgtcctctagaaagatttgtgataaatctcactttcaggccattcacagtgagagttccgataccttctcagaccagtcccccacgcttgttgggggggctctcctggatcaaaataagccacagactgaaatgcagttcgtaaacgaagaggatctcgagacattgggtgcggcagcccccctcttacccatgatcgaagagctcaagcctcctagtgcgagcgtagtgcaaaccgctaacaagaccgattcgccttcccgcaaaagggataagcggtcccgacatctgggggcagatggggtctatttggacgatctcaccgacatggaccccgaggttgccgctctgtattttccaaagaacggcgacccttccggtttagcaaagcatgcctctgacaacggtgctaggagcgcaaaccagagccctcagtctgtgggtagtagtggcgtggactcaggagttgagtctacatcagatggacttagagaccttccctccattgctatttcgctttgtgggggactttctgaccacagagagattactaaagacgcattcctcgagcaagcagtgagctatcagcaattcgtggacaatcctgccatcattgatgatcctaatctcgtcgttaagattgggagcaagtactacaactggacgactgccgcgcccctgctgctggcaatgcaggcctttcagaagcctctcccaaaggccacagtggagtcaatcatgagggacaagatgccgaaaaagggaggccgttggtggttttcctggagaggaaggaatactactattaaggaagagagtaagcccgaacaatgcttggccggcaaggcccacagtaccggtgagcaacccccacagttatcccttgctactcgagttaagcacgagtcaagcagctcggacgaagagcgggcagccgcaaagccatcgaatgccggccatctgccacttctccccaacgtgagttacaaaaagactcttaggcttacttcagagcaactcaagtccctcaagcttaaaaacgggcccaatgacgtggtgttttccgtcacaacccagtatcagggaacgtgtcggtgtgaggggacaatctacctttggaattgggacgacaaagtgattatctcagatattgacggcactatcacgagatctgatactctcggccacatcctaccgaccctgggcaaggactggacacaccaaggaatcgcaaagttgtaccataaagtgagtcagaatgggtacaaattcctctactgttcagccagagctataggcatggcggatatgactcggggctacctgcactgggtgaatgaacgcggtactgttctgccacaaggtcccctgctgttgagtcccagttctcttttctcagcacttcacagagaggtgatcgagaaaaaacccgaaaagttcaaagtacagtgcctgactgacattaaaaacctattcttcccgaacacggagcctttttatgcagcctttggaaaccgacccgccgatgtatactcttataagcaggtgggcgtcagcctcaataggatcttcaccgtcaaccccaaaggcgagctggtccaagagcacgcaaaaacaaatattagctcctatgttagattgtgtgaggtcgtggatcacgtgttccctctgttgaaacgctcccactcttctgactttccgtgttccgatactttttccaactttaccttttggagagagccgctgccccccttcgaaaaccaggatattcacagtgcctccgcgtag

SEQ ID NO: 122644 - DNA, 1380 bp, Artificial Sequence
  Description of Artificial Sequence: Synthetic coding sequence
atgtcgagggtgcagaccatgaactacgtcggacagctggcaggtcaggtgttcgttacggtgaaagaactgtacaaaggtcttaatccagccactttgtcaggttgcattgacatcattgtcattcgccagcccaacggcaacctgcagtgctctccgtttcacgtgcgtttcggcaagatgggggtgctgcggtccagggaaaaagtagtcgacatcgagattaacggggagagcgtggatctgcacatgaagctgggcgataatggcgaggctttctttgtccaagaaaccgacaacgatcaagaggtgattcccatgcacttggcaaccagtccaatcttgtctgaaggtgcgagtcgtatggagtgccagctcaagagaggctcagtggatcgtatgagaggcctggaccctagtacacctgcccaggtgattgccccctctgaaacccccagcagcagctccgttgtgaaaaagaggcgtaagaggaggaggaaaagccagttggactccctaaaaagagatgacaatatgaatacgtcggaagacgaggatatgtttccaatcgagatgagctcagatgaggccatggagttgctggagagctcgcgtacactgccaaacgacattccaccttttcaagatgatatccccgaagagaacctcagtctggccgttatttacccccagtccgcgagctaccccaactctgaccgagaatggtcccccacgccctctagcctggtggactgtaagcggacagcaccccacttggcagtggctgctgagggcggcctgtccagttcttgtcctccccaatctagccttttccacccttcagagtcgcctagcggcagccggccaagtacccccaaatcagactccgaattagtgagcaagtcgacggagcgaacagggcagaagaatccggagatgttatggctgtggggcgagctcccacaggcagcaaaaagctcctcaccacacaaaatgaaagagagtagccccctgagcagtcgcaagatctgtgataaaagccatttccaagccatacactcggagagtagcgatacgttctctgatcaatccccgactctcgtggggggcgccttactagaccagaataaaccccagacagaaatgcagttcgtcaacgaagaggatctcgagaccctgggtgccgccgccccattattaccaatgatcgaggaattgaaacccccaagtgcaagcgtggtccagactgccaacaaaacagactcaccaagcaggaagcgggacaagcgaagccggcacctgggggcagatggggtgtaccttgacgacctgaccgacatggacccggaggtggccgcactgtacttcccaaaaaagtag

SEQ ID NO: 122645 - DNA, 2691 bp, Artificial Sequence
  Description of Artificial Sequence: Synthetic coding sequence
atgaactacgtcggccagctcgcaggacaagtcatcgtgaccgtgaaggagctctacaagggcatcaatcaggctactttaagtggctgcatcgatgtaatcgtagttcagcagcaagacggctcctaccaatgttcaccctttcatgtccgcttcggtaaattaggggtactgcggagtaaagaaaaagtgatagacatagagatcaatgggtccgcagtcgatttacatatgaaactcggtgacaacggggaagcctttttcgtggaggaaaccgaagaggagtacgaaaagctcccggcttacctcgcaaccagccctattcccaccgaagaccaattttttaaagacatagatacaccactcgtgaaatccgggggcgacgagactccctctcagagttccgacatctcccacgtcctggagaccgaaaccatcttcaccccgagttccgtgaagaaaaagaagagacgccgtaaaaagtacaagcaagactcaaagaaagaagaacaggctgccagcgccgccgcggaggacacttgtgatgtgggggtcagttcagatgacgacaagggcgcacaggccgccaggggctcttctaatgctagtttaaaggaagaggagtgcaaggaaccgcttctttttcattctggggaccactacccattgtcagacggagattggtcccccttagagaccacttaccctcaaacagcctgtcctaagagcgatagcgaattggaagtgaagcctgctgaatcactattgcggtccgagtcacatatggaatggacctggggcggtttcccggagtccactaaagtttctaagcgggagagaagcgaccaccacccccgaaccgcgacaatcaccccaagcgagaatactcactttcgcgtcattccatccgaagataatcttatctctgaggtggaaaaggatgcctctatggaagacacagtctgcacaatcgtcaaacccaagccacgggcattgggcacccagatgagtgaccccacatccgtcgccgagctccttgaaccaccgctggaatctacccagatttcttcaatgctcgatgccgatcatctccccaacgctgctttggcagaagccccctccgaatccaaaccagcagccaaagtcgactcaccgagcaaaaaaaagggggtccacaagaggtcacagcaccaaggaccggacgatatctatctcgacgacctcaagggcctggagcctgaagtcgccgcgctgtattttcctaaatccgagagtgagcccggaagtaggcaatggcccgagtccgacactttgtccgggtcacagtctccccagagtgtgggaagcgctgctgccgattccggcaccgaatgtttatccgattccgccatggatctgcccgatgttacactgagcctttgcggtggactgtccgaaaacggggagataagcaaagaaaagttcatggaacatatcataacttatcacgagtttgccgagaatcctgggcttattgacaatcctaatctcgttatccgaatatacaaccggtattataactgggctcttgccgctcccatgatcctgagtcttcaggttttccagaagtctcttccaaaggctacagttgagtcttgggttaaggacaaaatgcctaagaagtccggccgctggtggttttggaggaagcgggagtccatgaccaaacagctgcccgaatcaaaagaaggcaagtccgaggccccccctgcaagtgacctgccgtctagttccaaggagcccgccggagcccgccccgctgagaacgattcctcgagtgatgagggcagtcaagagctggaggagagtatcacggtcgaccctatccccaccgagcctctgtcgcacggctccactacctcctacaagaagagcctgagactgtccagtgaccagatcgcaaagttaaaacttcatgatgggcctaatgacgtggttttctctataactacccagtaccagggcacctgtcggtgtgccggcaccatttatctctggaattggaacgacaagattattatctctgacatagacgggacaatcactaaatctgacgcactgggtcagatcctcccccagctcggcaaagactggactcaccagggcatcgctaagttgtatcatagcatcaatgaaaatggctacaagttcttatactgctctgcccgggcaatcggaatggcagatatgaccagggggtatctccattgggtgaacgataaaggaactattttgccccggggtccgctgatgttgagcccctctagcctgttcagtgccttccaccgcgaagtcatcgagaagaaacccgagaaattcaagatcgagtgtctcaacgacatcaagaatctcttcgcaccaagcaaacagccattctacgccgctttcggtaatagacccaacgatgtctacgcttatacccaggtgggggttccagattgtcggatctttacggttaaccccaagggagagcttatccaggagagaaccaaaggcaacaagtcaagctaccatagattgagcgaactggtggagcacgtctttccactgttaagtaaggaacagaacagcgccttcccatgccccgagttttcaagcttttgctattggagggatcctatccctgaagtggaccttgatgaccttagttag

SEQ ID NO: 122646 - DNA, 702 bp, Artificial Sequence
  Description of Artificial Sequence: Synthetic coding sequence
atgaactatgtgggccagctggcaggacaggttatcgtgaccgtcaaggaactctataagggcattaatcaggctacactatccggctgtatcgatgtcatcgtggtgcagcagcaagacgggtcataccagtgcagccctttccatgtccgcttcggtaagcttggggtgctgcggtctaaagagaaggtgattgacatcgagataaacgggagtgctgtggaccttcacatgaagctcggggataacggggaagccttcttcgtcgaggaaacggaagaggagtatgaaaaacttccagcgtatttagcaacctcaccaatcccgacggaggaccaatttttcaaggatatcgatacgccgttagtcaaaagcgggggcgacgaaacgccctcccaatcatccgacatctcccacgtgttagaaaccgaaactatttttacccccagcagtgtgaaaaaaaaaaaacggcgcaggaagaagtataaacaggattccaaaaaagaggagcaggccgcttctgcggctgccgaggacacatgcgacgtgggtgttagcagcgatgacgataagggcgcgcaggcggctcgtggctcaagcaatgcctccctgaaggaggaagaatgcaaggagcccctgctattccacagcggggatcattatccattatcagatggcgattggtcccccctggagacctag

SEQ ID NO: 122647 - DNA, 2556 bp, Artificial Sequence
  Description of Artificial Sequence: Synthetic coding sequence
atgaactacgtgggccagcttgctgaaaccgttttcggtactgtgaaagagctgtaccgtgggctaaatccggcaaccctgagtgggggcatcgacgtgctggtggtgaagcaggtggacggatcatttaggtgctcacctttccatgtcaggttcggcaagcttggagtgttgaggtcccgggagaaggtcgttgatattgaacttaacggagaacctgtggatttacacatgaagctgggagactccggtgaagcattctttgtccaggaactggagagtgatgatgagcatgtcccgccagggctgtgcacatcgccaatcccctgggggggattgtcgggctttccttcggattcccagctaggcactgccagtgagccggaaggcctggtgatggcaggcactgccagtactggcagaaggaagcgcaggcgccgccgaaagcctaaacagaaagaagatgccgttgccactgattccagcccggaggagttagaggccggcgcagaaagcgaattgtctctgcctgagaagcttcgcccagaacctcctggagttcagttggaggagaagtcctccctgcagcctaaggacatatacccttactctgacggtgagtggccccctcaggcctccctgagcgccggcgagctgaccagcccaaaaagcgattccgagctcgaagtgagaacccctgaaccctcgccactcagggccgagtcgcatatgcagtgggcctggggaagattgcctaaggtcgcgagggccgagcgccctgaatctagcgtggttctggaaggccgggcgggggccacatctccccccagagggggccctagcaccccttccacgagcgtagccgggggagtcgacccgttggggctgccaatccagcagacagaggcaggcgctgatttgcagccggatactgaggacccaactctggtgggcccacctctacacacccccgagaccgaggaaagcaaaacgcagtccagtggagatatggggctgccaccagcaagcaagagctggagttgggccactctggaggtccctgtccctaccggtcagcccgaaagagtgtcacgtggaaaaggctcccctaagagatcgcagcatcttgggccaagtgacatttaccttgacgatttaccaagtctggatagcgagaatgccgccctttacttcccccagagtgactctgggctgggcgccaggcggtggtcagagccctctagccagaagagtctgagagatcccaatcctgaacacgagccagagcccacattagataccgtggacaccattgccctgagtctgtgtggcggactggccgacagcagagatatttctttagaaaaatttaaccagcattccgtcagttatcaggacctgactaaaaatcctggactgctagatgatcctaacctggtcgttaagatcaacggaaaacactataattgggctgtggccgcacctatgatcttgagtctgcaagcattccagaaaaatctacctaagtcgacaatggataaactcgagagagagaagatgccacggaaaggcggacgctggtggttttcttggaggcgtagggacttcctggcagaggagaggtctgcccagaaagagaaaacagctgctaaagaacagcagggggagaagacagaggtattgtcttcagacgacgacgcacctgactcccccgtgattctggagattccctctttgcctccctcaacaccaccgtcaactccaacctacaaaaaatccctgcgtttgagctccgatcagattcgccggctgaatcttcaagagggagcaaatgacgtggtgttctctgtgactacccaataccaaggaacgtgtcgatgcaaggccactatttatctgtggaagtgggatgataaggtcgtgatcagcgacatcgacggaacaattactaaaagcgacgccctcggacacatcttaccccagctgggaaaggactggacccaccagggaataaccagcctctatcacaagatccagttaaacggatacaaattcctttactgttccgcccgcgccatcggcatggcggacttgacgaagggctacctgcaatgggtgtcagagggagggtgtagcctacccaaggggcccatcctcctctctccctcttcccttttttccgcactgcaccgagaagtgatcgaaaagaaaccagaagtgttcaaggtggcctgcctgtccgatatccagcagctgttcttacctcacggccagcctttctacgccgcttttggcaatagacctaacgacgtgtttgcctacaggcaagtcggcctgcccgaatcaaggatttttaccgtcaatccgcggggcgagctaattcaggagctgattaagaaccacaaaagtacatatgagaggcttggcgaagtggtagaactgctctttccacctgtggcaaggggcccttccaccgacctggctaatccagagtacagcaatttttgttactggagggagccgctgcctgctgtggatctcgatacgctcgattag

SEQ ID NO: 122648 - DNA, 1242 bp, Artificial Sequence
  Description of Artificial Sequence: Synthetic coding sequence
atgggcctgccaccagctagcaaatcttggagctgggctacactagaagttcctgtgcctactgggcagcccgaaagagtgtcaagaggcaaaggaagcccaaagaggtctcagcatctcggccccagtgacatctatctggatgatcttccttctttggactctgaaaatgccgccctgtatttccctcaatcggactctggcctgggcgccaggaggtggtccgaaccctccagtcagaagagtctgcgggaccccaaccccgagcacgaacccgagcccactctggatacagtggatactatagctctgtcactatgtggcgggctggcggacagcagagacataagcctggagaagttcaaccagcacagcgtgagttatcaggatttgaccaaaaaccccggccttctggatgaccctaatcttgtggttaagattaacggtaagcattacaactgggcggtcgctgccccaatgattctcagcctccaggctttccaaaagaatctacctaagcggtctgcacagaaggaaaagacggcagctaaggaacaacagggggagaagacggaggtcttgtcctctgatgatgacgccccagactccccagttattctggagattccctccttgcctccatccacccctccgagtaccccaacatataagaaaagtctgagactgtcatctgaccagatccggcgtctgaatctccaggagggagcgaacgatgtagtatttagtgttaccacccagtatcagggtacctgtagatgcaaggcaaccatctatctgtggaaatgggacgacaaggtggttatctcagacattgacggaacaattaccaaaagtgatgcccttgggcatattttgccccagttgggaaaagattggacccaccagggcattacctcactctaccacaaaatccagttgaatgggtataaattcctctattgttctgctcgcgccataggcatggcggatctgactaagggatacctccagtgggttagcgaaggtggctgttctctaccaaagggcccaattctgctgtcgcctagttccctcttcagtgcgctgcaccgggaagtaattgagaaaaagccagaagtgtttaaggtcgcttgcctgtccgacatccagcaactgttcttgccccatggtcagccattttatgccgcattcggaaatcggcctaacgatgtgttcgcctaccggcaggtggggcttccttag

SEQ ID NO: 122649 - DNA, 813 bp, Artificial Sequence
  Description of Artificial Sequence: Synthetic coding sequence
taagtcaagataaacggtaaacattacaactgggccgtggctgctcccatgatcctgtctctgcaggctttccagaagaacctgcccaaacgcagcgcgcagaaagaaaaaacggccgccaaagaacagcagggggaaaaaactgaagtcctttcatccgacgatgacgctccggatagccccgtaattctcgaaataccatctctacctcccagtacacctccaagtactccgacatataaaaaatcattaagattgagcagtgatcaaattagaagactgaatctccaagaaggcgccaatgacgtggtattcagcgtcaccacgcagtatcaggggacttgccgctgtaaggcgacgatctacctctggaagtgggatgacaaggtggtaatatccgatatcgatggaacaatcacgaagtctgatgctctgggacatattctcccacagcttggaaaggactggacccatcagggaataacttcactataccacaaaattcagctgaacggctacaagttcctgtattgctccgcccgcgccatcggcatggcagaccttacgaaggggtacctgcaatgggtgtctgaagggggatgcagtctgccaaaaggtcccatattactatctccatcatccctcttctccgccctgcaccgggaggttatcgagaaaaagcctgaggtgttcaaagttgcgtgtctgagcgatattcagcagctattcttaccccacggtcaacctttctacgccgctttcggcaacagaccgaatgacgttttcgcgtatcgccaggtcggcctgccatag

SEQ ID NO: 122650 - DNA, 531 bp, Artificial Sequence
  Description of Artificial Sequence: Synthetic coding sequence
atgaagcccctgctgttggccgtgtctctcgggttaatagctgctctccaagcacaccatcttcttgctagtgacgaagaaatccaggatgtaagcggtacctggtacttgaaagcaatgacagtggacagagaattcccggaaatgaatctcgagagtgtcacccccatgacactgaccaccctcgagggaggcaacttggaagctaaagtcaccatgttgattagcgggagatgtcaggaggtaaaagccgtgctagaaaaaacagatgagccgggaaagtacaccgctgacggaggtaagcatgtggcttacatcatccggagccacgtgaaggatcattatatcttttactgcgaaggtgagctgcatggaaagcccgtaagaggtgttaagttggtgggacgagatcctaaaaacaatttagaggccctcgaagactttgaaaaagccgcgggcgccaggggacttagtacagagtcgatactcattccccgacagtccgagacctgtagccccgggtccgattag

SEQ ID NO: 122651 - DNA, 531 bp, Artificial Sequence
  Description of Artificial Sequence: Synthetic coding sequence
atgaaaccactcttgctagccgttagtcttggcttaatcgcggctctgcaggcccatcatctgctggcctccgacgaggagattcaggacgtgtctggcacatggtacttaaaggcgatgactgtggaccgcgagttcccagaaatgaatcttgagagcgtgactcccatgacattaacaactctggagggcggaaatctggaagcaaaagtgacaatgctgatatccggccgctgccaagaggtcaaagccgttctggaaaagacagacgagccggggaaatacaccgcggacggtgggaaacatgtagcttatattatcaggtcacacgtgaaggaccactatatcttttattgcgaaggggaactgcatggaaagcctgtgcgaggagttaagcttgtcggcagagaccccaagaacaatctggaagccctcgaggatttcgagaaagcagctggtgctcgtggtttaagtaccgagtcgatcctgattcctaggcaaagtgaaacgtgttctccaggatccgattag

SEQ ID NO: 122652 - DNA, 564 bp, Artificial Sequence
  Description of Artificial Sequence: Synthetic coding sequence
atgcgtcagggattgctagtcctggccctagttctcgttctggttctcgtgctcgccgctggttctcaggtccaggagtggtacccacgggagagtcatgcactgaattggaataagttctccggcttttggtacatcctggctacagccaccgacgcacagggctttctgcctgcccgtgataagagaaaactgggggcatccgtcgtgaaggtgaacaaagtgggccagctgcgtgtcttgcttgctttccgtcggggccagggctgcggccgcgcccagccgaggcacccgggcacctcagggcacctgtgggcgtcgttgagcgtgaagggtgttaaggctttccacgtgctttctacagactattcttatggattagtgtatctgagattgggaagagccacacagaactacaagaaccttctcctttttcaccgccagaatgtgagctcattccaatcactcaaggagttcatggatgcgtgtgatatactcggattgagcaaggctgctgtgattttgcccaaggatgcctctcgtactcacacaatccttccctag

SEQ ID NO: 122653 - DNA, 603 bp, Artificial Sequence
  Description of Artificial Sequence: Synthetic coding sequence
atgagacagggacttttggtcctggccctggtgttggtcctggtgttggtgttagccgcagggtcgcaagtgcaggagtggtacccgcgggaatcgcatgctctgaactggaacaagttttcaggattctggtacatcttggcaacagcgactgacgcccaggggttccttcccgctcgcgacaagagaaaactgggcgccagtgtcgtgaaagtgaataaggtgggtcagctccgggtgctgctcgcattccgaaggctgaaaggctgccagagccaggaggtgatcctgcgcaaagatggcaagaaacccgtattcgggaacgcctgcgcatatgccgctgggcctagagaaggacaggagggagttaaaggagtcaaagcattccacgtgttgtctactgactacagctatggacttgtctatctgcgattaggacgcgcaacacagaactacaagaatttactcctcttccacagacagaacgtttcctccttccaaagcttaaaagaatttatggatgcctgtgacattctgggcctttctaaggctgcagtcatcctgcccaaggacgctagtcgcactcacacaattttgccctag

SEQ ID NO: 122654 - DNA, 273 bp, Artificial Sequence
  Description of Artificial Sequence: Synthetic coding sequence
accttcgaattgtcagacgatgggcgctttgaggtctggaatgcaatgacgcgcgggcaacactgcgatacatggtcttatgtgttaatcccagctgcgcaacccggccagtttaccgtcgaccacggcgtggatacacgggctggctggcctagctctggctcggcttgctgggcaggcgctgggtgttgcctgcccggccggtggacgagttccagcgcctgggcagaattacgggctagccgcatgacaaccagttcatctcaaatgtag

SEQ ID NO: 122655 - DNA, 579 bp, Artificial Sequence
  Description of Artificial Sequence: Synthetic coding sequence
atgagactactgtgcggcctgtggttgtggcttagtctgttgaaagtcttacaagctcagaccccaacccccctccctctcccacccccgatgcagagttttcaagggaatcaatttcagggcgagtggtttgtgctcggtttagcggggaactcattccgacctgaacacagggcactgttaaacgcattcactgcgactttcgagctctccgatgacggtcgctttgaggtatggaatgccatgaccagggggcaacattgtgacacatggtcttacgtcttgattcccgctgcccagccagggcagttcaccgtagatcatggggttgagcccggggcagaccgggaagaaaccagggtggtggacagcgactacacccagttcgccctgatgcttagccgcaggcacaccagccgtctggccgtactccggattagcttgcttggacggtcttggctgctgcctccaggtactctggaccagttcatctgcttggggcgcgcccagggactgtcagatgacaacatagtctttcccgacgttacagggtggtcacctcaggcatcagtctgttag

SEQ ID NO: 122656 - DNA, 597 bp, Artificial Sequence
  Description of Artificial Sequence: Synthetic coding sequence
atgccattaggtctcctctggctagggttagccctcctaggcgcactgcatgctcaggcacaagattctacatcggatctgattccagcccccccactatctaaggttcctctccaacagaattttcaggataaccaattccagggaaagtggtatgttgtagggctggccgggaacgccatcctgcgggaagacaaggaccctcaaaaaatgtatgccaccatctacgagctcaaagaggacaaatcctacaacgtcacgagcgtattgtttagaaaaaagaagtgtgactactggatccggacgttcgtaccaggttgtcagcctggtgagtttaccctgggaaacattaagtcctatccagggctgacaagttacctggttcgggtggtgagcacaaactacaatcaacacgccatggtattctttaagaaagtcagtcagaatcgagagtacttcaaaattacactctacggaagaaccaaggaactgaccagtgagctgaaggaaaattttatccgtttttctaagtctcttggtcttccagaaaaccacattgtgtttcctgtcccaattgaccagtgcatagatgggtag

SEQ ID NO: 122657 - DNA, 603 bp, Artificial Sequence
  Description of Artificial Sequence: Synthetic coding sequence
atgccactcggactcctgtggctggggctcgccctgctgggagctcttcacgcccaggcacaggactcgactagtgatctgatacctgctccaccactgtctaaggtccctctgcagcagaatttccaagacaaccagttccaaggaaagtggtatgtggtcggactggccggtaacgcaattctgcgtgaggacaaggacccacagaagatgtacgccaccatctatgaactgaaggaggataagtcctacaatgttacatccgtccttttccgggagaaggctcagaagtgcgactactggattcggaccttcgtccctggatgtcagccaggcgagtttactcttgggaacataaagagctatcccggcctcaccagctacctggtgagagttgtgtcaacaaattacaatcaacacgctatggtatttttcaaaaaagtttcacagaaccgggagtacttcaagataaccctgtatggtaggactaaagaattgacaagtgaactgaaagagaatttcattaggttttccaagtcccttggcctgccagagaaccatattgtcttccctgtccccattgaccagtgcattgacggttag

SEQ ID NO: 122658 - DNA, 603 bp, Artificial Sequence
  Description of Artificial Sequence: Synthetic coding sequence
atgccattaggactgctgtggcttgggctggcccttctcggtgcccttcacgctcaggcacaagattccacttcagacctgattcccgccccccctctcagcaaagtgccgctgcagcagaactttcaggacaaccaattccagggaaagtggtacgtagttggattagctggtaatgctattctgagagaggataaagaccctcagaagatgtacgcaacaatctatgaactgaaggaggataagtcgtacaatgtgaccagcgtcctgttccgtcagtggaaaaaaaaatgcgattactggatccgcacttttgtccctgggtgccagcccggcgaatttacgctcggaaacatcaaatcctaccccgggttgacatcttatctagtcagggtggtaagtaccaattacaaccagcatgctatggtctttttcaagaaagtcagccagaatcgggaatatttcaagattactctatatggtcggacaaaagagttgacgtccgaactgaaggaaaacttcattagattctccaagtctttgggcctgccagagaatcatattgtctttccagtcccaattgaccagtgcatcgatggttag

SEQ ID NO: 122659 - DNA, 597 bp, Artificial Sequence
  Description of Artificial Sequence: Synthetic coding sequence
atgcctttagggctcctgtggctgggccttgccctgctgggtgctctgcacgcccaagcacaggactccacatctgatttgatcccggcacctcccctgtcaaaagtgcccctgcagcagaatttccaggacaaccagtttcaaggtaagtggtacgtcgtcggccttgccggcaacgctatcctccgcgaggataaggacccccagaagatgtatgcaactatatatgagctgaaggaagacaagtcttacaacgtgacctccgtgttattccggaagaaaaaatgtgactattggattagaacattcgtgcccggatgtcagccaggagaattcactctggggaatatcaagtcgtatccagggttaacaagctacctggtaagggttgtgtccaccaattataaccagcacgccatggtgttctttaagaaagtatcacaaaatcgagaatatttcaagattactttgtatggcagaaccaaggaactcactagcgagctcaaggagaatttcatccggttttccaagtcgctagggctccccgagaaccacatcgtctttcctgtgcccatcgaccagtgtattgacggttag

SEQ ID NO: 122660 - DNA, 597 bp, Artificial Sequence
  Description of Artificial Sequence: Synthetic coding sequence
atgcctctggggcttctgtggcttggcctagccttgcttggcgctctgcacgcccaagcgcaagatagcacttccgacctgatcccagctccacccctgtccaaagttccactacagcagaattttcaggataaccagtttcagggtaaatggtatgtcgtggggcttgccggaaacgctattctgagggaggacaaggatcctcagaagatgtatgccaccatctatgagctgaaagaagataaatcgtataacgtgacatccgtgctgtttcggaagaaaaagtgcgattactggattcgtacatttgtgcccggctgccagcccggagagtttacacttggcaacataaaatcgtatcccggcttgacgagttacctcgtgagggtggtgtcgaccaactacaaccagcacgccatggtctttttcaagaaggtgagtcagaatagggagtacttcaagattacactgtacggtcgtaccaaagagctcacttctgagttgaaggagaactttatccggttttccaagagcttgggattgccggaaaaccacatcgtgttcccagtccccatcgggaacgggcaaagtgggtag

SEQ ID NO: 122661 - DNA, 492 bp, Artificial Sequence
  Description of Artificial Sequence: Synthetic coding sequence
atgggtgggctgcttcttgcggcatttctcgctctggttagcgttcctcgggctcaggctgtgtggctgggtcgattggaccctgaacagctgctagggccctggtacgtcctagccgtggccagtcgggaaaaaggatttgctatggaaaaagatatgaaaaatgtcgtcggggtggtggtgaccctgacccccgaaaacaacttgcgcactctgtcatcgcagcacggactgggaggctgcgatcagagtgtgatggatcttatcaagcgcaacagtggatgggtgttcgagaaccctagcatcggtgtgctggagttatgggttctagcgactaactttcgagattacgccatcattttcacccagctggagttcggcgatgagccatttaacaccgttgagctctatagcctcaccgaaactgcatctcaagaagccatgggactgttcacgaagtggtcaaggtccttgggtttcctgtcacaatag

SEQ ID NO: 122662 - DNA, 459 bp, Artificial Sequence
  Description of Artificial Sequence: Synthetic coding sequence
atggaagaattagacaggcagaaaatcggggggttctggcgcgaagttggcgtggctagtgaccagagccttgttttaaccgccccgaagagagtagaaggcctcttcctgactctcagcgggtcaaatctgacggtgaaggtggcttacaattctagcggctcctgcgagattgagaaaattgtagggagcgaaatagatagcaccgggaaatttgcgttcccagggcaccgcgaaatacatgtgctggatactgattatgagggttatgcaatcctccgcgtgagcctcatgtggagagggcgcaacttcagagttctcaagtacttcaccagatccctcgaggacaaggaccggctggggttttggaagttcagggaacttacggctgacacaggcctgtatttggccgcacgccctggccgctgtgcagagctactgaaagaggagctaatttag

SEQ ID NO: 122663 - DNA, 531 bp, Artificial Sequence
  Description of Artificial Sequence: Synthetic coding sequence
atggccctgctcttactcagtctcggcctatccctcattgccgctcaggaatttgacccccatacggtaatgcagagaaactacaatgtggcacgggtcagcggggtctggtactccatattcatggcctctgatgatcttaacaggatcaaagaaaatggggatctgcgagtattcgtccgcaatattgagcacctgaagaacggctccttgatcttcgattttgagtacatggtgcaaggggaatgcgtggccgtggtggtagtgtgtgagaagacagagaagaacggtgagtacagtataaactacgaaggccagaacaccgtcgccgtgagcgagaccgactacagattatttatcactttccacctccagaatttccggaacggcaccgaaacacatactctggctttgtacgagacctgcgagaagtacgggctcgggtcgcagaatatcattgacctgacaaacaaggacccctgttattctaaacattaccgctctcccccacgaccgcccatgcggtggtag

SEQ ID NO: 122664 - DNA, 1119 bp, Artificial Sequence
  Description of Artificial Sequence: Synthetic coding sequence
atgtccctacggtgcggggacgccgcccggacactaggcccccgggtcttcgggcgttacttctgtagtcccgtccggcctctttcctcccttcccgacaagaagaaggaactgctccagaatggccccgaccttcaggatttcgtctcaggagatttggccgatcgtagcacctgggacgagtataaaggcaacctgaaaagacagaaaggagagagactgcgactccccccttggctcaaaactgagataccgatgggtaagaactacaataagctaaagaacaccttgcggaaccttaatttgcatactgtgtgtgaggaggcccgatgcccaaatattggggagtgctggggaggaggagaatatgctacagctactgccacaattatgctgatgggagacacctgcacgcggggctgcaggttctgttccgtaaaaactgcaagaaaccctccaccacttgacgcaagcgagccctacaatacagcgaaagcaattgccgagtggggactcgattacgtggtgcttacttcagtggaccgggacgacatgccagatgggggtgctgaacacatcgcaaagacagtaagctatcttaaagaaagaaaccccaaaatcctagtagagtgcctcactcccgacttcagaggagacctgaaagctatagagaaggtcgctctctctgggctggatgtctacgctcacaatgtggaaaccgtgccagagcttcaatcaaaagtcagggatcctagggccaacttcgaccaaagtcttcgcgttctgaagcacgctaaaaaagtccagcccgatgtgattagcaaaactagcatcatgctcggccttggggagaacgatgagcaagtttacgcaacaatgaaggcattaagagaggcagatgtggactgtctgacattgggccaatatatgcagcctactcgaagacatctgaaggtcgaagagtatattacccctgaaaaattcaagtattgggaaaaagtcggaaatgagcttgggtttcattacacggcaagcggaccattggtcagaagctcatacaaagcaggcgagtttttcttgaaaaacctcgtggccaaacgaaagaccaaagacttatag

SEQ ID NO: 122665 - DNA, 969 bp, Artificial Sequence
  Description of Artificial Sequence: Synthetic coding sequence
atgagcctgaggtgtggcgatgccgcccggaccttaggacctagggtgtttggcaggtacttctgttcaccagtaaggccgctgtccagtctgcccgacaagaagaaggagctgctgcagaacggcccagatctccaggatttcgtgtctggagatttagctgacagatccacctgggatgagtataagggcaacttgaaacggcagaaaggggagcgtctgcggttgccaccgtggctcaaaactgagatcccaatggggaaaaattataacaaactgaaaaacacactgcggaacctgaacctgcatacggtctgcgaggaggcccgatgcccaaacatcggggaatgttggggtggcggagaatatgccaccgcgacggcaacgatcatgttaatgggtgatacatgtacccgtggatgccggttctgctccgtgaaaacagcacggaaccccccccctttggacgccagtgaaccttacaatacagccaaagctattgccgaatggggcttggattacgtcgtgctgacaagtgtggatcgcgacgatatgccagatggcggcgctgagcacatagccaaaacagtctcttaccttaaggagcggaatcccaaaattttggtcgagtgtctcactccggactttcggggagatctgaaagctatcgagaaagtagccctgtctggtctggatgtttacgcacacaatgtcgagactgtccctgagctgcagagcaaggttcgagaccccagagcaaacttcgatcagtccctgagggtgctgaagcacgctaaaaaggttcagcctgacgtaatcagcaaaacctctatcatgctcggcctgggcgagaacgatgaacaggtctacgcgaccatgaaggctttgagggaggctgacgtggattgtctcactctcggtcaatacatgcagcccacccgcaggcacctgaaggtgaacttctcctag

SEQ ID NO: 122666 - DNA, 603 bp, Artificial Sequence
  Description of Artificial Sequence: Synthetic coding sequence
atggcttccagtctcacatgcaccggagtcatctgggccctattaagcttcctgtgcgctgccacctcctgcgtgggctttttcatgccatactggctctggggctctcagctaggaaagccggtaagttttgggacgttccggaggtgcagctatccggtgcacgatgaaagccggcagatgatggtcatggtggaggaatgtggaaggtacgcaagtttccaaggaattccaagcgccgaatggaggatctgtaccatcgtgactggattgggttgtggccttctgttgctggtggcacttactgcactgatgggttgctgtgtctctgaccttatctcccgtaccgtggggcgcgtcgccggtggaatccagtttctagggggtctgttaataggagctgggtgtgccttgtaccctctcggctgggattcagaagaagtgcgccagacttgcggctatacatcagggcagttcgatttgggcaaatgtgaaatagggtgggcctattactgtactggagccggggctacagcggctatgcttctgtgtacctggctggcttgtttctcaggcaaaaagcaaaagcattacccctactag

SEQ ID NO: 122667 - DNA, 663 bp, Artificial Sequence
  Description of Artificial Sequence: Synthetic coding sequence
atgaggtcgagcctcactatggtgggcaccctctgggccttcttaagcctggttactgccgttacatcatctacaagttatttcctgccgtattggttgtttggcagccaaatggggaaacccgtttcattctctacctttagacggtgcaactacccagttcgtggggaaggtcacagtctgattatggtcgaggaatgcgggcgctacgcatccttcaatgccatcccctccttagcctggcaaatgtgtactgtagttacgggggccggttgcgccctactcctacttgttgctctcgccgcagtattggggtgttgtatggaggagcttatttcccggatgatgggtagatgtatgggcgctgcccagtttgtcggtggtctgctcatctctagtgggtgtgctctgtatcctctaggctggaactcacctgagattatgcaaacctgtgggaacgtgagtaaccagttccagttgggtacttgtcggctaggctgggcttattactgtgccgggggcggcgccgccgcagctatgctgatttgcacctggttaagctgtttcgcgggtaggaacccaaagcctgtaatcttggtggaaagtataatgcgcaacaccaactcatacgcaatggaattggatcattgcctgaaaccctag

SEQ ID NO: 122668 - DNA, 564 bp, Artificial Sequence
  Description of Artificial Sequence: Synthetic coding sequence
atgcggtcctctttaaccatggtcgggacactgtgggctttcctgagtttggttacagcggttaccagcagtacatcctacttcttgccctattggctctttgggtcccagatgggcaaacccgtgtcattcagcacctttagacggtgtaactatccagtgcggggggaggggcactccctgatcatggttgaagaatgcggcagatacgcaagcttcaacgctattccttccctagcctggcagatgtgtaccgtcgtcacaggcgctgggtgcgctttgctgcttctcgttgctcttgctgctgtccttggatgctgtatggaggaacttatcagtagaatgatgggcaggtgcatgggagctgctcaattcgtgggcggaacctgtcgattgggatgggcgtattattgcgcaggaggaggcgccgccgctgccatgctcatatgcacgtggttgtcttgcttcgccggtcgaaatccaaaacctgtgattctagtcgagagcattatgcggaatacaaatagttacgccatggagctggaccactgtcttaaaccttag

SEQ ID NO: 122669 - DNA, 687 bp, Artificial Sequence
  Description of Artificial Sequence: Synthetic coding sequence
atgtgccatgtcattgtaacatgcagatcgatgctttggaccctcttgtcaatcgtggtagcctttgccgaattgattgcttttatgtcagcagactggctaattggcaaagccaggtcccgcggcggcgtggagcccgctgggccgggaggtggctcaccagagccttaccaccccacactgggcatctacgcgaggtgtatccgcaatcctggtgtgcagcattttcaacgtgacaccctgtgcggcccctatgcagagagtttcggagagatagcttctggtttctggcaggcaaccgccatatttctggccgtgggcatcttcattctgtgcatggtcgccttggtgagcgtgttcacaatgtgcgttcagagtatcatgaagaaatccatctttaatgtctgcggtttgttgcaaggaattgccggtttatttctgattcttggccttattttatatccggccggctgggggtgccagaaggccatcgactactgcgggcattacgcaagtgcctataaacctggcgactgctccctcggctgggcattttatactgctattgggggcaccgtgctgacgtttatctgcgctgtgttctctgcccaggccgagatcgcgaccagcagcgacaaggtgcaagaggagattgaagagggtaaaaatctcatctgcctgctgtag

SEQ ID NO: 122670 - DNA, 687 bp, Artificial Sequence
  Description of Artificial Sequence: Synthetic coding sequence
atgtgccacgtgattgtcacatgtagatctatgctttggaccctgctgtccatagtggtcgcttttgcggagcttattgcattcatgtctgccgattggttgattggcaaagccagatcacgagggggggtggaacccgcaggccccggtggtggttctccagagccctaccatcctaccctggggatttatgcccgttgtattcgaaacccaggcgtacaacacttccagagggataccctgtgtggtccttatgcagaatccttcggagagatcgcttccgggttctggcaggccaccgcgatatttttggccgtcgggatatttattctttgcatggtcgccctggtgagtgtcttcaccatgtgtgttcagagcataatgaaaaaaagtatctttaacgtatgcggtttgcttcagggcatagctgggttgtttttaatcctgggactgatcctgtacccagctggctggggctgccagaaggcgatcgattactgtggccactacgcgagcgcatacaagccaggagattgcagtctggggtgggcgttttatacggctataggcggcacggtgctgacgtttatatgtgcagtcttcagcgcccaggccgagatagcaacgagttctgacaaagtccaggaggaaatcgaggagggtaagaatttgatctgcctcttgtag

SEQ ID NO: 122671 - DNA, 669 bp, Artificial Sequence
  Description of Artificial Sequence: Synthetic coding sequence
atgctacccgcacaagaagccgcaaaactctatcacaccaactatgtaaggaactcccgggctatcggcgttctgtgggcaatcttcacaatttgtttcgccatcgtcaacgtagtgtgtttcatccaaccttactggatcggagacggagtggataccccacaggcggggtactttgggttatttcattactgtatcggaaacggcttctccagggagctcacttgcagggggtccttcaccgattttagcacactgccaagcggggcttttaaggccgccagttttttcattggccttagcatgatgctcattatcgcttgtataatatgcttcactttattctttttctgtaatacggcaacggtctacaagatctgcgcatggatgcagcttacatccgcagcgtgccttgtgctcgggtgcatgatcttccctgacgggtgggattccgacgaggtcaaacgcatgtgcggcgaaaaaacagacaagtataccctgggggcctgctctgtgagatgggcttatatcctggctatcatagggatcctggatgccttgatactgtccttccttgccttcgtgctgggtaacagacaggactccctcatggcggaggagctcaaggccgagaacaaagtactgctttctcagtacagcctagaatag

SEQ ID NO: 122672 - DNA, 711 bp, Artificial Sequence
  Description of Artificial Sequence: Synthetic coding sequence
atgccaggagccgccgccgctgctgctgctgccgcagcagcaatgctccccgcacaggaggccgcaaagctctaccacaccaactatgttcggaacagccgcgctatcggagtactatgggcaatcttcaccatatgtttcgctatcgtcaacgtcgtgtgcttcatccaaccgtattggatcggagacggcgtggatactccccaagcgggatactttggcctgtttcactactgcataggcaatggcttttctagagagctcacctgccggggttcctttacagacttttcaacgctgcctagtggtgcttttaaggccgccagctttttcatcggactttctatgatgctgataatagcatgcatcatatgttttacactgttcttcttttgtaataccgcaaccgtttacaagatttgtgcctggatgcagcttacctctggggattgcctggtgttgtttgacttgcattttccagacgggtgggatagcgatgaggtgaagcgcatgtgcggtgagaagactgataagtacaccctgggggcttgctccgtgagatgggcctacatcctcgccataataggaattttagacgccttgatcctgtcttttctggccttcgtgctgggcaaccggcaagacagcctgatggcggaagagctgaaggccgaaaacaaagttctactatcccagtacagtctcgagtag

SEQ ID NO: 122673 - DNA, 699 bp, Artificial Sequence
  Description of Artificial Sequence: Synthetic coding sequence
atgccaggtgcagcagccgctgccgcagccgctgctgcagccatgcttcccgcacaggaagccgcaaaactctaccacacgaattacgtcaggaactcgagagcgattggcgttctgtgggccatctttaccatctgtttcgccatcgttaacgtggtgtgtttcatccagccttattggatcggagatggtgttgataccccccaggccggttactttggtctctttcattactgtatcggaaacggattttctagggagctgacttgtcgaggcagctttaccgatttcagtacactccccagtggggccttcaaagccgcttctttcttcatcggcttatctatgatgctgataatcgcctgtattatttgcttcactctgttcttcttctgtaacaccgctactgtatataaaatttgtgcctggatgcagctgacttcaggcgactgtcttgtcctgtttgacctccattttcctgatggttgggatagtgatgaagtcaagcggatgtgtggagagaaaacagacaagtataccttaggagcttgttcggtgaggtgggcgtacattttggccatcatcggcatcctggatgccttaatcttaagttttttggctttcgtcctgggtaatcgccaggacagcctgatggcagaagaacttaaggctgaaaacaaggacgacgggaacgcctag

SEQ ID NO: 122674 - DNA, 660 bp, Artificial Sequence
  Description of Artificial Sequence: Synthetic coding sequence
atggtgaaactcctgccagcacaggaggccgctaaaatctatcatacaaactatgtcagaaatagtcgtgccgtgggcgtgatgtggggcacactgacgatctgttttagcgttctggtgatggcgctttttattcagccatactggatcggtgatagtgtgaatacacctcaggccgggtactttggcctcttttcatactgcgtgggtaatgtcctgtctagcgaactgatttgcaaagggggccccctggatttcagctctattccctcgcgggccttcaagacagctatgtttttcgtggccctagggatgttccttatcataggaagcatcatttgcttttcactgttctttatatgcaacaccgctacagtgtacaagatttgcgcgtggatgcagctagcagcggccactggactgatgatcggttgcctggtgtatccagacggatgggatagttctgaggtaaggaggatgtgcggcgaacaaacgggaaaatatacacttggccactgcaccatccggtgggcttttatgcttgctatcttgagcatcggcgacgcgcttattctttcattcttggcctttgtccttggataccgccaggataagctgctgccagacgactataaagccgatgggaccgaagaagtctag

SEQ ID NO: 122675 - DNA, 660 bp, Artificial Sequence
  Description of Artificial Sequence: Synthetic coding sequence
atggtgaaactgctccccgctcaggaagcggccaaaatctatcacactaattacgtcaggaactcgcgggctgtgggcgtgatgtggggcaccctgacaatatgttttagtgtgctggtcatggccttgttcatacagccttattggataggggattctgtgaataccccccaagccgggtattttggactcttcagctattgcgtcggaaatgttttatcctccgaactgatctgcaagggcggaccgctcgacttcagctcaatcccaagtagggcctttaagacagccatgtttttcgtggccttggggatgtttctgatcataggctcaataatatgcttctccctgtttttcatctgcaacaccgccacagtgtataagatttgcgcctggatgcagctggccgcagctactggcctgatgatcggatgcctggtgtacccagacgggtgggactccagtgaagtgagaagaatgtgtggagaacagacaggcaaatacacattggggcactgtaccatcaggtgggcctttatgctcgcaatcttgtcaatcggagacgccctgattttgtcctttctggcttttgtgctcggatataggcaggacaaactacttcccgacgattacaaggccgacggcactgaagaagtgtag

SEQ ID NO: 122676 - DNA, 675 bp, Artificial Sequence
  Description of Artificial Sequence: Synthetic coding sequence
atgagtgtgtttggaaaacttttcggcgccggcggagggaaggctggcaaaggtggacctacccctcaggaagccatccaacggctgagggataccgaggaaatgctgagcaagaaacaagagttcttggagaagaaaatagagcaggagctgactgcagcaaagaaacacgggaccaagaataagcgggccgcgctgcaagccttaaagaggaagaaaaggtacgagaagcagttggcccagattgacgggacgctgagcactattgagtttcaacgagaagccctggaaaacgctaacacaaatacggaggtactcaagaacatgggttacgccgccaaagccatgaaagcagcacacgataacatggacatcgacaaagtggatgagctgatgcaggacattgccgaccaacaggagcttgcagaagagatttcaacggccatttctaagccggtgggtttcggagaggagttcgacgaagatgagcttatggcagagttagaggagctcgaacaggaagagctggataagaacctcttagaaatcagtggaccggaaaccgtgcctctgcccaacgtgccgtctatagcgttgccaagcaaaccggccaagaagaaagaggaagaggatgacgacatgaaagaattggaaaactgggccggaagtatgtag

SEQ ID NO: 122677 - DNA, 1434 bp, Artificial Sequence
  Description of Artificial Sequence: Synthetic coding sequence
atgggcgccttggcccgcgcactgccaagtatattgctcgcattgctacttacttccacccctgaggctttaggtgctaatcccggtctcgttgcgcgcattacagataaggggttacagtacgcagcacaggaggggctgctggccctccaatccgaattgctgcgcattacactccctgactttaccggtgatctgaggatcccacatgtcgggagagggcggtacgaatttcactcactgaacatccattcttgcgagctgctgcacagcgcactgaggcctgtgccaggccaagggctgagcctgtccatcagcgattcgtccattcgggtgcagggcagatggaaggttcgcaagtcatttttcaagctgcagggatcattcgatgtcagtgtaaagggaatttcaatttctgtcaatctcctccttggcagtgaatcaagcggccgccccaccgttaccgctagtagctgttcatccgacattgccgacgttgaagtggacatgtccggcgacctgggatggctgcttaacttgttccataaccagatcgagtcaaaattccagaaggttttggagtcacggatctgtgaaatgatccagaagagcgtgtcgtccgatcttcagccatatcttcagaccttaccagtgaccactgaaatagacagctttgcggacatcgattatagtctggtggaggcacctcgtgccactgcccaaatgctagaggttatgttcaaaggggagatctttcatagaaaccatagaagcccggtgactctactggcggctgtcatgagtctgcctgaagagcacaataagatggtctactttgctatttctgactacgttttcaataccgccagcttagtgtaccatgaagagggatacttaaatttttcaataaccgacgatatgatcccacccgactctaacatacggcttacaaccaagtccttccgaccatttgtgcccaggctggcccggctctatcctaatatgaacctggagctgcagggctccgtgccctcagccccccttctcaactttagtccaggaaatttgagcgtcgatccttatatggagattgatgctttcgtgttactcccatcaagttctaaggagcccgtcttccgcctgtcggtagccacaaatgtgagcgctaccttgaccttcaacacaagcaagataactggatttttaaagcccggcaaggttaaagtcgagttgaaggaatcaaaggtggggctttttaacgcagaactcctggaggcgctgctgaactactatatcctaaataccttctatcccaaatttaatgacaagctcgccgagggctttccactgcccctgctaaagagagtccagttgtacgatctgggcctccagatccacaaagacttcccttcgcgtagggatcaccccccttag

SEQ ID NO: 122678 - DNA, 486 bp, Artificial Sequence
  Description of Artificial Sequence: Synthetic coding sequence
atgagcgtccccgggccttaccaggccgctactgggccctcatctgcgcctagtgctccaccctcatacgaagaaacggtggccgtaaactcctactacccgacaccaccagctccaatgcccggaccaaccaccggcctcgttacaggcccagatgggaagggcatgaatcccccctcctattacactcaacccgctccaatccctaataacaacccaattacagtgcagactgtatatgtgcaacaccccattacctttttggatcgccctattcaaatgtgctgtccttcctgcaataagatgatcgtgtcccaattaagctacaacgccggtgctctgacgtggctctcttgtggttctctttgcctgttagggtgtatcgcaggatgttgttttatcccgttttgtgtggatgccctccaggatgtcgaccactattgtccaaattgtagagccctgcttgggacctacaaacgcttgtag

SEQ ID NO: 122679 - DNA, 687 bp, Artificial Sequence
  Description of Artificial Sequence: Synthetic coding sequence
atgtcggttccgggaccgtaccaggcggctacagggcccagctctgccccatccgctcctcctagctatgaagagacagtagctgttaactcctactacccaactccacctgccccgatgcccgggcccacaaccggtcttgtaaccgggccagatggaaaaggcatgaaccctccttcttattatacgcagcctgcccctattcccaacaacaaccccatcactgtgcagacggtctacgtgcaacacccaataacattcctcgatagaccaatccagatgtgctgcccttcctgcaacaaaatgatcgtgtcccagctctcctacaatgcaggagctctgacgtggttatcctgcggtagcctttgcttactcggagtgcattccggactcctgttgcacccgctgcttcgcgggtgcccagcagggaggggtccattactttctcaactgcagagcagcccgggtcatctgcaggcttttgtcggactatcccagacctggagagagcccggggccgccgggagtccctttcatctcagttctagttttacacctggagggggctctgctcttgtggtgagtccactacagggggcccacctacacgtgtttttctggggcgagtacgtggcaaagctgacgaacctgcagacccccgagattgccgcgtggagtcgtgcctag

SEQ ID NO: 122680 - DNA, 459 bp, Artificial Sequence
  Description of Artificial Sequence: Synthetic coding sequence
atgtctgtaccaggaccctatcaggccgctaccggcccctcgtcagccccctcagctcctccgtcctacgaagaaacagtggctgtgaactcttactatcccacgccgcctgctcctatgccagggccaactaccgggctcgttaccggccctgatggcaaaggcatgaaccctccttcatattacacccagcctgccccaatccctaacaacaacccaatcacggtccagacggtgtatgttcagcatcccattacattcttggatcggccaattcagatgtgttgcccctcctgcaacaagatgattgttagccagttatcctataacgctggggccttgacttggctgtcctgtggcagcctgtgcctgttagggcaggaatgcagcgggaccatcgtggcactgcgctccttcgacctgctgggctcttgcaacccccctagttcagcctcgtag

SEQ ID NO: 122681 - DNA, 486 bp, Artificial Sequence
  Description of Artificial Sequence: Synthetic coding sequence
atgtctgtccccggaccataccaagccgcaaccggccctagctccgcgccatcagcccctccctcttacgaggaaaccgtagctgtgaactcttattacccaactccacccgccccgatgcccggccccacaaccggcctcgtgacaggcccagatgggaaaggcatgaatccgccttcgtactatacccagcccgcacccatccctaataacaatcccataaccgtccagactgtttacgtacagcaccccatcacctttctcgataggccgatacagatgtgctgtccaagttgcaacaaaatgatagtttcccagctgtcttataacgcaggggccctcacgtggctgagctgtggctctctctgcttgctcggctgcatcgcaggctgctgcttcataccgttttgcgtggacgcccttcaggatgtggaccattactgcccaaattgtagagcgcttctgggcacatataaaaggctctag

SEQ ID NO: 122682 - DNA, 6123 bp, Artificial Sequence
  Description of Artificial Sequence: Synthetic coding sequence
atggaacacaaagaagtggtgctgctcctgctgctgttcctgaaaagtgcggcaccagagcagagccatgtggtacaagattgttaccatggcgacggacagagttacaggggaacctattccacaacagtcaccggccggacctgccaagcatggtcttctatgacccctcatcagcataatcgcactacagagaactatccaaatgctggcctgattatgaattactgtcgcaatcccgacgcggttgcagctccttactgttatacaagagatccaggtgtacggtgggaatactgcaatttgacgcagtgctctgacgccgagggaactgctgttgccccccctactgtgactcctgtgccctccttggaggctccctcggagcaggctcccactgagcaacggcccggagtccaggagtgttaccacggaaatggtcagtcctatcgcggaacctactccacgacagttactgggagaacttgccaagcatggagtagcatgaccccgcacagccattcaagaactcccgagtactacccaaacgccggactcatcatgaattactgccgaaacccagatgcggtcgccgccccatactgctatactagggatcctggggtgcggtgggaatactgcaacctcacacagtgcagtgatgcagagggtacagcagttgctccaccaactgtgaccccggtgccatcattggaggccccaagtgaacaagcccctacagaacagcggcccggagttcaggaatgttaccacggcaacgggcaatcttatagaggcacctattctaccaccgtcacaggcagaacgtgccaggcctggtcatccatgaccccccattcccattcgagaacaccagaatattatcctaatgccggactgataatgaactactgtcggaatccagacgcagttgccgccccatactgctacacccgtgatccaggcgtgaggtgggagtactgcaacttgacacagtgctctgacgctgaagggacggcagtggctccaccaaccgtgacccctgtgccctcattagaggccccttccgaacaggctccaaccgagcagagaccaggggtccaggaatgctaccacggcaacgggcaatcttacaggggcacgtactccacaactgtgaccggccgaacctgtcaggcctggtcttccatgactccccactcccactccagaactccagaatattatcctaacgctggccttattatgaactactgtaggaaccccgatgcggtggctgcgccctactgttacacccgagatccaggcgtgaggtgggaatattgcaacttgacacagtgcagcgatgctgagggaaccgccgtggcacctccaaccgtgacaccagtgccatctttggaagcaccatcagagcaggcccccaccgagcagaggcctggtgtgcaggagtgttatcacgggaacggacaatcttaccgagggacatattcaaccaccgttacagggcgcacatgtcaggcctggtcctccatgacaccacactcccactctcggacccctgagtattaccctaacgcaggcctgatcatgaattattgtcgcaaccccgatgccgtcgcagccccctactgctatacccgggatccaggagtccgatgggaatactgcaatctaacgcagtgcagcgacgctgagggcactgccgtggctccccctactgtgactcccgtcccaagcctcgaagctccgtccgagcaagccccaacggagcaaaggcctggggtgcaggaatgctaccatggcaatggccaatcgtataggggcacgtattccactaccgtaacgggcagaacttgtcaagcatggagttctatgacaccacatagccatagcaggacccccgagtattaccctaacgccggcctgataatgaactattgcaggaaccccgatgccgtagctgcgccttactgctacacaagagaccccggggtccgatgggaatactgcaatctaacccagtgttccgatgcggagggcacggcagttgctccacccaccgtaactcctgtaccaagcctggaggcccccagtgagcaggctcccacggagcagcgcccgggtgtgcaggagtgttaccatggaaatggccaatcctaccggggaacgtacagcacaacggtgactggcaggacctgccaggcttggtcgagcatgacgccacacagtcatagcagaaccccagagtattatcctaatgcaggactgattatgaactattgtcgcaatcctgacgcggttgcggccccctactgctatacacgggaccccggggtgcgctgggaatactgtaatctgacccagtgcagtgatgccgagggcaccgcagtggccccacccacagtgactccggtgcccagcctcgaagccccatccgagcaggcccctactgaacaacgtccgggagtgcaggaatgctatcacggcaatggacagtcctaccgcgggacatattctaccacggtgaccggacgaacatgccaggcgtggagttccatgacaccccacagtcatagtcggacgcccgagtactacccaaacgcagggctcatcatgaactattgcagaaatccagatccggtggccgcaccctattgttacactcgcgatccttcagtgaggtgggagtactgtaacctgacccagtgttccgatgccgaggggactgcagtggcccctccgacaataactccgattccaagtttggaggccccctctgaacaggccccaaccgagcagagacccggggtacaggagtgttaccatggaaatggccagagctaccaaggaacttattttataaccgtgacaggaagaacatgtcaggcatggtctagcatgacgccccactctcatagccgtacaccagcttattatcctaacgccgggttgatcaaaaactactgtcgaaaccccgatcctgtggctgcaccgtggtgctacaccacagatccatctgtccgctgggagtactgtaacctcacaaggtgcagcgatgcggagtggaccgcttttgtgccacccaatgtgattctggcacccagcctggaggccttctttgaacaggccttaacggaggagacgcctggggtacaggactgctactatcactacggtcagtcctatcgcggaacgtattccaccaccgtcaccggtcgcacatgccaggcctggagcagcatgacacctcatcagcactcaagaacaccggaaaactatccaaacgccgggctgacccggaactattgcaggaaccctgacgccgaaattcgcccttggtgttacaccatggacccatcagtccgctgggagtactgtaacttaactcaatgtctagtcaccgagagttcggtgttagctacgttaacggtcgtgccagacccttccactgaggcctctagtgaggaggcaccgaccgaacagtcccccggcgtgcaggactgctaccacggtgatggacagtcttacagggggtccttctcaacaacagtgaccgggcgcacatgtcagagttggagcagtatgacgccccactggcaccaaaggactactgaatactatcctaacggcgggctaacacggaattactgccgtaatcccgacgccgaaatttcaccctggtgctacaccatggaccccaatgtaagatgggagtattgcaatctgactcaatgccccgtgacggagagctctgttctggccactagcacggcagtctctgagcaggctccgaccgaacagtcccctaccgtacaggattgctatcatggagatggccagagttaccgcggatccttttccacaactgtgaccgggcggacttgtcaatcatggtcctctatgacacctcattggcatcagcgtacaaccgagtactacccaaacggtggtctgactaggaactattgcagaaatcctgacgccgaaatcaggccgtggtgctatacgatggaccctagcgtacggtgggaatactgtaatcttactcagtgtccagtcatggaatcaaccctgttgacaactcccactgttgtgcctgtgccttccacagagctgcctagcgaagaagcccccacggaaaattccacaggagtccaagattgttatcggggggacggacagagctatcgagggaccctgtccaccactatcaccggacgcacctgccagtcatggtcatccatgacaccccattggcacagaagaatcccgctgtattaccctaatgcaggcctcaccaggaattattgtcgcaatcctgatgcggagatcagaccatggtgctacaccatggatccaagcgtgcggtgggagtattgcaacctcacccgatgccctgtcacagagagtagtgtgttaaccacacccaccgtggccccagtaccttctaccgaagcacctagcgaacaggctccccccgaaaagagccctgtggttcaagattgctatcatggagacggaaggtcctaccggggcatctcatccacgaccgtaacaggacggacctgtcaatcatggagcagcatgatccctcactggcaccagagaacacctgagaactaccctaacgcgggcctcacagaaaactattgtagaaatcctgactcaggcaaacaaccatggtgctacaccacagacccatgtgtgcgctgggagtactgcaatctgacccaatgctctgaaacggaatccggggttctggagacaccaaccgtggtaccggtgccttctatggaagctcatagcgaggctgccccaactgaacagacgcccgtcgttagacagtgctaccacggtaatggacaatcttacagagggacattctccacaacagtgacagggaggacctgtcaaagctggtctagcatgaccccccaccgtcatcagaggaccccagagaactatcctaacgacggcctgaccatgaactactgccggaatcctgatgcagataccgggccttggtgcttcacaatggatccatccattcgatgggagtattgtaatctaaccagatgttccgacacagaagggaccgtcgtcgctccacctacagtgatacaggtcccctccctggggcctccatcagagcaggactgcatgtttggaaacggtaaaggttatagagggaagaaggccactactgtcaccggcaccccctgccaggaatgggccgctcaggagccccacagacatagtacattcataccaggcaccaataagtgggcagggctcgaaaaaaattactgcaggaatcctgacggagatatcaacggcccctggtgctacaccatgaatcctcgcaagcttttcgactactgtgacatacccttgtgcgccagttcaagctttgactgcggtaagccccaggttgaaccaaagaagtgtcctggatccatcgtgggtggatgcgtcgcacacccacactcctggccttggcaagtatccttgcgtaccaggtttggcaaacatttctgcggtggaactctgatcagcccagaatgggtgctgaccgccgcccattgtctgaaaaagtcctcccggccgtctagttacaaagtgatactcggggctcatcaggaggtgaatctagagtctcacgtacaggagatcgaggtgtcacgccttttcctggaaccaacccaggcagacatcgccttgctgaagctgagccggcccgcagtgataacagataaggttatgcccgcttgcctcccaagcccagattacatggtgaccgcccggaccgaatgctacataactggctggggtgagactcagggtacgtttggtacagggttgctcaaagaggcacagctgcttgtgattgagaatgaggtctgcaatcactataaatacatctgcgcagagcatcttgcccgtggcactgattcctgccagggggactctggggggcccttggtatgtttcgaaaaagacaaatatatcctgcagggggtgaccagttgggggttagggtgtgctaggccgaacaaaccgggcgtttatgccagggtatcccggtttgtcacctggattgaaggcatgatgaggaacaactag

SEQ ID NO: 122683 - DNA, 6123 bp, Artificial Sequence
  Description of Artificial Sequence: Synthetic coding sequence
atggagcacaaggaagttgtgctgctcctgctactgttcctgaagtcggcagcgccagaacaatctcacgtggtccaggactgctatcatggggatgggcagtcatatagaggcacttactctacaacagtgacaggtcggacttgccaggcctggagttccatgacgcctcaccagcacaaccgcacaaccgaaaactaccctaacgcaggcctgattatgaattactgccggaatcccgatgctgtcgccgctccttattgctacaccagggatcctggggtgagatgggaatattgcaacctaactcagtgcagcgacgcggaaggtactgccgtcgccccccccaccgtgacacccgtcccatcactagaagccccatctgaacaggccccaacagagcagaggcctggcgtccaggagtgttatcacggcaacggacagagctatcggggaacttactccacaaccgtcactgggaggacctgccaggcatggtcttcaatgactccgcactctcactctcgcacccctgagtactaccctaacgccggccttattatgaattattgcagaaatcccgacgctgttgccgcaccctattgctacacacgggatccgggcgtcaggtgggagtattgcaatctaacacaatgctcggacgctgagggcactgcggtagcccctcccacagtcacacccgtgccctccctcgaggcaccttcagagcaggcccccaccgaacagaggccaggcgtgcaggagtgttaccatggtaacggtcagagctataggggaacctacagcaccaccgtaacagggaggacctgtcaggcatggagtagcatgaccccacattcacactcccgcacccctgaatactacccgaacgctgggcttatcatgaactactgtcggaatccagacgccgtggcagctccatattgttacacccgagaccccggggtacgttgggagtattgtaatctcacccagtgctccgacgctgagggaaccgccgtggctccacccacggtcacccccgttccctctctcgaggctccctcggagcaagcccccaccgagcaaagacccggcgtccaggagtgttaccatggcaatggtcagtcctataggggcacatattctacgactgtgacagggcgtacatgccaggcctggtccagtatgacaccccacagccattcgagaacaccggagtactaccccaacgcagggctcatcatgaattattgcaggaaccctgacgccgtcgccgctccctattgttacaccagagatcccggcgtccgctgggagtactgcaacttgactcagtgttccgacgcggagggcacagctgtcgccccccccacggtgaccccggtcccatccttggaggcaccctcggaacaggctccaaccgaacagagacccggagtgcaggagtgttaccacggaaatggacagagttacaggggaacctattccacaaccgtgaccgggcgaacttgccaggcttggagctctatgacgcctcactctcactcacgcactcctgagtattaccccaatgcgggtctgattatgaactattgcaggaaccccgatgctgtggccgcaccatactgctatacgagggatcctggggtgaggtgggagtactgtaacctcacccagtgctctgatgctgaagggacagcagtggctccaccaaccgtaacacccgtaccctctcttgaggctccctcagaacaggctcctactgaacagagacccggcgtccaggagtgttaccacggaaacggccagagctaccgggggacctatagcaccaccgtgaccggccgcacctgtcaggcatggtcatcaatgaccccacacagtcattccaggacaccggagtactatccgaatgctggcctgataatgaattactgtaggaacccagacgcagtcgcggctccatactgttataccagagatccgggcgtgcgatgggaatactgtaacttgactcaatgctctgatgccgaaggtaccgctgtggccccccccactgtgactccggtgccatccctggaagccccatcagaacaggcccctaccgagcaaaggccaggagtacaggagtgctatcacggcaatgggcagtcctacagaggaacctactccaccactgtcaccgggagaacctgtcaagcctggtcatctatgactccgcatagtcatagccgtacacctgaatattatcccaatgctggcctgatcatgaattattgtcgaaatccagatgctgtggcagctccgtattgctacacgagggaccccggagttcggtgggaatactgcaacctgactcagtgctccgacgctgaaggtaccgccgtggctccacctaccgtgactcctgtgccttcactggaagctccttcagaacaggcccccactgagcaacggccgggagtgcaggaatgttaccatggcaacggtcagtcataccgcggtacctacagtaccaccgtgacaggtcgcacatgtcaggcctggtctagtatgaccccccacagccactctagaacaccagagtactaccccaacgcaggcttgattatgaattattgtagaaaccccgatccagtagctgcaccttactgttacactcgcgatccgtccgttcgttgggaatactgtaatcttacccagtgttctgatgcagagggaaccgccgtggcacccccaaccattactcccatacccagtctcgaagcaccttccgagcaggctccaaccgaacagcgaccgggcgtacaggagtgctatcatggtaatggccagtcctaccagggaacttactttatcacagtcaccgggagaacttgccaggcttggtcaagtatgacccctcattcacactctcgaactcccgcctattaccccaatgcaggactgatcaaaaattattgccgcaaccccgacccggttgccgcgccatggtgttacacaacagaccccagcgtgagatgggagtattgcaacctgaccaggtgctccgacgcggagtggaccgcattcgtcccgcctaatgttattctcgcaccaagcctggaggcctttttcgagcaagcccttactgaggagactccaggagtccaggactgttactaccattatgggcagagttatcgtgggacatattctacaaccgtgacggggcgaacatgtcaggcatggtctagtatgactcctcatcagcactccagaactccagagaactaccccaatgcagggttgactcgaaactattgcagaaatcccgacgcagaaattcggccttggtgttataccatggatccaagtgtaaggtgggaatactgcaatctgacccagtgcctggtgaccgagagcagcgtgctggctaccctcacggtggtgcctgaccctagcactgaagcctctagtgaggaggcacccaccgaacagtctccaggtgtccaagactgctatcatggggacggtcaaagctaccgaggttccttcagcaccaccgtaacggggaggacctgtcagtcttggtctagtatgacacctcactggcaccaacgaacaacggagtattatccaaacggtggcctcactaggaattactgtagaaaccccgacgctgagatttcaccttggtgttacaccatggaccccaatgtccgctgggaatactgtaatcttactcagtgtccagtgactgagtcgtcagtgctggctacctctactgcggttagcgagcaagctcctacagagcagagcccaactgtgcaggactgctaccatggtgacggccagagctaccgaggtagcttttcgacaactgttaccgggcggacctgccaatcttggagcagcatgacacctcactggcatcagagaacaacagagtactatccaaatggcggattaaccagaaattactgccggaatccggatgctgagatccggccatggtgctatactatggatcccagtgtgaggtgggaatattgtaatctcacccaatgtcccgttatggagagtaccctgcttaccacaccaacagttgtacccgttccaagcacagaattaccttccgaagaggcccctaccgaaaatagtactggcgtacaagactgttatcgaggagatggccagagttatcgggggaccttgagcaccaccatcaccggacgcacatgccaatcatggtcatctatgaccccacattggcatcgacgcattcccttgtactaccccaatgccggactcacaaggaattactgtaggaatcctgatgctgagattaggccttggtgctacaccatggacccaagcgtgcgctgggagtattgtaacctaacgcgctgccccgtaacagaatcatcagtgctgactaccccaacagtagcccctgtaccctcgaccgaagctcctagcgaacaggcgccacccgaaaaaagccctgtagtacaggactgctaccacggagacgggagatcataccgggggatttcctctacaacggtgactggcagaacctgtcagtcttggtcgagcatgatcccccactggcatcagcggaccccagaaaactatcccaacgccgggctgaccgaaaactactgtcgcaaccctgactccggcaagcagccttggtgctataccaccgacccatgcgtccgctgggagtattgtaatctgacccagtgcagcgaaaccgaaagcggcgtgttggagaccccaaccgtggtacccgttccctccatggaagctcactcggaggctgctccaacggaacagacacctgtggtgagacaatgttatcatggcaacggccaatcttacagggggaccttttccacgacagtgacagggagaacatgccaatcctggtcatccatgacaccccatagacaccagaggacccccgaaaactacccaaacgatggtctgacaatgaattactgtaggaacccggatgccgacactggcccatggtgctttactatggacccaagcattcggtgggaatactgcaatcttactaggtgttctgataccgagggcacagtggttgcgccccctacggtgatccaagtgcccagtcttggacctccgtcagagcaggattgcatgtttggcaatgggaaaggttaccgtgggaaaaaggccaccaccgtgactggaaccccttgtcaggaatgggctgcgcaggagccccacagacattctacgtttattccgggcaccaacaaatgggccggtctggagaaaaattattgtcggaatcctgatggtgacatcaacggtccctggtgctacacaatgaaccctcggaaattgtttgactactgtgacattcccttgtgcgcaagttcgagtttcgactgcggtaaaccgcaggttgagcccaagaaatgtccaggtagtatcgtgggtggctgcgttgctcatccacatagctggccctggcaggtgtccctgaggacgcgctttggcaaacacttctgtgggggtactctaatcagccctgagtgggttctgacagccgcacattgtttaaagaagtcctcacgcccaagcagctacaaggtcatactgggagcccatcaagaggtgaatctggagtcccacgtgcaggagattgaggtgtcccgcctgttcctggaacctacccaggcagacattgccttgttaaaacttagccgccctgccgtgatcacggacaaggtgatgcctgcctgtttaccctcacccgattacatggttacagcgcggacggagtgttacattactgggtggggtgagactcaaggcacatttggcactggcttgctgaaagaggcccaactgctcgtaattgagaacgaggtgtgtaatcactacaaatacatttgcgcagagcatttggccaggggcaccgacagttgccaaggagacagtggcgggccgttagtttgcttcgaaaaagacaagtatatattgcagggcgtgacttcatgggggcttggctgtgctcggcccaataagccaggggtgtacgccagggtgagtcgattcgttacatggatcgaaggcatgatgcggaataactag

SEQ ID NO: 122684 - DNA, 4602 bp, Artificial Sequence
  Description of Artificial Sequence: Synthetic coding sequence
atgatgcagctgacactgaacaccctctttccagtggtgtctacccccgccattacctacattgtcaccgtgtttaccggggatgtgcgtggcgctgggaccaagtcaaaaatatacctggtgatgtacggagctcgagggaataagaacagcgggaagatattcctggagggtggcgttttcgaccgggggcgcactgacatcttccacattgaactcgctgtgcttctcagcccgctgtcaagagtgagtgtgggacatggcaacgtgggcgttaacagaggctggttttgtgagaaggtggtcatactgtgcccgttcacgggtattcagcagacctttccttgttccaactggctagacgaaaagaaagccgatggtttaatcgaaagacagctttacgaaatggtctcgctgaggaagaagagactcaagaaattcccctggtctttgtgggtctggactactgatctcaaaaaagctgggacgaacagtcccatcttcatccagatatatggtcaaaaagggcgtaccgatgagatcttactcaatcctaataataagtggtttaagcccggtataattgaaaaattccgtatcgaattaccagacttgggacgattttataagattagagtctggcacgacaaaagatcttccgggagtggctggcacctggaacggatgaccctgatgaacaccctcaacaaagacaagtacaatttcaactgtaaccgctggctcgacgctaacgaggatgataatgaaatagtgcgagagatgacagctgagggcccgacagtgaggcgtattatgggtatggcccggtatcatgtcactgtgtgtaccggggagctggaaggtgccggaactgatgcgaatgtctatctctgtctgttcggagacgtcggagatactggcgagaggctcctgtataactgtcgcaacaatactgacttatttgagaaaggcaatgcggacgaatttaccatcgaaagtgtgaccatgcgaaatgtgaggagggtgagaatcagacacgacggaaaaggctcagggagcggctggtatctagatcgtgtgctcgtgcgtgaggagggacaaccagagtctgacaatgtggaatttccctgcctgcgctggctagataaggacaaggatgacgggcagttagtcagggagcttctgccatctgacagtagcgcgacccttaaaaactttcgataccatatctccctgaaaaccggggatgtgtccggcgcatcaactgactcgcgcgtttatataaagttgtacggtgataagtcagacacaataaagcaagtgctgcttgtttcagacaacaacctgaaggattattttgagagagggcgagtggatgagttcacactagagacactgaacatcggcaacatcaacaggctcgtgataggacacgattcgaccggaatgcatgctagctggtttctggggtcagttcagattagagttcctcgccaaggcaaacaatacacatttcccgctaaccggtggcttgacaagaaccaggcagacggccggctggaggtcgagctgtacccttcggaagtggtagaaatacaaaaattggtacattatgaagtcgaaatttggacgggcgatgtgggaggtgcaggtacttccgcgcgcgtttacatgcaaatttatggagagaaggggaaaaccgaggtgttattcctgtctagccgctcaaaggttttcgagagggcctccaaagacactttccaactcgaggcagcagatgttggggaagtgtacaaactccggctcgggcacactggtgaaggatttgggcctagttggttcgttgacacggtgtggctgcgtcacctcgtggtgcgcgaagttgatctcactcccgaagaggaggcccggaagaaaaaggagaaagacaaactcaggcagctgctcaagaaggagcggctgaaggctaagctgcagcgcaagaaaaaaaagaggaagggctccgatgaagaagatgaaggcgaggaagaggagagttcgagttcagaggaatcttctagtgaggaggaggaaatggaagaggaagaggaagaggaagaattcggccctggtatgcaggaggtgatcgagcagcacaaatttgaagcccacaggtggctggccaggggcaaagaggacaacgagttggtggtggagttggtgcctgccggaaaaccaggccccgaacgcaatacttatgaggttcaggtagtgaccggtaatgtgcctaaagctgggaccgacgcaaatgtgtacctgaccatttacggggaggaatacggagacactggcgaaagacctctgaaaaaatccgataaatctaacaaatttgaacagggacagacagacaccttcacgatttatgcaattgatcttggcgcattgacgaagatccgtattcgccacgataacaccggcaaccgggccggttggttcctggatagaatcgacattaccgatatgaacaacgagatcacatactacttcccctgccagcgttggctcgccgtggaagaggatgacgggcagctgtcccgcgagttactccccgtggacgagtcctacgtactgccccagagcgaggagggacggggcggcggcgataataaccccttagataatctcgccttggagcaaaaggataaatcaactacgttctcagtgactatcaagaccggcgtgaaaaagaacgcaggtaccgatgcaaatgtgttcatcactctcttcgggacccaggacgataccggtatgacactgttgaagtcttcaaagacaaactccgataagttcgagcgagatagtatcgagattttcaccgtggaaaccttggacctgggggacctctggaaggtcaggctgggccatgataacacaggaaaggcacctggatggtttgtagattgggtagaagtagacgctcctagcttggggaagtgtatgacattcccttgcggccggtggctcgccaagaatgaagatgacgggtcaattattcgtgatctgtttcatgcggagctgcaaacaagattgtatacaccattcgtgccctacgagattaccctgtacacaagcgacgtattcgccgctggaaccgacgccaacatcttcatcataatttacgggtgtgacgcagtgtgtacccagcagaaatacctgtgcaccaacaagcgggagcaaaaacagttcttcgaacggaaatcagcgtctaggttcatcgtcgagcttgaagacgtgggcgagatcattgaaaaaatccgcatcggacacaacaatactggcatgaaccctggctggcactgcagccacgtggatatccgtcgcctattacccgacaaggacggtgccgaaaccctcacatttccctgcgacaggtggttggctacatcagaggatgataagaagacaatcagggagctggtcccttacgatatctttaccgagaaatacatgaaggacggctccctcagacaggtttacaaagaagtggaggagcctctggacatcgtcttgtattcagtccagatattcacaggcaatatcccgggtgccgggactgacgccaaggtgtatatcactatctatggggacctgggcgatacaggcgagaggtatctcggaaagagcgaaaaccgcaccaacaaatttgaaagaggcaccgctgatactttcattatcgaggcggccgacctgggggtgatttacaagatcaagctgcgccacgacaacagtaaatggtgcgccgattggtacgttgaaaaggttgaaatctggaacgacacgaacgaggatgaatttttgttcttatgcggcaggtggcttagtctgaagaaggaggacggccgactggaaaggcttttctatgaaaaagagtacaccggcgacaggtccagtaactgttcttcacctgctgatttctgggagatcgccctcagttcgaagatggccgatgtggacatcagcacagtcaccgggcccatggcagactacgtgcaggagggccccataattccctactatgtatccgttaccacaggaaaacataaagacgctgccaccgattccagggcatttatctttctgatcggtgaggatgacgaacgctctaagaggatctggctggactacccaaggggcaagcgtggattcagccggggaagcgtcgaggaattctatgtggccggcctggatgtcgggattattaagaaaatcgaggtcttatatgagatgacggtgtggacaggagatgtcgtgggcggcggcactgactccaacatcttcatgactttgtacggtatcaatgggagcaccgaggaaatgcagctcgacaagaagaaggcgcgattcgaacgtgagcaaaatgatactttcatcatggagattctcgacatagcaccttttaccaaaatgcggattagaattgacggacttggttccagacccgagtggtttcttgagcgcgtgaaatgcctggatcctcattctagctttcagcctccaccaactccaagtcccgggtccagcggactcagcatggaccttgtaaaagcacagatgagcctgtag

SEQ ID NO: 122685 - DNA, 5844 bp, Artificial Sequence
  Description of Artificial Sequence: Synthetic coding sequence
atgatgcagctcaccctgaataccctgtttcccgtggtctcaacacctgcaataacgtacatcgtgacagtatttaccggcgatgtcaggggagccggcaccaagtcgaaaatctacttggtgatgtacggagcacgaggaaacaagaattccgggaagatcttcctagagggcggcgtcttcgacagaggccggaccgacatcttccacatagaactcgcagtactgctgagcccactctcgagagtttcagttggacacggcaacgttggggtcaataggggttggttctgtgaaaaggtagtcattctttgcccttttacagggattcagcagacgtttccctgcagtaactggctggatgaaaagaaggcggacggtctgatcgagcgtcagctgtatgagatggtgtcattacgcaagaagagattaaagaaattcccgtggtccctatgggtgtggacaactgatctgaagaaagctggaaccaactctccgatcttcatccagatctatggtcaaaaaggaagaacagacgaaatcctgctaaaccctaataataagtggtttaaaccaggaatcattgaaaagttcagaattgagttgcctgacttgggccgattctataagatccgcgtctggcacgacaaacgctcgagtggttccggctggcacctcgaaaggatgacgctcatgaatacactaaataaagacaagtacaactttaattgcaaccgctggcttgatgccaatgaagacgataacgaaattgttcgcgagatgaccgccgaggggcccaccgtccgacgcatcatggggatggccaggtatcacgtaaccgtctgtactggcgaattagaaggcgctggtactgacgccaacgtttatttatgcctttttggcgatgtcggagatacaggtgaacgtctgctttacaactgcagaaacaataccgacctgtttgagaaaggaaatgcggatgaattcaccatcgaaagcgtcaccatgcggaacgtgagacgcgttcgcatcagacacgatgggaagggtagtggaagcggctggtacttagacagggtcctggtgcgggaggaagggcagcccgaatccgataatgtcgaattcccatgcttacgctggcttgataaggataaagacgatggccagcttgtcagagagctcctgccgtctgattcatctgcgactctaaagaattttaggtatcacatctctctgaagaccggcgacgtgtcaggggcctctaccgattcgcgagtatatatcaaactgtacggagacaagagtgacaccatcaaacaggtcctcctggtctctgacaataacctcaaagattacttcgaacgggggcgcgttgacgagttcaccctagagaccctcaacattggaaatatcaatcgcctcgtaataggccatgactccacgggtatgcatgcttcgtggtttctcgggtcagtgcagatcagagtcccgcgccaaggcaaacagtatacgttcccagctaataggtggcttgacaagaaccaggctgatggaagacttgaggtcgaactgtatcctagtgaggtggtagagatacaaaagctagtgcactacgaagtggagatttggacaggagacgtggggggagccgggacctcggccagagtttatatgcagatatacggtgaaaagggcaaaacggaggtgctgttcctgtcctctcgatcaaaggtttttgagagagcgtccaaggatacctttcaactagaggccgccgatgtcggcgaggtatacaagctgcggctcggacacacaggggagggcttcggccctagttggtttgtggacaccgtctggttaaggcatctggttgtgcgtgaggtggacctaacacccgaggaggaggcccgaaaaaaaaaagaaaaggacaaactccggcaattactcaagaaggagagactgaaggcaaagctccagagaaagaaaaagaagagaaaggggtccgatgaggaggacgagggcgaggaggaagaatcctctagcagtgaggaatcttcctctgaggaggaggagatggaggaagaagaggaggaagaagagttcgggcccggcatgcaggaggttattgaacagcataaatttgaggcccacagatggctagcgagaggtaaggaagataacgaactggtggtggaactcgtccctgccggcaagcccgggcccgaaagaaacacatacgaagtacaggtggtcacaggaaatgtcccgaaagcaggcactgatgccaatgtatatctgacaatctatggtgaggagtacggcgatacgggtgaaagaccccttaaaaagtccgataaatctaacaaatttgaacagggtcagacagacacattcacaatatatgctatagacttgggcgcactgacgaagatacggatacgccacgacaacactggcaatcgcgcaggttggtttctagatcgcatagacataacagatatgaataatgagattacatactattttccatgtcaacggtggctggccgtggaggaagatgacggacaactctccagagagttattgccagtggacgagtcttatgtgctgccccagagcgaggaaggccggggtggcggggacaacaaccccctggataatctggccttagagcaaaaggataagtcaaccacattttctgtaaccattaagaccggggtgaaaaaaaacgccggcactgatgcaaacgtgttcatcactctttttggcactcaagacgacaccggtatgaccctgctaaagagcagtaaaacgaactctgacaaattcgaacgcgactccatcgaaatcttcaccgtggagactcttgatctgggagatctatggaaagtccgcctgggtcacgacaataccggaaaagctcctggatggttcgttgattgggtggaggtggacgctccctccctgggaaagtgcatgacttttccatgtggacgatggttggccaagaacgaggacgatggtagtatcattcgggatctcttccacgcagagctacaaacgcggctatatacccccttcgttccctacgagatcactctgtacaccagcgatgtctttgctgctgggacagatgctaatatcttcattattatttacggctgcgacgcagtgtgcacacagcagaaatacctttgcacaaataagcgtgagcaaaaacaatttttcgagcggaagagcgcttccaggtttatagtggagttggaagatgtgggcgagatcattgagaagattcggatcggccacaacaacactgggatgaaccccggatggcattgctcccatgtcgacatccggagactcctgcccgataaggacggggctgaaaccttgacattcccatgtgataggtggctggctacgtcagaggacgataagaaaactatccgcgaactggtgccttacgacatttttacagagaaatatatgaaagacggatcactccgccaggtctacaaagaggtcgaggaacccttagacatcgtgctgtactctgtgcagatatttacaggcaacataccaggagcaggaactgatgcaaaggtgtacattacaatctacggggatctaggagacacaggcgaaaggtacctgggaaagtctgagaatcgcacgaacaagttcgaacgtggtactgcggataccttcattatagaagcggcggacctcggagtcatctacaagataaagcttcggcatgataattctaagtggtgcgccgattggtacgtcgaaaaggtggaaatttggaatgacacaaatgaagatgagttcctgtttctatgtgggagatggctctccttgaaaaaagaggacgggcgcctcgaacgactcttttacgagaaagaatacactggggataggtcctcaaactgctccagccctgcagatttctgggaaatagcactttcctcaaaaatggccgacgtggacatatccacagtgaccggtcccatggccgattacgttcaagaaggccccattatcccttattacgtctctgttaccaccggtaagcacaaagacgctgccacggatagtagagcattcatcttcttgataggcgaggatgatgaaagaagcaagcggatctggttagactacccgaggggaaagcggggcttctctagaggatccgtcgaggaattctacgttgcggggcttgatgtcgggatcattaagaagatcgagcttggccacgacggcgcatccccagagagctgttggctcgtcgaggagctgtgcttagccgtaccaacccagggaacaaagtacatgttgaattgtaactgttggctggccaaggatcgcggagacgggatcacgagtcgagtgttcgacctgttggacgccatggtcgtgaatattggggtgaaggtgttatacgaaatgaccgtgtggaccggcgatgtggtgggaggtggcacagattccaatatcttcatgacgctttatggcatcaacggcagcactgaagagatgcaactagataagaagaaggccagattcgaaagagagcagaacgacaccttcatcatggaaattctggacattgcccctttcacaaagatgagaatccgtattgacggactgggctcaagacctgagtggttcctcgagaggatattgctgaaaaatatgaacacaggcgacttaacaatgttctattatggagactggctcagccaaaggaaaggaaagaaaacactggtctgtgagatgtgcgcagtgattgacgaagaggaaatgatggaatggacctcatacactgttgctgtgaagactagcgacatcctaggcgccgggaccgacgcaaacgtctttattataattttcggcgagaatggcgacagtggtaccctggcgctcaagcaaagcgccaactggaacaagtttgagcggaataatacggataccttcaatttccctgacatgcttagtctggggcacctgtgcaagctcagggtctggcacgacaacaagggtatttttcctggttggcacctctcatacgtagacgtgaaagacaattcccgcgatgagacctttcacttccagtgcgactgctggctgagtaaatccgagggcgatggtcagacagtccgggatttcgcctgtgccaacaataagatttgcgacgaactggaggagactacctacgaaattgtaatcgaaacagggaacggcggggaaaccagagagaacgtatggttgatattggaaggaagaaaaaatagaagcaaggagttcttgatggaaaactcttcccgccagcgcgccttcagaaaggggaccaccgatacttttgaattcgatagtatctacctgggagacattgccagcttgtgtgttggccacctcgccagagaggaccgatttattcccaaacgcgagctcgcctggcacgtcaagacaattactattactgagatggaatacggcaacgtgtatttcttcaattgtgattgcctgattcccttgaaacgaaaacgcaaatattttaaagtgttcgaggtgaccaaaacgacagagtcattcgcctccaaggtacagtcattggtcccggttaaatacgaagtgatagtcactactgggtatgaacccggcgcaggcaccgacgccaacgtgtttgttaccatttttggtgctaatggcgacacgggtaagagagagcttaagcagaagatgcggaatctatttgagaggggttctactgatcggtttttccttgagacactggagttggttgttacccgcctgggcctggccgccgagtgtggatag

SEQ ID NO: 122686 - DNA, 3435 bp, Artificial Sequence
  Description of Artificial Sequence: Synthetic coding sequence
atgttgcgacacctgaccgacaccttcacgatttacgctatagatctgggcgccctgaccaagatacgtattagacacgataataccggtaatagagccggctggtttctcgacagaatcgatattaccgatatgaataacgagataacctattactttccctgtcaaagatggctagctgtggaggaagatgatggtcagcttagcagggagctgttacctgtcgacgagagttatgttctgccacaatcggaggagggacgcggcggcggggataataacccactggataaccttgccctggagcaaaaagacaagagcaccactttttctgtgactatcaaaaccggcgttaagaaaaatgctggcacggacgctaacgtgtttatcacactgttcggcacccaggacgatacgggtatgaccctgctcaagtctagtaagactaattcagacaagttcgagcgagattccatagagatcttcactgtagagaccctggacctaggagacctgtggaaggtgaggctgggacacgataacacaggaaaggcaccggggtggttcgtggattgggtagaagtcgatgccccctccctcggaaaatgtatgacctttccgtgtgggaggtggctcgcaaaaaatgaagatgacggatccattataagggatctctttcacgccgagctgcagacccgtctctatacaccctttgtaccttatgaaatcaccctgtatacctctgacgttttcgccgctggcactgacgccaacatcttcattatcatctacgggtgtgacgccgtgtgcactcaacaaaaatatctgtgtaccaataagagagaacaaaagcagttcttcgagaggaagtccgccagccgattcattgttgagctggaagacgtgggcgaaattatcgaaaaaattcggattggtcacaacaacactggtatgaatccaggatggcactgcagccatgttgatatccgacggttgctccccgacaaagacggggccgaaactctaactttcccctgcgatagatggcttgcgaccagcgaagacgacaaaaagactattcgggagctggtgccctatgatatttttactgaaaagtatatgaaagatggctctttgcgccaggtgtacaaagaggtcgaggagcctctggacatcgttctctattcggtacaaatcttcacaggcaacattccaggggctgggacagatgcgaaggtgtacattactatttatggggacctcggagatacgggcgagagatatcttgggaaatccgaaaaccggaccaacaaatttgagagggggacggctgacacatttattatcgaggctgcagatctgggggtgatctacaagatcaaacttagacatgataattcaaagtggtgcgcagattggtatgtcgaaaaggtggagatttggaacgataccaatgaggatgagttcctgttcctctgtggaaggtggttgagcttgaagaaggaagatggccgactggaaaggctcttttatgagaaggagtacactggggacagaagctctaactgctccagcccagcggatttctgggaaattgccctgtcttctaagatggccgatgtggatatctccaccgtgacaggccccatggcagattacgtacaagaaggccccataataccttattatgtgtctgttactaccggcaaacataaggacgccgccactgactccagagccttcattttcctcatcggggaggacgacgagcggagcaagaggatttggctggattacccgaggggaaaaagaggattcagtagaggaagcgtggaggaattttatgttgccggcctcgatgtcggcattattaaaaaaatagaagtgttgtatgagatgacagtgtggacaggcgacgtggttggcggcgggacagatagcaatatctttatgacactttatggaattaatggcagcactgaggagatgcagctggacaaaaagaaggcacggttcgaacgcgagcagaatgatacattcatcatggagatattggatattgcccccttcactaagatgcgaatacggatcgatggacttggctcacgccccgaatggtttttggagagaatactcctgaagaatatgaacactggtgatcttacaatgttctactatggagattggctgtctcagcgcaagggtaagaaaaccctggtgtgcgaaatgtgcgccgtgatcgatgaggaggaaatgatggagtggacttcttacaccgtggctgtaaagacaagcgacattttgggcgcaggtactgatgcaaatgtgttcatcatcatattcggtgagaacggcgatagtggaactctagccctgaaacaaagcgctaactggaataaatttgaaaggaacaacacagacacatttaactttcccgatatgctttcactcgggcatctgtgtaaattgcgggtgtggcacgacaacaaaggtatctttcccggctggcatctgtcctacgtagatgtgaaggataacagtcgagacgagactttccactttcagtgcgattgctggttatctaagtccgagggagatggccagacagtcagagacttcgcctgcgccaacaacaagatctgcgacgagctagaggaaactacatacgagattgtgattgaaactggaaatggaggcgagactcgcgagaatgtgtggctgatcttggagggacggaaaaacaggtccaaggaattcttaatggagaatagtagcaggcaacgagcgtttcggaagggaactactgacacattcgaatttgactccatctacctgggcgatatagcatccttgtgtgtggggcatcttgctcgggaagaccggttcatcccaaagcgggagttagcttggcacgtaaagaccattactattacagaaatggagtatggaaatgtatactttttcaactgcgactgtttgattcccctgaagaggaagaggaaatattttaaggtgttcgaggtaacaaaaactacggagagttttgcaagcaaggtccagagtttagtgccggttaaatatgaggtcatagtcaccacaggctacgagccaggggctggcactgacgcaaacgtcttcgttacaatatttggagctaatggcgacactggcaagagagagttaaaacaaaaaatgcgtaacctgttcgagaggggcagtactgatcggttttttctggaaacccttgaacttggagagctaagaaaagtgcggctcgagcacgactcctccggatactgttctgggtggctcgttgaaaaggtggaagtgacaaacacctctactggggttgccactatctttaactgtggcaggtggctggataagaagaggggcgacggcctgacctggcgcgatctcttcccaagtgtctag

SEQ ID NO: 122687 - DNA, 921 bp, Artificial Sequence
  Description of Artificial Sequence: Synthetic coding sequence
atgaggttgggcactaattgtgaacatcctcagctgccactggcagcgcccagcggctattattttccatgtcaaaggtggctggcggtggaagaagatgatggtcagctctccagggagctgctgcctgtggacgagtcctatgtcttaccccaatctgaagaggggagaggcggcggagacaacaatccccttgataaccttgccctcgaacaaaaagacaagtctacaacgttttccgtgacaatcaagaccggggtgaagaaaaacgcagggaccgacgccaacgtgttcattaccctgttcggaacacaggatgacacgggcatgacgctgctgaaatcttccaaaaccaactcagacaagtttgaaagagactccatcgaaatttttacggtggagaccctggacctgggcgatctgtggaaggtgcggttgggacatgacaacacaggaaaagccccgggctggtttgttgactgggttgaggtcgatgccccctctctgggtaagtgtatgacgttcccttgcggccgctggctcgctaagaatgaagacgatgggtccattattcgagatctcttccatgccgagctgcagacacgactatatacaccttttgtgccctacgaaatcaccttatatacttccgacgtgttcgcagccggcacagacgctaatattttcatcattatttacggctgtgatgctgtatgcacgcagcagaaatacctttgtaccaataaaagagagcagaaacaattttttgaaagaaagtcagccagccgtttcattgtggagctcgaggatgtgggggagataatcgaaaagatccgcatcggtcacaacaacactgggatgaacccagggtggcactgcagccacgttgatatacgacgcttgctgccagataaggattag

SEQ ID NO: 122688 - DNA, 6636 bp, Artificial Sequence
  Description of Artificial Sequence: Synthetic coding sequence
atgatgccgcagaaaaaacggaggaggaaaaaggacatagacttcttggctttgtatgaggccgaactgctcaactacgcttcagaagacgacgaaggcgagctcgagcacgagtattacaaagccagggtttacgaggtggtcacggctaccggcgatgtcaggggcgcaggtacggacgcgaacgtattcattacactcttcggcgaaaacgggctgtcccccaagctgcagctgacttccaagtcaaaatcagcatttgagaaagggaatgtggatgtgtttcgggtgcgtactaataatgttggattgatatataaggtgcggatcgaacatgataacaccggattaaatgccagctggtaccttgaccacgtcattgttactgatatgaaaagaccccatctgagatattactttaattgcaataattggctcagtaaggtcgaaggagacagacagtggtgccgggatcttcttgccagtttcaacccgatggacatgcctaggggcaataagtacgaggtgaaggtttacacaggagacgtaatcggcgccggcacagatgcggacgtgttcatcaacatctttggggagtacggggatactggtgaacgaaggttggagaatgaaaaagacaactttgagaagggagcggaggatcgctttatccttgacgcaccggacctgggacagctgatgaagatcaacgtgggacacaacaacaaaggtgggtcagccggctggtttctctcacaaatcgtgatcgaagacattggcaataagcggaagtacgattttccactgaatcgatggctagcgctggacgaggacgatgggaagatacaaagagacattcttgtgggtggggctgagactaccgcgataacatacatagttacggtgttcaccggtgacgtgcgcggagctggcaccaagtcaaaaatatacctggttatgtatggggccaggggcaacaagaatagcggcaaaatcttcctcgagggcggggtgttcgatcgaggacgtacggacatctttcacattgagttagcagttcttctgtctcccctgagtagagttagcgttggccacggtaacgttggggtcaacaggggttggttttgcgagaaggtggtgatcctctgccccttcacagggatacagcaaacctttccttgttctaattggttagacgaaaaaaaggccgacgggctgatcgagcggcaactgtatgagatggtatcactaaggaagaaacgactgaagaagtttccttggtcattatgggtctggactacagacctgaagaaggccggaacgaacagtcccatcttcattcagatctacggacagaagggacggacagacgagattttattaaacccaaacaataagtggttcaagcctggaatcatcgagaaattccgcattgagctgcctgacttaggaaggttttataagatcagagtatggcatgataagagaagctctgggagcggctggcacctggagcggatgactctgatgaacacacttaataaagataagtacaacttcaactgtaatcggtggctcgacgcgaacgaagacgacaatgagattgtgcgggagatgacagccgagggacccactgttcggcgcattatgggcatggccagataccatgtaacagtttgcacaggggagctcgaaggagcaggcactgacgccaatgtgtacctctgcctcttcggcgacgtcggcgacactggagagcggctgctgtacaactgtcggaacaacaccgacctgttcgagaagggtaatgctgacgagtttaccatcgagtccgtgaccatgcggaatgtgcggcgggtccgcatcagacatgacgggaaagggtcgggatcaggctggtatttagatagagtgttggttagggaggagggacagcccgaatccgacaatgtagaattcccatgcctgcgctggctggataaggacaaggacgacgggcagttggtgagggaattgctcccaagtgattcgagtgccaccctgaaaaatttccggtaccatataagcttgaagacaggtgacgtatcaggcgcaagcacagactccagggtctacatcaagctgtatggagataaatccgatacaattaagcaggtgctccttgtcagtgacaacaatcttaaggattatttcgaacgtggccgagttgatgaatttacccttgaaactcttaatatcggcaatatcaacaggctggtcattggccacgatagtacgggcatgcacgcttcctggtttctcggttcggttcagatacgtgttccacggcaggggaaacagtatacatttcccgccaatagatggcttgacaaaaatcaggccgatgggagattggaggtagagctctatccttccgaagtggtggaaatccaaaaactggtccattatgaagtggagatctggaccggcgatgttgggggggcaggcacttccgccagagtatacatgcagatctacggggaaaaaggcaagacagaagtgctatttctcagtagtcgctctaaggtcttcgagagggcctccaaggacacttttcaactggaggccgcggatgtgggcgaggtgtataagctccgactcgggcacacgggcgagggttttggtccgtcttggttcgtggacaccgtctggctgagacacctggtggtccgggaagtggaccttacccctgaagaggaggctcgtaagaagaaagaaaaggacaaactgcgtcagctccttaaaaaggagcggttgaaggcaaaattgcaacggaagaaaaagaagagaaaaggatcagacgaggaggacgagggcgaagaggaagaatcctccagctcggaagagagctctagcgaggaggaggagatggaagaggaggaggaggaagaggaatttggtccggggatgcaagaggtcattgagcaacacaaattcgaggctcacaggtggcttgcccgggggaaagaggataacgagctagtcgtggagcttgtgcctgccgggaaacccgggccagagcgtaatacatacgaggtgcaggtggtaacaggcaatgtaccaaaggctggtaccgacgctaacgtgtacttgaccatatacggcgaggagtacggcgatactggcgagcgtcctctgaagaagagtgacaagtctaataagtttgaacaggggcagactgataccttcaccatctatgcaatagatttgggcgcgctgactaaaatccggattcgccacgataatacagggaaccgggccggatggttcctggaccggatcgacattacggacatgaataacgagatcacctactatttcccctgccaaaggtggctcgctgtagaagaggatgatgggcagctctctcgggaactcctacctgtcgatgagtcatatgtgctacctcagagcgaggaaggtcgtgggggcggagataataatccactggataacctcgcccttgaacagaaagacaaaagcacaaccttttcagtcacaataaaaaccggggtgaagaaaaatgcggggaccgacgcaaacgtctttatcaccctgttcggcacccaggatgacactggcatgactttgcttaagtcttcaaagactaactcggataagtttgagcgggattctatcgaaatttttaccgttgagaccttggatctaggtgatctctggaaagtccgtctggggcatgataacaccggcaaagctccgggctggtttgtggactgggtggaagtagacgctccaagtcttggcaagtgcatgactttcccgtgcgggcggtggttagcgaagaacgaggatgatggatcaatcattcgcgatctgttccacgccgagttacagaccagactgtacactcctttcgtgccctacgagattaccctttacaccagcgatgtgttcgccgcaggaactgatgccaacatatttattattatctatggatgtgacgctgtatgtacccaacagaaatatctatgtacgaataaaagggaacagaagcaattcttcgagcgaaagagtgccagcagatttattgtcgaacttgaggacgtcggggagattatcgagaaaattcggattgggcacaacaatacgggaatgaaccctggatggcactgttcgcacgtcgatatcagacggcttctccctgacaaagacggcgccgaaaccctgactttcccctgtgaccgatggctggccacaagcgaggatgacaagaaaaccatcagggagctggtaccgtacgatatttttaccgagaaatatatgaaagatgggtccctgaggcaggtgtataaagaagtggaggaacccctcgatatcgtgctgtactcagtgcagatctttactgggaacatcccgggggcaggcacagatgctaaggtttatattactatctatggggacctcggagatacgggagaacgttacttaggtaagagtgagaaccgaacaaataaattcgaacgtggcaccgcggataccttcatcattgaggccgccgacctgggggtgatttacaaaatcaagctcagacacgataattcaaagtggtgcgctgattggtacgtggagaaggtagagatctggaatgacactaacgaagatgagttcttattcctttgcggccggtggctgtccctgaagaaagaggatggccggctggagcgcctattttatgaaaaggaatacactggcgacaggtcttctaactgctcaagccccgcagatttctgggagatcgctctcagctctaaaatggcagatgtggatatttccacagtaacgggacccatggctgattatgtgcaggagggacccataatcccatactatgtttcggtgactaccggaaagcataaagacgccgccaccgattcccgggcattcattttcctgattggcgaggatgacgaaaggtcgaaaaggatttggttggattacccgcgtggcaaaaggggattttcgcggggatccgttgaggagttctacgtggctggtctcgatgtggggataatcaaaaaaatcgaagttctgtatgaaatgaccgtgtggacaggggatgtcgtgggtggaggcaccgatagtaacatctttatgaccttgtatggcattaacgggtccaccgaagagatgcagcttgacaagaagaaggcacggtttgagagggaacagaacgatacattcatcatggaaattctagacatagccccctttacgaaaatgcgaatccgcatcgacgggctgggctccaggcctgaatggttcctggaacgcattctgctgaaaaacatgaatacgggggacttgactatgttctattacggcgattggttatcccagcgaaagggaaaaaaaacattagtgtgtgaaatgtgcgccgtgatagatgaagaagagatgatggagtggacctcctacaccgtggccgtcaaaacctctgatattctgggagcgggcaccgatgccaatgtctttattattatcttcggtgagaatggtgacagcggaactttagcgctgaagcagagcgctaattggaataaattcgagaggaacaacacagatacattcaactttcctgatatgttgtcccttggacatctgtgtaagctgcgcgtttggcacgataataaggggatcttccccgggtggcatctctcctacgtggatgtgaaggacaattcccgggatgaaactttccacttccaatgtgactgttggctgagcaagagcgaaggcgacggacagacagtcagagacttcgcgtgtgctaataataagatctgcgacgagctggaggagacaacatacgagatcgtgatcgagaccgggaacgggggcgagacccgagaaaacgtttggttaattctagagggccggaagaaccggtcaaaagaattcctgatggaaaacagcagccgccagagggcctttcggaagggcaccacagacacctttgaattcgactccatttacttgggtgacattgcatctctgtgtgttggccacttagctagggaagataggttcattcctaaacgcgaactggcctggcatgtgaaaaccatcaccattacagagatggagtacggcaacgtctacttcttcaattgtgattgcctgatccccttgaaaaggaaaagaaaatacttcaaagtattcgaagtgacgaaaacaaccgaatccttcgcctccaaggtccaatccctggttcctgtcaaatacgaagtgattgtcaccaccggctacgaaccaggcgctggaaccgacgcaaacgtcttcgtgaccattttcggcgcaaatggagataccggtaagcgtgaactgaagcagaagatgagaaacttattcgagaggggatccaccgatagattctttctggaaaccctggaattaggcgagctgcggaaagtccggctggaacacgactcatccggttactgttcgggctggttagtagagaaggttgaagttacaaataccagtactggagtggctacaatttttaactgcggaaggtggctggataagaagaggggcgatggcttgacatggagagacctgttcccgtccgtctag

SEQ ID NO: 122689 - DNA, 3345 bp, Artificial Sequence
  Description of Artificial Sequence: Synthetic coding sequence
atgaacaacgaaatcacctattacttcccatgccagcggtggcttgccgtcgaggaagacgatgggcagttgagtagggaactcctccctgtcgacgaaagctacgtactccctcagtctgaagagggacgaggaggtggtgacaacaatcctctggacaacctggcacttgagcagaaggataagtccaccactttttccgtgaccatcaaaaccggagtaaagaagaacgctggaacagatgccaacgtgtttatcacacttttcgggactcaggatgataccggaatgacactgttgaagtcctcaaagaccaacagcgacaagttcgagcgcgatagtattgagatttttacggtcgaaacactagacttgggcgacctgtggaaggtcagactggggcacgataacaccggcaaagcccccgggtggtttgtagactgggtagaagtcgacgctccatccttgggcaagtgcatgacatttccatgcggacgctggctggctaaaaatgaggacgatgggtccatcatcagagacctgtttcacgcagaattacagactagattatacacacccttcgtgccttacgaaatcacactctatacgtcggatgtctttgccgcaggcacagacgccaatattttcattattatctacggttgtgatgccgtatgtacccagcagaagtatctttgcacaaacaagcgagagcagaaacagttctttgaacggaaatccgccagtcggtttatagtagaactggaggacgtcggggagattatcgagaagatccgaatcggacacaacaataccggcatgaatcccggatggcactgttctcatgttgacattagaaggctccttcccgacaaagacggtgcggagaccttgacattcccctgcgatcgttggctggccacgagtgaggatgacaaaaaaactatacgagaactggtcccctatgacatctttacagagaagtatatgaaagatggatccctaaggcaggtatacaaagaggtcgaggaacccctcgacatcgtcctttacagcgttcagatttttacaggaaacatacccggcgctgggactgatgccaaggtttacatcacaatatatggggatctgggagacacaggcgaaagatatttggggaaaagtgaaaaccgaaccaataagtttgagagaggcacagccgacacattcataattgaggccgctgatctgggagtaatatataaaattaagttacggcatgataactcaaaatggtgcgcggactggtacgttgaaaaagtggagatatggaacgataccaacgaagatgagtttctatttctttgtggcagatggctgtcgctaaagaaggaggatggccgcctggaaaggctcttttacgagaaggaatatacaggcgaccgctccagcaactgttcatcacccgccgatttctgggaaatcgccctctccagcaaaatggcggacgtggacatcagtaccgtgactggccccatggctgattacgtgcaagaaggaccaatcattccctattacgtctccgtgaccacgggaaaacacaaggacgccgcaacagattctagggcctttatctttttgatcggagaggatgacgaacgttccaaaaggatctggctggactatccacgcggaaagagggggttcagccgaggctctgttgaggagttttatgtggccggtcttgatgtgggcatcatcaaaaagatcgaattaggccatgacggcgcatctccggaatcgtgttggcttgtggaggagctgtgcctggctgtgccaacacagggcactaagtacatgctcaactgtaactgctggttagctaaagaccggggtgatggcattacctcacgagtgtttgatctgctagacgccatggtagtcaacatcggagtcaaggtgctgtatgaaatgacggtgtggaccggcgatgtcgtcggtggtgggaccgattcaaatattttcatgacattatacggcataaacggtagtacggaggaaatgcagctcgataaaaaaaaggcaagatttgaacgcgaacagaacgacaccttcataatggagatcctggatatcgctccttttaccaagatgagaattagaatagacggcctcggaagccggcccgagtggttcctggagagaatcctccttaagaacatgaatacaggagatctaacaatgttttactatggagattggctgtctcagaggaagggaaagaagaccttggtatgcgagatgtgtgccgtcatcgacgaggaagaaatgatggaatggacctcttataccgtggccgtcaaaaccagcgacatactcggtgccggcacagatgccaatgtcttcattattattttcggcgagaatggggattcagggactctagccctgaagcagtccgctaattggaataaatttgaacgcaataatacagacactttcaattttccggatatgttgtctctcggacatctctgtaagttgagagtgtggcatgataacaagggcatttttcccggatggcacctttcatatgtcgacgtcaaagacaacagccgtgacgagacgttccattttcagtgcgactgctggctctccaagtcagaaggcgacggccaaaccgtgagggacttcgcttgtgcgaacaacaagatatgtgatgagctggaggaaaccacatacgagatcgtgatcgagactgggaatggcggggagacgagagaaaatgtgtggttaatactagaaggtcgcaagaaccgctcaaaagagtttttaatggagaatagctcgcgccagagagccttccgtaaggggacgacagatacctttgaatttgattctatctaccttggggacatcgcgtcactctgtgttggccacctcgccagggaagaccgatttatacccaagagagaactggcttggcacgttaagaccattacaataaccgagatggagtatggaaacgtgtacttttttaattgtgactgtcttattccccttaagcgcaaaaggaagtacttcaaggtgtttgaagtgactaaaacaacagagagtttcgcaagtaaggtgcagagcttagtgccggtgaaatatgaggtaattgtgaccacaggctacgaaccaggagccggaacagatgctaacgtgttcgtcacgatttttggtgctaatggagacaccgggaaacgtgaactgaaacagaagatgcgcaacttgtttgaacggggtagtaccgatcgcttctttctggaaacgctcgaattggtagttacccggcttggactcgctgctgagtgcggctag

SEQ ID NO: 122690 - DNA, 1539 bp, Artificial Sequence
  Description of Artificial Sequence: Synthetic coding sequence
atgacggtgtggacaggtgacgtggtgggggggggtactgacagtaatatatttatgactttgtacggtattaacggctctactgaggaaatgcaactagataaaaagaaggcgagattcgagcgggaacagaatgacaccttcatcatggaaatcctggacattgcaccattcacaaaaatgcggatccgcatcgacggactgggctctcggccagaatggtttctggagcgtatactcctgaagaacatgaatactggtgatctgaccatgttctattatggtgactggctgtctcagcgaaaaggcaaaaaaacccttgtgtgcgagatgtgcgccgtaatcgatgaagaagagatgatggagtggacctcctataccgtcgccgttaaaacctcggatatactcggggctggcaccgatgcaaacgtcttcatcattatttttggtgaaaacggagatagtggaaccctagcacttaaacagtccgcaaattggaacaagttcgaacgaaataacactgatactttcaactttcctgacatgttatcattgggtcacctctgcaagcttagggtgtggcatgacaataaaggcatcttccccgggtggcacctatcttacgtcgacgtgaaggataacagccgcgacgagacctttcacttccagtgtgattgctggctttctaagagcgagggggatggccagactgtcagagacttcgcctgcgcaaacaataaaatctgcgacgagctggaagagactacctatgagatagtgatcgaaacgggaaacggaggcgagacgagggagaacgtttggcttatcctggaagggcgcaagaaccgatcaaaggagtttctaatggagaatagttcaagacaacgcgccttccgaaagggcaccaccgatacattcgaatttgattctatataccttggagacatcgctagcctgtgcgtgggccacttagcacgggaggaccgcttcattccaaaacgggaactcgcttggcacgtgaagacaataacaattaccgagatggagtacgggaacgtgtatttttttaattgcgattgcctcattcccctaaagcggaaacgcaagtattttaaggtgttcgaggtaacaaaaaccacagagtcttttgccagtaaggtgcagtctttagtgcctgtaaaatatgaagtcatcgtgacaactggatacgagcccggggcagggaccgacgcgaatgtgtttgtgaccatttttggggctaacggtgacacaggaaaacgcgaattgaagcagaagatgaggaacttgtttgaacggggctccactgataggttttttctcgagaccctggaactgggagagttgagaaaggtgaggctcgaacacgactcgtcaggctactgttctgggtggctcgtggagaaagtggaggtgaccaatacgagtaccggagtggccaccatcttcaattgcggacgctggctcgacaaaaagaggggcgacgggcttacatggcgcgatctgttccccagtgtgtag

SEQ ID NO: 122691 - DNA, 1374 bp, Artificial Sequence
  Description of Artificial Sequence: Synthetic coding sequence
atgacagtgtggacaggagacgtggtgggaggcggcaccgactccaatatcttcatgacattgtatgggatcaatggatccacagaagaaatgcaactcgataaaaaaaaagccaggttcgaaagagaacagaacgatacttttattatggagattctcgatatagccccattcaccaaaatgcggatcagaattgacggccttggcagtaggccagagtggttcctcgagagaatcttgttgaagaacatgaacacaggggacctgactatgttctactacggcgactggctcagtcaaaggaaggggaagaaaacgcttgtctgcgaaatgtgcgctgttattgacgaggaagaaatgatggaatggacaagttacaccgtggccgtgaaaacttccgatatactaggagcagggactgacgccaatgttttcattatcatttttggagagaatggcgattcgggtacgctggccttgaaacagagcgctaattggaataagttcgaacggaacaataccgacaccttcaacttccctgacatgctgtctctaggccacctttgcaagctacgtgtttggcatgataacaagggcatttttccaggatggcacctcagctatgtcgatgtgaaggacaactccagggatgagaccttccacttccagtgtgactgctggttgtccaagagcgagggggatggccagaccgtccgtgattttgcctgtgccaataacaaaatctgcgacgagcttgaagaaacaacctatgagatcgtcatcgagaccgggaacggaggagagacccgggaaaatgtgtggctgatcctggaaggcaggaagaataggtccaaggagttcctgatggaaaactctagcagacaacgagctttcagaaagggtacaaccgatacctttgagttcgactccatctacctcggcgacatcgcgtctctttgcgtcgggcacctagcccgggaggatcgcttcatccccaagagggagttggcttggcatgtgaagaccatcacaattacagagatggagtatgggaacgtttatttcttcaactgcgactgtttgattcccctgaaaagaaaaaggaagtacttcaaggtcttcgaggtgactaagactaccgaaagttttgccagcaaagtacagtcccttgttccagtcaaatatgaagtaattgtgactaccggctacgaaccaggcgctgggacagatgcaaacgtatttgtgacgatcttcggggccaacggggacacaggcaagagagagctcaagcaaaaaatgcggaacctcttcgaacgcggcagcaccgatcggttcttcctggaaaccttagaactgggcgagctgagaaaatag

SEQ ID NO: 122692 - DNA, 1122 bp, Artificial Sequence
  Description of Artificial Sequence: Synthetic coding sequence
atgctcatcccgttctccatgaagaattgcttccagctgctgtgcaactgtcaagtcccagccgctggatttaagaagaccgtcaaaaatggcctgatcctgcagtcaatatctaacgacgtgtatcagaatctggccgtggaggactggatacacgatcacatgaacctcgagggaaaaccaatcctctttttttggcagaatagccctagcgtcgtcattggcagacaccaaaacccctggcaggagtgcaacttgaacttaatgagggaggaagggataaagctggcacgaaggcgatccggcggcggcaccgtttatcacgacatgggcaacattaacttgacattctttactactaaaaagaagtacgaccgcatggaaaaccttaagcttattgtgcgtgccctgaatgccgtgcagcctcaactagacgtgcaagctacaaaaaggtttgacctcttgctcgacgggcagttcaaaatatctggcactgcctctaaaatagggcggacaacggcttatcatcactgtaccctgctctgctctaccgacggcacattcctatctagtctcttaaaatccccctatcagggaatccgttcaaacgccacagcaagcatcccgtctctggtaaagaacctgctggaaaaggacccaaccctgacctgtgaggtgcttatgaatgcagtcgctaccgagtacgccgcctatcatcaaatcgataatcacatacatctaataaatcctacagacgaaaccctgtttccagggattaactccaaggctaaagaattacagacctgggaatggatctatggcaaaacaccaaagtttagcatcaatactagtttccacgtcctgtacgagcagagccacctggagattaaagtattcattgacataaaaaatggcagaattgagatctgtaatatcgaagcaccggaccactggttgcctcttgagatccgcgacaaactaaacagctcactaattggctccaagttctgcccgaccgagactaccatgttgaccaacatcttactcagaacttgtcctcaggatcataagcttaattccaaatggaacatcctttgcgagaagattaaaggaatcatgtag

SEQ ID NO: 122693 - DNA, 1122 bp, Artificial Sequence
  Description of Artificial Sequence: Synthetic coding sequence
atgctgattcccttcagcatgaaaaattgttttcagctgttgtgcaattgccaagtccctgccgccggatttaagaaaaccgttaagaatggcttgatcttgcaatctatctccaatgacgtgtaccaaaaccttgcggtggaggactggatccatgatcatatgaaccttgaggggaagcccatactcttcttctggcagaacagtccaagcgtggtaattggaaggcaccagaacccctggcaggagtgtaacctgaatttgatgagagaggagggcatcaaattggctagacggcggagtggaggaggtaccgtgtaccacgatatgggtaacatcaatctgacattctttaccactaagaaaaaatacgacagaatggagaaccttaagttaattgtacgcgccctgaatgctgtgcagccacagttggatgtgcaagcaaccaagcggtttgacctgctattggacggccagttcaaaataagcggcactgcatctaagattggacgaacaaccgcataccaccattgtacactgctttgctccacagacggcacattcctgtcttcgctgctgaagtccccgtaccagggcattaggtctaatgcaacggcctccatcccaagcctcgtgaaaaacctactcgaaaaagatccaacgttgacatgtgaagttctgatgaatgccgttgccactgagtatgccgcctaccaccaaatcgataaccatattcatttgatcaatcccactgacgagacactgttccctggcattaatagtaaggcgaaagagctccagacctgggaatggatctacggtaaaacaccaaagttttcaattaatacaagtttccacgtgttgtatgaacaatctcacctggaaattaaggtgttcatcgatattaagaatggtaggattgagatatgtaacatagaagcacctgaccactggctacctcttgagataagagacaagcttaatagcagtttaatcggcagtaagttttgtcctacagaaaccacaatgctcaccaacatcttacttcgcacatgcccccaggaccacaagctgaactccaaatggaatatactttgtgaaaagatcaagggcatcatgtag

SEQ ID NO: 122694 - DNA, 1122 bp, Artificial Sequence
  Description of Artificial Sequence: Synthetic coding sequence
atgcttattcccttttccatgaaaaactgttttcagctcttatgtaactgccaggtcccagcagcagggttcaagaaaactgtgaagaacgggctcattctccaatccatatcaaacgacgtatatcaaaatctggcagttgaggactggatccacgaccacatgaacttagagggcaagcccatattgttcttttggcaaaactctccatccgtggttatagggaggcatcagaatccctggcaggagtgtaatctgaatctgatgcgggaagagggcatcaaactggcacgccgacgcagtggcggtggtactgtttatcacgatatgggcaacatcaatctcactttcttcacaactaagaaaaagtacgaccggatggagaatctcaaactcatagttagagccttaaacgcagtgcagccccagttggacgtgcaggccacaaaacggttcgatcttctgctggacggacagtttaaaatttccggtaccgctagcaaaatcggcaggactacagcctatcatcattgtactctcctttgctcaactgacggcacctttcttagcagcttgctgaagagtccatatcaggggattaggtcaaacgccacagctagtataccctctctcgtgaagaacctcctagaaaaggatccgactctcacctgcgaggtgctgatgaacgccgttgccacagagtacgcagcataccatcagatcgataaccatatccacctcattaaccccacggatgagacactcttccccggcatcaactccaaagcgaaggagctccagacttgggagtggatctacgggaagacccccaagttttctatcaacacatcattccatgtgctctatgagcagtcgcacctggagattaaagtttttattgacattaagaatgggcgcattgaaatatgcaacatcgaagcccccgaccattggctgccactcgagattagagataagctgaattcttcactgattggttccaaattctgtcccacagagactaccatgcttacaaatatcttgttacggacttgccctcaggaccataagctgaactcaaagtggaacattttatgtgagaaaattaaaggcattatgtag

SEQ ID NO: 122695 - DNA, 1122 bp, Artificial Sequence
  Description of Artificial Sequence: Synthetic coding sequence
atgctcattcccttttctatgaaaaactgtttccaattactttgcaattgtcaggttcccgccgctggttttaaaaaaaccgtgaagaatggattgattctgcaatctatatccaatgacgtatatcagaatttggctgtggaggattggattcatgatcacatgaacctagaagggaaaccaatcctcttcttctggcagaactcgccttccgtcgtgattggcagacaccagaacccctggcaagagtgtaacttgaacctgatgagagaggaaggaattaagcttgcaaggcggaggagcggcgggggcacagtttatcatgatatgggaaatattaacttgacattttttaccacgaaaaaaaagtacgaccggatggaaaatctcaaactcatcgtgagagcgcttaatgcagttcagccccagttggatgtgcaggccacaaagaggtttgatctgctcctggacggccaatttaagatctctgggactgccagtaaaatcggaagaaccacagcttaccaccattgcactttgctctgctccaccgatgggacctttctcagtagcctcctcaagagtccatatcaaggcatcaggtccaatgctaccgcctcaattccctctctggtcaagaacttgcttgaaaaggatccgacactcacatgcgaggtcttgatgaatgccgtggccactgagtacgccgcctaccatcagatcgataatcacatacatctgatcaatccaaccgacgagactctctttccaggtataaatagcaaggctaaggaactacagacctgggagtggatctatggcaaaactcctaagttttccattaacacttccttccatgtcctctatgaacagtctcacctggagatcaaggtcttcattgacatcaaaaatggacggatcgaaatctgtaacatagaagcccctgatcactggttgcctctcgaaatcagagataaactgaacagcagcctgatcgggtccaagttttgtccgaccgaaacaactatgctgacgaatatccttctccgcacctgcccccaagaccacaagttgaatagcaagtggaatattctttgtgagaagatcaagggtatcatgtag

SEQ ID NO: 122696 - DNA, 1122 bp, Artificial Sequence
  Description of Artificial Sequence: Synthetic coding sequence
atgctaattccgtttagcatgaagaattgctttcagctgctctgcaattgccaggtgccagccgcaggctttaagaagacagtcaaaaatggtctgattctccagagcattagtaatgatgtctaccaaaacctcgccgtggaagattggatccacgaccacatgaatctcgagggtaagccgatcttattcttttggcagaatagcccaagcgtggtcattggacggcatcagaatccatggcaggagtgtaacctgaatctgatgagggaagagggtatcaagctggcccgccgacgtagcggaggaggtaccgtgtaccacgacatgggtaatattaatctgacatttttcactaccaagaaaaagtacgatcgcatggagaatctgaagctcattgtgcgcgcactgaatgctgtccaaccccaactggacgttcaggccactaaacggttcgatctgcttcttgatggccaatttaaaataagcggcacagcatccaagatcggtaggaccaccgcttatcatcactgtaccttgctgtgttctaccgacggcacattcttgtccagtctcctgaagagcccttaccaaggaatcaggtctaatgctacggccagcattccatctctggtcaagaacttgctcgagaaagatcccacgttgacatgcgaggtgctaatgaatgctgtggccacagaatatgccgcctaccatcaaatcgacaaccacatacatctgatcaatccaacagatgaaaccttatttcccggcattaatagtaaagcgaaagagcttcagacttgggagtggatttacggaaagacacctaagttttcaatcaatacctctttccacgtgctgtacgaacaatctcatctggaaatcaaggtgtttattgatatcaagaatggtagaattgaaatatgcaatatagaggcacctgaccattggctgccactggaaatcagagataagttgaactctagcttgattggctcaaaattttgccccactgagacgaccatgctgaccaatattctgttaaggacctgtccccaggatcataagctgaattctaagtggaacatcttatgcgagaaaataaagggaataatgtag

SEQ ID NO: 122697 - DNA, 321 bp, Artificial Sequence
  Description of Artificial Sequence: Synthetic coding sequence
atgctgatccccttctcaatgaagaactgtttccagctgctatgcaactgccaggtgcccgctgccggattcaaaaaaaccgtgaagaatgggctgattctgcagtctatctccaatgatgtctaccagaatctggcagttgaagattggatccacgatcatatgaacctcgaaggaaaacccattttgtttttctggcagaatagcccctccgttgtcattggacggcaccagaacccatggcaggaatgtaacctgaacttaatgcgggaggaggggattaagctcgccaggcgaaggagcggcggggggaccgtgtag

SEQ ID NO: 122698 - DNA, 756 bp, Artificial Sequence
  Description of Artificial Sequence: Synthetic coding sequence
atgctcattccattctcaatgaagaactgtttccagttactatgcaactgtcaagtgcctgcagcgggcttcaagaaaaccgtgaagaatggcctaattctgcagagcataagcaatgacgtctaccagaatttggcagtcgaagattggatccatgatcacatgaatctcgagggcaagcccatcctgtttttttggcagaacagtccttcagttgtgattggcaggcatcagaacccatggcaggaatgtaatctgaaccttatgagagaagaggggatcaagctggctagaagacggagcggaggcggcactgtgtaccatgacatgggaaatataaacctcaccttctttacaaccaaaaagaagtacgatcgcatggagaacctgaaactgatcgtgcgcgctctgaatgccgtacaaccccagctggatgtgcaggcaacaaagcgtttcgacctgctcttagatgggcagttcaagatctctgggactgcctctaaaattggacgcaccactgcataccaccactgcacactcttgtgtagtactgacggtacatttctgagtagcctcttaaaatccccatatcagggaattaggtccaacgctacggcaagtatacccagcttggtgaagaatctgttagagaaggaccccacactgacctgtgaggttttgatgaacgcagtcgccactgagtatgcagcatatcatcaaatcgacaaccatatccacctcatcaatcccacttag

SEQ ID NO: 122699 - DNA, 120 bp, Artificial Sequence
  Description of Artificial Sequence: Synthetic coding sequence
atgctgattccattttccatgaagaactgctttcaactgttgtgtaactgccaggtcccagccgctggttttaaaaagactgttaagaatggcttgattcttcaatccatcagcaattag

SEQ ID NO: 122700 - DNA, 408 bp, Artificial Sequence
  Description of Artificial Sequence: Synthetic coding sequence
atgctcattcccttttctatgaagaattgcttccagctgctgtgcaattgtcaggttccagctgccggtttcaaaaaaactgtgaaaaacgggctgatactgcagagtatctcaaatgacgtctatcaaaatcttgcggtcgaagattggattcatgaccacatgaatctggaaggcaagcccatcctgttcttttggcagaatagcccctcggtggttatcggaagacaccagaacccctggcaagagtgcaatctaaacctcatgagagaggaaggcattaagctcgcacgcaggagatccggcggcggaaccgtttatcacgacatgggcaacatcaacctcacattttttaccaccaagaagaagtacgatcggatggagaatctgaaactgattgtgagatag

SEQ ID NO: 122701 - DNA, 5301 bp, Artificial Sequence
  Description of Artificial Sequence: Synthetic coding sequence
atgggcggaaagaataaacagagaacaaaaggaaacctcagaccaagcaattccggcagagcggccgagttgctggcgaaggaacagggcaccgttccaggattcatcggcttcgggacatcccagtctgatctcggctatgtgccggctatccagggagctgaggagatcgactccttggtggacagtgattttagaatggtgctgcgcaaactcagtaagaaggacgtcaccacaaagctgaaggctatgcaggagttcggaaccatgtgtaccgagagggatactgagacagtcaagggggtgttaccctactggcctagaatattttgtaaaatttcgctggaccatgacaggcgggtgagagaggccacacagcaggcctttgagaagctgatccttaaagtgaaaaaacaattagcgccatacttgaagtcactgatgggctattggctgatggcccagtgcgacacttacacaccagcagccttcgcagcgaaggacgctttcgaggctgctttccctccttccaagcagcccgaggctatcgccttctgtaaagacgaaatcacatctgtactgcaagatcatctgatcaaagaaacaccagataccctgtccgatccccagacagtgccagaagaagagcgggaggcaaaattctacagggtggtgacctgctccttgctcgccttgaaaaggctgctgtgcctcctgccagacaacgaactcgactcattagaggagaagtttaaatctctgctgtcccagaacaagttctggaagtacggcaagcattccgtgccgcaaatcagaagcgcatacttcgagctggtgtcggcgctctgtcagaggatcccgcagttgatgaaggaagaagcgagtaaggtctcaccatcagttctgctgtccattgacgattcagatcctatcgtctgccctgccctgtgggaagccgttctctatactttgaccaccattgaagattgctggttgcatgtgaacgccaagaagagtgtgtttcccaagctgagtacggtaattagagaggggggacgcgggctcgctacggtgatatatccatatttgctgccctttatttctaagttgccccagtccattactaacccaaagctagatttctttaaaaatttcctgactagcctggtggctgggctctccacggagagaaccaagacatctagccttgaaagtagtgcagtgattagcgcgttttttgaatgcctgcgattcattatgcagcagaacttaggagaggaagagatcgagcagatgttggtcaatgaccaactcattccttttatcgacgccgttctgaaggaccctggactacagcacggacagctgtttaatcatttagcagaaaccctgtcatcgtgggaagccaaagccgatactgagaaggacgagaagacagcccataatctggagaatgtgctgatccatttttgggaacgactatccgaaatatgtgtggcaaagatctccgaaccagaggcagacgtcgagtcagtcctgggagtgtcgaacttgctccaggtcctacagaagcctaagagctcccttaagagctccaagaagaagaatggcaaggtcaggtttgctgacgagattcttgaaagcaacaaggagaatgaaaagtgcgtgtcctctgagggcgaaaagattgaggggtgggaactgaccactgaaccaagtctaacccataattccagtggacttttgagccccctgaggaaaaaaccgcttgaggatctagtctgcaagctggccgacatcagcatcaattacgtaaatgaacgcaagtcagaacagcaccttcgctttctctcaaccctgctggacagcttttcctcatcccgagtgttcaaaatgctgcttggtgacgaaaaacagtcgatagtccaggccaagccccttgaaattgcaaaactggttcagaaaaacccagctgttcaatttctttaccagaagcttattggatggctgaatgaggatcagcgtaaggacttcggattcctcgtggatatcctttactccgctctccggtgttgcgacaatgatatggagcgaaagaaggtcctcgacgacctcactaaggtggacctcaaatggaactctctgctgaagattatcgaaaaagcctgcccgtctagtgataagcatgcactcgtgactccctggctgaaaggtgacattctaggcgagaaactggtcaatttggctgactgtctgtgcaatgaggaccttgagtcacgggtttcatctgagtctcatttctccgagaggtggactttactttcgctggtgttgtcgcaacatgtcaagaatgattatctgataggtgacgtttatgtggagaggataattgtgaggctgcacgaaacgctgttcaaaaccaagaaattatctgaggctgagtcgtccgattcctcagtgtccttcatctgtgacgtggcatacaactattttagttctgccaaaggctgtctgttgatgccatctagcgaggacctgcttcttacgctcttccaattatgtgcccaaagtaaggagaaaacccatcttcccgatttcctcatctgtaagctcaaaaacacatggctgagtggggtcaatctgctcgttcatcagacggactccagttataaggagtccaccttccttcatctttcggccctctggctgaaaaatcaggttcaggcaagcagcttggatataaatagcttacaggtgctgctaagtgctgttgacgatctgcttaatacccttttggaaagcgaggattcttatctcatgggagtgtacattggtagcgtcatgccgaatgactctgaatgggagaaaatgcgccagtcacttccaatgcagtggctgcatagacctcttctggagggccgactgagcctcaactacgaatgtttcaagaccgattttaaagagcaggacataaaaactctgcccagccacttgtgcacaagtgcgctgctttcaaagatggtcctgatcgcattaagaaaagagaccgtcctggagaacaacgagcttgaaaaaatcatcgccgagctactatactccctgcagtggtgcgaggagcttgacaatcccccgatctttctgataggattttgcgagatacttcaaaaaatgaacatcacatatgataacctaagagtgctgggcaacaccagcggactgctccagctgctgttcaacagaagcagagaacatggaacactgtggtcgcttattatcgcaaagcttatcctgtctcgttcaatatcatccgacgaggtaaagcctcactacaaacgaaaagagtccttttttcccctgaccgagggaaaccttcacaccattcagtccctgtgtcccttcctcagtaaggaagagaagaaggagttttctgcccaatgcattcctgcactcctcgggtggacaaagaaggacctgtgttccactaacggtggctttggccacttagcaattttcaactcatgccttcagacaaaatcaatcgacgatggtgagctgctgcacggaatcctgaagattattatcagttggaagaaggagcacgaggacatattcttgttctcctgtaatttgtccgaagcatcaccagaggtgctgggtgtgaacatcgaaatcatccggtttctgtcactgtttctgaaatattgctcatccccactggctgagtccgaatgggatttcatcatgtgttcaatgttggcctggttagagactaccagcgagaaccaagctctttactccattcccctggtgcagctgttcgcctgcgtgtcctgcgatctggcctgtgacttgtccgctttttttgatagtacgacgctagataccattggaaacctacctgtgaatctcatttcagaatggaaggagtttttttcacagggcatccattcgcttctgctgccaatactggtgacagtgactggagagaacaaggatgtttctgaaacttccttccagaacgccatgctcaaacctatgtgtgaaactctcacctacatctccaaagaacaactcctttcacacaagctccctgctcggctcgttgccgatcagaagaccaatctgccggaatacttacagacactgctcaacactcttgcccctcttcttctgtttcgtgcacgccctgtgcagatcgccgtgtaccacatgctgtacaagctgatgcccgaactgccccaatacgatcaggataatctgaagtcatacggcgatgaggaggaggaaccggccctctcacctccagctgcccttatgagtctgctctccattcaggaagaccttctcgagaatgtcttaggttgcatacctgtcggccaaatcgtgaccattaagcctctgtcggaagacttctgctacgtgcttggatatctcctaacttggaaactgatccttacattctttaaagctgctagctctcagttgagggcattgtactccatgtatctgaggaagaccaagtccctcaacaaactgctgtatcacctcttccgattgatgcctgaaaaccctacgtacgccgagacagccgtcgaggtaccgaacaaggaccctaaaacatttttcacagaggaattgcagttgtctattagggagactaccatgctaccttatcatattcctcacctggcctgctccgtatatcatatgaccttgaaagatcttcccgcgatggttagattgtggtggaattcttcagagaagagagtcttcaacattgtcgacagattcacctcgaaatatgtgagcagtgtcctgtccttccaggagattagtagtgtgcagacctccacccagctgtttaatggaatgactgtgaaagctcgcgcaaccacccgcgaggtgatggccacctacactatagaggatattgtgatagagctcattatccaattaccatccaactacccgctgggaagcatcatcgtggagtcagggaagagagttggtgtggcagtgcagcagtggaggaactggatgttgcaactgtcaacatacctgacccaccaaaatggatccatcatggagggtctggctctttggaagaacaacgtagataaaagatttgagggcgtagaagattgtatgatttgcttcagcgtgatccacggctttaattacagcctacccaaaaaggcctgtaggacatgtaaaaagaaattccattctgcttgtctatataaatggtttactagttccaacaaatcgacatgccctctgtgcagagaaacttttttttag

SEQ ID NO: 122702 - DNA, 1443 bp, Artificial Sequence
  Description of Artificial Sequence: Synthetic coding sequence
atgggaggtaagaacaagcagcgtactaaaggaaatttgcggcctagtaattccggtagggcagctgagttgctggctaaggaacaggggaccgtgcctggtttcatcggatttggcacctcacagtcagacctggggtacgtacctgccattcaaggagccgaggaaatcgattccctggttgactctgacttccgcatggtactacgcaagctttctaagaaggacgtgacaacgaaactgaaggcaaatgctatgcaggagtttgggaccatgtgcaccgaacgggacacagaaactgtcaaaggcgtgctgccctattggccccggatattttgcaaaatcagccttgatcacgatagaagagtgcgggaggccacccagcaggcattcgagaagctgatccttaaagtcaagaagcaactggctccatacttgaaatccctgatgggatactggctgatggcgcagtgcgatacctacacgcctgctgccttcgcagctaaggatgctttcgaggcagcttttcccccttcaaaacagcccgaggcaatcgctttctgcaaagatgaaatcacgagcgtgttgcaagaccacctgattaaagaaacgcctgataccctttcagacccgcagactgtgcccgaagaggagcgtgaggccaaattctacagagtggtcacctgtagtttgctagccctcaagaggctgctgtgtttgttaccagataatgagttagatagtctcgaggaaaagttcaaatcactattatcgcagaataagttttggaaatatggaaagcattccgtgccgcagatcaggtccgcatattttgagcttgtctctgccctgtgccaacgaatcccccagctgatgaaggaggaagcgtccaaagtgagtccaagtgtcctcctcagtatagacgacagcgatccaatagtctgtcctgccctgtgggaagccgttctctatactctgacgaccatcgaagactgctggcttcacgttaacgctaaaaaatctgtctttcctaaactctcaacggtgattagggagggcggaaggggcttggccacggtgatatatccctacctgctgcctttcatctcgaagctgccccagagcatcacaaaccctaagctggatttttttaagaattttctgacctcgttggtagccgggctgagtaccgaaaggactaaaacatcctctctggagtccagcgcagttattagcgccttctttgaatgtcttagattcattatgcagcagaacctgggcgaagaagaaattgagcagatgttagtgaatgaccagttgatcccatttattgacgcggtgctgaaggatcccggcctgcagcacgggcaactgtttaatcacttggcagagacactttcgtcttgggaggcaaaagcagataccgaaaaggatgagaaatag

SEQ ID NO: 122703 - DNA, 5439 bp, Artificial Sequence
  Description of Artificial Sequence: Synthetic coding sequence
atggaccgcgtaggaggtgggaaaggtccgggtggatcctattatcgagtatcatctagcgccgcgagaagtcgtaaattatgtcctggccgagtaaaccgaggtctgtccgcccagtccaccgccgccactgctaccatgggcggaaagaataaacagcggacaaaaggcaacctcagaccttccaactctggcagagccgcagagctgctggcaaaggagcagggcaccgttcccggatttataggatttgggacttcccaaagtgatctgggttatgtgccagcgattcagggcgctgaggagatcgacagtctggtggacagcgacttccggatggtgctgcgcaagctcagcaagaaggacgtgaccacgaagctgaaggcaatgcaggaatttggcacgatgtgcacagaaagggacactgagactgtaaaaggtgtgctgccctattggccccggatattctgtaagatctctctggaccacgacaggcgagtcagagaagcaacccagcaggcattcgaaaagctcatactcaaagttaaaaagcaactagcgccttacctcaaatcattaatgggatactggctcatggcccagtgtgatacttacacacccgccgcctttgcagcgaaggacgcctttgaggccgcattccctcctagcaagcagccagaagcgatcgcattttgtaaagatgagatcacctcggtgctccaggaccatctgattaaggaaactcccgatacgctcagcgacccccagaccgtgcctgaagaggagagggaggcgaagttttaccgcgtagtgacctgtagcttattagccctgaaacgattactttgcctattgcctgataatgagctcgactccctggaagaaaaattcaagagtctgttgtcccagaacaagttctggaaatatggaaagcattccgtaccccagatcagatctgcatattttgagctcgtttccgcattgtgtcagcgcatcccacaattaatgaaggaagaggctagtaaagtgagtccctccgtgctcctgtcaatagacgattcagacccgatagtgtgtccagccttgtgggaggcggtcttgtatactttgacaactatcgaagattgctggctgcacgtgaatgccaagaaaagtgtctttcccaaactcagcaccgtgattcgagagggtggaagaggcctcgcaactgttatctacccctacttgctgcctttcatctctaaacttccacagtccatcacaaacccaaagctggatttctttaagaatttcctcactagccttgtggcaggattgtccacggagcgcaccaagacgtcatcgctcgaatcaagcgctgtgatctctgccttcttcgagtgcctccggtttattatgcagcaaaacttgggcgaagaggaaatagaacaaatgctagtgaatgatcaactgatcccatttattgacgcagtgctgaaggacccaggacttcagcatgggcagctgttcaaccacctggctgagacactttcaagctgggaagctaaagctgacactgaaaaggacgagaaaaccgctcacaaccttgaaaatgtccttatacacttttgggagagacttagcgaaatttgtgtggcaaaaatttcagagcctgaggccgacgttgagagcgtgctgggcgtgagtaacctgctgcaagtgctccagaagcctaaaagctctctgaagtctagcaagaagaaaaatggaaaggtgcgattcgcagacgagattttggaatccaacaaggagaacgagaaatgcgtaagctctgaaggggagaagattgagggatgggaattgacgacggagccttccctaactcataactcatccgggttgctgtctcctttgcgtaagaaaccactggaagatctggtttgtaagctggcggacatctccattaattatgttaacgagagaaaatccgagcagcatttacggttcttaagcactctgctcgactcttttagctccagccgcgtgttcaaaatgctcctgggcgacgagaagcagtcaatcgtgcaggctaagcctctggagatcgccaagctggtccagaagaatcctgccgtccagtttttgtatcagaagctgatcggctggctcaacgaggaccaaagaaaagattttgggtttcttgtggacatcctttatagcgcactgcgctgctgcgataacgatatggaacgcaagaaggtgctggacgaccttactaaggtggatttgaaatggaactcattgttaaaaatcatcgagaaggcctgcccttcctcagacaaacacgcactagtcactccatggttaaaaggagatattctgggtgagaaattggtgaacctggcagattgcctgtgcaacgaggatctggagagccgcgtcagctcggagagtcacttctcggagcggtggacactcctcagtctagttctctcccaacatgtgaagaatgactatttgattggtgatgtgtatgtcgagcggattatagttagactgcatgagaccttgtttaagacaaaaaagctgtccgaggccgaaagctccgatagtagcgtcagcttcatttgcgatgtggcctataactacttcagcagcgcaaaggggtgtctgctgatgccaagtagtgaggacctgctgctcactctgtttcagctctgtgcgcagagtaaggaaaagacccacctgccagattttttgatctgcaaactcaaaaacacatggctcagcggcgtgaacctgctcgtccaccaaacagacagcagttataaggagagtacttttttgcatctgtctgccctatggcttaaaaatcaggtccaagccagttcactggatatcaattcattacaggtcctacttagcgcagtagacgatcttttaaacaccctgctcgagtctgaggactcatatctgatgggggtctacatcggctctgtcatgcccaacgacagtgagtgggaaaaaatgcggcagtcccttccaatgcagtggctgcatcgcccactcctggagggccggctcagcctcaattatgaatgttttaagaccgactttaaggaacaggacatcaagaccctgcccagccatctgtgcacttcggccctgttgagcaagatggtcctgatcgctctgcgcaaagagacagtcctcgaaaacaacgagctggagaaaatcatagcagaactgttgtactccctgcagtggtgtgaagagttagacaatcccccaatatttctgataggtttctgtgagatcctgcagaaaatgaacattacctacgataacttaagggtgttgggaaacaccagcgggttgttgcaactgctgtttaatcgaagccgtgaacatggtacattgtggtccttgatcatcgcgaaacttatcttatccagaagtatttccagcgatgaggtgaaaccacactataagcgaaaagaatctttttttccactaaccgaaggcaacttgcatacgatacaatcactgtgccctttccttagcaaggaggaaaaaaaggaattctctgcccagtgcatacccgccctcctaggttggacaaagaaggatttgtgtagcacaaatggtgggttcggacatctcgctatcttcaacagctgtctgcaaacaaaaagtatcgatgatggagagctgttacatggtattttaaaaataataatttcctggaagaaagaacacgaagatattttcttattctcctgcaatctcagtgaggcgagtccagaggtccttggtgtcaatattgagatcatccgcttcctctcgctctttctgaagtactgctcatcacctctggccgagtctgagtgggatttcatcatgtgcagtatgcttgcttggcttgagaccacctctgaaaatcaagctctctacagtatccccttagtacaattatttgcctgtgtttcatgcgatctggcctgtgacctcagcgccttttttgacagtacgactctcgatacgataggtaaccttcccgtgaacctgatcagtgaatggaaggagtttttctcacaagggatccattcattgttgctccctatcctcgtcactgtcaccggggagaacaaggacgtttccgaaacaagctttcagaatgcaatgctgaagcctatgtgtgaaactctcacgtatattagcaaggagcagctgctatcacacaagctgccggctcgactggtggctgaccagaagactaacttgcccgaatatcttcagacactccttaacactctggccccactgctccttttccgcgctcgcccagtacagatcgctgtataccacatgctctacaaattgatgccagaattgccccaatacgaccaggacaacctaaagagctacggtgatgaggaagaggaaccggcgctgagtcctcccgctgctcttatgtcactgttgagtatccaggaggacctgctggaaaacgtcttaggctgcataccagtgggtcaaatcgtgactatcaagcctctgagcgaggatttctgctacgtgttggggtacctgctgacctggaaacttatacttacattcttcaaggcggccagttcccagctccgggcactctacagcatgtacctacggaagacaaaaagtctgaataaactgctctatcacctctttaggttaatgccggaaaatccaacctacgcagagaccgccgtggaggtgccaaacaaggaccccaagacatttttcaccgaggagttgcagttatccatccgggaaacaaccatgctgccttatcatatccctcacctggcctgcagcgtgtatcatatgacacttaaagacctcccagccatggtgagactgtggtggaattcttccgaaaagcgggtgttcaatattgtggatcgtttcacctctaagtacgtgagcagcgtgctatcctttcaagagataagttctgtgcagactagcacgcagttgttcaacggcatgacagtgaaagcacgagctacaacacgcgaggtcatggcaacatacacgatcgaggatatcgtgattgaactaattatccagctgccctcaaattaccctctggggtctatcatcgtcgagagtggcaaacgagtaggggtagccgttcagcagtggcgcaactggatgctacagctgtccacatacctgacacaccagaatgggtccataatggagggcctggccctgtggaagaacaacgtcgacaagaggttcgagggcgtggaagactgcatgatatgtttttccgtgattcacggcttcaattattccttacctaaaaaggcctgtagaacatgcaaaaaaaagtttcatagtgcctgcttatacaagtggttcacaagttccaacaagtccacctgtcccctgtgtcgcgagactttcttctag

SEQ ID NO: 122704 - DNA, 1404 bp, Artificial Sequence
  Description of Artificial Sequence: Synthetic coding sequence
atgaaaaatcaaaatggaaccttcaaagactgggcgaatgccaacgtgtcccgccagattgaggatactgtcctatatggatattataccctctactctgtgatcctgttctgcgtgtttttctggattccatttgtgtatttctactacgaggaaaaggacgacgacgacacatccaaatgcactcaaataaaaaccgctcttaaatacactctagggtttgtagtgatatgtgccctgctgctgctcgtaggcgcatttgtgccattgaacgtgcctaataacaagaattccaccgaatgggagaaggtgaagagcctgttcgaagaactaggatccagccacggcttggccgcgctatccttctcaatttcttctcttaccctgattggaatgctggccgcgatcacctatacagcttacggtatgtctgcgctaccactgaatctgatcaaaggtacgcggtctgcagcatacgagcgactggaaaatacggaggacatagaagaagtggagcagcacattcagacgattaagtccaaaagtaaagacggacgcccgctccccgccagagacaagagagcccttaagcagttcgaagaacggctgcgcacgcttaaaaagcgcgaaagacacctggagtttattgaaaacagctggtggaccaaattttgtggggcactaaggcctcttaagatcgtgtgggggatcttcttcattctggttgccctcctgtttgttatcagcctctttctgtccaaccttgacaaagccctccactctgcaggaatcgatagcggcttcattattttcggtgccaatctttccaatccattaaacatgctccttccgctcctgcaaactgtgttcccactggactatattctgattacaatcatcattatgtatttcatattcacttccatggccggaataagaaacataggaatttggttcttctggatacgactttataagattcgaagagggcgaaccaggcctcaggcccttttatttctatgcatgatactgcttctgatcgttctgcacacatcctacatgatctattctcttgccccccagtacgtaatgtacgggtcacagaactatctcatcgaaaccaatattacgtcagacaaccataaggggaactccacgcttagcgtcccgaaaagatgtgacgcggatgctcccgaagatcagtgtacggttacaaggacttacctgtttctgcacaaattctggtttttcagcgccgcatactacttcgggaattgggctttcctgggggttttcctcataggccttattgtgtcttgttgtaaggggaaaaagtcagtaattgaaggggtggacgaggattcagatattagtgacgacgagccttctgtttattctgcttag

SEQ ID NO: 122705 - DNA, 1623 bp, Artificial Sequence
  Description of Artificial Sequence: Synthetic coding sequence
atggctacaagcggagcagccagtgctgaactcgtgatcggctggtgcatcttcggcctgctgctcttggcgatacttgctttctgttggatttatgttaggaaataccagagtcggagagaaagcgaggtcgtgtccacaattaccgcaatcttttcgttggccatcgctcttattacatccgccttgctgcctgtggacattttcctggtgtcttatatgaagaatcagaacggtacgttcaaggattgggcaaatgccaacgtgtcacgacagatcgaggacactgttttgtacggctactacaccctctacagcgttattttgttttgcgtgttcttctggatcccatttgtttacttctattacgaagagaaagatgacgacgacactagcaaatgcacgcaaatcaagaccgcactcaaatacaccctggggttcgtagttatctgcgccctgttattactggtaggagcctttgtcccccttaatgtgcccaataataagaattctaccgaatgggaaaaagtgaagagtctttttgaggagttgggcagttcccacgggctcgccgccctctccttttcaatttcatcattaactttgattggaatgctggccgctatcacttatacagcttacggaatgagcgctttaccactcaacctgatcaagggcacccgaagtgcagcctatgaaaggctcgaaaataccgaggatatagaggaagtagagcaacacattcagacaatcaagtccaagagtaaagacggccgccctttgcctgcccgcgacaaacgggccctgaagcagttcgaagaacggctaaggaccttgaaaaagcgcgaaagacacctggagttcattgagaattcttggtggacaaagttctgtggagccttgcggccgttgaaaatcgtttggggtatcttttttatcctggtggccctgctcttcgttattagtctcttcctgtccaatttggataaggcactgcactccgccgggatcgattctggattcattattttcggcgccaatctcagcaacccattaaatatgttgctgccactcctacaaaccgttttccccctcgattacatactcatcaccattataatcatgtatttcatcttcacatcaatggcaggtattcgcaacatagggatctggttcttctggatacgcttgtacaaaatacgacgagggagaaccaggccccaagccctgctcttcctgtgcatgatcctgctcctaatcgtcctccacacttcttacatgatttactctctggccccacagtacgtcatgtatggcagccagaactatctgatagagaccaacatcacctcggacaaccacaaaggtaactcaaccttgagcgtgcccaaacggtgtgacgccgacgccccagaagaccagtgcacagtgacacggacgtacttgttcctacacaagttttggttcttctcggctgcttattattttggtaattgggcttttctgggagtgtttttgatcggtttgattgtctcttgttgtaaaggaaagaaaagtgtcattgaaggagtggacgaagatagtgatatctctgacgatgaaccctcagtttactccgcgtag

SEQ ID NO: 122706 - DNA, 939 bp, Artificial Sequence
  Description of Artificial Sequence: Synthetic coding sequence
atgtcatatcaaaaaaaacagcctaccccccagccacctgtggattgcgttaaaacctctggaggggggggtgggggcggtgggtccggggggggcggctgtggatttttcggcgggggtgggtcagggggcggtagctcaggcagcggttgcgggtatagcggcggggggggctacagcggcggagggtgcggagggggcagtagcggcggcggcgggggaggcgggatcggtggctgcggagggggcagtggtggcagtgtgaagtactctggggggggcggatcaagtggcggcggctccggatgtttttcctcggggggtggaggatccggctgcttctcaagcgggggaggtgggtccagcggtggaggcagtggatgtttcagcagtggtgggggcggttcctccggaggcggcagcggttgcttcagctcaggaggcggcggtttttccgggcaggcagtgcagtgccagtcctacgggggcgtgtcttccggcggcagtagcgggggcggctctggatgttttagctctggaggaggcgggggctccgtgtgcgggtactcaggaggagggtcagggtgcggagggggatcctcgggcggcagcggctccgggtatgtgtcctcacagcaggtgacacagacatcatgcgcgccgcagccaagctatgggggcggttcgtccggggggggaggctctggtggctccgggtgcttcagcagtggcggcggcggggggtcatccggatgtggcggaggaagcagcggcatcggcagtggctgcataatctccggcggcggtagtgtctgcggcgggggatcttccgggggagggggggggggctcaagtgtaggcggcagtggctccggcaaaggcgtgcccatctgccaccagactcagcagaaacaggcccctacttggccaagcaagtag

SEQ ID NO: 122707 - DNA, 1002 bp, Artificial Sequence
  Description of Artificial Sequence: Synthetic coding sequence
atgtcttaccaaaaaaaacagccgactccacaacctcccgtagattgcgtaaaaaccagcgggggcggaggggggggaggaggctcgggagggggcgggtgcggctttttcggggggggtggctccggagggggttccagtggaagtggttgcggctattcaggcggggggggatactccgggggaggctgtggaggaggcagcagcggcgggggcggaggcggcggcattggaggttgtgggggaggctccggtggcagcgtgaaatattcagggggaggaggtagcagcggcgggggcagtggttgttttagcagcggaggcggagggagcggctgcttttctagcggtgggggcgggagcagcgggggagggagtggatgtttttcctctggcggaggcgggtcctccgggggcggcagtgggtgcttctcgagtggcggaggcggttttagtggtcaagccgtgcagtgtcagagttacgggggggtgagtagtggtgggagcagcggcggtggcagtggatgtttctcctcaggaggtggtggagggtctgtgtgcggatactccgggggcgggagtggttgcggtggaggctcttctgggggcagcggctctgggtatgtctcatctcagcaggtgactcagacatcatgtgctcctcaaccatcttacggcggtggggtgcggcggagaagacagcgcaggaagcgcctgttgctgcaaaggcgtgggcgccgcgagctgagactgagaagacgccttcttcgcgattggcaaagactccaccatcagtggcgcggtctacgcttaaggagatggtttctgtggcggaggcggcgcagattgctgcgcgggtggctgcgtgagtggcaaggtcgcccagatttgcctccagatcccgccgaagcgggtgcctacctggcagttcagattgatcctcctggatatcacggaggtgagggcgtgggtggtgtcttccagggacacaggtgggcatag

SEQ ID NO: 122708 - DNA, 927 bp, Artificial Sequence
  Description of Artificial Sequence: Synthetic coding sequence
atggacgcccttaaaagcgcaggtcgagcgcttatcaggagcccatcattggccaaacagtcatggggcgggggcggccgacataggaagctcccagagaactggacagatactagggaaaccctgttggagggaatgctcttttcacttaaatacctggggatgaccttggtcgaacagcctaagggtgaggagctgtccgctgctgcaataaaaaggattgtggcgaccgccaaagccagcgggaagaagctccaaaaggttaccctaaaagtttccccacgggggatcatactgaccgataatctgacaaaccaactcatcgaaaatgtatcaatataccggatatcatactgtactgctgataagatgcatgacaaagtgttcgcttacatcgcccaaagccagcataatcagagcctcgaatgtcatgctttcctgtgcaccaagagaaagatggcacaggccgtcaccctgactgtggcacaggccttcaaggtcgcctttgagttctggcaggtgtccaaggaggagaaagagaaacgggataaggccagtcaggaaggtggcgacgtgctaggagcccgacaggactgtactccttcgctgaaaagcctcgtcgctactggcaaccttttagatttagaagaaacagctaaggcaccactctccactgtgtctgccaacacgaccaacatggacgaagtacctagaccacaggccttaagcggttcctcagtggtctgggaactagatgatggactggatgaagcattctctcggttggctcagagtcgcaccaacccccaagtgttggacacaggcctgactgcgcaggacatgcactacgcccagtgcctgtcgcccgttgactgggataaacctgactcttccgggacagagcaggacgacctcttctcgttttag

SEQ ID NO: 122709 - DNA, 810 bp, Artificial Sequence
  Description of Artificial Sequence: Synthetic coding sequence
atgtctagcgaccacctcaataacagtacgctaaaagaggcacagtttaaggacctgttcctgaagaaggctgagctcgagtttgcacaaataataatcatcgttgtagtcgtcacagtgatggtcgtagtcatagtttgcttactcaaccattataaagtaagtacgcggtcgttcatcaacaggcctaaccagtctcgccggagggaggacgggctgccccaggagggatgcctttggccatccgattccgccgcaccacggcttggagcttcggaaatcatgcatgcacctcgatccagggacaggttcaccgcaccatcattcatccagagagaccggttctctagatttcagccaacctatccatacgtacagcatgagattgatctgccacccaccatctccctctcagatggcgaggagccccccccttaccaagggccgtgcacattgcagctgcgtgatccggaacaacagatggagctgaatcgggagtccgtgcgtgccccacctaacaggaccatctttgactccgatttaattgacatcgccatgtactccggaggtccttgtcctccgagtagcaactccggtataagcgcttcaacctgtagctccaacggcagaatggaggggcctccacccacatattctgaagtcatggggcaccaccctggagcatcttttctgcatcaccaaagatctaatgcgcaccgaggttccaggctgcagttccaacagaacaacgccgaaagcacgattgtgccaattaaaggcaaggaccgtaagcccggaaatctagtgtag
